United States Patent 11,001,841 (CCCTC-BINDING FACTOR (CTCF) RNA INTERACTOME) - sequence listing, part 42

SEQ ID NO: 100091 - DNA, 1456 bp, Homo sapiens
actgagactttctcaaaagttcccctagagactaactactagcattttattcaatttctggagtgagttctggatgcttacatcacatccctttgtactgtttgaaatccttcccacagaagacacctcacacacgcacaacagtgccacacttaagccaacaccacaggaaaaatctccttctaaaactccttgaccaaatatcttgctttacctacatggctgacttttgagtacggcagtcttgggcttatggcacttccctggaggcctgttaatcacaatcactagcaggacacagtggctcacacctgtaatcacagcactttaggaggccaaggcaggaggcttgctggagcccaagagttcaaggatgcagtgagttatgattgcaccactgcactctagcctgggggaaagagtgagaccctgtctcaaaaaacaaaacccacactaaaagcattgctacaaagtaaagaaacaagcaattcaggatgaatgacaagcagccagcactattttctagacaattccaaaatattttgattaaagcataatcttgtctcacaaacacctggcatgtggatcaacattaaaatgttccccaccctagactgcacttaaacctagtggcatagcctactacacacctaggctgtatggtagagcctattactcctagaccacaaacctggacagcacgttactatactgaatactgtcggcaactgtaacacaatggtatttgtgtatctaattacagtagaaaatacattataattgtatgggaccaccatagtatatgcagtctttgacatgtaataatgcacagctgtgtatcaaaatgctaaccatgtgatggcatgtggtaggacaatgtataatttcccttttctctattttctaaattttaaatgtgaatttataattttgtataatatttattacacttatagtgtaataaacattgaaaacgttcccaacttttacaccaactttcttattcaccagagggagttgtgacttttttttttttttttgagacaaggtcttgctctgtcatccaggctggagtacagtggcacgatctcagctcacctcctgggctcaagtgatcctcccacctcagcatccaaagtagctgggactactgacgtgcaccaccacacccggctaattttgtttatttttagtagatgagatcccactatgttgcccacgctgattgtcaaactcctggcctcaaactatcctcttgcctcggcctcccaaaatgctgggattacaggagtgagccaccacactcagccaaccttaactcttaattattggaaatacccaaacctcaatgccttaccccatatggaaggcaaaatcctgtattcccaattcacacatgaaaattacacgagaggtaagtcaaaaatgcttcctttattacataaagccaatactg

SEQ ID NO: 100092 - DNA, 1334 bp, Homo sapiens
tgattacaggtgtgagccactgtgtcctgctagtgattgtgattaacaggcctccagggaagtgccataagcccaagactgccgtactcaaaagtcagccatgtaggtaaagcaagatatttggtcaaggagttttagaaggagatttttcctgtggtgttggcttaagtgtggcactgttgtgcgtgtgtgaggtgtcttctgtgggaaggatttcaaacagtacaaagggatgtgatgtaagcatccagaactcactccagaaattgaataaaatgctagtagttagtctctaggggaacttttgagaaagtctcagtggattcctgaggcccaagaattgtgctaacaagcactcaaggcgattctggtacataattagggttcagacctcagctgattggtctactgttggtcaggaacaaaactgcaagtatactctgtttccagaaaatacgtttacctcttcacaaatgctaacacactgcaaaaatatgtttgtggaaagctgacttagtctcatctagcggttactctcttgccctgacaaagcagcaaataaagccattgctaacaattcaatcagagcttgactgtgaagttatctcagataatattactctgcaaaaacagtggacacagtgacttggataataggtttggtttggtggtttcctttctgcagagtaccggctgccgcaggcacagcaagtgcaacttgtttcttgactataattgcccttcggaccaccagagactgaatatgcccaacacgcatcacttcttcgtgatttggggcatttctgaaattgagaacgggctctagactgggttccagctggactgcagctggaagggacagtaatggcattatggctggtgaggggagtattccaggagccagggtttcagtggaaggcaggcttgagtaccgttttgttactgagggctctctgggttctgcacagtcccaaaagggcactggggaagggacttatggagcctctggccagtaccctcagtaaccagcccagaggtgaattaacttgcctaaggttaatcgactcacaagtggcagaactgggacaaaaactcagatctcttggtttctgttcctgagctatttccaccacctcaggagaattcacttcattcctcttattataattggatcatctttccacatttctaacatctgaaattcaaaggttagaccttgttcagtgctggggtgagatttgaaagggccaagaaggaaagcatttcttttgcactctgagctctcatcagacccagccctgaaggaagtgtagtgatggcatctgtggagggcg

SEQ ID NO: 100093 - DNA, 1034 bp, Homo sapiens
tgatttggggtctgcacctacagggctcaggagcagctctgggcagggtctgcagccatcgaaggggactgtctcccactgcaaccccggctgggacatcgctagcaggatattcgctctccagagttttgagcccggcaatagccaccaagagtcctcaccaagaggcagggcctgtccctggggtggccatggtgtggctgttaagggggttgtcatggggccagggctcggaggcatcgttcttgtcctgtgagtctcgttaaaggcccctgaggttgcagaggccccatcagctgctcctgagccacaccgaagtctgtaccaggggctgaggtgccctctccccaacgaggggagcgttggggcagggaaaggggaagctagaagcagctagagagcggtgcctgtgctggatccctgggcccctggagggttcctcaccgggctgccgggttatgtttgcggtgtttgcacagctgaagacgcagctggagtggacagaagccatcctggaggatgagcagacacagcggcagaagctcacggccgagtttgaggaggtcaggccctgcctggtggctctcagcccccatcagcccctgggccctgagtctccagggaatgagtgggtcagccctgccccgctcggctgtgcccagcagcacctgggctgggcctgggccttctgggcagcagtgggtggggcccgggcaggtggagcacaggctggaggcaccttgggagccctgtgggtggtctgcatccctgaggagccttgagggcctggggctgggtcagaacttgtgggtctggcccactcattccagctacaggatggagctgttgctccatcaggctgggggggccccctggtccccaggcgtgctcggtagggtcttgacagcacagccgtttataagacgtctcacccagacctcacttccctctccggcaaggctcagacctcggcatgtcggttacaagaagaattggagaagctccgcacagccggccccctagagtcttcagaa

SEQ ID NO: 100094 - DNA, 1062 bp, Homo sapiens
tggcctcgagcaatccacctcagcctttcaaagtgctgggattacaggcatgagccgctgtgcctggcccaaaagtttgagattaaaccagaattgggatactgggcttgtgcttctgcttctgaagagcagaaaaagtgtcagatctaaatccactccccaccagatatgacatcagcaagccaggcagagaatccccttgcggagggataacctagaacgtcaaacgcctccctcggggcagggctgcctggctctgcccctgtcctggctgggaggctgcctttttgaaacctgccctgagagacacctcaggcctgacagcccaacgaggggcctgtgaggcttcgggcaaacgcctgaggactcggacttcaaggcttatgtcaccgagagctgctcccacagggctgaggagaagcagctcagggaggaccgcagatctgctgggcaggggctgcactccttggggggcagactcacccctgccacctccttggcgtagttctggcactcggcgctggcggccgccatgtgcttttccagctctgcctccaaatgcgacgtgtgctccctcacctggacagatgcacagacacgcacacgcatgcgccagcagcctctgctcaaagggcactcacctcagggagcaggctggccctgggataggtgaggcctctcgggagatccctgaggcccaccagctaccaagcaaacgagaaactagtccgcggcaagagaaccccttacggaaagtggcaggctgcacccgggcactcctggggactgacatgctcttagatttacttgcaaaagcaggtaccaagggtaccttctccagggctccctgtggcgtctgaagggggcagtggggccaccttgactgtgaaggccgtggcagaagccctgttcaccagggctgggcaggtctgcacagggcccgtggctgggtctcagggtcctctgaggtagtcaatgtctctcattaaggaaaaacaggatggacaagatcccttggcttgagagagaatgcctctcttaaggcacacggtccatgaggaa

SEQ ID NO: 100095 - DNA, 1695 bp, Homo sapiens
cgggagggagagggccctgcctcacctcggtttccccccaggagggcatgctcagagacctgcagaagagcgtggaggaggaggagcaggtgtggagggccaaggtgggcgccgcagaggaggagctccagaaggtatatgcagccctgcctgcctcccggcgccgtggagcacatgaagcccaggggagagttgacaggattgtctctgtcacctgtgagactcgtgtgtctcggtggggcttttccacgacaccctatgaagcacagttgcgggatgacagctcagtccgtcctccaggaggcccccgcctaggaagacactgccagatggcgccagggtgaccgtcccagctgggcggagtgggcacccccggggcttcctaagttgggtcagtcccgctcgggtcctagcatggcctcggaaggagacacccccaggtgctcgtgtctgacggagccttccccttgctttgtagtcccgggtcacagtgaagcatctcgaagagattgtagagaagctaaaaggagaacttgaaagttcggaccaggtatgtgctctgctcagagaactctttctcttgtcccgggagcctctttgaaagtgacgttaatgcagaggacacttcactgatttcttcctcatggaccgtgtgccttaagagaggcattctctctcaagccaagggatcttgtccatcctgtttttccttaatgagagacattgactacctcagaggaccctgagacccagccacgggccctgtgcagacctgcccagccctggtgaacagggcttctgccacggccttcacagtcaaggtggccccactgcccccttcagacgccacagggagccctggagaaggtacccttggtacctgcttttgcaagtaaatctaagagcatgtcagtccccaggagtgcccgggtgcagcctgccactttccgtaaggggttctcttgccgcggactagtttctcgtttgcttggtagctggtgggcctcagggatctcccgagaggcctcacctatcccagggccagcctgctccctgaggtgagtgccctttgagcagaggctgctggcgcatgcgtgtgcgtgtctgtgcatctgtccaggtgagggagcacacgtcgcatttggaggcagagctggaaaagcacatggcggccgccagcgccgagtgccagaactacgccaaggaggtggcaggggtgagtctgccccccaaggagtgcagcccctgcccagcagatctgcggtcctccctgagctgcttctcctcagccctgtgggagcagctctcggtgacataagccttgaagtccgagtcctcaggcgtttgcccgaagcctcacaggcccctcgttgggctgtcaggcctgaggtgtctctcagggcaggtttcaaaaaggcagcctcccagccaggacaggggcagagccaggcagccctgccccgagggaggcgtttgacgttctaggttatccctccgcaaggggattctctgcctggcttgctgatgtcatatctggtggggagtggatttagatctgacactttttctgctcttcagaagcagaagcacaagcccagtatcccaattctggtttaatctcaaacttttgggccaggcacagcggctcatgcctgtaatcccagcactttgaaaggctgaggtggattgctcgag

SEQ ID NO: 100096 - DNA, 1022 bp, Homo sapiens
tcagtaaagacctggggaggtgccccacacctccacagctgaacaccttccgctcttccccacccaccccccaggaggaatcggagaagcagctctgtctgattgaggcgcagaccatggaggccctgctggctctgctcccagaactctctgtcttggcacaacaggtaggaggggagggtggttcccggggacctcacagttctcagggaatgtccccgggtctcaccgaatgtgtttcattgcagaattacaccgagtggctgcaggatctcaaagagaaaggccccacgctgctgaagcacccgccagctcccgcggagccctcctcggtaagtgtggctgcctggcaaggctcctctgttgggctcccctgtccccaggaagaggggctgccccaagtcatttcaacgggaagccaagagaagaacctttgtgtgtggctaactaaacacctgttcttccctctctcaggacctggcctccaagttgagggaggccgaggagacgcagagcacactgcaggccgagtgtgaccagtaccgcagcatcctggcggagacggtgagcattgggaacctgtcagctgggcatccctgggaggctgcagggaaggagagcttcggggcctatggggcaggaggtggcctggtgttttggaaaagcccactggccttgtgactctgggccccgttcttcggctgcatggtaaatggatggcaccctctgaggtcgtcattgtttctaagctgaagagaaggccaagttgaaggttcggggccggtctctaagctggggaaggggaaggacggggtaagcagctggtgactgccaggttgaaccccgtttgtgactaagagcaatgccaggtctagccctgccactctctggccagcccatcctgtgctcctcgtcctgggccattgacacacttggtgctggtggcaaaccccggcagtaacaagcatcctagtggtcctgtgcaggtcacagacctcatttccttgcctggcactgcagcc

SEQ ID NO: 100097 - DNA, 1123 bp, Homo sapiens
cctgtgtcccctccaggacctccgggagaagaactggaaggccatggaggcactggccacggccgagcaggcctgcaaggagaagctgctctccctgacccaggccaaggtcagagcccgaccacactcacacccccaccatggaaagtgcactaggatgcacaaatgcactaagacgtacagatgcactaggacaccagatgctctaggacgcacagatgcactaggacagacatacagaggcactaggaacgcatagaagcactaggacacacagatgcactagtacgcacagacgcactaggacacacagaggcactaggacagacacagaggcactaggacgtacagacgcactaggacacacagacgcacaggtgcactaggacgcacacagtgcactaagtgcgcacagagtggccttggcctcagagctcctgagtccacgccagaccccggctctacatccacctccccctcccacctccttccctgccgtccttcccttcttcacttgctcctttccaagagagggatgggggtgcccccttgatgggcttctccgtgctggtctctctggctgagggtacagagctgctggggtgggactggaggcagtgagcccgaggctgcactctttatgagcttttttggtgttatttctgttgtgtgtccttttgtcgggtaatcctgctgcttgggcctctgaagtcatggcccagggggctctgtgaggagactttttttttttttgagacggtgtcttgctctgtcgcccaggctggagtgcagtggcgtgatctcaggtcactccaacccctgcctcccgggttcaagcaattctcctgcctcaccctctcaagtagctgggattacaggcgtgcaccaccacgcccggctaagttttgcatgttttgtacagatggggttttgccatgttggcttggttggtctccaactcctgacctcaagtgatctgcctgccttggcctcccaaagtgttgggattacaggggtgaaccaccacgcccagtcccatgaggagtctttaagtcacagaggggaggacattgtttgcagcgagcactcggggaacagaggccgcgttggccctgcgctccat

SEQ ID NO: 100098 - DNA, 1034 bp, Homo sapiens
ccccaagccgcagagcccaaatgccagggaacatgggctgtggcctggggagctgcctctgctgagaggcacacagggaggtgcttctttggtgacgagggtcaggacaagggaactttgtgaactgatggcctaggacacatctgaccgtgtgcgagggaatgcaggacaccctccatgcctcccccacctactgctgcatggacccctagccacggcggccaggacctgcctccccagactgtgggcatgtgctacaggaggcgagccccagaagtgatggtcacaaggactccggcccctgactcgagccaccccacccaggtgttggccggccttagcaacagcaaataaacactccccgaacatggcctggcgctggtgctgctgacacggagggaaaacaaggtctggccagcagtgaagtcacctcacagatggaggaaaacaacgctgagacgctgccagctctgccccgacgcctcaaacctgtgctccagcagcaagcctgggttcgccattctgggttgtgcaaccatttttcctgttagagttcctgacctcagcccctaaaatcccttgcttgtacacacagaacctctgaccagtcagtcccttcccacagagagatggacaggtggatggacggacggcaggtggcagggggtgctcccaccctggctgaggccactctggaacgatgtgatcacgaagctctctgcaaggccgccttctttcccgcccaggcctgtcccgtcctctaaatcaccggaggatgggggagggaagggagcctctgaaaggggctcttctgcagaggacctgagcaccctcctgaaaaccctggccccccaagggtctttggtcccccgggctgaggctcaagtgagcaggcaggctgcttccccagcttaccgagtctgctgctggtcagcctccgcctggctggcctggaatgagagacaaaagctccttggtctccaggagactcatctcacgcagcggggctagtccacccacctgctagatggagt

SEQ ID NO: 100099 - DNA, 1030 bp, Homo sapiens
gggcatggctttagattgcgtggtcctggagactctctgaggcaggaggggatgcatggcagaggccagcacagggcccggaggtgggaatgaactgacttggcctatgtgagaaatgggctaacaagtgtggctggaaggagaaggctggtggcggggcagggccaggtcaccctccctctgaggagcttgggcaccgtggaaggtgtgacagaagtgcttggggcaggagatgaagtcgtctcatgtgcgcttctggacactgacaccaggtggagagcagaccagaggggcacgagtggcccatggagaccagggatgaggccttgcagttgctgaggcccaaggcaacagggcagggcccaggtggccgcagaggtgctagtgaagagggcaacttgacagatggcgggtgtgggctcgtaggcttcggcagtgggcgagggaggaagatgaggagtcctgggaggtcgggatgttgggtttgcgttgtctaactagagcttcatttagaagaggcagatggcagagcctggggttggggagagtgcagcctcagaggcacgaagatgacacttagacccatgggactgtctgaggtgacctgaggaggaggacacctcaaggggagaaaggggcccagggcagaagagtcaccccctggcctttctcgactgtgaagaggtcttgggggttgagggggacccagccagggaggtgggggaggtgtggcagtggggtccacctagccactttctaaggaacttctggtctcagtaagaaaaagagtcttctagaagatgaatctttaaaagcctcagctggagtccgtttccactctctatcattttctcatgagtgtcctgagagcattgcattctaccctgacggttctcagaagtgatgccagagtggcactttcttcaaccgctaacaagaggccccagtggtcagtagtatgtcttaagagccccagacacacagaggaggcaggaggaagccctcggtgccccacatgtgctaagagggc

SEQ ID NO: 100100 - DNA, 1088 bp, Homo sapiens
atagtaggagctgtcctgcagggtgactgtgggagttaaccatgctattacacccagagtgcctaggactagatcagtgcttttcagaaaaagagctcaatgtgaactctacaaaattttattcaagatatctccaagtcagactggcggttgaggttgtagaaaatgtctcttttttgctgaggtgaaaatggggctctttccatattgtgactgtcctgccttcacctgaggccccttcactgccagccagctctgcaggaatgagggcgggggtggcctgtgctgaccttcggtcctggagcactggcatcagggaggtgccctgcccctcattgcctgtctctccccggacggcctcttggggcctgcttggaagaaagtacccattgaaggtgctgatgacatccttctagaagaactgaatcttagaaatccaggagggccttatgaaagtccccagctgggcccacccagccacgggacccgcttctgaaattgttcagtgtgattggctgtgctaacaacattctcttcaaggcaaagacagttgtcacctgaggtcttaagatggaggcccgtggtttccatcaaagattttaagtttggggttcctgaaggtgggtgggtttttgtttgcttgttgctggaatcagagttctaatcaatgttagtaacaaacggaagaacatgtgtggtcagtctccctgcagtctgagctggagtcccttttcttaaagaaaaaaagcagcagcagctggtgtgttttcttccagtcgtgtaatgaccctgccctatgtatcctggtcgaggcagaggtgtgagggtgttggagccggtgggtgcaaggcaggctcctgcccgggacacctggcagaggagaagcaggtgtgctttctgggagcagcttgcagtcactcctttctttcatttcctccctaggagttggaactgagtaatcccctgctacgttctaatgcagaaagcactgcccatcctaaagctgcccccagttttcactgcacagtacacgtgaaccacggcctagtggccacctccttggtgatggcttcactggctccagccac

SEQ ID NO: 100101 - DNA, 2042 bp, Homo sapiens
tcccaggggccctggatgttggtgactgagtcaagctggggtgttgtcatcacagcagggccgagccagtgccctggagagccagggacagcaccgtgtgtctctgctgttcctgccgcatctgccacctccactgtggccaaggcctgacattgagcccacaaccggccagggccagcagggtttccagggatcccttgttgtctgtcgtcgttcccactgcagctggcttgagtctagctgagaacccggccagcaggaggggtctgtgctctgctctccagcctcccagctcgggtgatgctcttgctcccttctgataggctcctgccctgcaaggcttaccagcccctctctctgctactttccccccaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaaggtgggtgtagtggctggcgggggcatgggaagggacaggacccagtccaggtccaggacggagggagccagagaggcccaaagggtgaggcatgaggagggggttgaggatgcccacaggggtctgtaaggtctggtcaggtttaggagtccaggggctgttgcatttggctggacagggtctggcagcccaagtgtgtgtataatgttaaaagccagggaggtatgaaatacattttaaagaacacttttcaaaagagcctagtctcagatggccagccctgtttccctgcctcctgggtgtctgtgaagttctcacccttcatgtgaacctagagaaacgcaggctctatcttctttccacatggtggggaggatcccataataccaaggcctgaaaatcacacagctccagcggccagcactgggcggctgcccagactggccctgtagtcaaagtctgaagcctgcaccctgctcatagtgggctgcgacctcctccctgctgcatgtctcaggacgtgctggaggtcagagggcaggaatcgaggcttcctcaggggggttagaggcggtgcatgtgctttgtcttagaacagtcaaccatgtgaccttggaggcagatgttcatggggtgtgtcagagaccctgggctgagtgttcagccttgggcaggccatgagcagtgaggagggagagaggtgtcgctgggtgtgggagtcatgcttggccgcttaagcttcgcaattttcaggcctcttgttttatgggatcctcttaacttccacgtggaaaaggtggaggcttttgggggttttcttttgtgggctgtgtcttcactaaccactgctcagaagtcagttctgtgtgtgaggccgagctgcctctgatgcccttgcccgtgactttccagatccggactcttcaggagcagctggagaatggccccaacacgcagctggcccgcctgcagcaggagaactccatcctgcgggatgccttgaaccaggccacgagccaggtggagagcaagtaagctgagctttcctgcctcagcacctccccaagggccctggagcgaggaaggcttcacgaggctgcggccagggcagctggcacaagagccaggcatgggccctacatgtgtgcggagccgtcctgaccttccatctcccgtctgggttctgggcccctgagtcttctaacaggtggcccagcgtccctgtggtggctggtggtgggcctcgactgtgccctggagcacagcctcctgctctgcaacacccttgcttcagatgcactggtactagggagggtttccagcacccacctgcctagcggggttctcatctcagtgttgtctctgagttgctgaagcaccgcagcccacagcaagtgggccggagggtgcacttcccctccggagttgagtacagccgcacttctgcttccctgatttaagcattacaccctcagtggcagccctcgagaaacccactgcagtgtctttagttg

SEQ ID NO: 100102 - DNA, 1478 bp, Homo sapiens
ctgaggccagtggggtcactcccttcctggccatacacatcctgcacagtctcagtggcaccgagagcttgtcagtcgtcactgggggctctactgggtatgagtggccataggagattcagatgaccagggagaggcctggctctcctcaggtcactgtcctcagagtacccggcccccatactgcagccagaggcctacgggctgcacgcccggctcgggtaggctccaggccagaaatggtggccagctgcccctcagaggagctggcaacaccacactcctaaatgccactccagggattcaaagcctttggccttgacagtcccaacacacgctgggtcaggggtcccggcaggctgatggctgaggcggggccgcctttccccacaagtatctggagtcccagtggaacccttgactcgaagcccctgctccacttcatcaagccctcaggcctctgctcttgtccggggtcaggggatgagccaagtcccatttgtcccctctgttaacgcatctctgggtatttctaggccactcagaagggtgaccctgtggcgattctgaaacgccagctggaagagaaggaaaaactgctggccacagaacaggaagatgcggctgtcgccaagagcaaactgagggagctcaacaaggtacagcctgagtgggctcggagatggtttgtcctctcccgtcctcagaggacccccgccccatccacggtggatcccgggctccgagatgctggggcctgcctggaacgtagctggctgtcaggctgctgagtagggactgctgcttatctgctgcctaaagagccaagggccggcagctcacccttggcagtgctcgtggctctacggcgtggtggcttccttcgtggctgtaagaacgcagggaagtgaagcaagggtttggaagttaagcagcatcagtttgtgatggggatggaccagacctggctttcactagacaggtcctgcagtcacaggccagctttctaggggctgtgcctggaaaggagggtggccacagtagattcaaggttgttttcttgaggattatgcaaaaccttgtggggaggggactggaggggctgctcttctccctttttctgatgtcagaggagggatgtgcagggaaaccctggctccccgtatcagcggatggcgtggcacgtagcatttgcactctgaacagcaaacggtggtgggttggtgctgccataggacggggctgatggcacgttgagattgtgttgggatccatggcataggggctgttcttcccactgcagaattcaccggggtctttccccacctctctgctgctgagggtgggccctggtgccccagccttcctggaggaagggcagggtgaggggccccctggccctctgggactggtcaggccctgttgaaagccgtctttgccccatgcagcaccgcaggcttgctcttgccctctccctg

SEQ ID NO: 100103 - DNA, 1050 bp, Homo sapiens
aaccatggtgagccatgcaggttgagaacaggaccagtgcatttgcgagaaaaaaaaggaagggagaaaagcctatggaaaaagtacgccttgcttaattttgttgcaggccatcttgatggtggaaaaaaaaaaagaggagctctacttccaccccaggctgggacttcctatgggcgagttaggacggtgcagggacctatcgttgagtcagtttcttggtgtcctgaaagagcaggagacactggagcagactcgccatgctcagcctgctgaccccaagcagtcagagagctcttcgtggctgtgaccagaaccttcttggtgtgatgggcattgtggccacgtgtgttgtggcttatgggcctaagtctcagctctttccctcttgctgcacagggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggtgggcccaccctcctgctggccatgctcagaggccactgcagctggctagggtggttttgcccttccctctgccacagagaggacattcataggacagcctccacttctctttcctggcagaattctgccaccccgagggatcgctcgcaggtgctttggcttctgtcaagccacccatggcctggctcctgagatggttagggctggggcagggctctgtattggcagggtatgggatctagggagctggggcctagccagtttgtggccacagctcagggtgcagaaagaaaggtatagggacacagtgtggggccctgtgaggttccccagcccaggagcgcccctggtttccgtcgtgctgccgggggcaggttcagaggctaagagttctgagctatctcgtgcctctggccaagagctgtgcccaagaagtgctgcgtggcacattccttcactggagtcagagttcagggtaactgtgctggaggatttagtgg

SEQ ID NO: 100104 - DNA, 1173 bp, Homo sapiens
gcactctgtggactgagcctgcggcgggtgagcatgtggccatgctgcccctgtgcaggaagcggcgtcctagagcgcgtgccctccagctgccttatccagatgtttccccacccagcagtgcagtaggggccgtggggcctggaagggtggtctttaaggagagagttcaagagaggccagagctcttgggtcactctggaacctctgtaggaccaggggctgccaggaattcagcagggggcactttgggggtccctggttctggaaaggaataggccagccagtccaggagaaacagaatgtgagccacacacgtgtgagccatggatgtgatgtaaatgtcctcagccacatttaaaaaggccagcaagaaacaaatggactgaatgttaacgatacattttgtttgacccagtttatccaaaatgttatttcaacatacaatccatatataaaattattacagatacttcacattctttttttttcataccaaatcttctaaattccacgtgtactttccactcatagcacatctcgagtcaggccagccacgttgcaggtgcccagtagccacacatggctggtgcccagcacatcggacggcgcaggacgcttttctgagtcaggagggggaaatgtccttgcagccagcagctagacgccggctgaagcagctgccctgcccagtctgtaactacagaggtgtctttgaaacaagtgacctctgtctcctggaaagtgctggcagtagacacgcacctgcaggctgagggggaagacaggaaggctgggaaccgaaatgtgaactaacacgggggtttctcccgagagtgagccatgcatgtttttattttcttttggcttttgggttagaattttctcttgtgtgtgcattaaaattactttatgtacatacacgtatttcagtgaaaagaaggttgaaggggcatgcttttgccaggacctgttttcgtggcacccatgacctcttaggcctttggtgtcaacatggttatttttaaactcccgagcctcaccagggtaagaagttataaaataaaggtgctcatagcaaccagctcgcccacatcccacgttcccctcattaaggtatcgtgccaaatgctttgacttgtaatgaaaatattatgactagtaagtgaaaat

SEQ ID NO: 100105 - DNA, 1048 bp, Homo sapiens
gtgcctgagcctcccagtgtggtcgcagaagggagagtcattttgaaatttggggtgtgaggtgcgttatctgagctgctgtgagctgcttgaaggccggccatgctgatttattttgctgtgcgttaccctgcgccaggcatggttccaagcacgttgcaacttactcttttcagccacgctgtgaggggaacaatgatcatccccgttttgtaggcaaggaaacagaagcaaaggaaggttaagccacttgtccaaggacaaaggtgggaaggagctgagctgggattcgactccaggccacctggtcccagaggccttgctctgaccttggtgccccactgcccaaggacagaggtgacctgcagactggacgtggcccacggatgtgtttgttcatctgtacagtggtttcattcatttatttgttttttattgagttagctgtcagcagtaaagatgagaagatagcacttaaaaatctcgtttccaggctcttgggcaggcctgtggctttgagggttctggctcagattcccccattgcagctatcacctggaggtgaagtgccgtgcccaggaccacccagctcaggagaggccacccccctgagcccaggcctgtgtggttatttgtcacagtacctgtcccattcctgcagggcctggcccctggggtgttgctgtgtcccctgccagacagaggtctggattatccatcaaagtgagacactggcctgcgtctctactcttgggtctcctgctccctggtcactccccaggcctcctggcctgtcccttcctggtatttcatacccaccaagatgggcaaagcgttagccgcaggagcaagccctcagggagctgagcttttccagcattcactgcaccctgggccttttgaagtctgtgatttcacagactaggtgttgagtctgagagacttagtttagtgcgttaagatttcacaattcggaagattactggtatcttcgagtatttgctggagccctaagtgatgtgctgggcacgccttaggctcccgttag

SEQ ID NO: 100106 - DNA, 1056 bp, Homo sapiens
gagctcctccctagagagcgtcttgcgtcccacctcggggtgggaccctgaagggagccggctcctcaggttgagagagacagagatgcccttggctttgggtcagcaggaatggggagcttgtcctcagcctctgaatcttggtctgcagaggctgatgactgcttgcgtggtgctgggcttccaggaggcatgtgggagccctttcctggggccccagggtcttcaccttcttacagcagacctgagtttgggtcgggtgactggggactacagggcgtggaaggcacgccaagattgcgatctggcttgggcagccatgctgggtgccttggtctgcactgtctggagtcaccccgtgcaggcccggaggcagcagctattcagactacatgtgtgtgtctgagggaggcaccctcagaactgatctggacaatctcttaggaaatgagagtttttgccactggagttcttccccaagccctcaagtccatgctgtttcaggttccattgccagagtccctgggttgacacctgggcctctctcccaccagctcagcttcctgaatactcgggcccagatcctggtcctgggctcttaggacccagcggggataggctcttaggaccagggtccaggccagctggtctgcctgcttccagccgcatccccctgggcatcctgaaatctttttctcaaattcaaacgctccttcctaggcatcgcttgttgcctacagaataaaatccagattcccagggcctatgaagacttggacctagtccaacctcgggtgcaagtctgacacgctagggcccaaagcccctcaccgtgtccttacccagctatgcttggcccaatgccttaaagcctttctcggcattgctgccacaattgttctccaggtcccccttgtgtcactcttctgccttatggccctgtgtcctctgcctctgttggccacagcccaacctataacttaactttccaggcccagcaatttacgaactgctgggtatgcaggtggtacatactttgtgtctagagaccacctg

SEQ ID NO: 100107 - DNA, 1079 bp, Homo sapiens
ggcccccgccctgcccggcaggtgcccctgtgcccttctcgccggcagttgcacagagaggtgtacacggagatcaagtcagatactttttcttttgaacctaactcagtttctcagggtctgaagctctgaagaaaactctctggggcttatgaccctttattcactttctgtggaagttcttcaaacccaactttttcttttcttcttctttttttaaagaagaacaaaaacatcccctagggaagcgagccaagtatcagtgtgagaagctgctagatgacactcttccagaaatctcttttcagccacttgaaaacgtgttgaggctgggactccggtcactgcccccagacggctgtggtcagacagcctgggattaaaaatcccctgccgttttctgcaggcattaggtagagtcctaattgctgtttaaactgtattctccttgggccagcctgtgtgccttgggaagggccttgcccagaggtcctccaggaattgtcgttcttttaaaaatattgtgatgtgggttttttttaactccaggtataaaattggttttgttgaaatttggaggaaaaaacaaaactttaaagaggaaaacagttcttcaatctataggatattttaaattccattagataccattaaatataccagtccccaagtttgtagccgattacgtttttctccaactaaaggaaaaggactgattgaaaggccctgaattgggttgttcttgacattatttgtactgagctccattgcccttaaagctgcggatgtgaccgttcgtggcatttggggtcaagtgcagctgcgcctccttggcctgcttcctgtcaggagcgctgagcagcgcttgggcaaggccgggctctgtggcctgagctgggcctggagtccactgtttgtgcactgcccagggcctgcctcagctgtgggcagatgagcaatgagtgagagcaggagtcgcagtttgcctccaggagcatttggtagatcttcatttcctccagggtctcataaagctcacttcccccacaggctcaggaggagccttcacggccacagtc

SEQ ID NO: 100108 - DNA, 1097 bp, Homo sapiens
tcattgtgctcttcacatgggcacccacaaacgggagctgcagtgcacactgctgtctgcttaacagtgtgttggtgacatctttccgtattgcacctgcgaaactgccacattcagctgcataatattccctagcatgactgtattgtaatttatttaaatgacatttaagtagtgtgcagctattttgcagctaaaattaatgctgcaatgatgtacatacactgttgtgtgtctctacaaaataaagtcctagataagtaattgtcaagtcaaaaggtgggtacgtttttaatttaggaagacagtgctgcattgctttccagaaacgtttcacaatttacgatgagaggcccacaagatttgttttctgactcagcactcctcacacggtgctgctgtgctactctgggaatgattctaacttcaggaagtttggggagcagggagcattataaacccagacgtgggataaggagaaagcctctttctttggaaatgaaaggcacaaattctttactaaatatttggagaggaggaaattgatgggatcctcgagaagtggaaattccccagaatggaagcttccccgtgttccgggtactgtcagctgacgcacgtgtccaggctttagctggtttgttctccgatagttaactgagcacctatgcacagtgtctattaggaaagtcaagtttctaacacaagacgtgtgtgtatgcagtggtgttggtttttaaaaaaatctatttttatcctcagattgagtctttgtttgcaggattatgctggtttgcctcccacctgggctgccctgatcttgtactaatcaccatctgggtgttacactggcaggagagctgtcccacccagcacctggaatcaagtctggatcctacagtgtgggcgtagactgaggaagtacatatgtacattctgaagaccccacagttagcatgagctccagaacagtgtacttttaactggagcttgcttcactcattgttgctgctggttggaaacaggtgtttcctcattacctctgctagcacgtcactcaggggatgcggggatgcagggtacttgttgcactcttg

SEQ ID NO: 100109 - DNA, 1245 bp, Homo sapiens
ttggtttcacccttgctacgtcttatatgtggagttttcatgttccagaattatttggatttccacttaacattggcggctgtgaccatgttgcctggtgagcaagcccggatgagacacgttagaccgtgggttcctccctttgttggaaaggctgcggcggcccccactggctgccttgtgcctcgttgcccctctgctggggctgagcttcctgtcagtctggggcctgcccactccagcttctctgggggtcatgtgtgcccaacctgaggcaactgtaggcagaactccgggtgggctgactggccctgggcatctagaaacacagggacctgtgggtgtgagtgtgttgggtgggaggggtgaggtggcatgagggctgtgctgcggggatctgggaggtgcttggcagtgggttctagatcaccggtgtggagcaggccaggacgggaactcctcccatgagtccaggaggccttgacttgggcaggggaggtgtagggcctagggctgtgctgtcccatatgggaggcactggtcacatgggagcatttaaattatcacctaaatcagtcagaagtaaataaaattaaagattccattcctcagtcacactagccacattccaagtgcctactagtcacatgtggctagtggctccctttacacagtgcagagacagatcatctcagtcagagcagaaagttttgcacagcagtgctctaaacaggaccttctgaaaggaggtggcctcttggatcactagccggtctgtgcagacctgtgttggtgttgcacagaggctgtggctggcccatagcacaggacagattagcagcaaaaccagtactggagctgggctccaccagagacttgaagtgcttcttcagtcttcctagccctacctgttacctggctggtccagcagggccccctgctgacaggtgccccagagggagacctggcaggagtggtaggcccaggacatgcttttgcagacccaggctggagctcttccagaacttctgctctgattttcctccaagagcagatgggggccctgcagcgggtttttaccacttgtccatggctgtatttgacagagaacacctgccttcctaatccttgccttttacaatttattattacataaatatgtgtttccagcaaacaaaattcacagtatggaggcatggaaggtgaaaatagaaagtctttttgctccatcccaatcaccatccg

SEQ ID NO: 100110 - DNA, 2753 bp, Homo sapiens
aggcctccactctgctctgactctgctgttgctttgtatggggactgctcatgccttgggtacgaatcgctcactcctaaagaggagcaggtgagaatgtgggacatcagagagtgcctgggtttgtttcttctctgaatttattagcctgaagaaagaattagtgaaacctgaagtttggtggtagggtggggatagaaactgttgaaggccttgatttctataaatagtaacctccatgtatgtttgacaggtgaaaggaaagcaagccaggatggatatttacgacactcaaaccttgggggttgtggtctttggaggattcatggttgtttctgccattggcatcttcctggtgtcgactttctccatgaaggaaacgtcatatgaagaagccctagccaaccagcgcaaggagatggcgaaaactcaccaccagaaagtcgagaagaaaaagaaggagaaaacagtggagaagaaaggaaagaccaagaaaaaggaagagaaacctaatgggaagatacctgatcatgatccagcccccaatgtgactgtcctccttcgagaaccagtgcgggctcctgctgtggctgtggctccaaccccagtgcagccccccattatcgttgctcctgtcgccacagttccagccatgccccaggagaagctggcctcctcccccaaggacaaaaagaagaaggagaaaaaagtggcaaaagtggaaccagctgtcagctctgtagtgaattccatccaggttctcacttcgaaggctgccatcttggaaactgctcccaaggaggtgccgatggtggtggtgcccccagtgggtgccaagggcaacacaccagccactggcactactcagggcaaaaaggcggaggggactcagaatcaaagcaaaaaggctgaaggagccccaaaccagggcagaaaggcagagggaaccccaaaccagggcaaaaagacagagggaaccccaaaccaagggaaaaaggcagagggaaccccaaaccaaggcaaaaaggcagaaggaaccccaaaccaaggcaaaaaggcggagggggcccagaaccagggtaaaaaggtagatacaaccccaaaccaggggaaaaaggtggagggggccccaacccagggcagaaaggccgagggggctcagaaccaggccaaaaaggtagaaggggcccagaaccagggcaaaaaggcagagggggcccagaatcagggcaaaaagggagagggggcccagaaccagggcaagaaggccgagggggcccagaatcagggcaagaaggccgagggggcccagaatcagggcaagaaggccgagggggcccagaatcagggcaagaaggccgagggggcccagaatcagggcaagaaggctgagggggctcagaaccagggcaaaaagtccgagggggctcagaaccagggcaaaaaagtagaaggggcccagaaccagggcaagaaggctgagggtgcccagaaccagggcaaaaaggccgagggggcccagaatcagggcaaaaaggccgagggggcccagaaccagggcaagaaggccgagggggcccagaaccagggcaagaaggccgagggggcccagaaccagggcaagaaggccgagggggcccagaaccagggcaagaaggccgagggtgctcagaaccagggcaaaaaagtagaaggggcccagaaccagggcaagaaggctgagggggcccagaaccagggcaagaaggccgagggggctcagaaccagggcaaaaaggccgagggagcccagaaccagggccaaaaaggagagggagcccagaatcagggtaaaaagacagaaggggctcagggcaaaaaggcagaaaggagtcccaaccaaggcaaaaaaggagagggagctcccatccagggcaaaaaggcagattcggttgctaatcagggcacaaaggtagagggtattacaaaccaggggaaaaaagcagaagggtcccccagtgaaggcaaaaaggcagaagggtcccccaaccaaggcaaaaaggcagacgcagctgccaatcagggtaaaaagacagagtcagcttctgtccagggcagaaatacagatgtggcccagagcccagaggcaccaaagcaagaggctcctgccaagaagaagtctggttcaaagaaaaaaggtgagcctggtaagtaactgatttctttatgaacttagaaggaaaggctgtctttaaatgacttatggattctctcggggagtgccacctgtatcagtcagctattgtcataataaggctgcgtaacaaacattcaaaaaaaaattcagtggccttcaacagcagtcatttattgttgctcatgcttctggaggttggcagatgtgagctttctcggttggtggctctgcctcaatctggttttaactgggttggtgactctttgctacaggttgagctcaggtcagttccatgtgtggtccttctggcgccctccagggcagaggcccttcatagttacaacagaggcacaaaagggcatttcaagtcagcatttcattgaccagatcaagtgatgtgtctgagcctgagtcaaggggcagggagtccactgtgtccagggagaagggactgcaaggtgatgtgagaaaggagaggtgaggagtgagcaacaggtccgtgtcttggcatgtcttaaacatatgggagcacaaggagaggtgaggaattaggagcaataattctgtccaccacaca

SEQ ID NO: 100111 - DNA, 1076 bp, Homo sapiens
cccctggtttgtaataccctctacctttgtgccctgattagcaaccgaatctgcctttttgccctggatgggagctccctctccttttttgccttggttgggactcctttctgcctttttgccctgagccccttctgtctttttaccctgattctgggctccctctcctttttggccctggttctgggctccctcggcctttttgccctggttctgagccccctcggccttcttgccctggttctgggccccctcagccttcttgccctggttctgggccccttctacttttttgccctggttctgagcaccctcggccttcttgccctggttctgggccccctcggccttcttgccctggttctgggccccctcggccttcttgccctggttctgggccccctcggccttcttgccctggttctgggccccctcggcctttttgccctgattctgggccccctcggcctttttgccctggttctgggcaccctcagccttcttgccctggttctgggccccttctacttttttgccctggttctgagccccctcggactttttgccctggttctgagccccctcagccttcttgccctgattctgggccccctcggccttcttgccctgattctgggccccctcggccttcttgccctgattctgggccccctcggccttcttgccctgattctgggccccctcggccttcttgccctggttctgggccccctctccctttttgccctgattctgggccccctctgcctttttgccctggttctgggccccttctacctttttggcctggttctgagccccctcggcctttctgccctgggttggggccccctccacctttttcccctggtttggggttgtatctacctttttaccctggttctgggccccctccgcctttttgccttggtttggggttccttctgcctttttgccttggtttggggttccctctgcctttttcccttggtttggggttccctctgtctttttgccctggtttggggttccctctgcctttctgccctggtttggggctccttcagcctttttgc

SEQ ID NO: 100112 - DNA, 1036 bp, Homo sapiens
aaaaaaaaaagaatcctacactactcattttgatgccagccaaccttgttacaaaacttgacaagaatggtaggaggaaagaaaaccatcagtcagatctcatacctgaaaagataaacaaagtccagcagtatgtatgactaaatcgttttatcctaggaattcaaacttggtttaacgtttaaaaataagtttatattcaccttccacacctacgggttataggagtagaatagtatgattatcttaatagatacagataaagtatttgataaaattcaacatctatttatgtaaactaggaataagaaagcaacctctttatcctgataaaggatgtctgcaaaaaggctttagtaaatctcacactaaagagagacacctaaatctttccctttgatatgagaaaaacagaatacttgctgtcattccttctctttagcactgtgttgaaggtcctgccctgtgcaaaaattcaagaagaattaagcagacgataggaaattgggaagaaagaaacaaaactgtgattcatatgcttatatatgtagaatttttttctttttaatcgacagatgtgttactagaattaggcaagttgctgtgggggaaaaatcaccctgctggaatcagttacgtttccgtataccagcaacaagcagaaaacgaaacttcagagctaccatttgtaagagtgtgaaaactatgaaaaactaagaagtaactctgaaaacgtgtaagactccatggtgtgtattatttcccatctggaaacttgggttgttctgtttagatttgatccttataatggtatacattagcacatacgatgctgatatgatattgagtagacgattgattcatcacttaccatatttgatgtggtgaggtttgatttgatacagtatagatgacactgacccctgcttttgggagacaaatgtttacggcagtaagaactcccttgtgggctagcacatcttaactgttcatgtccattttgagacatcagttcttgattcctaccgcataggca

SEQ ID NO: 100113 - DNA, 1171 bp, Homo sapiens
tgctggatggcctggacaagaggtaaatgacattaaaaataccttctgacaagcctagaatggaatacactgaagcaggtggtgaaaggagtgacccaagaggataaggacaaccccgggggcctttggcaaaataggcaaactcttaagttctgatagcatctccaggcgcagggggcagagattaatgctggcagcatgataggacacaggctccctgagttggaaccacaaggggccatgacaccttcatggagaaggggagtcagaggtaagcccattctcaccctacaggcagggtagggaggggcacattctgagaagtggatatcacaagttgtccctcatgtggatcccatgacttgagtagtgggaaactccaagctgatttgaagattctttatttgagagtggacctgcacacctagtgttcctgggtcagtccaggggcgagcagatcattgaaggactgcacctttatcctaggctcaccaaatccccagttgtaattatcaaacgaaagagaatagtccatagttaggaacaactaaatgcaaaggatgaaatagcactgaatgaggaccagcaggaagagatctcagaaaacataagataatggacttgttgacatagattttaaaggccttactcaaactaaataggcaagattgaaaatacctatgaggaagaggaaactatacaatgacctagcaaatttgaaaaaggaaccaggaacaacttgtagacatgaaaagttcatgtctttataataaaaatctaacagatggatttactagcagattacataaaactgaagagagtgaatgacctggaaagtagagaagaagaaatataatttagagaaccacatagatgaataatttgtaagaccaattaagattcaggaagagtagatgcagaagtgtgtctaattggggttccaggagaggagcgaggacagagccagtacttgaaaagctaatgactgagaattttgcggaatgcgtaagacacccaaccaaaacccaagccgggtaaataaaaataaatccacatatagacatttagtgatacagcaactcaagggaaaaattcaacagtgagagtgaaaagattgttttaagacaaaaacccaagatagctactgacagatctttgctaaaggaacttc

SEQ ID NO: 100114 - DNA, 1923 bp, Homo sapiens
tgaaaaaagtcttattggtaatgtgtcaaaggactcttaaaaggtcaactttagccactgctctgaagctaagttagtcttttccatcttaagtcatatccctcttaagttggaagatctggagacttattctgtacagtttgattttaaaaagactgcaggtgggccgggcatggtggctcagcctgtagtcccagcactttgggaggctaaggcgggcagatcacctgaggtcaggaggtcgagaccagcctggccaacatggtgaaaccctgtctctactaaaaatacaaaaactagctggacatggtggcacatgcctgtaatcgcagctacttgggaggctgaggcaggagaatcaattgaacccgggaggcggaggttgcagtgagccgggatcgtaccactgcactccagcctgggcgacaaagtgagactccatcacaaaaaaaagaaaaaagaaagacttcaggacagcaaggtggcatggccacaggactataaagggctgtgggtcccactgagtcactgccctgtcaggtcaggaggtgactgcctgccttgaccctggcctcagttacttcctgtctgtgaagggagcgatcctgtgtgggtgtgagcactgggaagtggcagtagtaacagggctccataacagattcttcaggccttaaagatgctcctcctccaggatctgtggggcgcgttttccaaggaaatatgacacacattttaaactctttattaaagtaaaatatatacagaaaaatgcactatcacgagtctacgcaataagtatccacaagctaaacatgcctgtttaaccagcagatcaagaaatagattattcctgacctccccaacctccttctgtgcccctcttccagctgctgcccatcgtgggcagggaatacctgctctcttcttaataataccagtgattgattttgcttgtgtttgaacttgatgtaaatggactcaaacggcatatgctcttttgtgtctttcactcaacgttacgtgtaagacttgtcaggttgttggggtaattgtagtttgttcattctcactattccagcatgtgaatatatgagtttattcacattactgtaggtgggtacttggagagtttccagtttggggctattaatgccgcagacttttggtgaatgtctatacacatttccattgggtctgtatacctaggagtagaattgcaggaccagaaggaggtaggtgctcggctttaaaagaaagtgccagactttttgtctgaagtgcttgttctaatttatactcccaccaacagtatatgaatgagaccttggaatatattataaagtggctgattctaaaagggaaccaaaatgaattttgagttaccgttgataataaataagaaatgactcactcaggctgaagttctccgctgtcacagagagaggatgttaggctggcagaattcgttaatcaaaggtgggccttgggaaaagggcttgtgagggtcagattttattgctgatgagcaggtgatatttcctaatataaacctgagtggaaatgcagctcttctccaaggagttaatggaagggaattcaacgaagctcatatcttgagattgaattcttcatcagaactcttcccctacagagtgaatttcctaaaaacgaaccaatagttgggtatcagacctcatttagctctggcccatgtgtttctaattagaagctctgcccacctctaggggttggcagtgtcgggatattcctgcaggagcccttcctccctggcccacctagtaatgaaggatggtatatccaggtccagagttggtagtagtctccctggcacagccagcctcctggcacatggcagccacgtgctcccttttctttgaagagcatggttggctggaatttggt

SEQ ID NO: 100115 - DNA, 1034 bp, Homo sapiens
agtattttttggtgatggaagagttttaaataaatcttaaatcaagtcacatttgagcaattatgctctttaatgaaatgagccctaactcaacaggctgcaataattacatagcagcaaactcagtttaaatggttgaatgccagtgattgaattggagtattgatttattatgtagcagggacaccttttaaaagtgtcgggaccccagactcttcttgtctttttagccctgggaattttaactaatagatgaatgacacatagaggatcaacagttctgttgagacagcaagtttttctttgctaaaatcttgtttcaggagaaacaaaaataatggtcaagtcagaatgatgaaggcagggactgtgctgtccgtctgtgcatgctgggcctgcagtggttaaggcctggcctataacatcataaatattggttataccaggcggacagcgcccccatacctgttaaactattcccagctgtctcattggataaatgaagcttagcccaacttggtttttaaggttcactttttagaatcagattccacaactgtggtttacatttaggccttaaaataaccctgttctagggggtgggaatggttgtcacccattcagtggatgagaatgtggaggtccagctggtcagaaggttgtcaggccagttcctgttgcccagttgctaggcgatgtgggcccggccttccaaatgttccctcctggctatatacctccaccttcctggggcaataattacccaagggaggacacagaacgtgaagatcaaaattaagagcttcagtggcaggaaggtggggaggcattttgaaaatctggcagtgctgaaggtatttttcatttcatttttttcaccgagggtctcctgtgtggtgggccttcaaacaccgcaagtgagacctagttcttgcctgaaaaagctactgtctagaactgtgttgtccaatacagtagccacaagtagcaatttaagtttaaaacaattcaaattaagtaaaattaaaaattca

SEQ ID NO: 100116 - DNA, 1137 bp, Homo sapiens
gctgtttccagccaagggacagagcaggtgtggccacttcactctgccctggaccctcctccctcgctgcccctcactccctgtgctgccaaagagtgctgctccctctctgagacttcgcttcctcttctgttacttggctctaatgagccctctgcctaaaatcactagggaaggtggtgaaaatgcacattcctgagcttcgacctgcagtgtcctggaggggtaggtgtgggctcaggaatgtgcctcttacccagcgcccaggggcctctattgagagccctgcacccacactttgagaagctcactgaagaacgccagcaggccctttggtttgggggatccactgaacgcgctgttgaagtgggacaggtgtttggccagggccttccagccgtggcaccgtcagaggctacgggtggcccctctgggacacacctttggcaaacaccagcaactgatcccgtggataggctcctcatcctgacagcctgagtccaagccctcaaggtgccgaagcacctgccgagacgggggaaggacctccgtagaggcagcctcgccaagggcccctggggagggtggctcggggctgaggcttcctcgcagtcatcccaggagaccctatctaggccatgttccttctggggcctcggccacctggccttcctgccgctccgcacctttgtcaatatttatttcttctctggactcgaacagcctggtatttgtttaaagggcaggagcagacgtggctgttcctgcctccttgccttgcgccctgcttcctggcacctccccagggtgcctcttgcctgcaggtgggctcaccaggcaggcccacctctgtccctggccctcccactggggccaaaggcctcacaagagctttctcacttcaccattgactccaatttccctcgagacaccttgacctgggcctctggcccaacgcacatcatatgtggcctacaggcctagaactgagatgctcagagcattagcaatgttccgaaaatactcctggcttctgatccaatagaacaagccacaaagaggttgtggcaaaaggtcatgtggtttgaaacagatttgcacatcattttcggagaaatcagagcctgtcctgggctg

SEQ ID NO: 100117 - DNA, 3878 bp, Homo sapiens
ccactgaaacttgctgcaaggaaatggagcaggagactggccagctgcttgggtttcaggaactgtttatgaacggccttactttttaactgttacattgcagatcctttccagttgttctgatggggtttggagagggaatggaggtcatgtgtttgttgtttaccccatcctctctacattgcaaaaagacagggaggggatgacccatgctctggacggtcaacctaagacagggcaaagtcaaggaacagttaataagaacggtgctgtgcggtgttaggctgtgtatcagttacccctaaatcaggccggatacccatagcaattcttgacatagcttcccattgctctgccctgctgaagttaggaggtttctgcgaagcagttggcacacttcgcatgagggtggaaacccgtagctagagccagccttcaagattccagctggatgcagctgcagctcccggggcctctcagctccttggatttgttgattgtatcatgatcccgtgattcagtcctgttgggaggcaggtggctggacatttatctgggggcagaaaaagtgtcagaagtaggagaaagaatacacaaaaaagaccctaaggggaggagaggaaaggagccagagagagcctgcagacagcaatgtaggaagccccattcctgccttcctatgaagctgatcttggcctgctcagcgaatgcctcagaagacaggaaatcccaagcctgcagtctcgagaaaaacattggaaacgcctgctgcgaatcccaacagggctcgcgctatgtgtttttctaaagtctggttcatgtctgcagtgcttttgaccccttttgcactgtctgttaaagcacttgtcgccataggagggggcgggggagtgaaactgaccagatgtgactcgcctcagaattgggggcaagaggtgaagctggtgtgaggggaggggctacttgcaagggtccttgttgcagggaagagggaaatagggtccagaagctgggatcgtcatgccaactccaccaccaagtactaggctggggtctgatttcagtttagtttagggctaggtacaacctaaggaaactcccagactctgccttcaccccctacgttttattcacttgcaacagccaaaggaatcttcttcgcacatgagtcagattgtgaccctactctgcaaatacccttcatgactccctgtttgactcaaagccccagtccttccaacaactacaaagccctacgtgatttgatgtccccaactccaacgttgtattttccaacaatatttccagtcccgtatactcttctgtaatgtgatcttgcagctttcccatcagaaggaatcggatccccctcctcttgaacctgggttggctggaatggcacatgtgtaacccaccagaacaggacagaagtgacgctggcgggtaacctccaggtacagagcggaggaagccttgctcttgggccactctcttggaatgtggttgccatccgtgaggacccacgccagatacagaggtcccacattccagtgaagccccgtcttcacgtcctcccagcccaggaagcagacaggtgagtgaagacctctccagagcagcagtgttcataaggactttctgtgtgacgggaatgttcggtatctgtgccgtccagcctagtggtcgttagccacatgttagctgggatttagataaaacatggaacactgccaaatttgaattccatacaacaaataatatagtgtaatacataccatgcaatatttggaacatagttattctaaaaaaaaatttgttgattatttaaaattcggatttcactgggtgtcctgtatttttatctgccaagtatggcaattctctcttttgtaaaaattattttaattttttattttttacagagacagggtctacctgtattgcccaggctggtctcgaactcctgagctcaagggttcctctcacctcggcctcccaaagtgctgggattgcaggcgtgagccactgcgcccagccaagtctggcacttctctattaagcacctggaatgtggctggtgcaattgaggaagctaagtttttattttgcttaattttaattaatttctgtttaaatagtcacatgagcctaggggctactgtattagacagttgcccccgcaagacactcacatcttcctagctgaagccccagatgttatgtaacagagacgagtcattcccactaaggcctgtccagactctagcctcccagaagcccaagcacaataaaatggtggtggttttattgtggttgtttcctgcatgaaatgtggggtggtttgtgatctgcaagtgtagctgagctcccctgacctctgtgaacttccctcctgtgccatccctctccttcatccccatccagccacacctgttccaggacaccccaggctctcctgcgcaggccctctgttccagttgtccctgtgcttgggatgttcccacccaaccctccccaccccccaccaaagattctgatatcaatagtacagggtacagcctaagtattggaggtttaacatgtcttcacctggtggtcctgatgtacagctagggttgagaaccaaccacttgtttagttcagtcacagttacatcctgtgagccggggctgttttacagatgaggagaatgagactccaggagattcagccaggccccagagtcagagggtgagaaatggtgcatcccggtaaaatgttgggtcctccccctactgtgcaaggacaggtttgacctgaaggcagaagcctgggctgaggcccctgaactttggaggggccctcaatcccccaggaggtagccggcgacctcccctggccttcctcccccatggctgggcctctttccttagctaatcaggctgatgaaaggccctgctgcctgcccactccctctctgtaatttgctcgtccttctctctaattttatagcctcctcagcagtttcccaaagatcgggggctcagtttccactggacccccctccctggcttaatgaaaggggctgctttgcagccactgactagctaagggtggggatcattcttaaagccctaggggatgggaagatgtgttggcaaatgttttagagcaggggccaacaaccccttttgtccgccaagtgctatcctaagtccctttttagccacttcttgagaaaggcccttacaagaagaagcgggcgggaggcggcgaggccgactgctgggtgtggaatgtccggctctgggtggtagcctccttgtattattgccttatgttgcggtttaactgctcttgctcattttcctcggggtcttatttccccggctggattgcagctcccttagggtaaagactctgtgatgtgtttgaatcacccaggcctcccagggttctgcctctgtctcactccctggcaccggtgaccatggccaagctcctgaagctcatccctttccacgttggtaaaatgggaggggggttactctgagcacaaaaggagagtccagttagtgaaggggctgccacccctgcctgccccggagaggtgtttggaataccggtcctatctcaggggagagtcgtagttgccactaggaggaggggctgtgagcgctgaggtaggccatgcacagcctcagtgaatgcttaatgaacatgaccttggtgttctcttatgggcccctgcccatctcctggctgcagctatgcacacagtagactttcagtctatgctgtctgtgcctttgcatgcagagccattggtctggggactaattctaggggtttcatttctgtaaaagagctcctgtctttgggcttccatggtgtagcca

SEQ ID NO: 100118 - DNA, 2648 bp, Homo sapiens
catggtggctgtactaatttacattcccagcaacggtgtagaagagttcacttttctctgcattgttgctaacactgatctttcatctatttgagaaaatgcattctagcaggtgtgaggtaatctcattgtggttttaatttgcatttccctaatggctagtgctgctgaacgttgtttgcatgaacctggtatgtcttcttttgagaagcattttcacaagccattggtgaagtatgtggctcaccaccacccatactccagccctgttcccagtcactggtacctagagggtgagagtgaggctgctcatcaacgtgttctccaagtcataagctgctgctctcccactcacgatgcttggtgattcagtgatgttttccacttaaagacagtgatagctgtatcaccacagttaatagatgtctgatgtgtcccagtcacagagataatacaaatgtgaggaaataatgctggtgcctgaaagcattggagaccatttgtaagaatgccatttggtagttaaagtgaacatgaaaattgtttagtttttcttggtttcataaacattttttcttcctgtagaactgataaatttcaaacggaagagagtggcagcatttagaaagaatctaattgaaatgtctgaactggaaataaaacatgccagggtaagtgttttctacagatgaagccaacatcttttatggttttttccaagttatttcccagtttactaacccattgtcatcaggcagttggggtggccttgtggtattaatcgtctgtagtacttagttgatgggagccactcattgtttatttgtagtcttgtttataatgtcacccatgactaatttttagcaactttttttttttttttttaatagagatggggtttcaccattttggccaggctggacttgaacccctgacctcaggtgatccacctgccttggcctcccaaagtgctgggattacaggtgtgagctaaagctcccagccctaatttctagcaacttttattcaatctttccaaggcccttgccttcatggaacaacgcactgatagtgtcttaagaagttacagtaagcaggatcacatttaggagcaagcaggtgagggcagaggtgctggagtgaacgtcggctctttggctggtagccttacccactgagggagaggagctgaaacatgaaatggggatgcgtggtacgttgcagttcacctgggatttgatgaagagaagggccagcttgctctggctgactttaaacctcccgtgaaaagccgtgttggtgtacttgagtcattccaggtatatggcaagttttaataattcactggtctgccttgccttttttccccacagaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacatttaaccatgttggtttaaaaatattattgcttgctacttggacataactaatttttccttgtgcatttaatacctctgggcagaatccaaatactgggttctcccgtagttcgtctttagttactaagaaagggtgtaggacacattagccttctggaaacaagtagaagccatcacctggcccatgtccctacaaacccatgattgtcagggaggtgccagttacagcaggtgattcagctacttgaggtcggtaacagaccttccattcctcactgaaggtggggtttgtgtttttgttttgccctgttactccactggtagtcatctggtgtttgtactataacaacagcaagaaaatctcatttatctttatatactctttgcacctcctttttttagtcgagatataaatatttgaggggagagaaatatctacaggtatatatggaaacaaataatgtggtctgctttataagatggccagatctacattaggaaaagtataagccccctccctaatggccgctggggggtgagggcggtgtgttgtatgtctttgggtgtttgtttttttataaagcatataataaaataatcgtgctactaatgtacggcctgttttcgtggaaactacaaccagagtgtgtcccaggagtgcaggtggtgctagggtttggctgtggttacagggttttcaggttctgcccagagtcctgggggcggtcaggggaaatttgtcctagtcttgacattcttaagtactccaggccttttttagatggtctctaaatgtgggtttgtctgtttgctcctgacctgatggaggtttgcattttggccagggcctttaccatagggcagtggtccccagtctcaggtccatggcttgttaggaagaggtgagccagcattgccgcctgaggttcgcctcctgtcagattagcagcagcattagattctcataggagtgcaaacccagtattgtgaactgggcatgcaacaggtctaggttgtgcgctccttaggagaatcaaatgcctgatgatctgatgtggaatggtttcatctggaagc

SEQ ID NO: 100119 - DNA, 1115 bp, Homo sapiens
taagattgcaaagaatctttatatctgactaagtggatctccaaggtagattaccagaagcaggatttgcagggtagggttatgtttcttactacttcattgcccagttgtattttagcagcgctcaacttgacttacccagcagtgactgtatatttcaagttatctctgatacacaatatttaatttttaaagttaactttatttactgaattactggaaaacaaaagtccttctgttttcactcttgagtaatcacttgattcatataaggaattctaaaaaaagctctcaacaaagctatcagcattgctcatccctgcgaagctggagatttaaaaatactctgggagagggaaggtgtagaggtagattattgccactaacatctcaggtggtacattggcacttgggctattttttagactggtttagatacttagtatgtatacctgttaatttttttcccaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaaggttgagcaggacattcttctttctgtactgtaatttgaaaataatttcaaacttagaaaagttctacaaatagtgcaaaaaacacccatgtatccttcacccagtgtcagcacttcacccctctgccttatcacttgcacatgcacagtcatcctcatggctttgcgtgcttacaaacgttacacacctggtttttctgtaccattggagattaagttgcatatgtcatgcttcttttagccctaaaaacgttgtggtttatttcctaagactgaagacattctcttgtatggttacagtatggttgtttgctgtgataaacttaactttgggtctacaatctgctctctgtattttcatgtttgtcttgatgtcctctacaagatccagtctaggattgcatctggttgtcttagctattagtctcctttactctggaatagttcttagtttttaacagtatcagtctttttagagaatctct

SEQ ID NO: 100120 - DNA, 1113 bp, Homo sapiens
acttctgactcgaaattgaaaggctaatggcagaaccatgacgaattaaatagcatatttactgctttgtgatgcccatagcatagctcattagaaaccaaccttggtttacacagcattggcatttaataagaatatttgggcgcatggcaggatgaccgaagggtcaccaagaggctgagtgtggtgctgtacatgtgtgtaattttgtgaccattttctctactatttggggtcagttgaagtgagagcactacttttaaattaatgctaaagtaccaaaggctaggactcctgagttgacccattcctgtcttgcacactggtaagatcatgttttatagatgatttaagaccttaaaccaaaattatatgtacatttccaggtacctattgaaggttgctgagctatttgaaaaactaagggtaaggatttctgtgttggtcttcataatatatattttataatctatagctttctgccttgatggtgacctttccttttctatatagaaagtagagggtcgagtttcatcagatgaagatttgaagctaacagagctcctccgatactacatgctcaacattgaagctgctaaggtaggaagagagttgctcagcttctcagagcagtgcaggaccagaagtctgtttaaaaagtttctttatacaaaggagcagaataagaatttatcagacttgtttttataaatgacatgcctttctggcattgtatccataaagcttgtgtatctgacagcactgtatgggttgtgtgaagtagacaggtaatagtttgggggattataggtcattgatgtgggacataacatgcagaaagggctgtttctggggcaaagaagatttgggagtttttattgaattgcaagtatccctgcagcctttgagccgtgaagcgttatatgtatatgtggacaaaatggtaagcagaataacctttgggaatgaaacatgctttgtctgcattgccctgaacaaatatgttttaattttatgtgaaatgtattaaatcaggcaaaataaaattagataggattgtatgccctctaaggctgaaatgtcatcagaaagtaaaagagtaaaaaaaatttt

SEQ ID NO: 100121 - DNA, 1178 bp, Homo sapiens
cattatgggatatttggcattggcatccttggccaatgcctaccagataccaggatttcctcccagtctgaaaccaatcgagaaaaaaaaacctcattcacacacagataggtatccaaggctaagtggccatgttccacctggtagaaccattgtactagcgtaaaattgctgtgtcttagggtgccagttttactggtggttgttaagtgattcttctgtagacattttctgccagcccttgatttttcccagccttggttaagaaatagtatcgtaaatttgtaattccctgatctgtagaggttaaactttactcacgtttatatgccatgttctaagcaatatatttttatattgataaatgtaaaaggctgcagggatagtatatttcatgaaatgtctggttctttttttcttccttctaggaggtagatgacttctttgagcaagagaagaacttccttattaactattacaataggatcaaagattcttgtgtgaaagctgacaaaatgaccagatctcataaaagtaaatatcatttaccgctagtcagagctttgctgatgagcctggctgtgtttggataaaaagacttgtccttgtttctgcagatgttgccgatgactatatccacaccgcagcctgcttacatagcctggctttagaagagcccacagtcatcaaaaagtaagtttttttggaaaagcatttcccctaacccaattgaagagtgccgagtggtgtaattaaaagcataaatgagtagtgactacatggtcctgctctggagttacaagctcagtaagacaagtctctagcactcatcttacatgttctctggacataagacacttgtaagacaattgtaggggacttgggctcttctatatgtaaacaaatacagtaaatgttgtcaaagcagtagtttctgtcacacttaaaagcctgttttctttagttttggagtttgtaagagtttatcttgcatcttcccctggcaattggtgcttgcaattttgcctggtaatgccctagaccttctttttttttggcctgtgatgcagcctcaggagatcctgagaacatgtgcccctgccctggaccttgaagagatttggttatagtggtcatgagaataatttaatgaccccagtctaacacacagctgtttt

SEQ ID NO: 100122 - DNA, 2193 bp, Homo sapiens
tgaggcactgaacacaacagatccaagtttctaccgttaggaattttaaggtgacttttaatgtctaggttgagataaagctgctttgtaatttttgttaacttttagcttcattagactcatgctgtatacttaggctgcagttaaagggttctcattgctttaaagaaacaaatgttctgtggctactaagtaacagtaattgcatgtagatttaggagctcatggacttgacccatcaaatccagttacaacattgctttcctccatagtcttattccacagattcaaaaatggcaactgccttagtatctaactagacaccagtttatactgaaatactgtttggtccagttgcagtgttttatgtggtggcatgagcagggccatagaattaatcaggagtggtattggtcaggtagttgagctgtgtcaactgaatgccatgtgcacatctcttttcagtgagtatctcgctgtgtttaagaagactgtgtcctcccatgaagtctttcttcagcggctttcttctcaccctgttctcagtaaagatcgcaactttcatgttttcctggaatatgatcaggatgtaaggcatttttattccattttgataatccacttcaaatgtttatactttcaaaatgtacttgatagtttctactgctttaaagttttgaatttcttacacaatggaaacctttttagatgctgcttttccttcattgtaagtcattttttgtaaaactctgcttaaagaaaattttgacttctttccccttccaaaacctaggtttctttttaagaaattaacagtcccaaacatcccttagttaatttcttaacaattccaaacttaactaagttcattttaaggaaattaaaatttgtgtaatttattttcttcccacctacgctttttgttgaattatgacttttttcttttcttttttgaggcagaatctcgctctgtcatccaggctggagtgcagtggcgcgatctcggcttactgcaagctccaccttctgggttcacgccattctcctgcctcagcctcccgagtagctaggattacaggtgcccaccaccacacccggcttattttttgtatttttagtagagatggggtttcaccgcgttagccaagatggtctcgatctcctgacctcgtgatccgcccgccttggcctcccaaagtgctgggattacaggcgtgagccactgcgcccggccgcgaattatgacttttatgctatttttctttttaacatgttttggtttttgctacttaatatggatagaagagaacagtaattttcccaaggatttcagagccactaagacttagcttctagtcagtctttcaaaatctgtcaagccttttagaatgagatgacctacctatgtttgggtttagccattaggtgttttaagcttggaggttaaggcagaattaaagatactttatgcatttgcctgtactgataaagaggattacttaaaatgttactcagaacttctttaagagaatctagaaaaatccataccatataaactctttggaattttcttcttttagctaagtgttaggcggaaaaatactaaagagatgtttggtggcttcttcaaaagtgtggtgaaaagtgctgatgaagtcctttttactggagttaaggtaagtgacctttggctgttggagaaaattttttacttcatcgggaataggtgaccttttgtttctttgaaagagatacttgtgaaacaaatggttaacttttaagacatgtaagtgttcttcagattttggtaattttcatctacttattcaattttcacttatttcccagagcaccttgttctgtcccaggagaagcaacttgaacctttccacacttggcttcattttctccttttctgtaaggagggagattactcagttaatttctaaaataaagtacaagatcagtattttatcccactctcagaactacactgtccagtttggtcaccaactacaggtgatagagaagcacttgacatgcaacctagctggcacaactaaggaaccaaactttagattttatttacatactggatttcaaggcgttagcacaaagacaagaatacaaaataacgtttccgttaccgttagaggtatgatttactttactacttctcgggccttctcattc

SEQ ID NO: 100123 - DNA, 2581 bp, Homo sapiens
gttgggtggctcacacctgtaatcctagcacttcgggaggacaagatgggcagatcgtttgagcctgggcaacatggcaaaaacctgtctcttccaaaaatataaaaattagccggatgtggtagcacacacctgtagttccagctactcaggaggctgaggtgggaggatggcttaagagcctggaaggcagaggttgcagtgagccaagaagccaagatcattccactgcactccagcctgggtgacagccagaccctgtcccaaaaatgtatataaacaaaaaaaagtacacagaaacaaaaaaatagaattagggttgtggcttatttcttagaactgaacttctaccagtagattctgatgggatattcattacaagcttcagaaaggtggagtttggggagaaatcgttagagttcaggttgaatcttagctatgactttcatgacaggagatcatgtataactgctttgttctttactggatcatattatgatgtattatgcagaattttcccactgtgtagcctaggaaacccagatcacttatctaaaagtcgtggttaccagttaacttctttctttctttacagaccacactgcccacgtttcagagcccagagttttctgttacaaggcaacatgaagactttgtgtggctacatgacactcttattgaaacaacagactatgctgggcttattgtgagtcttttagaaaatcaaataagctagttctttctgccttgctatgcattagtttaaaagagacttatatccactttttttaatggattgtgaaaagttagatttcatctacctactggagtatttgctgactgtcaagtggaaagtatgtgaaggaatagtgttacagctttgaggtggtgcatacaggcttacattatttacattgtaaaggggtgtgaacagtgtaatgactttagtcttacctacctttaggtttggtttttctctggtatgttttttcctatgtcagtagaattgatttctaggaaacactgctattggtaatagtttgtgataagatttctcaaaagttgctgaaggaggccatgcctttaatcctagcactttgggaggccaaggtgggtggatcacctgagctcagaattttaagacgtgcctgggcaacatgatgagaccctgtctctactaaaaatacaaaaaatttgctgggcgtggtggtgcgtacctgtagtcccagccactggggaggctgaggcatgagaatcgcttgaacttgagaggcagaggttgcagtaagccgaggccgtgccacgtcactccagcctgggtgacagagcgagactctttctcccaaaaacaaaaaaagtgctcaaggaggcagttttcagcccttgattgttatttcttggcggcaggaacagacttaactgattttaaaggagatttccacgcgttttgtcctgccaggcagactgaagaagctctccaaatgatgattgcttaatcattaaacaaaattaataccgaagcttatatttagatatgtctttcattcaaaattagagtccttgattatcctttgggattaggaaaaaattcctttggaatactgaacactttataatcttgatggctcatctttggtgcttagcattcgttgtactagttttaggcgaacactgaagcagtatagacactgttgtgctctgaacaattgtctataatggataaactgaacaaatgattgccatcaaagtgaatatgcaactctcaggaagacacctcattttaaatgtccagaagagttaaggaaggttaagaaaaaacaggagttgacttttaaatagccccacaggagtggagtggttgtctcctgtggaccagcaagagtagaatgaggcaccaactagaaaacatcgctgctgggacaagaggctcatgagttcctgcctctgctgcagattccacctgctcctacgaagcccgactttgatggtcctcgagagaagatgcagaaactgggagaaggtgaagggtctatgaccaaagaagaatttgccaagatgaaacaagaactggaagcgtaagtggattttcctggtgggctctgtcttttgagaagtagaaaagtggtgctgtgtacaaaaataagtagaagaacctgacttaattttgttttaagtgcagctgtttaattaggtccctagcgtcgttttctaaaactagtaatacatcttgcatagtgtgggacatggtctttgtacttcacacattgattcattggaggccattgacactaatacccgatagagtagttgtcttttcccatatgtagggcatacttattaaggatgctggtctggcacagtgaggaaataaacttttgtgcctttataaattgctcataatgtacaaagcttttctttcggaagcttggttactagacgttgagaagaaactagagagttgggggtttcgtcatgtgttgccccggctggtctcgaactcctgagttcaagtgatcagcttgcttttgcctcccatagtgctgagattatagtgagctgcccctgggccaggccaaatagt

SEQ ID NO: 100124 - DNA, 1038 bp, Homo sapiens
tgatctcagctcactgcaagctccgcctccagtgttcaggccattctcctgcctcagcctcccaagtagctgggactacaggtgcccgccaccacgcttagctaattttttgtatttttagtagagacggggtttcaccatgttagccaggatggtctccatctcctgaccctgtgaaccacccgccttggcctcccaaagtgctgggattacaggggtgagccgccgcgcccagctcaactgacatttctaaatgatctatgtataaactgctttttagtaactactcatttttggaataattttttagggccaaatgagtttgaaactaatacgcaaaaaatgtatttcagctgagatctgtatctgtggacctgaatgttgatccctcgcttcagattgacatacctgatgcgctcagtgagagagacaaagtcaaatttacagtgcacacaaaggtaagtaacatgcagtggtaatacatacagtgctaggttgcagccttgttattcacagtggatgtgagaagagattccctgagcttgaaacagttgctattcgtagggtagcactattaagtgagaacctccctaatctatctcacagtaagcatcaggtgagtgccattgtggcggcagcagcattctgctgtggcagagccctgggctgtgggcattgtttttttgtttttttttttttttttttttttttttttttggagacagtctcattgtgttgcccaggctggaatgaagtggcaccatcttggctcactgcagcccctgcctcccgggttcaagcaattctcctgcctcagccaccagagtagctgggattacaggcctgagccaccacactcggctcaaactcctgacctcaggtgatgcacgtgcctcagcttcccaaagtgctgggattcaaggcgtgagccagagccaccacaccgggccccagctttgtttttaatttgcatccaagggaagtttgtctctgtagcttgctttttttcagcatttactaaattgggaaagacctttc

SEQ ID NO: 100125 - DNA, 1056 bp, Homo sapiens
agagacggggtttcaccatgttggtcaggctggtctcgatctcctgacctcaagtgatctgcctaccttggcatcccaaattgctgggattgcaggcgtgagccaccacacccagccagaagtcagttttaaaacttaaattatttgagagtaggtatattttcaatttgattcttacaagtgacctaagggatctggaaaagaggtaaaactttgcatggtaaaggtccggcatgcccaaggctggacttggttctaaagcctgctttgttaactgttgtaaacggccactgtaagcattgtaacatctgtggcctaagtcagagactcaagtgttggccagcagggctaaggagtactctgagcccttcaagcttaaggggggatggaggcagaggcaagtgagaggggaagagtggagcctggcaattatttagcaagttctgtagcactgtggagtgggtttgttgactaagcagaaggaatgctgaacttttggtcacacttgatgcttcccgagtgagagtacaaatgctgacttagaagctctagtcatttcacaagtttctacccatgtttgtctcatctggagggttatatgctataatatgagaaagttcatttaacttgcgcctgggggacattgagttaatgatggcctggatgctgaggggttttgccaatactctcttttagacagttctttaaggcccaaatacaacattgcattatttgcttatttggtggttaggactgtcatgtcaagtgattggagttttgcttgaatcccttcctagggcgaaatgtctgggcaaaatggctgctagtgaacctcggatgtttgatatgctgtggttgcagtcactcataacctagtggttttcttctttttgtcttcatcacattctgaaacaaaaaatatgtttctatactaaccagaaaggaagacaggtatagtcgggggtattacctctacatggggaaagggacgaaaagagaagataattattcagaggaacgaaaagcagctaaagcagctggtagcatccattgcag

SEQ ID NO: 100126 - DNA, 2249 bp, Homo sapiens
tgctcccaggctcgagttcagtggtctgatcgtagttcactgcagactcaaaatcctgagctcaagtgatcttcccacctcagcctcccagagtgttaggagtaaaggcataggccaccgagcctaggtgattttttttaaggctttgctgtgttgcccaggcttgtctcaaactcctggccgcgggcgatcctcctgcctcagcctcccaaagtgctgggattacagacaagaacctctctgcctggctgggtttcttttattcatttgttggacctgctttcttggtagcagtggtgtattgattcccagtaggatttatctgccaggagatccttacagatcattagttcagctgttttgctttgtgaattcatttgaaagtattataatttcggtacttagtaattagatggatttcttgacatgcattagatatttaaggcagtaatttaactctggttccatgttgattccattagtacatgggcttgcagccttgtgaaatgatgattcagtttatccattcgctgagtgcgctgcactgaccttcttccaagcctcagttcctgttctaggaacttgaggctatgtagcctgaaaatgccctgcagtctgcagtgttctactgtgaactgcttgtgtgttggcaggctaccggtaagaatggttggtgtcagcagggacggggccctctgagacccatctcacaaagatgagtggtgaaaatctgatcacttgctgcagccctttagttttttattaagccgatgcctgagtagctttaatagctattagctatgttagtagactgagatcttctgttagaagtctttagttctgttttccttgggggactaagaaattatattgcaggcctgaattacaggaaggggagaaccaatggctagggaatgagagccaatacctgtaaaagcagagttgggctgggcgcggtggctcacgcctataatcccaggactttgggaggctgaggcgggcagatcacgaggtcaggagttagagaccagcctgaccaacatggtgaaaccctgtctctactaaaaatacaaaaattagctgggtggggtggtgggcgcctgtaatcccagctactcaggaggctgaggcaggagtatctgggagaattgaaccccgggggtggaggtcgcggtgagctgagactgtgccactgcactccagcctgggcaacagagtgagactccgtctcaaaaaaaaaaaaaaaaaagcagagttaatatattgcttatagttagttgaaccagttgtttctcacacaccagtgccataatctaaagctgagattgaacacagataggtacgtattagttatcttcaggatggcagagaatagtaacaattcggagcaccaatgggaacattgtttcctgagagttcaaacagtaacaaagtagcatgtgtttcctaaatatgtatcatgtgaatctttaatatttgtggacattaatacaaatctagagtgtgacagaacatctttgaattttatattctcacttaacaaatattggactaggcaaggtgtggatatctttccagctgaaaatctgatcaaggaggcaggcttcttggctccatgctaagaatcatcgatgatttgtcatattggccctcttgctggcaaaatcttagtttcttaggcagtggaatgaaacataacaaaacaaaatccctagaggctaggaacagatagtttgaaagagaagacactgtagcatgtgctgcttaagtacatatcttctgcttttggaatggaaactaggaagtcatttaaatagatatgtgtcttttttatcctatctgtagtaatttatgtgggatattcaaataggaaaatacaggctagcactgcatattgtatccatgtcttacattgtatacaaatgactattagatttaaatgactgttcaactagccccaatctaacagatcagagattgtggagtttcacttctttggactgtgtctttttcattttggcactgagtctgcagtcaccataaccacttagaaaaaactgtattttttctgttctcctggtgggttctgagttttagaatcttgccttttgtgttgttcagtcatccaggtgccctttgccctctgtaagccattaaaccttttgaagaggcagctttgctggtagagtcgtaagtgaaatttggaccaaaagtgagtttatgaagactggtgggcaggagctcaacag

SEQ ID NO: 100127 - DNA, 4215 bp, Homo sapiens
tcgggcagggaggccggcggaggcggggccgtggccgcccccgagaggcgcccaggcggcggcggcggcggcccagcttcttctttcctcgcacagccaggcggcccctgctcgagtcccgcgtcgccatggccgcggttcccgagttgctgcagcagcaggaggaggaccgcagcaaggtgaggtcctcccagcctcagactcctgggcgggcggccctgcgagctccggggtcgctgcattctttcccttgcgcgtccataggccgtggctgctcgccgccatccccagcgcgggaagcacccgtgagacccgggcggcccctctccctggtcttcactgaaggctgccccggggaatccctgtggatgtcccggattctattaggacagaaccagagacgcgggaccttagccccagctcaggcgccggtgccgagcggacttggagagatgatctctggagaccccggaatgttctttttaaaactttcctcggcttcgtggtgaccagtaggtgaacgtgaaattgacttaacatgcgacagaccagtttggtttgttgcccccaaaataccctccttccccccaccttttactgagaagacttttttggggggggggcccaaacaacttgggaaattgcatcaagcgtccgaacatgctgcttacaactttagaaacgcaaaatgcgttgttgtgggagttgtgtaatttttagtaggtgctcaaatacttgctgaacttggtgtctatttttaagtcttgcccattgatgtaaactgtccctaggtcacgtgtatcttgaggtctaaaagattatttatgcaataaattgaaattcccatagccaattaaagattcagacgagcctccactctttttcattggttctttaaatttgcctcggtagctttgcgatgcatggtttgcgagcaacctttcttgcagaatcgtcaacgtaagtttttctgaccgatgaaaaagaacctctaaaaatacaaggctctcttaaaatgtaatttggagccgtcttaacttacacatttcttgagaagttaaaggcacctccatagagaaacttgttcatctagtaagtaaataccagagtttcaaagcggctggattgttccaacaagggtatcattgcattaattattaaaatagagctttctatacaggagggtgttgtttagagtggttttttttttgaaagttctttattactaaaacaaagtggaaacttgagaccacgattctttgtaaaacattataaaggtacttttctccataaagggtagataatggattgggattttggtagcattttattttttctttctttctggtacattcttttagctgtcttgattcggagtcagctaggtaaaaggactcaattgcttcaccccactctctggtagtacagtatattgcagctggtttttaaaatgacttccaccaccctgatcctccagcaaaattggagaatggttatgaaggccatttcctgcctgttttagaggctacagaaactgtccgtatctgtagcgaagagagttacatgacattgttttcctttttacattacaggaataaagagacaataaaaataaataattaccctgacgcgtggctttatttttgttttctgatctctgctgatgctgataacctgctgtggtctggcctagatggtgttatggttaactgaaagggagtttggggcaagtatgaaataatgggaaactaagtcttgggcaactttttgccataatacaatttcggtagtcaactgaaatgttttgtgtgttacctgaaatgtgtgttacttaaattgtttaaatgccctcctgataatttactttggtttggaattctccctaaggatggagttaattaagactcactaaggtagggggacatacttgattcttcaggattttgaattctagcccaatactcattttggccaattcagcaaaactgaaagggaatactgtgtcagtcgtgtctggtagccagacactggcattttgttacattctttagccgagggtgttggggtttgccttcttcctcagaaaatagttcaggggaagagatgcatggttaatttggttcctaactggtcctctatttactggtttttgattttttttttttttttgagacggagtctcgctctgtcgtccaggctggagcgcaatggctcgatctcagctcactgcaacttccgctttctgggttcaagcgattctcctgcctcagcctctcaagtagctgggattacagtcgctcaccgccatgcccggctaatttttgtatttttgtggagaccgggtttcaccatgttggccaggctggtatttgaactcgaccttcgcagcctagtgctatttttaactagggggttctccttccttgacagtaacaacttggccttaacttactgcttggttacagggactttggtgaatgatatctgtcctcttacctactcaggagtgtttgtagactaagtactgctgctctggtttcgtgtttaactggtgtggaagctgcctctaggggtatttttgttctccattagctagaatggagtgcagttggttagtataggaacaatcctgaactttgaccaataccatagcaagtccaaacttacaaactttgtggactgaagctttatgctacccttgcaactattttctaagttgaggaagtatgacgtatcaagcttcccacgccttagttctagttcagtaacttgtactcggtgtcttaagatccccatttgtgaatactctaaaaggtcattatctgttcacattattttggccataggtagaaatggccaagaggcttttttttttttttttttgagacagggtctggctctgtcacccaggcgggagtgcagtgtcacgatcacaactcactgcagcctcgacctggggagctcaggtgatcacccccacctcagcctcctgagtagctggggctacaggcacacaccagcatgcccacctaatttttgtattttttggtagagatggggtttcaccatccagttcaacatgccgggattacaggcatgagccattgtgcttggccaaggctgttaagttttctagatttgtttctgagctgtaaactcctcattcggtgagacctagtggtcatctaaactagaggttgagtttaaaattcagtttctcaacctggggagcactgttgacattttagcctgatcacttttgttgaggagtgccctctgggttgtaggatgtgaagcaactgtttttggcctctgctaggacgcggcctcctcccctcccatggtgataagaagtcaaaattgcctgtttgagaatcactggtttaaacggacttccttctaaaatggtgtgatatgggtggggtcaggttgtgttacagaagctagtctttgtgtgcttgttgcgaatttttcaggttttctattaatcttgcctaaggaaataacatgccatgtaaaaattagcattgttggatatctttgtgagaataaagcttttccactaatactgaggaaccttaacaaaaggtggtgaaagatggttttcttcagcaggttctgggtacttgagggttgcaaagggagggcttcgtgtttgtgtttgtgagtgtaggctttggacactggaaacttacctgagtttcttgtgctgcagaggggaacttggtttaaaattctgctgtttcagcatttttctgtctttattatcagggtcttgatgctcgagcaaattaggtgagaacagatctataggttagtaccctgaatgtcttaaatagcccgtggtcacaacagtgtgtagtgaagttaaatagtatttaaggaaacagtctaacttttaatgatcccaatagtgagaaacggctattaaagtgtaaattaagtttctctgcatgatctaactttccaaaaagtggcttcttcacccttaatacctgttttctgattggccattgaggtactctgacaagatctcctaaaagagatcttcacaccttcacatgctgcctaaaggcaaaccatagtaccccaggaggagtaagttgcagtttgaggggcagccaacacttaagtttaaaaatgggggtccttggcttgactcttctttttacattttggcataacttttttaggcattcctatatggtctggaga

SEQ ID NO: 100128 - DNA, 1050 bp, Homo sapiens
ggaatacaaacataaaggccttcgaccgttgcaaatagactaaagtgaaaacaaatctgaatgaagatgaagttatttcagaccatttgcaggcagctcaggagttcaaagttttctgtggaatcagctgcccttgtggctttctctacttcctcttactcatgtggccggaagaaaaaagtgaacccatatgaagaagtggaccaagaaaaatactctaatttagttcagtctgtcttgtcatccagaggcgtcgcccagaccccgggatcggtggaggaagatgctttgctctgtggacccgtgagcaagcataagctgccaaaccaaggtgaggacagacgagtgccacaaaactggtttcctatcttcaatccagagagaagtgataaaccaaatgcaagtgatccttcagttcctttgaaaatccccttgcaaaggaatgtgataccaagtgtgacccgagtccttcagcagaccatgacaaaacaacaggttttcttgttggagaggtggaaacagcggatgattctggaactgggagaagatggctttaaagaatacacttcaagtaattatctcaattctgattctatatgtttgctatgttttctataatagagagcaacggtgtcaaaagaatgaggtttggttttgtttttttaacttactagcaaggaactcccttcagatagtaattaacattaaatagcactttatgtgtattaactcacttgatcctcatggtagtcctgtggagtatagatactgttatccacattttacagatgaaactaaaatagatcaaatatttgactaaataatacataaaattcacttgttttataagctaccaacaatattagaattgcttgttttccttgattattgaaaaaagtcacctggtaacagaattctagttgtttgctagataattctgtttagaatccagtaaatacccactgtcctacttattagcgtaaactgactcgtaaatttaaagaccttgaagcagaccagaacacatgacctatatttagaccttggtaa

SEQ ID NO: 100129 - DNA, 1968 bp, Homo sapiens
agcctgggcaacgtgacaaaactccatcattactaaaaatagaaaaatcagccggaagtggtgcccgcctcagcttcgagggtgcaacgagccgagattgtgccactgcactccagcctggacgatgggagtgggatcctgtctcaaaaaagaaaaaaaaagcacttttccaccctcttcttgggccttttttttttttcaatggctctgtaaggatcacagcccagtcttcaatgttttatctgtcatctttgtgttcttgtgtcctggtgcagtctttgatcaacctaccttagaaactgagttaggagatatcctgtagattattttatactgagtttgccctggagtaagaaggaaacgaacctaaactctggacctactgtagtgaaacgagaattgccctgtgtttcttcctaggttcaatgtggcttaattgtggtggcctacaaagatggatcacctgcccacccacatttcatggatgcagagctctgttcccagtactggaccaagtggcttcttcgactagaagaatatacggaaaagaaaaagaaccagaatattcagaaaccagaatattcagaatagggagcaagttgctatttgggaacattcagcaccttctcacagtttgggaacatatattgctgtttactccagtgtaaaaatgaggtgccactggatctgagtgctacacgaacacaagtagaagtattaatttgttgaaatgtgttgttaccaaaaagactgaaaagccccaaagtctagatataaagacctagacttcggcacgcgaaatcccagctatgctacctcttatttacctgaaaggaggacacgcaggatgggcagtcatgctggtgactcttgtactcccttgagggacattgggggggggggggcgtggtcccaggcaggatgcccagtctttgagctgagattggaaggcagtgaggctgagggtgccaagatttccccagggttcacccagaggggaaggggctacatgcccccagctgtgtgcagggaggacacatcagcccactaccgctgccaacaccaatgcctaaaacttgtttcatacattggggttttctatatatttcagctgggaaaagcttacatttaaccttttgaaaaaataaatacgtgattagcctcaactaaacattgctgactataaagacagtatattcaccatgtcgctggcaatatgtcattgcgtaacaccaaataaccccccagaagtagccagaggccagtttgaacatcacaattctaagtgttttagtaactatttctggcgtgagtcaacagatcatgtagatagagtcaattattgtttgtggagtttttcagctataggggaggggaactattaaaatccatttgtttctattcaataggtaataaaaattagttgtccctgggtttgggaaacttaaatgcccattacagccctggggaagggttttctgtcttatggagtgagtcttagcatttaagttatacagttgctgccttaaaatagtagcctgctacaatgacttctttgggtagccattttcataagaaataaaatacaagatatgagtaatgaagctttggttttgtttactttgtgtgtttataggataattttataaacctggaaattgtttgcactttttttataattcagaattttacaagcccaatagctttggtgagagttctgtgtaagtgcataaaagaaagcgtcctcggctgggcgcagtggctcacgcctgaaatcccagcactttgggaggccgaggcgggcggatcacaaggtcaggagatcgagaccatcctgggtaacacggtgaaaccccgtctctactaaaaatacaaaaaattagctgggcgtcgtggcgggcgcctgtagtcccaggtgctccggaggctgaggcaggagaatggcgtatacccggaaggcggagcttg

SEQ ID NO: 100130 - DNA, 1063 bp, Homo sapiens
gacttttactggcttcatagttgggtggttctggcttggccatgaccaaccgatgctgtgtctgtccctcatcctttcaggcattcgtccctacaaatgcaacgtctgcaataaagccttcacccagcgctgctctctggagtcccacctgaagaaaatccatggggtgcagcagcagtatgcctataagcagcggcgggacaagctctacgtctgcgaggattgcggctacacgggccccacccaggaggacctgtacctgcacgtgaacagtgcccatccgggcagctcgtttctcaaaaagacatctaaaaaactggcagcccttctgcagggcaagctgacatccgcacaccaggagaataccagcctgagtgaggaggaggagaggaagtgaggagaaggaaggggaggacagacgttcacactgccacgtatgtctacgtggatttttggttttcagcttcccccaccccactggctcttcttaattagaagtgaccagttcacctctgtgtccttttgaaacatcagcagtagggtccattccaagattgtcagttgccgttagtgacgtcaggccctgtaacctgtgtcctgtctggcgcagttgctcacattcaccaaagtttgttttcatgatcctgatggccaagaacaccgtgtgggatttttttttcccccaaggattttcacacacggaaggagaggtatttcttagagagatcatcattttatggtgccttgaaataaaaatacttctacttgaaatgctgtttaagcaaggcaagtgaattttgttattctgaaagagtttacagaaactattttaataaatgaaatgttcttgtgaagcttttaaaagcaaaatggaacattgacctacagctctctgttcagggcttattgtgtgatgtttaacttcaggttattgaggtggggaggttgattactttatattagttgtgtgggtttgaagaagcagatcttcctctctttttttgtttttgagacaagttctcactctgtcacccaggctggagtacagtggcatgatcatggc

SEQ ID NO: 100131 - DNA, 1038 bp, Homo sapiens
gggttttgccatgttggccaggctggtctcgaactcctgacctcaggtgatccacccacctcggcatcccaaagtgctgggattacaggcgtgagccaccgtgcccggccactttgcatatttaattagactaacataacttgcagattattttttcacttccaaaatacgtattgatggtggatactaacctggtagggtgaagtgataacttaggttgcacatatgtggttcttagcaaacaactgaccagtatttctagttgcatctgaaaaagcccatctctcactgaagacctgaaagagaatcagttggtcttgaatggactccattgatgtagccacattcttagtatattgaaatgtgggttttccgtctttaaattttaaactttgaaagatttaccaaagaaatatgtagaaatgcttgtaacacaaatagcattttgtttgtattataaaatacttacagtaaagaggtctgatctcctgattaaaaagccccttcttgccacactccctttctgtgtcctctcctcttccttggtgactcctgtgaatagcagttccatacgtaggagaaactttatcaaacatttgggaaggatagggaagtttttgcattcttttcctggagactcattcttatggcacaagtaaagatactatgatcgatctttgcttgttatttttctagtgttcttcagcatatactgagtacctgccagctctgagctaggccctgtggatacattggtccacaagatcagcctcattactgatgagcttggtctggtaacatgagagcagaaaactaaactggggttcatttttttttgtttttttttttttgagatggagtttcactcttgttgcccaggctggagtgcaatggcgcgatcttggctcactgcaacctctgcctcctgcattcaaacgattctcctgcttcagcctcccgagtagctggaactacaggcgtgcgccaccatgcctggctaatttttgtatttttagtagagacggggtttcaccatgt

SEQ ID NO: 100132 - DNA, 1046 bp, Homo sapiens
ctgtaaaattcataagccgaggccgcaggccagatgtgattctggaaaaaggcgaagtgattgacttttcctccttgagctcctctgaccgcaccccgctgacaagcccatctccttctccttctctggatttctctgcccctggtacacctgcctctcattctgccacacctagcttgctttcagaagcagatctgattccagatgtgatgcccccacaagccttgtttcatggtaagagtttgtttgctttgctcttttattttgggtatgggccatggtataaatgtacaagttttcaccccgtgggctgtgtgctctgcatttcttccttcctatgtcttgatgacactgttttgtactctgcacagatgacgatgagatggaaggcgatggagtcatagacccagggatggagtacgtcccaccccctgctgggtcagtagcttctgggccagtggttggggtcagaaagaaggtcagaggccctgaacagataaagcaggaggtagagagtgaggaggaaaaacccgacaggatggatattgacagtgaagacacagattcaaacacatctttgcaaacaagggctagagaaaagaggaagcctcagctggagaaggacacaaagccgaaagagcccaggtatactcccgtgagcatctacgaggaaaagctgctgctcaagaggctggaagcttgtcccggtgctgttgccatgactccggaagctcggagactgaaacgcaaactgattgtcagacaagcgaaaagggataggggattaccactttttgacttggatcaagttgttaatgctgctcttttgttagttgacgggatttatggagccaaagaaggaggaatttccagacttccagctggacaagccacgtacagaaccacctgtcaggacttcagaatccttgaccgataccaggtgaatgcaagcacttgctgtaaagcccttgggggcaggagtggaggtggggcaggcagcactaggcattggacatggttatgctgtgaccttttaaatcctgagt

SEQ ID NO: 100133 - DNA, 1060 bp, Homo sapiens
tttttgtttcttatcaattaagtggcctccttgttttattctcccatctcctaaaactttcagaattttctctttgttttttatctttaattagtgcatgttaagtgtcttttattttctctttttaaagctttgttttcttttttctattattttattttccagcacatccaaaacacagaaattgtgtttgttctcatttgtcttacttgacaactctgttcttttggtcagaggtattttatatgcttcttggcatttattctgcttggtgttcgctgaccttcctgaatgtgtggtttggtgtctgacattaaattggggatattctcagtcattattgcttcaaatttttcttctattcctttctgtcttctggtattcccattgtgtgtttattacaccttttgtagttttccgcagttctcggatagtctgttttgttcttttttttcatcttttttgtctttgcttttcagttttggaagtttttactgacagatcctcaagttcagagattctttactcagccgtgtccagtctacaaataagcccatcatcaaaggcaacctttatattggttacagtgttttttatctccagcatttctttttgattcattttcagagttttcatctctttaattgcccatctgttcttgcatattgtgtattttgtccattaagcccttaacatattaaacatattataggcatatcttgttttattcacattgctgtattgcacttcacagatactgcattttgtacaaatggaaggtttgtgacaatcttatgtcgagcaagtctgttggcaccatttttctagtagtgtgtgcttactttctgtctctgtgtctcacgttttggcagtttttgcattacttccaactttttcattattattatatcttttatggtggtctgtgatcagtgatctttgatgttagtattgtaattgttttggagcaccatgaaccacacccatatgagacaatgaacttaattggtaaatgtgtgttttctgactgttgcactaaccagctgttccccatgtttct

SEQ ID NO: 100134 - DNA, 1007 bp, Homo sapiens
aaaaaaaaaaaaaaaaagtgccaagcgctattctagcaggggatctgctgtgaactaagacagagtaggtccctgtccttaggcagggggcatccttgagcagggagctgacattaactagctcaccaggcaaataagattacatcatgcagagtgaacgcggggacagtgatgttacatcatgcagagtgaacgtggggaggagtagcgggcaggagcactgctctatgggggttcaggacggcctctctgaggaggcagcacttgaactaagtccacaaggaggagccagggtgatgaagggtcagtgtggaaggcccaggcgcaggccctgaagcaggagttgggttggtgtatgtggctggaacctggtgatggcagagggaacgggttggtggctaatgaggctactggggtgacaggggccagatcctgcaggatcctacaggtcataagtaaggagtttgaactgcattctgaacatatggtaggaagccatgtcagagttttgatcaagggaagtgaatttatgtttttagaagactctggcttctgtgtcgagagtggatagtatgggtgtaagagtgggagcagagagaccaatgggaggcagttgatccaggcagcattgggagtggtttacactagagtgggaagaagttagggagctgtataactttgatggagcttcccagaacttaccttgaggcattaaccagataatgagagtattctgtgcagtaagtagttcagtgcctggtgttacagttatctgttgctgcattataaaccactccaaaacttagtggcttttgatccctgtatcttttttctgattctgtggattgactgggcactgttgggttctttacttagtgggctgaaggctgggttcactcatgtgctgcattaacctgagagctagtttgggattggaatgaccaggagagcctctcttcctccagagtccatctccctgtggcctctagttattaactggtctagct

SEQ ID NO: 100135 - DNA, 1011 bp, Homo sapiens
agacctactttatgacacataaaaatatgatactaattatatatggaaattaaccaatcctcagagtaattttgtttcttttttttttttttttttttttgagacggagtctcgctctatcgcccaggctggagtgcagtggtgcaatctcggctcactgcaagctccgcctcctgggttcacgccattctcctgcctcagcctcccaagtagctgggactacaggcgcacctgccaccacggccggctaatttttgtatttttagtagagacagggttttaccgtgttagccaggatgatctcgatcttgtgaccttgtgatccgcctacctcagcttcccaaagtgttgggattaccggcatgagccactgtgcccagcctgagtaattatttctatataaccagtgtttctttctcatagacttccttgccgtccaggaagggatttcgacaccagaccaccaagtttttgtatcgcttggtaggatcagaagatatggctgtggaccagagtattgtcagcccttatacctctcggatcttgaaaccttatatcaggtatatggagaactagaggtgtgatgtcaggtgtgtcatgagggataatgattgtggtttctgtgccctgttctcctgttggagagaataaagatcacaaactgtgaacaacattggcaaggactgagttctgtgcttcacctccagttttgtcctttgcttgtttcaactctacttttttgcagagaacatggtcctttgaaagaaacttaaaaagcaaaaataaattaactgaaagattgctttgtgatgatcataatcattgttttatttattattattattttttttttgagacagactcttgccctgtcacccaggctgggctgcagtggtgcaatcttggctcactgtaacctctgcctccggggttcagggaattatcttgcctcagcctcccaagtagctgggattataggcatgcaccaccaagcccagctaatttttgtat

SEQ ID NO: 100136 - DNA, 1040 bp, Homo sapiens
tgaaggcacctagcacagtccctggtgggtacagagggctttggcctgatgaatgttcagagtgaattttagatttcatacataaaagtatagctgtaatcaagccagcttcgtgtaaaacagtgcaggttactttaaagtttcaagcagatcaaagagtttatatgagtcaaaaagctaggaataataccaggtatttttcttgacttgaatttgtttatcttctgtggtaccggaggcgtgattatgaaacaaagccacccaaactgcagctcctgtcacagattcgttcccacctgcacaggagcgaccctcactggacgccggagcccgacgcacctctcgattactgttatgtgcggccaaatcacatcccaacgatcaactccatgtgtcaggagtttttttggcctggtatgttccccctcccaaaccaggcaggtcatttttctgtacagtccattctagcaatttttaaaattagtttatgtgatatccttaagatttttatttatgatttcgtttagtttgtctctgctaacatggaaatattaaaatacaaatacctcttgctttcccaaaatctagaagaagccagcaataaacagtgtttttgtttgtttctcttccctgtttgtctctgtttccagagtaaaagattcatcctgttttgcttctgcatatgtttagataccaggtaatgtctatcaaagatacacagactggtagcttgggcgtgtttggacacttttgtttttggcttaataattctttatgttttgtttatttagctgttccttagagagtattagtacagccagaaggtgttttttaaaagccaaatgccctgatcacagactgagaataagggtaaacccaatataatttgtcattttatcagccttaacaaaattgcctctgaagaccaaagtcattaattaaaggaacacatttgcattgctaaatataaactattctttgtggatctgctttcccacgctgccttgaaacctaaaggaaataatacatgtctttcagat

SEQ ID NO: 100137 - DNA, 2306 bp, Homo sapiens
aggtgaagattttgactttttttgtttggtaggtataattccaaaaacaggccccattatggtgaattgtcataacaaattttggcttcctaccagaaacatctgcatttgcctcctgcttgcagatttatggcttaactttgtcatgcttattacacccgagaaaactgaagtctcagctttaatattttttctgtgatttcattagacttttgctctaatttaaagttcttattagtgaggaaaagaaatattcttaaataacaataatactgtaaacatgtatttagaaatcatcttcttcaatttctaacatgctttgatccaaaaccatcacagaaacccagattgtctgccaaatgtgaaaaaggcacagtttcaaactattctacttgtatttttacccccactgtctcttgaaacaggtaaccatgaaggataacattaatacctttgtttctaggattatagaattatgtcaccagttccctcatggaatcacagaccaagtaattcagaatgaaatgcctcatatagaagcccagcagcgggcagtagccatcaataggttgttgtctatggtaaggtgaatctaactattttgcataattactgatatgctgattatcactggtttttattatgtagttgtgatggttaatttcatgtcaacttgactaagatacaggattcctacatatctagttaaatattttattggagtgtctgtgtgggtgtttctgaaagaggttagcattttgaattggtgaacggagtaaagtagatatgggtccagttgggtgagcatcatccaatccattcagggcctaaatagaacaaagtggcagaggaagattgaattcactctttgaattcaatcttgagctgggctatgaatcttgtgccctcagcactcctggttctcagaccttcagacttggactggtatctacaccatcagctctctgctctcagccctttgatctgcaacaccagctttcctgggtctccagcttgcagagggcagatgatgggactcctcagcctccataatcacagagcaaatagcttctgatgaatctttcaagagggaggtgtatcctattggttctttttctctggagaaccctaatacagcagtcataaaacgagaaagtgtgttaggtttgactgataagactctaaaccaggaaacagctcaaactacctgaattgaaaaaagaagaaataattatgcgttataagacaaatgaaataaatgtattatggtataactgttgtatttattaattgccactgccatacataggtctagtctgttctcaccttctgtttgcttcctactgctggtgttgggccatttcccataaaatattccaccccccgattttcctatgagttgtcacagagcccagtcatcagggtttcattctccacattgtcactctgagcatttcaggaagcaagaatgagtccagttgaatgaagaatgttgggctttggggaggaagtgcagccttagcccccagtgacattgcaatggaatttatcagtgaagccattctccatctgtccagaaacaaacaagcaagactgtctaaaaacccaccaagtggtgccgatgctctaaatctcccttactttccctcatcaccaaaacatccttttcctaagagcatttcagtttggctttagtagcagttaggttaaagagttctacgccaaggcctcatctgaatgactgatttgttttttaagtctactagccttgttggatttccaagggctctggatgtggagatttggggtccgatgaatcttttcttaaacctttcccatcaattttctagctcaggagttggcaaactttttctataaagtgccagacagtatatgttttaggctttgtgagccatatgatttctgtcacaactacactgtcattttagcaagaagcagccatggatgatgatacataaacaaatggctacagccatgttccaacaaaactttggttataaaaacaagctgtggagcagattgctcacccctgttctagcccaaggacaaaggaatgttgctgatttctagttatttcactgtggtgaaggtcttcagctctaggaaagacagaggaagggattctgggaggttgtagcagtggaaaaagttcttttcttcctctgatcgccctctcagctctttccttctgactgaaaatcatcttcagcacctctcttttaccacctctgccaccacccacccactgcgagtcctattggctataggttgtatgcaggcagtag

SEQ ID NO: 100138 - DNA, 1409 bp, Homo sapiens
tgcatgccatcaggcccggctaattatttttgtatttttagtagggacagagtttcaccatgttggccaggctggtctcaaactcctgagctcaggtgacccacctgcctcggcctccctaagtgctgggattacaggcatgagccaccatgcccagccctttccataagttttttaaaagtttgccacactgggattccaagaaatttctagttagaaattataaatcattataataagtcttacaaagcattatacttatttattgtttagcatacttttgctactttagccagcattctttactgttagctttatactgctagctttggaatgagacacaagttagaggaataacattaaaaatccatgaaaaccagagttcaacttattttactttactttcttataggaatatggagcagagatatccgctataaaagtaatttgccattaacagaaatcaacaaaattctgaagaatctggaaagtaaaaagcttatcaaagctgttaagtctgtagcagtgagtagtcctttcctcagatacccacttacatatgttgcttcaagtttttattcttgaagttatgtcatgatttagaacagctggtcaaaaaagacttaaaaatttagctcatgttggattggtttggagatgctgcttagacttgtccctacacagttagctcttggtgtctcactcacccactcaaaaatctaaaactactttactgtcttcagtgaagaatctttggaactgtgaacatttttcctagattttgtggtgtgtaagataatttactttatcccgacatattagctttctcattcaacaaagagtgtttgctgtgtgccagacactgttttgagtgcttgggatacattaatgaacaagtcgtagaaagatccctgccttggtggagcttctcttctagtacacgtgtgtttttcctgctcctcatcctgccccacccctgctccagagctggctccctcggggacatctgcccctgacctcactgatttagacatcagaggaactgagattcccctagaataaagtttgcttcaatacacatttcataagaattacagctataattcaaattttataatttcagagctgttaggtctgtggcagtgagtagacctttcctcaaatatccgcttacatatgttgcttcaagtttttatttttgaataaaacaagaattataagaattataacatcacttataagaatttgatgcttattagtgattttatttatcagaatagcatttcccttccacattgtttaatggataatttcaaatatatacaaaggtagaaaaaatcatataataaaaccctatcatgtagcctcattttgtcagtcctccttctacatctttatgtttaataaca

SEQ ID NO: 100139 - DNA, 1136 bp, Homo sapiens
gagcatagcaaagggatacaggaaccaagtgaaaagcttccaatgcccaaagcattccaaagcttccagtgtgggaataacaatgaagtatctgaatgtaaatcaaagtataaaataaatactcatgagtccatagtgatagaaatacggtgtttgagaaactgtcacaactaaaagaagcctgagagagatgactaaatgtagtatgatgtcctggatggaatcctggagcagaaaaggaacattaggactaatgaaatctgaataaagtatggcatttagttagtaatgatttatcaatattagttcattaattgtgacaagtgtaccacactaatccaagatgttaaaaataggggaaacagcatgatgtatataggagctctgtgtactatctttgcaataattttgtacatcttaaactgttccaaaatataggtgtttttgtttttggaaattgttatcttataaacacatgaactgtgcatgttctttcctaggcctcaaaaaagaaggtgtatatgctctataacctgcagccagaccggtctgtgactggtggagcctggtacagtgaccaggattttgaatctgaatttgtagaggtgcttaaccaacagtgttttaaattcctacagtccaaggtgaggtatgattgaggaaacatcactgcaaaccctcttgtaaaaagtttttcacaaaggattttaatctatttatcatattttataggaattaaaaacctgaaattgggaatttttacttaactaaatatgttctgttgttggtttgactcagtataaagtgtattcagaaaacacaccaatattcttatttacatttcttatgtttcaatccttataggcagaaacagcacgagaaagcaaacagaacccaatgatacaaagaaatagttcatttgcctcatcacatgaagtgtggaaatatatctgcgaattgggaatcagtaaggtcagaactgaatttcatcttattttttaaaacttattctttgtcacatacaatgtattccaaacatgtatttgacccacattgttttttttttttgagatgatagctacgaacattctgcagaatccactttgggaaaatactgtcctgtatcttaggcaaag

SEQ ID NO: 100140 - DNA, 1080 bp, Homo sapiens
gctttaaattactccaccccagcataatgtttctcccatttcacagcagaattatgaccctttactgttttatttatttatttgagatggagtttggctcttgttgcccaggctggagtacagtagtgcgatctcagctcactgcaacttccgtctcccgggttcaagccattctcctgcctcagcctcccgagtaggtgggattacaagtgcctgccaccatacccagctaattgtatttttagtagagacagggttttgccatgttggccaggctggtctcgaactcctgacctcaagtgatccacctgcctcggcttcccaaagtgctgggattacaggcgtgagccactgcgcccagcaaccctttactgtttttaacaccctccaagtggatgtctccctatcctacttgtgtcctttctgatgtatcccttttttaggtagagttatccatggaagacattgaaaccatcctgaatacactcatttatgatggaaaagtggagatgacgattattgctgcaaaagaaggcacagttggcagtgtagatggacacatgaaactgtacagggcagtcaatccaatcatccctcccacaggtttggtccgggcaccctgtggactctgcccggtgagttaaagtggcttcactttacacttgactgcccacgggtgcaagtgccacattaagaaacagagcaagcacagcccagttttctcagactcttagggttgaccaagagctattcaaacctccatgaaaccttgatgaacagacctttaatgaacacatcattcctttacttttttttttttttttttttttgagacggagtctcactctatcaccgaggctggagtgcagtggcacaatcttgactcattgcaacctccaactcccgggttcaagcagctctcctgcctcagccacctgagtacctgagattataggcacccaccaccatgcccagctaattttttttatttttagtggagacggggtttcaccatgttggccaggctggtctcgaactcctgacctcaggtgatcccctcagcctcccaaagtgctgaga

SEQ ID NO: 100141 - DNA, 1025 bp, Homo sapiens
agcctctctactactcctaacttgatgatcacaaagcaggccctattatagtatgttcttcccgctcccccctcgccccccgagatggagtcttgctgtcgcccaggctggagtgcagtggcacgatcttggctcactacaacctctgcctcccaggttcaagcaattctcctgcctcagcctcccgagtagctgggattacaggtgcctgccaccacgctcagctaatttttgtattcttagtagagacggggtttcaccatgttagccaggatggtcttgaccacccacctcggcctcccaaagtgctgggattacaggtgtgagccactgcgtccggctataatatgttcttaagtacagtcctagtccctttcagtttgaaagttttgtttttaatcttgctttaaataagtggttgggtcttagatattttaaaactttaatttgaatataatttttttttcttttttaaaggtttttgatgactgccacgaaggtggtgagatttcaccatctaactgtatttacatgacagagtggctcgaattttaatagagagctatgaactttattgacattttgcaaatgaagttacttagggagcagataatttaattcatgatggaacacgaaatctccttgaaagcaaacttcacaataatggacgtagacttgctgctatgaaaacatattttttttatttatgaagactaaatttatattggtaaaatagccagtagaatatgaaagaaataaggttagtagtgaaattcattcttcaataaataaaacactttgaaactccggaggaccacatctttcaagacttctgatgggtcaaggaaaaagatgccaacatacccgtatttaccaagtactatgataatggctagagtataaaaatgttctttttaaagttatttattaagttcttcattggaagtttttttttatatctggttcactaccaccattttctgtttcctactttctcagtggtttcattgaaaagaaattagaag

SEQ ID NO: 100142 - DNA, 1111 bp, Homo sapiens
actcaaatgtattctttgttagaatttaccctagattcttatttaatgtctgcagtagactgaatgtttgtgtgcccccagaattctaatgttgaaatctcatttccaatgtgatggtatttggaggtggggcttttggtaagtgataggtcaggagagtaacagcgctcatgaatgggattagtgcccttatataaagagacccagagagctccatcaccccttctgccatgtgaaagggagaagacaaacatccacgaaccaggaagtgggtcctcaccagaaaacaaatctgtaagcaccttgatcttggacttctcagcctccagaattgtgagaaataaatttctgttgttgataaaccaccagtctatggtattctgttatagcattaactgaaactaaatatactccgtgccctccattcacactttattttgagagaggggataacattctttttctcttactctgttttagatttatttcccttccttattctgttctaaatcatggtgtgatgtgtctaagcagaaagccattataattgtcctcagttctaataacactttcagttcctatggtcagccacatagaaaacactaggttatttgatgtattgttgcacagaagttgactgtgcggctttttagaattgcagcttcatattttcactttgtagctccacttagaagtttctgtatccaagccaaaaacatgggacccatggaaaggaattcaagctccactagtactgagggttgggttctaataccagtttggagatgctctaagtggatatcagaagagttattttaagataaatggtatcagtaaaataaaattcaggccacattctgtgaattagcatttgatgacactagctctttgtaacaaaaattatttcaagtattgaatatacatacatatataagatacacagccttttggccagaacccccatcttccagtaatttgccaaaatgatgaacacaaacggaaagaggagaggcacccgatatatgttctctaggacttttagaaaacatggagttgttcctttggtcacgtatatgcgaatctataagaaaggtgatattgtagacatcaa

SEQ ID NO: 100143 - DNA, 1101 bp, Homo sapiens
cagacacttcaaggggaatagaaagccatgcagtgtctagggccagagtatcccaggtagaaggatgagagcaggctaagatgtgcatgtacttggcatgttccaggaactgcaatgaggtcagtaaacctggctgggaggagagaaggagagtctgtagagacagaatcagagctgactgatgggaagctactggggtttgcagccacttatgctttaaaaggatcactgcatctcaataagagcagattttttgttttctttcaatccactagcaaaaccaggaaggaattaggacagattatgttaccactttagaggtcagcactgtttcctctgcaacagaaatttaagatatacgcaaggtatttctcaagcaagcatgactggagcccacaaaggggatagcagtttaacaaagatcgcacctcatggccgcgatggccccagaactgtggccaatgatgatagtcttctcatcacagtgcagctctgtctccatgaagggcagccagatgctctctcgtgctgtaacttaaggttcagggtaaagaaaaagtctgtcatttgatagtggcagtctgaatccaacgctgccccacctttcaaacaggcaactattcagcagttcacaacttttaaaactgcaggaccacagcaggagaccagactgtattaacaaaaccaaagatttatgtattactacttgaaagatccaagtccacagttttggtaactagtttttcttttctcttttttttttttttttttggtttaccatgttcttgtaagaaaatactaaggaaataataaaatataactctgaaattttaatgtaaactttcaaacttgaaaaaaaaagctaatggtcaggtgcagtggttcacacctataatcccaacactttgggaggctgaggtggacagatcatttgaggtcaggagttcgagaccagcctgcccaaatgctgaaaccccgtctctgctaaaaatacaaaaaaaattagccaggcgtgatggcgcatgcctgtaatcccagctacttgggaggctgacacaggagaatcacttgaacccaggaggcagaggttgcagtgagcca

SEQ ID NO: 100144 - DNA, 1043 bp, Homo sapiens
tttttttgacatttagttcagaatttcacataccattaaggtaattaaagttttatcttcagttcccttttagactatggcgacatacctggagttcatccagcagaatgaagaacgggatggtgtgcgttttagttggaacgtgtggccttccagccggctggaggctacaagaatggttgtacccctggcttgtctccttactcctttgaaagaacgtccagacctacctcctgtacaatatgaacctgtgctttgcagcaggccaacttgtaaagctgttctcaacccactttggtatggattcttttgaaactggtaaaaatgataaatacaatatattatgaattttatgtgatgctcataaaagtcattaaatttgggcaggtcatcaaatttgtgataagtagtagatgatgagactcctaaacgattcttgtggtgagtagtaagtggtgaatatttgtagaaatctccctggcctgataattccagataaaattggaatcttacaggaatgaggtagaggtagagggagaggatttgtaattcactttttttttggctgataatcagtttgcttttggcttaactgtagactttattgattcctcttaaagtaatttcccagaagaattcgaaagcttagaccgtcttctcatgcttcccgggtacagtgatgctatatggcaaggagaagtagcaggcagaagaaattttaactgttaacaatttgttaagtgtaattttttttttttttgtgcctgagatagtgacctatttcttttaaatgtgggcattatttgaaatgatttttaaacaggtagagagtgtcataaaatttttatatgagggaacattttttacttcattctcattgcttttatttaatgtgcccatatgtgaatgcatagccactggttattaattttctaaatgtagaaaataagggaaaagtaactgaagcattatcttgaaccaatttgaggaagtgaaatgtgcttgcccaacttttcttaaaatgggctaagtcaggttaaaaa

SEQ ID NO: 100145 - DNA, 1045 bp, Homo sapiens
ccatgttggcagcctggtcttgaactcctgtgcttaagcaatcctcccatcttagcctcccaaagtgctgggattacaggcatgaacccggctcatatgctactttctaaatgaggctgccctgatttctctgtttaacagttgactctgccctctgcctctcctcctggtgtttgcagtcccccttaacctctccattccagaaagtttgctccttgaggcaggtagaagtctttgttttttctgttcactgtgtgtcccaggacctgaaacaatgtctagcatgtaggaagtattaaaaaatgttggcaaagttgttggatacaaatagtttttatctttagtttgatttaataaaatctaagtcatttaataagttagagctttgtatagatgtccttatctcctaaaactaaatatagatgaagacttacaattttcatacctaatttgccttaaaaagtgctggttaagtctatttgtatattgatcattatgctgtttttctttgcccaaagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggtttgtaccttacttgtacaggagcagaaacaaggacttttttttaaaagagactggggtctctttaaaagagcctgtagcccaggctggagttcagtggtgtgatcattgctcaatggctcaagccattggcccacctcagcctcatgagtaggtgggactagaggcacatgccaccacacccagctgaggacatttcttaaaaattagtcattcacttttagtgtcattggaaatgaatctttttggcttttttttttttaaggatatgttgggcctgaccaagccag

SEQ ID NO: 100146 - DNA, 1015 bp, Homo sapiens
gtactaaaaatacaaaaattagctgggcatggtggcatgtgcctgtaatttcagctactcgggaggctgaggcacgagaatccgttgaacctgggaggcagaggttgcagtgagctgagatcgtgccactgcactccagcctgggtgacggagtgagactgtctcaaaaagtaaataaaaataaaaatacaaaaatttgctggggatggtggcgcacgcttttaatcccagctacttgggaggctgaggcaggatgatcacttgaacccgggaggtggagatcgcaccactgcactctagcctgggcaacagagagagactctgtcacaaaaagagaaaagaaaatgatttacatgtttttatatttgattacctccttcggtaattcaggcataccttgggaataatgtcactgtttcctaaagatagctttcctctcttcacagcactatgagatgcttgctaatcgaacagctgcaaatggtcactgcattgatatttatgcttgtgcccttgatcaaactggacttttggagatgaagtgttgtgcaaatcttactgggtatgttgacagtgaaaacctgggcagagtgacagtgttattttaaggaaagagaaattagtgatggagccataggaatgggcaaggccaactcagagaagctttcaggtagctctgggctatggtttcagtgactggggagggcctgtgggctccttggagagggaagtagtgattagtaggagggctcaagagttcactacaaataagtcgtttcagagtaacttatttcttccttagagttgttaacacttttacagagaccaggccaagaaagcaagcagcatggactatctggccttcatcagggcacttccttttgagaattggggaaaacagggtctgaatgctgaaacaactaggataaacctggctaagtggccatactttgtgactaactccaagtgcactcagcctagaggttgtactgactcaaagcctgagtcagtattg

SEQ ID NO: 100147 - DNA, 1949 bp, Homo sapiens
tcagcctgggcaacagagttgccagttggcggggcaggtcaggggccgtcattagaagatacgattggaattattacttggagaattagagataattattaaatcatctaggttagactttaaaccataatcttaaatgcttgagggttttcttttaaagatggacttttgaaatgaattcacattttaaaaatctaagtatgttggccttgtcgttatattggagttcatgaattaagtatttttaaagcaacacaaaacagtatgttctctgattaggtatatgcaaataattatggatatacatgaatgtgaatatattcatacaagggattggaaaagaatgtagtattgttagaattgttatctacatgtacagtaatttccaagtttaaaaagtaagttgtgagagttgaaaatgctcatgtttcaagtgtttctaagggtggattttattaaagttctaatcacagtggctgaggaaaagtttgtaggactaagcagttatgatccctgtggagttttctcttggcagaatagtagtgttatattttccctctaagctttcattgtggccatgatgacagcagggtggattgaagtgatctttaactttacactgtcacatatttgttatagacctctcgggaactgaagattgcaggagccattggtccatgcgtatctctgaatgtgaaaggaccgtgtgtgtcagaaaatgtaaggaaaacaactccatcaccctcacctcctgccccggatttaacccgtcagaagtgtcagagcatgatgatctcacatgtgtcacctgttggatgtgtctgcagtgacaggagaagggctaaccctcactgatgactatactcggagaggtggtgttattccatctgttcatccaaagggttagagagaaggaaactgaggcccagaaaggttcagtatcttgctcagggtcagaactgacatgaaggagttagagcccaggtgcccctgactccaccacccatggtcgttgtgccaaagccacggcatgctgttcagcacaaggcaaacattcagcacagtccttccagagtaagcctattgctcattgcccttagaggtgatacgtttgtctcactcagctaataacaagccttttacaacagagaccaccatgagttggtgtggaagtgggtgacactgctgtgtgtgcagacatctgttttctctagtaatagtttttgagaacaatttagttatcatttgagatgagcggctttgcttattgtccacttcctctgattatactttacttgctaggaggcaaaccattcggtttggcaaggcctctctaaggtggtcctgggctggggttacacagtcatgttcttccctcattgtcaccatcaatgggagggtagaccatagagccagatgtggatccaaggtgcaggtttacaccccgcacctggcccgagcaaaggacttatttgctctgtgattcagtatccttatctggcaaatggggataataacagtgcccactctacagcattgttaggaggtttaaatgagttggttcaggtgaagcagttagtgcctggcacactggaagtgtgggtcttctttcatgttgtcagcaacaaacgttcttgggtgaccacataaattaaacttttgttgagcttggcagaggcaaggtgatttgagagcacattcctgtagccttctgagtgaggcagattgctgccctaaagcccatctgatgagtcattcattacccccagagtactaaggggcttgtacccctatttcctggcaaggctttggaaggctgccttgttataaaatatttttcatggacttaaaatctgcctgctgaaggcttcttgaagtagtttaagaaggtatttttatgaattagtacaaactaattaatatttctagtagaattcagccatgaaagt

SEQ ID NO: 100148 - DNA, 1085 bp, Homo sapiens
cccaggtagctgggaccacaggcacctgccaccaaaactagctaatctttttacttttatgcagagagatggtgatctcacattgttgcccaggctggtcttgaacttctaggctcaagcagtcctgccaccttgccctcccaaagtgttgggatttcaggaatgagccactgcacctagcctgtgtttctttttctgaatggatgtctggctttctgatctctcctaaacataagcatggcactaactctggaattgtcagttgggcagatgtacagagtcagctcaggcacatagaagcagcatttgaccaggaggctgcggcagtgttgatggcacggcttggggtgttccgagcggagtcagaggaggggcccgatgtgctccggtggctggaccgacaactcatccgactggtaaattggggacagtggcattaggttcagtcttggtttctgctttactttcgagaagaaaattgtcacttaattattattatatagtgaatcagcaagaatttatcagttgcctaccttatgctgcacgctggacattctgttaaagacgtgttaaatgtgcattttcccctcagagatttacattatagttgggaagaaacaacacgcatggagcatttggagagtgatacaaatctgtgtgggttgagttgacttagatgagtcattttgtgaatgctctggtcttgtatttttcttctaaatctggaaagtggttttggaaatagggatccagcctggtaagtttagggagatgccttttatcagtctggatttaatgagatgagagaagtcacactgtaatttaaatggggaaagtcttttataaagaatacaacaagagagtagaacagtgagggactggctagaaggaagtatagagaagtgggcagccactacttgtggggctgagatagagcaccaaaggaagtgcccttctccccagggctgatccagacctagttgggagggcatggccatggcttggtgagtcttttgcagagaagttaccgtggtgctgtgccaggggaacttactagaaattcactttctagaatttgaagaaaa

SEQ ID NO: 100149 - DNA, 1027 bp, Homo sapiens
tgagcagaaataaaggcgggaagagaaaacattgtggttcagaagtctgccattgggagaaataaatttgagttttagtgtgagagaacatcaaagcgtaactataattgttagttttcatggtgttagagggttttcatatggaacaggtgcctggaagagctcacctagcttctctggttagggcagtcctcaggccagcattgcctgagagctgattagagatgcagaatcttcagctcctccctagagtctgcattttaacaagatcccctggtcatttgcctgctcactgatgcttgagaagtgctagtctaggacttatagtaagtggcagagttcagactggatgtagcttagtccaggaatatttccaggtaatgctaacttagatttttctctctctttttgtgtgtgtttgtttgttttttggtattttctttccatagtgtcaaaagtttggacagtataacaaagaagaccccacttcttttaggttatcagattccttttctctatatcctcaggtaagtaatgtatgtttctaaaataactacagagcaataaattttgatagaaattaactttattcttagggtaaagtgaagactttttaatgtgttgagactcagtctgtaggtgacagagattgttcaacccaagtcgaatatgtgtctaggcaagacagcaccctacgccctacagaagatagagatgacatgcagaggggagaaaactcatgcatacattttcatgaacaggcaaaataggatcattgatataaggccgtaaaaaatatctctcatgtgtagaagttctggggaaacagctacctcagcaacaaaccaagaaaatgagcacacatggagatgaagataacaaaacaaaaccacagttagtacaacaaatatttaataatatgtctgtggttattatgtgcatcataaccaggagtgagcaataagcagctcctgaaagtaactgcactctgcatgaaccaagcctttggaagccattggacaagaga

SEQ ID NO: 100150 - DNA, 1008 bp, Homo sapiens
acccgggtaattttggatttttagtagagacggggtttctccatgttggtcaggctggtcttgaactcccgacctcaggtgatccgcccgcctcggcctcccaaagtgctgggattacaggcgtgagccaccacgcctggccaaaggccctttaaaaaaaaaaattaatttttaatgtggtaaaacacacataacaaaatttaccatcttaaccatttttaagcataccgttgagtagtgttacgtgtattcccattattgagcaactgatgtctagaatttttcactttgcagagctgaaactctgtgctcattaagcaacaactctcagttttcctctttccctagcccctggtgcccccttatgctttctgttctgtgaaaccagagagcccttttctgggttctcctatttcagagccctgaggtagatctactctgtgggtgtctaagaaggttacaattatatgcatttctctttccgttctttgtgaatgcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagaggtgaggctctacccaaatgctttcctgaggattggaatcacctaacatatattcttttttaagcaaatttacttagcagaactgtaaaaaagaagtaaaatttggagtttttatagtaatttaacattatttctattaaaaaatacctttaggaaaatgtcaaaggacatataaagctattatttgtgaaaggcaggaataaatgtaaaaaactctaggaaataacttggatgctttctttttccttgtgcttgtatacttacatccaacaattccatgtcttgtatctgaaggaaagactcctagatacagagtagactttgtgccaaaaaaaaaaatagtaaag

SEQ ID NO: 100151 - DNA, 1049 bp, Homo sapiens
tttaaagagttaactatttccagcttttttctacgtaaagtgtattattgtgtgtgtgtgtatatatatatatatttttaatttctttacaaaattggaatcttactacaaattgaggtttctattcaatttttcccataacattaataaaattataagctttttctgatatttgaaatatccatctgttcagtggagataccagttcactcgtttgtgggtacaccattatccagcttctgtggtaagcagagcacttaagaggaaaggcaggcatatgggcctccgtgagctcacagtggtggggagctagaccctgggtacttcatcaggactatggagaagagggtaaagtaaaacgcctgatgctcaaaactagcaggcggtggtggcctgatctcggcataccaggaaaggattttgtgaggaaattgtgctttagtcaaaagaagttgttcgtgaggcagaggatggggtgatgggagtactcgtagcagaggggacaacacctgtgaatgttctgagggaaggtgcttgacagctcatgaattctaatcagcttctaagatatctgccaactaatctttatcattacatttcaggaaactggagcacccatcctaactgatgatgttagcctgcaggtgttcatggaccatttgaagaagctggctgtctccagtgcctgttaagctgaggatacaaccaggaaatgcaacggtgtcagattgtgttcaaaatgtctagaaaggcttgataacattcctgttacttttctagcagattttaacaaataatcaaggacattttatatgtaactctttagattataatttatttgtattcctgtctttgtcctttttcttgcactataaaattataaggtcataaatgttttggtacttgtagatgtttatgtgctttttgtatcctaacttttagaatctaaataaaatcagaggtaatgtattttggcagcttgtttaggtgagaatcttaatgatcataaaggaaataaatctagatgcagaaagtactggctaaaatat

SEQ ID NO: 100152 - DNA, 1064 bp, Homo sapiens
aaaatcatttatgatatgaacattttccactttgtgcttcctgtatactgtgttaccatattttttgatattctgcaaaaggcaggaatctcttttctgagaattaatatagctgagctggcttctctgggggaggaaaacacagttctgtttttatagatgggcaaacttgaccatagaaaattttgggtgtcttacccaaggtaacatagatgaaatatggccctaagatcctgcttaatggttgttcactttacagctcccattcattccagagataaaatcagaatggatgggaattattatcatctcactgcatttatgtaactcttttcattttcgaatacgtactgactttaaccaaagaagttataagaagtatgtatgatgtttaaaatactcctatggttacttaaaagtgctttatgaccttgtttggttctgagttcttctctcccttttggttcctttctagttggaggagagcagattagtgccattggaaggggcatatgtgtgttgctgggtatttccctggaggatacgcagaaggaactggaacacatgtaagatgcatttctgtcattgctgtttgagtgggctatgtggtggtggtcatgctgggaacttccatagtactttgtgcctgtgaggtgagcccctgtcacttttaaccattgtcccattggatgtagtatggttatctccgtgtttcagagaagaccgaggaagaatgatttaggagacctcaacgctaagtcagcctttgagcaggagcaccgcctgtcccctgtctgtttgctactgtggcctcagagcatgcctcttgttctcttaacgcaaaaaccaagcctcttttcttatgtttggtttctcttttttaaattgggcagttatctgggcactatgtatttttagaatgtctactagctcgctgtgcacatagggatctagaactcagagaggttaaattgcttgccccagatcatgcacacacacttagcaaaaagcctgaaccccagttagagtctgggctccctgaccttgaagccagtgatcttttt

SEQ ID NO: 100153 - DNA, 1003 bp, Homo sapiens
tcaattggaagaaataaagataatttttaaaagaagatacaggcataggtagaaagaaacttctgttcagtgttgttacaatccaagtaagtaaggtgacttgggatgaaacgaaaagtctgaatcattcagcaggaggaatgggaagagttcaaaaccttattgattcagggactacgaattcagaaaaaaattatatataatatatataatattagatatataatttttaataatgtgtatatataatataatgtatatacatatacacacacatatatatttgtgaccatatatatgagggtttacttctggactcacagttctagttcattgttctatgtttctgtacttacacagtaccatactgttttgattactgtaactttgtagtaagttttgaaattgggaggtgtgagtcctctaactttattcttctaattaatgattgaataggtagtaggatgaggtagttcagacatcaaaatgatatgaaaaggtctaaactggaaaggtttgctctcattcgtgtctctgtccagcctgtttttcttgctctctagaggtaattacttttattatttttttctatccatctatccatttgcaaatgtgagcaaatatgaattttaaaaatattcccctttctatacaaaaggtatgatgtgatgtactgttttatatcttggctttaaaaaaaaattcacagtgtgtcctagagattcttttcataccagttcatagagacttctttctttttttttctcttctattctgaacaaattaaatctctctttttaaactgctgtgtactgttctgtggcaggaccatagcctggcttatttaatagatcttgtattgttggactcctggattatttctaatttatgtctcttaaaaacaacagtgacatgatgaatacatttgtacatatgccacttcatatgcagtcgggagatacctgttggagaaattctcagaaatgggatagacggtgccaga

SEQ ID NO: 100154 - DNA, 1088 bp, Homo sapiens
ctttgagccaggcgtctgctgctgtgttgtcccagtggtggttcactggcactggcccagcctctggggcactggggatgccaaggaacactcctgtctctgtagaagcagccctgtacttgaggtcagaaccaccatggatgctagcggcttccagagtcatactcccaaaggctctaggcacaatcctgcgcatccagatcaaactcctctagcaggcagtggctccagcctggccccaggcttattttgaacccctcaatgccactgatttgcttaatttcttgaggtcccagcctgtaacccactgttggggtttccatcagtaacagcctcctgcctgctcaggttctgaacagattgaaagtagaatgaagaggaagcctgtggggtgagaatgcctccttggtggcagataactgcctttaggggatgtgcttagatgggctgacctgaggcttactgtctagtgcccatgtcccatactggtccccaaaggttggctgaggtccagcccattcatggccacacagggccagctctggagagcagcgaatgtgggcttgctcccagccaggccaagaagcattggtacacgccttttgttctccccatttttctttcagagtatacttttttggcataatatttttctgtcccatccctgcaatttgcgcatatactaccatggacagtggtaggcatgacaatagtaataatagtgactatgatttcctgtacactcactgtgctgggctgtgtactaacctatgtgcacctttgtaaccatcccaggacaactgtcctgttgcaccagaacaaactggggcccggagaggtggtgtgagccttcttggctggtggctaaagtcagtgaagcattgtccagaggggcatggacaccagtttttgtagctacacagagaatctgcagggaggcactctggtttacagctgttagggccttgaaaagttctgctggagatgagttcatgggtggttagtctccagctgagagctttcctgctttaaacatgcagcataagcgtgtctaacatgtgcttaacctgcagctctgggtagaaaga

SEQ ID NO: 100155 - DNA, 1033 bp, Homo sapiens
tcaattaagcttttaattctcagtgttttatttttccattatattccaatcagtaatgaaaactgctacaattacattaaagaaaaatggttcttttggcaaatttcaacgttatagaaaaatgattcttttagcaggttcttttaaaatataaataagttctttaaactatctgaacaaatggatgatgtgtgtgtgtatatggatgtatatgtgtgcatgggtatgtgtgcatatgtgtatgtgtgtgtatgtgtgtgtgtatatgtgatgtgtgtgcccatgtgcatgtgcatgtgggtatgtgtgcatgcatttgtgtatgtatgtaagcaccaagtgtcgttttggtatttgatggtgtgctaggcactgtgaggaagagaaggaactgctgctgcccagcctgtgcagccggggatagattttgggcaacataaacctgaaaggttaatgacagtgaaagaggtggacagcataagacaacttaggaaaggttacaagaccattcagtttgtgctcctccttagaactcttcagtgccttccaagtgcattttgctgaagccttgcattccttgctgtcatttgccaaggcctaagtgaccaggcgtccgtggccctttcttgcctgctctgtggctgtctttccctccatccctatgcttcacctactgcatctgctgttgcctcctctcccttgctgagaagagggtcaagctctttcctacctcggagctcttgtctcaattccagggtctccccctccttctccaagaatctctgacccccacagttcccaggaagccccttcggctactctactctgccctgttgctctgatggtgtatttcacagacttcacaccatctgctatcatggtccacaccactcataaaactcaagctccctgagtgttgttcactgccctgtccagggaggtgtgtgtgggtgggaggggtggtgtttgtttagcagtggtgctcacagctggtgggctgtggtgtctatgaatgtcctgagttcagagaagg

SEQ ID NO: 100156 - DNA, 1018 bp, Homo sapiens
ttatcagcaagcattaatccctgagcctggaccttggaatgtcaagattgagacattcatggcttttgtaggatctgaaagaaatatgtagggtaagggggtgtgggggaaaagaattacatttggttttatttatttatacttccagtgacaggggcagccttttgattacctgctgtggaatccagaggtgaaatgaaggacacatgagcacacaggtggcttgcttctaccaggtggccccatcacaggtgcacagaggggagctctcacttgctgcatatttcagtttgggggacaaatcaaatgagaagtactctgaatataaggaagaattatgttgttgctaataactttgcatctcttcatggaagaacagttatttaaatgtactccttttcactctgtttttaggcttgaattctagattctagctccctaattgtggttggtttcagcttcagtgttcacatggcctgaaccaagctcgagttgttgacttgctgcaggagtatgttttaaagtctggttgccaagatggtagccagatcttgtcaattactccagaaatattagttcattttgtcatattaatttattgaacaaacgctgactgagggtccagctttgtttatgctgaagtatcaccaaaacagaagtgggaactcagcaaagcgtcctcattacagagttgttgctgttgtgcagtctttgtcagtgacgctgacttctgggacgtaggctgccacatggaaggcctcctaccagggctagggcgccacctggccagacctctcaccacacatggaatcacctggatttctgatcctttctgtctgagcacctgctttccatgaattatgagatcagctcagccctctggggagtgagttgggtgtagagatggtggagctcctgacctcactcagcccagcccactgctctgcacagtcagaatttatcctgagtccttgtcagtgcctgggggaatgcctgcctattgcatgaatatttggta

SEQ ID NO: 100157 - DNA, 1418 bp, Homo sapiens
ttagcacatgttaatatgggctctacaatctttaagttggtagaattattttattcaataaatggctaaactgggagttttacagggacttgttctaagttagcatctcactgagtgagaattattgttaacgataaagttgcctcaaaactatgtagctttctccaagaaggagatattttgggaaaactgtcaggtttaacaaacagaacatgtatacctcccagatgtgacctgtgaataaaataccaggtaggctcagccaacttttcttttatgcttctttcatgtctttcttaatagaatttaataaaatgaaacaggaggaggaatcatcaaaggttaggaataatagacctgaaagagttgcttggaacctgtgtagattcatttctcatcttggttcctttacttggcatcaggtgagatgagacatccattcaggaattcattccaagtctatttcagtacccaggatagatttgagataaatcagttccatactgaggtgtgacattaggcaaatcaagggaaggaggaggaaaggaatcaggtcagagctcagcttactttattcaaccgtggcgtatggggccaggcgcagtggctcacatctataatcccaagactttgggagcccaaggcaggaatatcgcatgagcccaggagtttgagacctgcctgtgcaacatagcaagactccatctctacaaataataataaaaaaaaattagcagaatgtggtggtgcacgtttgtagtcccagccagtcggaaggctgaggcgaagaatcacttgaacccagggggttgaggccacagtgagccatgatcgtgtgtctggactccagcttgggcaacaaagtgagaacttgtctgtaaatcaaccgatcaatgaatcaatcaatcaatcacctgtggtacatggagttctataaagataggtagatagatgagagatagagagagagaaattcgggacttggagaggagtgcagcatcaggagttttattgaagcatctaattttcacctgcagaaatggaaacaaggaggaactggtctcctaatttacatacccgcagggagaaatctgtgtgtaactctagattgcagtgcccggagcagaagcagaggcatgtggccagttgtgtcttcctaccagttctggaaaaatgagatagacttagataccagctcctgcaagctttggaggtgtggcctcaatatctaaaatgaagtctctgtgtgcctgttgttgggtgtttttgtttttaatgcttaattgcattcctagaattcccaggtttgcctgttaatagtggaatactatacaaaggaaccacagaggtttcttaacatttacactacattggaatcctattcctggctgaaatggtgttttgcagaaatgtggcat

SEQ ID NO: 100158 - DNA, 1052 bp, Homo sapiens
ttcagttcttgggaggctggcaggtaacacgaaggagcacatggatgctgggggagcactatgtctgcctcgctcctctggtcgtcagagtaggtgccattgtagatttgacagctcttgtccctgcagccctcacatagctaacaccacaccccattcacttgaagtcttctgtttaccagggaatcggaggtttgaaatcaagcttagactccacacgtgtctcagtaccttccttagtcgtggccgtggcagaacagcctctccaagtgcatcctggaaaaccggcatcagagcctttcagtaaatgggcttagtgtcatttaaattttaatggcaatattcttttttgttgttactttaaataaattccagtttttaaactttttaattttgaaataatttgtcatacaaaaaaagttgcaaaaataggatgcagatcacctttatacctttattcaactttccttaatggttgttttttttgtaactataatataatgatctaaaccaggaaattaacattgatacaacactaatccacagatcttctttgaattttgtcaaaggcaatactattataagtaaaggaaaagccgttctcaggttccagtttgcacatcccatcacctatgtgtggtctttctttggtcacggggaccccttactcaacaaatgagcaggatgcgctgagagtgcctactttgccgattaacaggtaacctagcactgggccttttgtagttcatgcattactatttttgcattactactctgttggcaacatgctgaaaaaaaacaaggggaaaggataatagcccttcttatttattagaaaatagacaaagaacctctagtaattttggagactttggagataaaaatggtctaaaactcagaccatcacttttctgcaatctttccatttctcttggccagagatagcacctctaaccttagctaattgggttgcccaaatgtgggcttggccaacaaaaggagcagaatgagggagtccagatcgctcagcagaaaataattctcaccactgc

SEQ ID NO: 100159 - DNA, 1050 bp, Homo sapiens
ttcacagttaattagacgtcctgtattttgttaaatctggcaaccctatttggaattcttctgtaagaaagatttgtctctttcccttgatgtttgattttgagtttgatttcactatcttcttggtatagctttcttcctactttctgtcatccttcagcagagtttgatatactttagtgattgtactttctctacttaattttttttaaagcaacatggaaaatagttttgtttgcttcaaaaaaggaatcagtttatgtgtgtgttttaatcaaaagatttttctcattatatgagccaaaaagcacattagtttccaacccctataaatgaaacccagagttgaagaaaacaagggatttgtaccgaatttctaagtgcagattgtgggaggggcagggaagaaggcgctgctcctggaagcagccccaggtgactaaagcagcagccagccaaacggttccatccagcctggcagtatgaggcacttgtgatttgcttatgacccatgacttccagcaggtgtgagagaattctaagtggatgtggaaaccaaggagggctacgtggtggggatgccaaagggatctgtgtagtttgcttttaaaaggaaacccgacctctcgtttcatgaagtgcacctagcccatcagatggcattgcatttcattaaagcagccattctgcaccacgattaccttgagtgttttgttctcagcagctggtacccatcaaattggggcctgcttttcatcagcagcaggtgttccaggaagcagccagggactgcagagttcaaagatggctcagctcatcctggagaggagaccactgttgtctaagcggccctgacgagcctttccagagctgaaagatcgctgatgggccaggcagagaggaggttttgggactcgggaaccaaatggggctgctctgctggcagttcccctcttatcagtttacttgaaagaaggatggcacatgagagggcgtgtgtcccttgaagggaaggtcccccctggcatacagcgggtgtttttttgaaca

SEQ ID NO: 100160 - DNA, 1191 bp, Homo sapiens
gtagtgcacgcctgtaatcccagctacttggaatgctgaggcaggagaattgcctgaacccaggaggcggaggttgcggtgagccaagatcacgccactgcactccaacctgggtgacagagcaaggctgtgtctcaaaaacaagcaaacaaatgtaagtcatttccatttgacttctcaagagctcatctcttgttctgcaattaaattatcaacttcttaaggcaagaaccagaacttaaaactctgccacagctcccattgcagtgcacagagtaggcagtcaacaaatatttgcttttgattagagttctaaataaagtcgtttactcagaataaagaagctttgtgtcactggaatgagaacatggtgttgctgtttctcctgctcacatccaatcttgtcgttcttcattggttcatgagaggctaagagcaaatcaagccaatgaacagagaagccatggagtgaaaccttcagaggtttctgtacatccagacagtgaaaacattgtcatcatcatcagtatcacctattaacagaaaaacgtgagtctcaagtgctagtggcattcatagtgaattattttgtgtcatttcctttagtgtttgtcccatggacccactcggcagattcttgggtgtgctggccattcttgggtgtggttgtggatgacaacctcatggaaatggaactgagagatgccttgtcaatcctcagtcagtgctcttccaaacagtccccactgtgcacatgccctggaatctgcagtctgtggctctgttgcttagtagaatcaaggcaggtggatggagaaaggctgccacttcacatgacattctcatgtaaggggcctctttctcattctctagtatttattttatcttgagaccttggtctcattacagtttaaattttgttctcttactttaatggcttatttaattgagaacatttcaatgaaaaaatgtttaaaacattgtagttgtaaagagtctggggtcatgcggaggttttaattgatccctatgatgaatgaatataactccctagtgcagggcctccttttcattatttctcaaggcctttatcccgtctccatcagcacagaacagcttgatgttttttggccaattgcagtctgagttattccacttttaaagcattgacttcataaccgagaggctgaa

SEQ ID NO: 100161 - DNA, 1023 bp, Homo sapiens
taccttttttcctgtaattacttgctaaatttctgtatttccctgtggatttatatatcctactttggtgatttttttttccaatttactaacttgatttgatattaatatacagagaaactgttgcaagtgaaacattctgagcaataataattttattgacttggaagcctggctgtcttgatttccagtgtttgcctgcagtgtttaactgacaaccctgagattattaccaaacgtttatgattttttaaaaagcaggagaagaggtagagaggggaatggaaaaaatgctgtttaaattagaaactgcttgtagcagttccatagggaggcagttaacccaagtcacttaaaatatggtcacgatattgagagttaaataattttacttggagatgacttcaagaacaaatatcaaaaggtccaaatgaacttaaaggtacatcaaagggattgcagggcagcatgcatagtttcaagagttactttgtggagggtcgtttcttctgtgggtttacccccaatttggggccacatgtgacctcgtgactccagattgattcctagtgcctctgtggacaaggccagatgctatctcctctgggggagctgatgcccctcctctgctgccccagttagtgctcaccaagcagttttggaaatcagctggcctcccgtctgtcacaggggagccctagaccatggtgatggaaatctgcccctgcctctgcccctgggaccaccctgggcagaatagtgtgggtgcctgtgcagagacctttcagcctttgcctgcagttgtgctggtggagaccccagtcccagctcctgggaagtgaattctgtgtgtgtcacattggtctttaagtcaggccgtctctgttagttgtttagtgcagcatagcaggttactcccaaactcagcagctcaacacaacaataaacattttttacacagtttctgtgggtcaggaatttggaccattgagcccaggtgtttctggccaggggtgtctcatg

SEQ ID NO: 100162 - DNA, 1034 bp, Homo sapiens
tccagaaattgttcttcatatgagcttgcatctttctaggttagcccactgcctactttaaccccacatctcactggacatgtagtatctcttgagttctgatacttgtcattttctggaaactcgtaatataatattttgaaactcgattgcaggtgagaccatattgtaactgtgatctattctaaaataaaagatctgaaaacatatcagaaatacacttttaggattataaaatggacattagctaaatgttcaatgttgaaatgaagttcaggtgagctgtttaccctctgggaaggcaacattttacctttttggttccgcatttgttttctctctctacttccccattcctcttcctcccctcgtcaccgcccttcctcttcccttcctcctgcattgccagcactacttttttttctcccctcccctgctcaccccacatctatcacattccttgatagagagttgattttcttctcagtatgtcgtaggcttagaatcagtagaccctgccggacacaggccttctcctcactcttctgggccttggctttctaggagagctcttttctccatgttgtctggtcatccattagatggcttattaggagtggaagaaaaagctagtgagaccctgggcttatgtcagcagctgttttttgacatttctatagtattcagagttaaacccggagtgagccacacccttaaccaggtccatgagtgagccagcaacttatttctggttttctcaagaccatccttttgagttgtgaaagtgtttcttgatttacattttctttgattgcatctgaaaaggcctgttggcctgacaaccgttgctatgggaataatactcgtggttagtgctgttggcagtcaccattatcaaaaggatcaggtgcctatttatttattcatggtgtggaacaaggttccctcataaagcgcatgaaccttgttctctcccaccttattatagtctgaggtttacatgacgtgcatccaaactgtagtagtgattttaa

SEQ ID NO: 100163 - DNA, 1038 bp, Homo sapiens
tgaattgcctgttcctgtcctttgctggtttttatcttttcaatggaggtgttctttttcttattgatgtgtgtgttctctgttgtccaccgtgttcttccttgtagcagaccatggctatggccctactcaaagaccaggttagagcagaaagtcttggggaagagattttatgagaagttgcaccaccacaatgcagactcactcaggccttccacaaatatttatttagcactgactttgtgccaggcactgtctagacacttgggatttagcagtgaacatagaaagatacatacagagcttagattctggtctattgggggttgtatggagctatgggaaatggtgcaaaagcagacaggtgtgccaggtggtgatgaaggtgatggagaaaattcaggcagaggagaaggatggggcttcctagtgggctgcatttttagggaaccatttgagtcaagacctatgccagggggcaatcatgcagaggtctaaggaaggacatcctaggtagagggaacttccaggttgggtcccagagagggccagtgctgggtgagtttgaggaactatgacagcacacagggtgtgagggtggcagtgttggtggagggaggtgagggggtgtcaggaccagggacacagggcctcaaatctgagcagctttacaaatagcaagttaagagggattagaacttgtacaggagtgtagtttgctgaagtgccttctgataaaggagaaatctcttccacagtggtagcccaggttagacttagtgaactgtaggaagtaaaaggaggtatttatagtgtattatgtttgtaaaacataaataaagggttttctttttttttctttttctctttttttattgagataaggtttctgtcacccaggctggagtacaatggcataagcatggctcactgcagccttaatctcctgtgctcaagtaatcctcctacctcggcctctggagtagctgggactataggcatgcccaactaattttttattttttggagagacggggt

SEQ ID NO: 100164 - DNA, 1026 bp, Homo sapiens
tatgctcatgacctgggtgatgagatcatctgtaccataaacctcagcatcacacaatatacccaggtaacaaacctacacatgtaccctctgaatcaaaaataaaattaagaaaagaaaaatttaaatagccacacctggctagtggctaccatattggacagtgcagggctagacaatgtcccaccttgttgcctgcatctggggtgcatgcattactcctactccccagccttagcccctactgcttggagaatctcacacctggtcagcataaagccagttttcaggctgccacttacttaccttttggtgtctgtgccatgaaaagaggcagagaccaaagaggttgtgcctatgtaaaaggaaaaaaaaattagcaccttacttacaacttagggcacaataaagcatgtatctaagaacatacttttattgtctactgattaccaatgatgtgagagccacaccccaaactgtgttctcctccatagtttattcttcactttagtgtacacactggccaatgcaaggacttaatgatctccatctttcatgtgtaattaaatattaacatgatacctaagacaaggagtttgacgtttgctgatttgatgccttgtttgtaagtgatggaggtaatgaaatggtttctaacttcttagagaaaagtctctggaacgtagcatctccattcatatttgccacaagctctctgtatctctgcttcctttggctatttgccagggggaatgccttttatctgcaggtttggggcaggctagggggagaagaggtcattttactctgcctttatgacaaggttaactggtttcatcaggctagtacaagccaccatgaatggatccactcactgagggaagaagacaaatgcctgctagctatggcactgattgagttgttgctgaggtcagtagctcaaagggatgcactaaaggcagagccatctgggctggagtcaggaggagccccactgactgcctggaaggagagctgaggctctga

SEQ ID NO: 100165 - DNA, 1035 bp, Homo sapiens
ttctgggcaaacaacaggttcatgtcctgcgctgctttatctcgggaggagtcgggtgctgagtctccagcatgcagatattctggttgtatctggagtctgttgttggcactgactcttgtttgggcttagtttatgtcatgtttgaaacacaaattgagtgatttgaggttggacccccttactgtactgttgagtttgtgctaaggaaagaccaatcctgctgtgctcttggtttgctagaagcttcaaactgcttttcaggcatttggattcaccagcacccagcatgtttcaatggtaccttcttcatctattttagagccatgtgtgttttgcagcaaatgtaacccatgtggtttgtttcacacacttcctccaaatattggttcaggatctgaacctttgatatcccagaagcatttggattctctccttgaaaaggctgtaacatttccccacttcccagaaaggggaaataatgttttaagactgaggaaggaactcaagctccacagtgtgtctggattcaggtttgtggcacgtggggtctgactggttggggaagcagcatcatgtcacaccggcccctcctcactggggtccaactctcaccaggagacacatgccacccgcaggtggctgccgggtctcacgggaggcccatggacttgtccagggtctgcttgctaactcacagaaggagtaaatctaaactgacggaggcacttagggctttattttttctttcttgtttatcttgaaaggtttttagaagggagatgtcacagtcttttaaaaatagtaagataggccagcctgtggtgttgtaaatttcaatttaggtaaaagagtacacttgactcgaacaatgtggaggtcaggggtgccaactccccactaagtggaaaatccaagtaaaacttttgacttctcaaaaacttacctgctgctagcctactgttgatcagagaagccttactggtaacatcaatagtcaattaacacatattttgtattttgcaaaaagggtaa

SEQ ID NO: 100166 - DNA, 1640 bp, Homo sapiens
gtcataacaagcatatacttagtgctttaaaatatgcattgccaaattgcattcccaaggcccaaatttatactcctatcaccaacataaaatattcctttcctcaaacccttgcaaaggctgagtattgtaattgtttagtccttatcagtttcatgaatcataagttatatcttattgtttgtatttgtatcaacttaattgctaatgaagttgagctcttcttttccacaagctcattaggcatttgcatttatttacaatttttaaattgattgtgaatctggattttggatccagataagcttgattatcttctcgtttgcattttatattttctcattcaagaattagttttggcatttgtataactcatttggcattgttacattacttaacataatttcctttattattctcaagaggctggaactcttttatgagtcatttattcatttattttttaaggatgggaatgatgttatattttctgaatatttgcgtgttttggaatgtcttggttgacatagaatatttgggtcaccatcttttactctcagactctgtggacattgtcctgtcctagtgtttggttgactgagttccttacttctcttcgtccattcctctgttgtcatgcagtcttttattcacccaacatatagtttgtcagtgtcttagcgtcctgcctgtccacttgcatttagtggtgtggaagggaaggttagtgcccttgttatggatctcctttcttaaatttccctgagggtcgatccttcccttatgtactgagcctttcgttagctgatgggatgaaggattgtagcccttctgtaatgttttttcatattgtcttttctgcatctgctccgctccctccttttacagttcctatcctacagatgactggatttcctgtgttgaatttccaagtttctgctttctgcttatcatcttttcctctgggtatcagaaaaatgacatgaactgatttttctgaatcattagtttggttttctgtagaacttgatctgttgttaaccacatccactgtgtgtgctttctttctccaatcaatttaagttgtttattaaagtattatgaacataattcaatatcacataatacctgaaggtgtataatgaaaaataacactctctgcctgttctccgccctcaatccttgtcctcttatccataagcaaccagcttgaacatattttaagcaatttctttatgtattttttctctatttctaaataatgaacttttgctatttcttgatttattaaaatttgacattattttttcatgctgctatacagatgaagactcaacactcttcactccctactactttccctctctccatcattgttatgtcattatttttaattgattcaataagcaatatttattgtctggactctgtaactgttatgcaccacaaagctgtgttatatcctataatctttgttgctgttgttcagccttttgcttttctgggagtgtgttcttctctttcttttctccttgaagccttggggaatgtacttctatttactcctcctgctcccaggccttcgctccagtgcccctctgtggagcccactctctggaagccttattagctcccatgtg

SEQ ID NO: 100167 - DNA, 1081 bp, Homo sapiens
aggaaattcctcctaacctgtggcagaatagtcaagagaaaaatatttttccatggaaaagtaatactacaaagaactatgtaacaagcagctctgtgtggccatttctcagattttaaaaatgctagctttttgtcatctttgctccagatcattcattcctacttaaagtgctgctgcatgaactgtttgttaccaggccatggcgaaacaaagaacaaaactgagacggcatcttactttttaaaactaaaattgtactttctcagcatctaacttggacctgttcatgagtatttatatatgtgtgtatatgtgtatgcacactcactgtcacccagactggagtgcagtggcgtgatctcggctcactgcaaccttcattttgggccagaatgaagtcagctacaccacagagctcacagttgagaagaaatctctcacaatactttgctgatgaaggaagctatgtactgatttacattctgacacgagcatcttactgttgctggtccaggtgtcacgtgcattttgtggagtgcactgattagtaactctgctctagatctggttttgttcttataaagttgatggttacagttgaagcctgtatatattcattccactaagatcccattatcctctttcccctccatgttaactagtgtattgaagttggcgtgtattcttccaggccatactgtatttgcatgagctcactagctatgtagagtattattttgtgttagtggaatcctactgtatatagccttctgaagctaaatttgttttgtataacatgattttcaagatttatctattttttttaattaaaaaaaattttttttgagacagtcttcctctgtcacccaggctggagtgcagtgacatgatctcaacttactgtaacctctgcttgctgggctcaagcgatcctcccgtctcagcctccccagtagctgggactacaggcatgtgccaccacgcctggctaacctttgtattttttttttttttttttttttgtagagacagggtctctctatgttgcccaggctggtctcaaactcctgagcccaag

SEQ ID NO: 100168 - DNA, 1050 bp, Homo sapiens
aggccaggtgtggtggcttacacctgtaatcctagcactttgggaggttgaagtgagagaatcactcgaacccaagagtttgagaccagcctgggcaacatggtgagacccccgtctcttaaaaaaaaaaattagctgagcatggtggtgcttgcctatcatcctagctactcagaaagctgaggtgggaggattgcttgagtttgggagttggaggctgcagtgagccatgattgcagcactgcactccagcctgggtgacagagtgagaccctgactcttaaaaataaaatttaaaaaagatacattagttgtaattgggcacagtggcaccagctcccaaatggatacacagacgagaggaacagaatggagagctcaggaagggtggattgttggttcatagacagttttaggggaggggactggacagtgagtcctgttgtcctcttaactgttccctcatcactgtgttttcctgctagtgttgtgcagggagacaacagcactgtggtgaccagccttggcttatgtatctcacgtatgcatgggacactgaagggtgcctcgaagggaagggacgtcacataaaacttccactcccacccctccaaaacttcatgataattcacttttgttagtggtcagttttggcatcacaaatattgctggtgcttctgatttatagtctgtccagaaatccttaatccaaagaggtgaaatgtgctaagtgaagacagggcacagagtggccctttaagatactttttcagttgtgctagttaaatgggtcaagcagtaattcagaaactcatcgaggtcttctttccatcctgctaacttttgggtgacagtgagtaagttctatggtttttcttctattggaggaaaactcatctccgtcagcagtgctttgtggaaggcaggcaggtagaagtcatggtgcctggaactggccccagcagcctgggcagggcgggggcaggcatgttccctccccgccatgtttctgtgttttctcaggcttctctggatcacagggaagcatga

SEQ ID NO: 100169 - DNA, 1046 bp, Homo sapiens
tgtgtcttctctcttttctgggtaagtctgaccagagacttatctattttattgatctttttatttttattttttctctcttgcctttttctgtttgaaatgtcatcagtttctgctccttattattctcttccttctctgcttgttttggatttactttgcttttattcttcaatttcttaaggtagaaacccagattattgatttgataacctttttcttttgtaatataagcatttaatgctgtgaatttccctctaagccctgccttaggtgaatataacaaattatgatatgttgtgttttcatttacttcaaagtattttctattttgcctggtgacttctctttgatgcaaaagccatttagaagtgtgttcagatatttgccttggtgtcttttgctctaagaatggagttttaatgaactggagactctttgaggagaaggtatttgggtttgtacatggcaacatggcaggtttttcagtgaagtgatgcactgatgctggtgtcactgtatgagcttgaaaacatatcttcagctgcttagttactcttatatgcctatgctaatagaatctgaaggcaaacattggaatccttcttaataacgtgtcttctttggtctttttagtgtgttatcattgggcagaactggatcctgaaaaattcaagatgctaagcacctacactactttaagaatttggaactgaaacatgaagaggaagacagaaataagaatttgggaacctgaatagctctgcaaaaaacaccaaaggaccgttttatcgttttctgttgttgctgtggtggagtgatgcagtgggcactgccggtgggccagggggcgggtgcgcatgtggtagaaggtgtgcgctcgtgcctcccccacagaaaggctttgttggtttctaccacatcttggcttgcttttggaacaggctggcccagcatcatttgtcatcaagtccactgtggtgtattctgcgtgtccatggcgggggttctccaatacactcacactgtccatgttctttttattg

SEQ ID NO: 100170 - DNA, 1650 bp, Homo sapiens
acaatggtttaaacctctagatttgaagtcattacatcccagatgcagaccctggccagctccctaagctgtgtgggcagtgaggtcccagaagctctgctgtttgagttatctaagcagggttttacagagtgaattcaaattcactttaaagctacttgaacctacatgtcgataaactcagttgtagggtttggcttgctggataactgtcatgtttctccaccacagcattttattgccaccaattaatgcttattgaacagttgcagcctgtccttgtagtaaggggtaacgaggattgcatagagatacgacctaaggatcatgacatttggatggtggtaaaatgctaaaggcctttgttggtcacagcccagttcctggctcccattctaaagggacagagacataccagagagtgagcaccatgtggtcaagttgctgaagggtctgaaaccgtaaaggaagagctgaaggagctggggctgtttcatctgggaggggaactctaaatgtttgaaagatgtggaagagaagctgggtcaggaacaaaaataggagcaatgggtgtaagttgcatcaacgtagattctggcattctaacaacatgattcaaaagtggaaggtgatgttgggagcttttggtgtttgagcagaaattctgagcctatatgtgtgaggggggatctttgattaattaaaacatcttcctcacagtatgcaggaacatggtaaaagaaagcatttactacttttgtaaacattttggattgaagagaacttttccatcatcctgaaaatcactttcaactcctgggatcagagaaatagcagtgaatacaccgaagtctggcctaagagggtcagatctaaccacagggccagattatagagaaaaatgaaagctcaagaagaaaccccataatatctgcagctgcctcaaaaaggtggttaatttccacccccacctacactcctgaaggtcctttcctagttgctttgaaactaatggctaaaattagattttgggtggcattcttgtggagaataaatctctcagtctttacatctctcccaacatctctgcctccttctttctgcttatttataaagcatactgcttattgtccattaaaacatcatttgaatgaggatgggagaggagaatcgtaccatgtatggcttttctgagaagccttggcagatcacagacccaggactttaaacagagtgctgtgccgataacactgcatagcaggacccatttaatcttgcctttggtggtttactttacaggagaccaagctcttgtggctacacaaaacatagaccaaataaaggcatctttgggggctggatgtccatagcagcacctcatggttagtggtcccagggagggcattttctctaccaagcagtgtcctggctcagatgggtgccagctggcatatatatggacaatttggcatttcattgatttgatcataaggaacaaatagttccgcaaacaccctatttcctttgatatggtaacatttgagtaactccaaagccagagaggcaatcttttctatctctggtttgtcagattttctgccgtttttcagccaggcactttaagaattcttaatttgttgttcgttattg

SEQ ID NO: 100171 - DNA, 1088 bp, Homo sapiens
tcaagcgattctcctgtctcagcctcctgagcagctgggattacaggtgactgccatcatgcccagctaatttttatatttttagtagagatggggtttcaccatgttggccaggctgatctccaactcctgacctcatgatctgcccacctcggcctccctaagtgctgggattacaggtgtgagccaccgcgcttggcctctacagggtattcttagtgtgaattgaagggcaggggaataacttaggttagtgtttctcagcccttatcgtctattaaactggtgactagcagtttaaccttaaccccaagagaggaagaggggcatctgcagtcagaaagcagtggaattggaaaccagactgtgaggagttacctttttggtgagcttctgtatttgcggagtcctgaattgaatgacttttcaaagacagaattagattcccaagaggcaattactgatatgctaatgataactttgaggggaggcctgggaacctggaggattgtctgactgactttgggatgaccatctgactttgctctcatgactcaaatgagcaatcaaggggtttgtaaacacataaggcttttgatgtatactcaaactgttctccagaaaggttgacttgacttctaggcgtgtgtgagagtgctcattgacccatctcttcatcagcaccaggagttgtcatggaaattgtaggtgaaaaatatgccatattgatttgtgttgctttattaccagagagagagagagagaataaatatgcttaatttgatatttgtatttcttttgtaaattgctcaaattatttgtttttttcttttgaagttttaaaaattgatttttgaaagttcagtatgtatgagctattatttttatacttcaagctacatctaattgccattgccacatttcccagtccaatataataggaaactctggttaggtgaattacatctaattattaagtttatcaagcaattgtctttcttatgtggcacacttttttttttctagattgaattttacttgtaagtttgagtggataggtgtgtttttgccattcagaaaactttaat

SEQ ID NO: 100172 - DNA, 1002 bp, Homo sapiens
aagatgccctagacagcttttggtgcaagaagcatgagagacatgtgaagcagacctgcaccccacttgttgtctggagccaagcccacccaagcccagcccaggtcagccatacttaagcccaaatgcaggtgcgagaatgaaaaataaatgcttattattgtttttgatgtgtttgttacttagcaaaagctgactaatatacagccctaatttactctctccactgccaaagtcaccgttgtgaaacacatctatcctgttactggtatacgatgtccaatttattccacaggataaactcctaaatatttaccctgccctgcatgtaagccaaccttgctcaacctcagtctaccgttcctgtctcattccgtcatgactctgactcatttgacattcagaatacttgaagggctgaagcaggctttggtctttgaccagtctaaacctttgcttctttctctctgcctggactctcatctcacatctgcttcctgccttgtcaattcctgctcattcttcaaagcctgctcaaatgccaccactctgaagccttgcttttctctcccaaaagcggccttttgctgtccccataataatgctgtttgagtgttcatttcaaggcactgcagcagattgtgtctatgacctggcctagcccaatagcttcagggaagtgattctactttattcatgcatgtgttccttacatctatggccaactcatatcctggcatacaatggatgctcaaaacaggtaagtgagtaattttaaggggcatcatttggcagcctgcccttctaggcactgcagtgagcttgtggagagtagattaattcagagttcacattgcaagcagtgctgctgtggttctcagagtaactctgccaggaaatgagttaggtgtgttgaagacttacctgtcctgctccagggcagatggttagtggcatagtgccatagcgggagcatgggactgcaagtcgagagccagcctg

SEQ ID NO: 100173 - DNA, 1035 bp, Homo sapiens
tcctccaggtttcccctttcctgttggattggggctcatctgatgacctcatctaaattagttaaatctgcatagaccccatttccaaataaggtaatatccaatgctagtaggggtgagaactccaacatatctctttgtggggacacaattcaacccataactaggtgtaaaattagaaactgatgagatatccaggaagtgtgaccagtgcacacaatcagaaaatagagtcaggcattctcagcagtaaatagctattccaggtcaaagggctgggtgtgagttgcctccatcttgtcttgttctgctgttgttggggaggccttagcaccttctgaggtgggtgaaagcagagaatgggagctgaaggcttaaagaaagggccaagcgaggtgggtggttcctgagctttgatttggtggcgtgctgtctattagaccaccctgactggtttctgtgatctctccatggtactgctgagtgccaggtacatctctttggaggtattgatgcttaatgaacggcagcttctccttcctgctggctgaggtgcatgagaggccaaatgactgtatttgggagatgtgcggtacaatttcaaaatgcctgataatacagtgatctggttacaatcactattaaaatcacatcatggattgtgataataaaaataaaataatatatactagatgataaatattataaaatattatatatatataataaagataaaggaaatatgtttagcttcatataaaaatcaccatcatgcccttgatttgcccctgaccagcacccagttcccatgaccttggagcttcctgcattctgaccctgagcttctgtcccatggagcaactgtgtttatgggctgtcaaccagctaccataggcaggggatggaggcctttataggctcctctcttttatctcacagggaatttttcaagacagagctcaggtttctgaactcaacttacataatgcatctaaaatgacataaatatgaatgtatctcacctatcacccccga

SEQ ID NO: 100174 - DNA, 1050 bp, Homo sapiens
agctgcctgctccctgtaggtggctcctaatcttataactgttgttccaatctgcctcctcccatggggtcgtaggactctcagggacatccaactattgcctggttccctgccatgtgcttcagtcccctctatgcatccccatgggttgttgttcagtctgtgctttaatatttttgatgaggagaaaatcacccagtcccaaagtgctagccagagattcctcacctcgagttgcaatttgtcttcctctaatttctctcctttggttctcctcttatctgtcactgagcaagtctaattccactcacatgacagaggcttccctgctttttcttttctccaagtcaatcatccaagactccttcaaacatcttttcctaaacatggtcacatatttcatttctagctacttcttgacgggccctaattttatcacgtttttatcaaaatgtggcacccagaattgaacagaaggcttgaaggtgatctggcctctatagaccatcatttccctcgttgcagatgagttgttttctgaatatagacttattcatttgtctctagtaattcttcaactgccttttggatttctcaatctggatctccctagaaacctcaatttattcaaaaatgaaataatcatacacccaccgacaccagcaactgccccagtcttacaaggctagcaagtcaggttgcctgcttcccactcagataacttgatctctagccttattaattagggggcagctattactccacttggctttcattctctatttgtgtatgtgggtttagggaaggggactttttatcctgatacagaatatccatttattcctgttaatttttcaactaatgttggatttttcaagttgggcttaacttatctaaatctaggataagctgggctctgtggcttgcacttgtagtcctatctactctggaggctgaggtaggaggatgacatgagtccaggaggagttcaaggccagcctgggcaacatagggttaccccagcagtaaaaaaattaataaaaatagaat

SEQ ID NO: 100175 - DNA, 1235 bp, Homo sapiens
gtagtgaacaaaagaggcagagtactttctcctaagaggcttccattcgagtgggagaaatagattataacaattgggcaaatgaatacgtaatacatgtcaggttataataggaattacaaaatgaagtaaaacacaataaaaaagtagagacaggtgcataaaaattctggaaggatgtactccaaatgattaataaatagacctgtagcttttaaaatttatgtcttctaaatgttctgtaacaaacatgtattttttaaaaaaatgaaaagttattttaaatatataaaaagcactgggtttgaatgtcccacatgattaattgtgtcacctgttgtatcataattttattaccaaaaatactgaaaaaagttcaactggaaaataatacatagtctttattatctggggtgtggtttcaacatattttaggaatcttgatatctggaaatataaataaattatagaaaactagacatgtttataaaatgccttccagatgggtaatttgaaatgatgaataatctcttccggtcttggtaaacagcaaaatgtgctaaataggtcagaatagaaaaatagtcgtatcacgtgcaagaaacagagaacaaagcattggagcccaaaatgctatttctaatgctgctttgttttgttatgttcttactggcaaatgaagggcaaatgtgtgtttacgaggtcacacaataaaatataaagtgaaaatttcagtcatttggttagcttggcccaaggagactatcaggcttggaaaaatcagacaaaaataaatcatgttaagtaaggtccaatccagccgcttgcctggggctcagctccctggggtgtttggacccatgtttggtaggtggacgtgaggtcgcggtgcacacttgccctttcccctcctcccaccccctccccagtgcttccacaagtctgactctgccttgtcactgattgactttgccttccaaaatgagatgacatgtttattgtctaacatcatcactgattacgacaacaatcactcacaacaactggtgtggtcacacaacatctcaccccagatgtccacctaaatcctccacctctcatgtgattaaagtcattcaatctctggtctatagtaattttatattttatattttggagacagggttttgccctttcatccaggctggagtgcagtggcacaatcagaccgcactggaactcctggaactcaagca

SEQ ID NO: 100176 - DNA, 1034 bp, Homo sapiens
tccaagagcaatcatctctcaaatggccctggagcccacagcttcatagctggagaagtctactgccttctctgtttttgaagccaaggaccaacattatctaccagctttgtccagccctctttaattctcctgagtgcttgaaggtgatcacaaataatctcacatgcatttaacttataaccatagtgtggcagtgagtcctccagattggaaaagaaaatgcctatagaagatccaggtacgcccttatgaccgccaaattgacttcaggatccagtcccgctttttaatgctggtctcctcttcctgtcttacagcctttaggtgttcagctgatgtaaattaattgctcccattgtcaaggactttagtaggtttgcttttctttttttctttttttttttttttgctgctagtcaaccacattgtgttccaaaagtacctttaaaaaggtattttatggttttatttagctttgttttatttgtaaaatacccttctcctgggctgtaggcttctaggcattattcacacagatccagcacactgtttggggtacacttaagcctctagagcccttacccatatttgcatgctgcccagctgtgagttcattgcaaaggtgcagactcacctgcttgtgatacctctccctcttagctactgacttatttgtggtgtcagaaccccattttcaagaacttcccattctgtttgatgggaacgagggcactttttatagactccaactcacctttaaactttgtgaaatctctgtttgtaaaccacaaaatttatcagcacaactgagtttcccattcctagcttttgtgaacataaggatgacataagaatttcctcttacaatgcctctcacttccacttccccaatcagttcctccccgtgaatcggaagtaagttgagaatagcagctccacccacagctttctgatccttctgagggctgaatctgcccacaagttaggtcaagtgtgtgtcagaaatggtttttatcacagagacactatga

SEQ ID NO: 100177 - DNA, 1108 bp, Homo sapiens
ttctcctcttgggacccttgtgtttctctcacactcactccccatggagtctggatggtgtgcccctctctctctgttttagcactgataagcttgtcttttaatggtttcttatttaattatgtccctcactggactatgagcatattcagaacagaaaccaaactctgattcacctttacatccccatagttgagttaatgaatgactaagtgaacgaagaaaaaagccataaaagaggtggcacagcacataaccaactgcaagtttttgcagataacccaggaaagtagcaaattaaagccagggcaaagaacacccttctttcactattacaaatcctatgataacattcggtcaggtctaaacccacagccagtctttccttgttaagtttagggttaacagttccccttatgactttatgaggtagaaaatattcagcagagtcaatcaagaatgtgtcaaatgtcctgctttgatcagtctccgggcagatgtcacactattccttctacccttcttgatcctgtccacctcctaaactcctattcttcctttaaagcctgtctcaaaagtcccacctccttataggtttccatgaccctccaacctctagagaaaattgatttctgcccagctgcactctactgtcattgtcagcctttgctatgatatgttccaccacagcccttccccttgacaaagattcttggcttgacgaaactttagtcaggctcctgaacctcctcctaggtgcttctgagcacttccttataaaatctagttttaacaaagaaccctgctaagtaggttgagcaagaacgccctgccctcgatatctgatcaccctccatatctgatcaccctccatatctgatcaccctccttatctgatcaccctccatatctgatgatcaccctccatatctggtgatcaccctccatatctgatgatcaccctccatatctaatgatcaccctccatatctgatcactctccatatctgatgatgaccctccgtatctgatcaacctccatatctgatgatcatcctccatatctgatgctcaccctccatatccgatgatcaccctccatatctga

SEQ ID NO: 100178 - DNA, 1317 bp, Homo sapiens
ccggggtcattcaaaggcccagcccagcagcagaggcccaacttgagaggccctctttggtcatgtctcacaggttggataagaaggtgcatcacgattgtgtttcagaaacagaaaacctgtcattatatttcagagaataacagaagagctctctgacaccacaaagactagacctgcgactagctttgaagaaactacattgctgaaatctggctataccgaatagatgaaccagtgggtgatgattcacttgacctcagctgagttccctcaactattggtctcttcttggcatttgaaaaagtattcaattttcaaaaattctgtctgccaagcaaaatttttcaatcattcagaactggtccaactgcacatctcaggcctcagggattcccagtaatggagttttcagatttttttgtttccagataagtggaaattcattcatctgcatgcacagtaacaatgtactgtggacagagattgcaggggcatgaaaaataatggatagaatcaaaaaccacattttagtcagtaatttctttttttattttttttatttttatttttatgtttttttgagacaaagtcttgctctgttgcctaggctggagtgcagtgacatgatcttggctcgcggcagcctccggctcccaggttcaatcaattttcctgcctcagcctcccaagtagctgggattacaggcatgcgccaccacacccagctaattttttgtatttttagtagaggcggggtttctccacgttggccaggctggcctccaactcctgctagtcagtaatttcattgagcaaatccttacatggttctctggatgctcaaaagccatagagatgaatgttgcccccttggcctcccagcagatcccctggactgtgagtagacggaacatcacctgcccactgtccagtgagtccacatccccacaatgtatcagcccacaggcctctcagcaccttgcagtggaaacagcagagcaagtagagatttagtcacagtgacaatttactcataatagtattgcaaagcatgcctcacacctgtatctggatgtgtcttttgttttccataaataaattcttcatagacactgacacctggagaggcctcagagcatagaaacaatagcaccatagaaaacaatgtaagccacagatgtaattttaagcattctagtagccacatttaaaactttaaaaggaaaacaagtggaattaatgttaataatatattgtatttggcctaatatatcaaaatatcatcatgtcaacacatgatagatataaaaaagt

SEQ ID NO: 100179 - DNA, 1048 bp, Homo sapiens
tcccagcactttgggaggccgaggcgggtagatcacttgaggtcaggagttcaagaccagcctggtctctactaaaaacacaaaaattagccaggtgtggtggcgcacgtctgtaatcccagccactcgggaggctgaggcaggagaattgcttgaacccagcaggtagaggttgcagtgagctgagatcatgccattgcactccagcctgggtgacagaatgagacttcgtctcaaaaaaaaaatatatatatatatatatataaaatatatatatatatttgctggatgaataaaaaaatgtgtagcacacatctgtatgcgctgcctatatatggttcatttattcagccagtattgattccacacctacaatggtgaggccagccctgggcaccgggtatgcggtgctgggggaagcaaatcagaattggagaaacttgaacttgaaggatggggatgaggggcagggctactcacattggggtagggaaagtcttcctgaaaaggtgactttaagctgaactgtgcaggagagaaagagacgaaaggaagagcattcccggataaggaagccacatgtttaaaggcctggagtgacatctgaggctctgagggagaaaaagggtggcaagtataatgaatggcaggccggaagggcaggaggggcaggatgccagtcatgccagccaggtgaacactgggattccattcttagtgctatcggaagcggtgatgggtatgaggaggggagtgccacctatgtgccaccctcataaagctcacccggcattagcactgtgtctccatccatcaaccaagaaaaccaaagtgcaattaaaatcttccctggagtcactcaaaggaggccagagccagcctccccatcagcacaacttgaaatcttgacattgagttgctgttctttctctacacttgcttcttcaggtgccaagcagctctctcaaattgaggtagccctgcccttcctccccatccttcaagttcaagcttctccagttctgatttgcttcctctatctctccca

SEQ ID NO: 100180 - DNA, 1058 bp, Homo sapiens
cgagtatttataaagtgacttgaactttacaattaaaagattatttactttgaaaagctgtataaatggttatttaaaatagttgtgtggcttctatcaagccattagtcatctctgagcctcagtttccccatctgttaaacggacataatattagtattgtgcaaaaataatagaattattgcaaggattagatgatagtgaagtaaagcacttagatggaggctggcccatctgagcactcaatattaatttctgttattaattttttatcataatgatgatataaggtaaagtcaaagatgctatgaagttgcacgagcttattaacacaaagcaaccaatgtaaaccaagtaatttgttttaatgccagatgtgaataagttgttctgctttttttcctactttataacctccttcgcatcaaccttgatttctatagttatataaacctttgtatttaaacaaagagatctcctggataagttggaagaggagaaagaaaaaaacaacttgggctggggaatctgatgattgtggggtcagcgttaacttttggcctcagttttaaccttgggggactgttttcattgtttgtacctctgcgttagatttatctttgtccctggccttctaataataggtaatcatttgaattcaataagatctgatccagcgtcaggaattccaaaggccagagagacaactcaactatttcttttgctttttcttttgagacagagtctcattctgtcactcaggctggagtgcagtggcaggatctcggctcactgcaagctttgcctccagggttcaagagattctcatgccccagcctccagagtagttggtattacaggtgtgcgccacaacgccaagctaattttttgtatttttggtagtgatgggatttcgctgtgttggccaggctggtcttgaacccctggcctcaagtgatctgcccaccccagcctcccaaagtgctgggattacagtcatgagccgccatgcctggcctaacttaactatttctgatcttatatgtaagtggacccat

SEQ ID NO: 100181 - DNA, 1924 bp, Homo sapiens
tccgagttgcatttcaggaggtcaacagtggttgcacaggaaagaccctccttgtgagaccttacatcaccactgaggatgtgtgtcagatctgcgctgagaagttcaaggtgggggaccctgaggagtacagcctctttctcttcgttgacgagacatggcagcagctggcagaggacacttaccctcaaaaaatcaaggcggagctgcacagccgaccacagccccacatcttccactttgtctacaaacgcatcaagaacgatccttatggcatcattttccagaacggggaagaagacctcaccacctcctagaagacaggcgggacttcccagtggtgcatccaaaggggagctggaagccttgccttcccgcttctacatgcttgagcttgaaaagcagtcacctcctcggggacccctcagtgtagtgactaagccatccacaggccaactcggccaagggcaactttagccacgcaaggtagctgaggtttgtgaaacagtaggattctcttttggcaatggagaattgcatctgatggttcaagtgtcctgagattgtttgctacctacccccagtcaggttctaggttggcttacaggtatgtatatgtgcagaagaaacacttaagatacaagttcttttgaattcaacagcagatgcttgcgatgcagtgcgtcaggtgattctcactcctgtggatggcttcatccctgccttccttcctttctttttccttttttttttttttttttttttttttacaaagagccttcatgtttttatatatttcatagaaatttttatagcagttgcaggtaaactgtcaggattggttttaaaatatttttgtaactttaaaatattctataattatgcatgtgattttaacatttaatattcaaaaataaatctcttgctggatttgagagtattgcatttttaaagtctctcttctgtaactggatgttttggcaactttgtggggagagactgctggatttcttaaagcaacgtattcctgacactggccacagaatgcctttggaaatcggatgtactgttctcttgttcacgtttagtggtgttttgctgttttgttttttaaacaaatgatgctgagaataaggagagaaatgaatgtagagagaggtagagagagaaatatgaactctaacaaaggactgaggagtgcagtctgctggttcaggctcttcaaaagatgtagaaaaagagatagaaggaaccacctatgcttaaaatactgtaaatatgcagtgaggtttggcaaaatctattccatgtgtgatttgcttgtagaaacaattttgaaagccccttgaggaaaataaaaatcaagaagaacacttttctcccttttccatacaaattaaaacttaacagcatcaaattattgggaccagaaaccaagtaatgtataatgtggcttttgttgagttaaataagatgctatataatggagaagaatttgaaaatgcacaaaaaaatcaatctacattatcagaacctgcagtgaaattaaacttatgttaaataaaaccagtttgcaggtgcacaaactatgagggtcttgtatccacgtaacacaggtagttacaaaaacatgttattgtactgtgtaaagatgcatagtcatctcatttggttggctttgtaccttgtaccttttttagccttggcttttgttgaactagaaccctcagcacatactgtgttgtacttttgtaaatgattttttaaatggaattttgcacataatacattgtaatactgtatgataatcatgtgtgaaaataatttttgaaatatcctttggctgtttttttttttctttagagtaagaatatattcatgcaccacgcagtgtcatggacagatgaaatccgaaccagggttt

SEQ ID NO: 100182 - DNA, 1043 bp, Homo sapiens
ggagtgcagtggcacgatctcggctcactgcaagctccgcctcccaggttcatgccattctcctgcctcagcctcctgagtagctgggactgcaggtgcccgccaccatgcccggctaattttttatatttttagtagagatggtgtttcaccgtgttagccaggatggtctcgatctcctgacctcgtgatccacccgccttggcctcccaaagtgctgggattacaggcgtgagccaccgcacctggcctaactttattgttgttactgctgacggtggtgatggcggtgatggtggtgtgtgcgtgtgagttgggagtagctcattttccccagtattcaatgctggtcaagagcatcatcagggcccatagccaggggtgactttcgccaagaagggagaagggagcaagggaggttgcaaagacgtcttgctagcttcccagtcacgggcagatcgaaatcctaagaggaaccatctctgcctgcacaagagtctaaaatagtatttcccaaaaaggaattattatttaagtaaaagcataattatagtcagtgattattttaaccactttcctccacctttttccccttttactttattatattcacgaatttatatgtccatttatatcatttaacaggactattgtttaaaacttggtgctttaccaagaagaatacagaggttgacgtgattaattctttttatttctgatgtgcgtgcttccgatttctcaccacttctacaaattatgagagaatgcatttatttaccagattgcagtttccgtccattttatctttctcactcccatttttctctgcagcctattgatgtacgatcatatgcagaaaagacttatgcatctattatctactgaaagaaaaactacagaaaacaataaaatgctagagactctttaaccaatcagaaaaaaatacgtaagtgaagcagctacgacatcacaaagcttctatttttcgctagcacatgaaaatatgagacctgacaaattgcaaactctcattgaacagatag

SEQ ID NO: 100183 - DNA, 1132 bp, Homo sapiens
tacaaagagggtattcacattctcaacaaaggtatttcacctctctttgcctcagtttctgtaaaaggtgcataatcatagcacctacttcattggattattatgaagattacatgagttaatatttgtaaagcagttataacagtgcttgccacattttaagtgccatataagtgtttgttaagaaaaataatgaaattaagtatcttgcattttgaaggatcagaatctggagatgtagagttaggagaggcacagccctcaatcatagaccttagcacaaatggctctggaggggtgatgtttgctcatagtccccgatgagcagcttagaggagatgggtggggctttggaagccgcctccctttcctcttattgtcttgcttcaaccagaaaagtctacatgttgacacacttgttttatgggttttaaaaataccttttagggctatttacattcttaaagactttttaataaaaaggatatatgcacattattaagaaatcaaagacttgtggaaatgtacaaagaataaagcaacaaatcattgaaaattttgccacctgggaataaaccatgttaactctcagataatttcagtcatctctctatgtagattaaggggagtgagaaagagacttttacttaaaagggattctaattatatatgttaatagattatgaagtataaggtattactgtacttgacttttttcttgaatttaacagaagaaaaacaaatcaaatgaaaatgaaagagtgccaggcgcggtgagtcacgcctgtaatcccagcactttgggaggccgaggcaggtggttcacctgagttcaggagtttgagaccagcctggccaacacggtgaaaccccatctctactaaaaatacaaaaattagccgggcgtggtggtgggcacctgtaatctcagctactcggaaggctgaggcagaagaatcgcttgaacccaggaggcagaggttgcagtttgctgagattgcaccactgcactccagcctgggcgacagagggagactccatgtcaataaataaataaataaataaataggctgggcgcggtggctcacacctgtaatcccaatgctttgggaggccgaggcgggtggatcat

SEQ ID NO: 100184 - DNA, 1745 bp, Homo sapiens
aaatttgggggtcagcacaagtgtagaaaaaaaggctaagagtttgtaagatggcgccttagggcatcaagtgttcaagtaaaggagaccgtgtggctcagtgaggtgagaggagaaccccatggtctcagaagctgagtgaagacagcatttcaggctgtcccaggagtgggaagctgttcaagaggagctgatggctcagtgcacatcatatttgtacatttcttccaggaaagagaaattgaagatgcagatgcaggagggaaagagaattgcaggaggagggtcccgagtactgagggggtctctcgcccgcactccgtgcctattgacaggagagcaagtagcatatgggtgcagatgcctgtgtgcgtgggttcggtgggcggggggggggggggactttggcaaagacttcttcctgttttctcttcttagtgatgaaataggaagcccctgagatggcggggctggaggtgagggtgcgggtgggcagacaagaggagataaagcagttcagtcgtcgaaaggtgtggtggagtgactccctgcactgtattagagcagtgattctcaaggagtgggccagggtttggggtccccaagattgtttcaggtgttgtgtgaggttagagctatcttcatgatgtattaagaaggtttttcatcttttccactgtcattccctcacaagtagacagtggagcttcccaaggtgtgatctttcagcagcaagcataacaaatgcttgagaatcccgttgtcttttaagcaggacgttgcagaattgttaaaacaatgccattgttgtcactggattttgttttgttttgttttcggaagtatagtgatttttttggtaaaggtatttgtgttaacgtgtaattgatttattatttttgagtgaatatttaaaatttttaaatctcagtagatattacgcgtataaacaaaagttctttggagtcttcagtaactttttagcgtaaaggagttctgaaaccaaacagtttaagaactgctggactacagaaatatgatatgactagcattgttatgggtctcaaaggagaatttgactagaaatcagaagagaacagttgaaaagtagctggttttgaacctgacaaaatagtggctccattaattgactagggaagtgaggggatggagatgggttttcagaatgcagatttgggaatggtgtgctgggatgtgctggtgagctgcccacagcatcggagccaggttgggaggcatccactaagaacacgtgattgaacacataggaatggggatggtggggacagggaggtgggagtgtagaataggagtggggagcaaaaaccgagtggtgggagtgaccacatttagagggtggaataaaggagcaattgtcagggaagacccagacacaggcggggaggatccatggggttggatgctgcagcgggcgagtttgaccttctgtctctgcgagatacatccctagttggtctccagttccattagcaatttattgccacttagaaaacacaagatgtagatttattaacttgaattttaaagaagcaagtagcagttaagtgaaaaaatatgtaaacaccttaatagtggctgtgacagcttattatggctattaggtagattaaatcatctgcctcagccctaaagttggccttaaagttgttgatgaaacatgttttgttttccttgtggcatattactgttagctttagcaggct

SEQ ID NO: 100185 - DNA, 1034 bp, Homo sapiens
tctagtaagcagcgtttacaataaccagttgaaataagcctgctaaagctaacagtaatatgccacaaggaaaacaaaacatgtttcatcaacaactttaaggccaactttagggctgaggcagatgatttaatctacctaatagccataataagctgtcacagccactattaaggtgtttacatattttttcacttaactgctacttgcttctttaaaattcaagttaataaatctacatcttgtgttttctaagtggcaataaattgctaatggaactggagaccaactagggatgtatctcgcagagacagaaggtcaaactcgcccgctgcagcatccaaccccatggatcctccccgcctgtgtctgggtcttccctgacaattgctcctttattccaccctctaaatgtggtcactcccaccactcggtttttgctccccactcctattctacactcccacctccctgtccccaccatccccattcctatgtgttcaatcacgtgttcttagtggatgcctcccaacctggctccgatgctgtgggcagctcaccagcacatcccagcacaccattcccaaatctgcattctgaaaacccatctccatcccctcacttccctagtcaattaatggagccactattttgtcaggttcaaaaccagctacttttcaactgttctcttctgatttctagtcaaattctcctttgagacccataacaatgctagtcatatcatatttctgtagtccagcagttcttaaactgtttggtttcagaactcctttacgctaaaaagttactgaagactccaaagaacttttgtttatacgcgtaatatctactgagatttaaaaattttaaatattcactcaaaaataataaatcaattacacgttaacacaaatacctttaccaaaaaaatcactatacttccgaaaacaaaacaaaacaaaatccagtgacaacaatggcattgttttaacaattctgcaacgtcctgcttaaaagacaacgggattctcaag

SEQ ID NO: 100186 - DNA, 3040 bp, Homo sapiens
cttcctgagtagctgggattataggcacgcgataccacgcccagctaattttttgtatttttagtagaggcaggctttcaccatttggccaggccgatcttgaactcctgacctcaaaggatctgcctgccttggccttccaaagtgttgggattacaggcgtgagccactgtacctggccttagaatgaaagattttttttttttttagaatgaaagatttaagaagactaagaccatgtctgtctggttcactgccgttatcgcctgggcctagcacagtgcccaaaacagagatcagtaagttcttgaattgttgaagaggaaataaaattacaagcatcattatattccaattctgcagtctaaagcaatcagttgaaatctatattaaaatctttacctactccacaaaatactagtggtattatacttactataacccattaattctccaccaggtgcctctgcaacaatgaaatactctggccagtgggcgaggtattgtaggtagaaaggaatcccatactagagtcctgttaaggagtgtgaaaagtaatggacagtaaaaagttcttcattaagggatattgtaaaaaaagtttcctttaaaaagtatactgttactttatccccagctctgtatgagtcctataatcatacataccattacatgaaatatttaggttatcactgatttttaacaaaattgcctggacatatagcctcaagtgtggaatggtgatagcactgtctaatagaaagcagagaatcaggaccccaaagttctacagtctacttccctactgaccataccatatctaagtctctccatttatcacctgatattgtttgtttgcggtctgcctcctcttagtctatgaatatcatgttccctctgtccctggtgcctggtacacagtagatgcttaatacactgatgcttacataattgcactgaaaaattaatgggtagttcctactttgacttcagctatgagactgtgaaaataactttacaacctaagtccttccagagccaacttaattacccagtttttcctctccactgattcaaatcctgcatttctagtaatgcagataaaagctgacttaaggaatcaactatgttaacagtaaatgcctgaataatttgctcatgacttcactcttcaaccttgggatatccttactgacatgtaatcattcctacatttctcttcttctttttactctgtactttaatggatgaaaatatatttcttgttagtataaactttctgatgcaatttatcagaggacaccatcaatcacacataaatatattttttaagttcctggaaaacctgttccgtgcgaaattcttcaaaatctcctctgaaggaccatcattattttgaatacccctcaaatacaacccttaacatggcaggacagccagtcttcctgccagccagccactgacatataccacaaccatctcttctgtggctaacagaggagtcccagacacccctccctcccatcgacctctaggacctaacaggttactttcaaatataggctcacctggattatgggactttcactgcaaattttaaatgtcactggaagcacaccatataaacggatttgcatcctaaaatccttccttcctatatagtgaaacttttgtcattcaaaattcttcaaaaatcttaaaagtggtgatatcattagtcgtaatttaaaaaatccagatgaacctgcagagattttttgcttttcccattcagttttgtttctgatatgtagtcctgttgctgcctgcacctgtaagttaatttttactgctgtatagtatttctttatgtgaagagacaccttaaatagcctgtatcctgacaatggacacctgggtcatttcctgtttctcaaaaaaatgtttgaaatccttcttcagtacagcttaatttacttaaccatctcctgattgttgtgtgtgaatcttattccaaatgcttagtaactctcctgcaataaataatgtttgtaatggtataactcaggggttagcaaactttttctgtaaaaggccaaatagttaacatcctaggctttgtgggccatacagtccctgctgaactactcaaactgcaaaagccacagaaaaaaatataaattaatcagcgtggtgtcccaataacattttatttacaaaaacaggcagtgggccagatttggcctatgggccttattttgtcaaccactgacaaactgcctctatttcttcttattttcagctttcaggaaatggaattactatttccaaagtgccttctggaaagataatagcaatttatattgtcactagcaatttatgagaatgttcctctcacctcaccatcatcagcactgaggtttatcattttttaaaatcttggctgatacataaaatatggcatctcattttggttttagtttacatgtcttttgactgatgagactgaactcttaacacgttcattaagctcctatatgccctcttttgataaattaccggttagcagaaccctcctacccacctacagtagatacagagcataacacagaatccgaactttgtgttgtaagccactagagatgtggggttatctgttacagcagcataaccacagtatcctatcttcacatctttgccccatttttccattaggacaataatagacactgttcattgttacctcaaagccttcactttagtaacaagtcccaatttataaagcagggcacatttctggactctagataggattcagtagacaggtgaagcatgaaacaggtgctggtcaatgagacagagcgggcctgtgtggcatttcccaaaggtactctccttttttttttttttttgagacggagtctcgctctacatgtagcccaggctggagtgcagtggcgcgatctcggctcactgcaacctcggctcactgcaacctctgcctcccgggtcctggttcaagcgattctcctgcctcagcctcctaagtagctgggattac

SEQ ID NO: 100187 - DNA, 2000 bp, Homo sapiens
agtaaattaagctgtactgaagaaggatttcaaacatttttttgagaaacaggaaatgacccaggtgtccattgtcaggatacaggctatttaaggtgtctcttcacataaagaaatactatacagcagtaaaaattaacttacaggtgcaggcagcaacaggactacatatcagaaacaaaactgaatgggaaaagcaaaaaatctctgcaggttcatctggattttttaaattacgactaatgatatcaccacttttaagatttttgaagaattttgaatgacaaaagtttcactatataggaaggaaggattttaggatgcaaatccgtttatatggtgtgcttccagtgacatttaaaatttgcagtgaaagtcccataatccaggtgagcctatatttgaaagtaacctgttaggtcctagaggtcgatgggagggaggggtgtctgggactcctctgttagccacagaagagatggttgtggtatatgtcagtggctggctggcaggaagactggctgtcctgccatgttaagggttgtatttgaggggtattcaaaataatgatggtccttcagaggagattttgaagaatttcgcacggaacaggttttccaggaacttaaaaaatatatttatgtgtgattgatggtgtcctctgataaattgcatcagaaagtttatactaacaagaaatatattttcatccattaaagtacagagtaaaaagaagaagagaaatgtaggaatgattacatgtcagtaaggatatcccaaggttgaagagtgaagtcatgagcaaattattcaggcatttactgttaacatagttgattccttaagtcagcttttatctgcattactagaaatgcaggatttgaatcagtggagaggaaaaactgggtaattaagttggctctggaaggacttaggttgtaaagttattttcacagtctcatagctgaagtcaaagtaggaactacccattaatttttcagtgcaattatgtaagcatcagtgtattaagcatctactgtgtaccaggcaccagggacagagggaacatgatattcatagactaagaggaggcagaccgcaaacaaacaatatcaggtgataaatggagagacttagatatggtatggtcagtagggaagtagactgtagaactttggggtcctgattctctgctttctattagacagtgctatcaccattccacacttgaggctatatgtccaggcaattttgttaaaaatcagtgataacctaaatatttcatgtaatggtatgtatgattataggactcatacagagctggggataaagtaacagtatactttttaaaggaaactttttttacaatatcccttaatgaagaactttttactgtccattacttttcacactccttaacaggactctagtatgggattcctttctacctacaatacctcgcccactggccagagtatttcattgttgcagaggcacctggtggagaattaatgggttatagtaagtataataccactagtattttgtggagtaggtaaagattttaatatagatttcaactgattgctttagactgcagaattggaatataatgatgcttgtaattttatttcctcttcaacaattcaagaacttactgatctctgttttgggcactgtgctaggcccaggcgataacggcagtgaaccagacagacatggtcttagtcttcttaaatctttcattctaaaaaaaaaaaaaatctttcattctaaggccaggtacagtggctcacgcctgtaatcccaacactttggaaggccaaggcaggcagatcctttgaggtcaggagttcaagatcggcctggccaaatggtgaaagcctgcctctactaaaaatacaaaaaattagctgggcgtggtatcgcgtgcctataatcccagctactcaggaagctgaggcgggagaatcacttgaaccccggaggcagaacttgca

SEQ ID NO: 100188 - DNA, 1033 bp, Homo sapiens
actctcatggttcatagtattcactgtatgtatgctagggaaaagacttgctccagtctcctcctcagttctgtgcctgagaaccactgctgcatatatttgtttttaaattttgtattgaactgttaattgaagctttaaaagcatatatgaaatgtataaatctaagatgtataatacattattgactctatgaatgttttctgaagtttgttagtcatttgtaaaactaaatcagattgtaatcccagtactttgggaggccaaggcaggctgattgcttgaggtcaggagtttgagaccagcctggccaaaatctatactaaaaaaaatacaaaaattagctgggcatcccagctatgcagaagctgaagcacaagaattgcttgaaccctggaggtggaggttgcagtgagctgagatcgtcccactgcactccagcccgggcaacagagtaagaccctgcctcaagaaaaaaaaaaaaaaaaaaaatcaggattgtgaaaggtcatcatcatttaagatacgtttaattaaattgtgacttccatacgtagtattttaaaaatgcacacttgaagcaatcactgtccagcatacttaagaagctcccttcttatcgtgtagtaaattcttcccagtcacctgcgttcataccattatactgtttgtttgttagtcctagatcttttctcctcttcacaatgctttgcttaaatcctgcccttctaaaaagccaaaaaaaaaaaaaaaaaacttgaggttttttttttttttggagagggaaaagaacataattcctaaagaaaggccatataactatatcataggccaaccatgtattttatgtgtagtgtcttcctctgtaatatgtgaaaatatccagttagttagttagtgaaagacttaacgaaagaaaaacccacaagaaattattaaacttttactatcgaaaggatttactttggtggagttgagggtgggagagaaatgaatctttatgttctcctgttagagaatagcttttttcctt

SEQ ID NO: 100189 - DNA, 1148 bp, Homo sapiens
gtgtctctaggctggagtgcagtggcgttatctcggctcactgcaacctccgcctcccaggttcaagcaattctcctgcctcagcctccagagtagctgggactagagacgcgcaccataatgcccaggctaatttttctatttttaatagagacagggtttcacctgttggccaggatggtctcgatctcttgacctcgtgatctgcccacctcagcctcccgaagtgctgggattacaggcgtgagccactgcacccagccaagttaaactcttttcaagagtttaagactatgtcagacatttaattgtagaatgtagaatcaaatattttcagtgtttatattgaagcatatattcattgttttcatctgtgaaacattagtgatgcacacattactttccgatgtcattaactgggaattcgctttattattactacattattatcttctgagtgatatggttaatttggttcaataataactttttttaaaggtatggatcagctttgctcagtttgagttgtcttcaggaaaagaaggaagtttgactaaatgcagacaaatttatgaagaagctaacaaaaccatgcgaaactgtgaagaaaaggaagagagacttatgctgctggaatcttggcgaagttttgaagaagaatttggaacagcttcagataaggagagagtagacaaactcatgccagagaaagtcaagaagagaagaaaggtccagactgatgatggggtaagaactctgccctgggactgttcatctcacgtcacatgagtagaaacacttctgacgtcgaaatgtggacttttaagtggcatatgtacaatcttagaatggaagcagaccacctggagtaggagatggttgcaatctggctgttatggaaacacggggtagaacatatggtccagtcagaggtggagaacgggaaggggttggcaaaggtgttttggtgatggttgagtctgggaacttcatgaagtgtgatatttttagagcatttaataggaagtaagtgtggaggaagatggaactgaactttcagataggagcctatccagagaaggcttgtaggcggtaagaaggagtttggtgggagtcagtgaaggctgttttgcataaaatgacgtgac

SEQ ID NO: 100190 - DNA, 1060 bp, Homo sapiens
acatgagaatcacagcaactcgggaggcagaggctgcagtgagccgagatcgtgccactgcactccagcctgggcgacagagcaagactttgtctcaaaaaaaaaaaaagaaagaaagaaagaaaggaaaaggaattgaggtctgcaaaaggaccatgagaagactttgggatctgatttgacctcttcactctagaatgtgggactgttttaaagcactaatgctgttatatatgaaattctgagaattaccagaggacttaaaggtaatagtcaaaaacattttttattagggacaagcatagaccattttaaagtatcagttagttgactgtaaccttctgtagtgggtttcttattcctcaaggattccaggatgtaatttctcttaaatatgaacaaaatgaataaccattttagtacaagacttaaaatagaccaagggtgctgtcatttttagtcatttgtcttttgacttgaccctttttgccttcttccagacttttgaagataatataagaaaaaacaggactgtgattagtaactggataaaatacgcacaatgggaagaaagcctaaaggagattcaaaggtaaaattactgagagtgtagttttgtatataatgattcatagattaacagataccaaaaagaaaagaagaaaaagttaaagcacaggtaaaagattgtgcctcgggtagaaattttcaactttggttccatggaaccctagggttcccttgagggcctcaggagtactggggtagaatagtcctggggagggtggcagaagaggctttagagatagatcttgtcagttgtagctaaagaagcacaatttcatttgctttgtatatattgagatttttacaaatttcagctaaacaatggccaaaaaaaataaaaccaatggccaaaaaaaataaaaattgcaatctggcccttcctgtggtctagctttctgcattctccccgcatacctccttcccccactgtgcctgtgtatgtgccactccctgaatatatcatgtctccttatcgtgaggcttgactgttctc

SEQ ID NO: 100191 - DNA, 1126 bp, Homo sapiens
tctaatgatgagaacttactgaaattgcctttgacttgaagtgccatgtaaaaccaaacccagttatacaccggggcattaaataagttgaagaattctgtaaatgcaggttgtaatgctgttaataagatgtgctacacattttgataaaacaaaacctctggtcagaattttacctagacggcctcaaagtttattattatactcatctaaaagggaaaacttgctattatttttgccacctttttctcttgagacttttacctatggctttgcagtagatactatgaataagagagaaaacggtattttttttttcttttcagtctcatggaggaatgggaacatgtcatacaaaaagggcatcttgtgataatactaacaaagttcatatcctaaaaaatgtatgtttgtttcttaagccttgtgtgaagagcaactactaaaaatagaaatgtcttctttcttaaaaggtgaaaaacaaagccccggctgaggtacagataactgctgaacaactcttaagagaggctaaagaaagagaacttgagcttcttccacctccacctcaacagaagatcacagatgaagaagaattaaatgattataaactaaggaaaaggaaggtcagtcagtgtggtatctttcagtccactaattgttaagactgtatcggtcagtttgaaaagctcctcattggttggattctgtagggcaagatgaggttaagtgtttccagacgcatgaataatgtacttctggttaccagataacagcatttttctgaactatataaaatatgccatgagttgtctggttaaagtgtaaagaaattgaatctgcataatttttgatgctgaatcaaagtgagcggaagtttagcagatggaacaactgacaacaagaaggagggtatgcttagtaaggctgcactgtgtacttctgtctataccaccttctgtgttaagaattgagatctggctgggcacagtggctcgcgcctgtaatcccaacactttgggaggccgaggcgggcagatcacctgaggtcaggagtttgagaccagcctagccaacatggtgaaaccccatctctactaaaatacaaaaattagccaggcgtggt

SEQ ID NO: 100192 - DNA, 1090 bp, Homo sapiens
agtcacactgaggggagggggtcatactgcgagtggaggtagtcacactgtgaagggtggtagtcacactgagaggaggtggtcacactgaggggaagtggtcacactgaggggaggtggtcatactgtgaggggaagtggtcacactgaggggaggtggtcatagtgtgaggggaggtggtcacactgaggggaggtggtcacagtgtgaggggaggtggtcacactgaggggaggtggtcacagtgtgcggggaggtggtcatactgaggggaggtggtcacagtgtgaggggaggtggtcacagtgtgaggggaggtggtcacactgaggggaggtggtcatagtgtgaggggaggtggtcacactgaggggaggtggtcacactgagggaaggtggtcacactgaggggaggtggtcatagtgtgaggggaggtggtcatagtgtgaggggaggtggtcacagtgtgaggggaggtggtcacactgaggagaggtggtcatagtgtgaggggaggtggtcacactgaggggaggtggtcacactgtgaggggaggtgggcacactgtgaggggtggtagtcacactgagaggaggtggtcacactgaggggaggtggtcacactgaggggaagtggtcacactgaggggaatggtcatactgtgaggggaggtggtcacactgaggggaagtggtcacactgaggggaatggtcatactgtgaggggaggtggtcacactgtgaaagaagatgatcacagtatgagaggtcatccttcaagaggcaagtgcccaaaaatctgtttataatctagagcaatatttgcctgaaataaactttaaaagtggttttacgctatttaacccagtgtcagaacagcagcatacaatatgagctcaaaatcttgtataattttagtaaggtaattgtttttggttggtttgatacaattctccagaaaaattaaggaagaaagagccaacctcatacacattgcagaatatatccacgaggccttactggtggcacccaaagttttcagaacctcccagtacttagttgtgagaatcagttgctttttcccta

SEQ ID NO: 100193 - DNA, 1034 bp, Homo sapiens
ctgactcatcacggtggtaccagtaggtcagccatctggaaacagaagtggccctaattgggccaaaatgtggtaagactcgctggcctcaggcagggccaggccagttccctcacttctctgcacacctattcccagattccatccagagcaaagctgatgtttatcgtctcattgtacttaggctttcgtactttaaaaaattatgactttttaaaaataagccttcagcagacagaagtgaagaaatttagcctgggttgcctcagcaacaaagtctgcggttcctaagagccacatgttggggaagtggggtgacccaaacttggtgacataggttgattgatcagaccctcagccttacaagcaagagctcatgcagatccacagagccatgcacatcctgtcttcctgaccttcctcaggtggcaccacctgcgccccatggacctgctgtatcggtgtcatgtggaggtctgatgaatcctttaaaacctaactgtgatgtcgtaaatgtaactgtgctacctttatatctactgaagggcagcgtctgcatccgagggaaattcaacatgaaacaaccatcgttttagttgcactcagtctgtccatatgacatacacatgaagtgaatgtttccttatgttttcaggtctacaatgtttagtacatgtaaataaggaaaaaatttgataaatatggtaaattaagttatagcgtgtcatttgattcttattttgctgtctcttgttatttaattttcctaatgctccacatctaggttccttcctaggtggtgggaacaccttgcagacgtgtgtgcaccaggacacaccgcggcccaggcagccacaccgagaaagcacacatctccactgatggcagccacccgactctccagttaacctcttttactctttaattctgatttactgtgatgatttaataaagtggaaacacagcacttcagtgctatatgtttctctcattctcattatagtttataagaaaataaagttcaccctggcatc

SEQ ID NO: 100194 - DNA, 1043 bp, Homo sapiens
tttgtcagaagcagcctgtttttgtgttctgaggtttttcatgtgtggtgttttttttttgagactgggtctcactttgtcacctaagctggagtgcagtgaagccatcactgcagccttgacctcccaggctcaaaatcctctcacctcagcctcccaagtagctgggactacaggtgcgcaccaccatgcctggataagttttgcaatgtttttgtagagacggggtttcactgtgtttcccaggctggtctggaactcctgggctgaagcgatccgcccaccgcgcccggctgcagcctgttttaaagatgagaatagtgagccttctctgtatgcccgacctgactgagcctagaagaagggaggcaaccatgaagcccctggactctgaaagtactgaatttcaggacaccctgagccaggctgcctccataggtccaagcacgtttgcaagtattgattttggaaactcctcctagaaacaataagggaaggtcagagaatgaaaaaagatgcgtctgtgaataaaataactgacttaaattaatttcaaatgccaataataataataatttcaaaggccaaagccctgcaagtgaatcacgcagggaggaagatgtggaaactctgcttctgaggttggttcccagcagaggtcatgcaggaaacttggggcataatacaacagggtttaaaaatacactacgaggggaagggtgatgaaatgatcctctcgctcgcagaacggtgctaggggagacccagctccacccgcaacagtggcttggtgttgcagcaggcattcttgtattcctctgagcacaccgacagcagccctggggaagcggggggtgcagatgtgcaggttttaattttattccttttccctccagtgatgaacagctgtatgctcatctggactcattcagacaagcaatttaggactgacctctagtcttagaccctttggggaataatcgagttgtaactcattgtgtagaatatcgatatgtaaacacgtggagattccaggaacaccg

SEQ ID NO: 100195 - DNA, 1053 bp, Homo sapiens
taattaggctggctaattcccactggccttgggttgccagtgttgagtgtgtgggcttaccccatccactgcctgcacctgttcccttcctcagagccattccaaggggtctgaatagcccagacagctctctgatctcccactctgtccgccttcctgctggtaggatatttagcacttgcctaaagctggagccctagtccactgtttctctccctcatccatgccagctctcaaaatcattctctttcctaattatcttgaaccagttaatcattttccacactgactgttcagtaaccaggatccaaggacaggcagcagcgtttcttgtcctgaccctgcccagcctcatcccaggtggcggttctggatggcagcctttcttcagaggcaagaagcttggttcaaagccttgctctcttgctatcccagtgagtacagctggagaaagcatgccatagaaaggcccaccaattcctggaacgcctctgctaggcggagccgcacataacacaacacatctccagccagcctcttgtttcctgtgctgctttaaatccctgttgatatccagagtatcggagaagtcacacaaggtggaagaagcaagacatctttcttcaaaagtgacttctggattcccccggctcaactctgtgtctgagccgccagttggccacagtttggccttttggtgtctgagttaaactgctaagggctgtccccgaggagtctcactcaactactcttagatatgagtagggctggcttcgattcccagcaccacaaataggtaaaaatgacttcaaatttaagacactgtaaccctataacctagtgtcacaactttttttttttttttttttgagacggagtttcgctctattgcccaggatgtagtgcaatggcatgatcccagctcactgaaaccacctccccagttcaagcgattctcctgcctcagcctcccaagtagctgggattacaggtgcccaccaccacacccagctgattttttggtatttttagtagagacaggatttcatcatg

SEQ ID NO: 100196 - DNA, 1125 bp, Homo sapiens
tccacagaccgagtaactgaaacttgattcgaggtgctttcgtagatggtctcgagggttttaaagggaattatcgatcaccttgtttagcaccactttaggcttcgtgcttcttcatccctttgttcttttaaaacttttttactctcctcagtgtcagctctggaagagatgagacaagcattcttttcatttgcttggctaggaaagtgccactgctacctgtcagatgttaccatctctgacgtggtccttgttgcccctggaggctgccactgagcaggactgtgcagggcacttcaggcaacacaaactaaggctctgggaatctcatgcaggcctgtgtctctccttcccttgtgaagcttgaagtcttattggagaaaagcagacactcgtgagccacacacaaaaaaaatggctatttattaataagctcagataagtttcctccaaactataaccacatgtcaaaaagatagccagccagtggtttaggccagttgggttgagatttccctgagatggaccatgccatttgccttgtcaacttgaggagaatgaaaacttgcctcgtttgtattagatattctactaagcatcctgccagttggtttggaacttccccacattgcctaatgtctgagaactggaaggcccatggacaaaaataaaaagatagaggatagtaaatgtgagaagagcagagagaaagaaaccacatgtttcagagccactgcggggacagtgacactcctgacaaccctggggctggtgctgggagtattcataggttcccagaataagaagcggcctgagatcattcattttgaagtgtgaccttgcactgaatctgttcccttggcagaactctgaaggtgcggtttttctgtgaaatgctgcgttaggttctgggttcccagtccttacagagttttaagtgcaggtggcatcttcctcctgcctgactgctaattacagctcaggggacgctttagcagttgccaagagatggctggcaggtaccaggaatttttctcagagacaatttttggaaataactcttaattaaagcttatttgaaataaccttgagaatgtatttcagaagaacctgaagctcccg

SEQ ID NO: 100197 - DNA, 1047 bp, Homo sapiens
ccaacaagccctgcgggggtgggttggccaggtgaacaggcttgcgttcaggatgcgccgtcaaccacacatggtggtgtagctgctaatatatgagcgctcggcatttttcaaagagctttcaaaacaaaatctattttcctaatgagaaaatatttttaaagaccatcgtatctaccttgtatctattccatccattacttgtattgataacacctgacatgtaaagatatttcaactacttttttacctagcactatagtttaccttccttttttgaccagcattaaataatctaaaatgtagccagtattaaaatattggttgcaattaacatatatatgttttatgtataaatacatttatatacacatatacatttctctctcacacacacacacatattggggtgggggactaaatttgtgctttcaatcatatcaccaagaaagagggaccggcagagaggccttgaaagggttaactggaatgggcaccctcgactgctgggagggactgatgtaatcactgcagctcacagccaagtgcatctgttcaccatgaggtcattcttctgcatgctaatgatttggaaaatcaagtctagtgtttgacattatcagaaaagatataaatagtgtaaatctttgctttttagaagttgctcttataaaagagaaaaaaaggaactttacattggacctgagatttttttcagaactgccttaaagattgtgtctggatctaaaaattttggaggaatccacttgtgtctgttgatcaatcaatccccagatcactattacggtcacagctagcaatctggtagccaagggctacaggtatgtctcatttaatatctaattttaagaatttccaagtgcctttgtcagaagttgatagatttttctcaaagaatgttcaaaaccaagttaaatgagtggttcttctcggaatacccaaactgacttgtgtttgctgaagatgccaatactacgtatggttcctttctgcttcaatattgctatagagagccagcagagggag

SEQ ID NO: 100198 - DNA, 1092 bp, Homo sapiens
actcttgagaaagctttttacttcttaaaattaaacacgtaaataataactagatgttttcattccttaactgttacattcttaagattattaagatattatcaaaatgaataatgatggactttgttttctatgtatattttagcctctgtataaactaatttgatcttttccaaacatccataattatttaaaccaatagaaatgagtgagattctaggagcaatttgagtttttaagaactctacttggagaggattgtcaataggcttcttcaagaacgtcatatttttgaaaattgcttagcagaatgaagattctgacagcatgtgagggtgggcattggaactcttctaaaaggaacgtgaaaccaaacatggaatatcaagacaaatgctactccctccgcttttcaaattattaacatcagtattacatttcatagtgttcatggtttaaggaattcagtgttgagtgggaaacatttttatacgtctatcatgcctatccttaagtgtgatttttaagtctaggcataatgttctgttttaattctttgcatatcttctcataacgctgagtaggaatgaactagatataatcttgatttgaactgaaatgtggggcagtacaatgaggacagagcatttcagcaccatagacaagcacgttttcggaagcatcttctagcttacatactggcttcgcttttgaggaatccctgtccactatctgttactacttctacagatgaaaacatttgtcatttgtttacactgttatgttcttgggacaagggcgatcaaacccagatgagccagccagcttaaactaagaaattgaggtgaagtctgttcttccaagcaacaagccaactggaaaaattgaccctgagcggcttaagctcccacagtgcacttaggacccaatcagaccatctctggccctcagtgtcatcaaagcagggccttgggcttgggctcacatgcgtatgcacaatctgaggaattaggggctcctaggttttctttgtatcctcaccaccaggactttattattaatgaagagggagcatcacctgaacactgcatt

SEQ ID NO: 100199 - DNA, 1061 bp, Homo sapiens
ggaagaggccatgtagccatggaagcaaagaggagagtcatgcagccccgtgaatgcagacagccacctggaactggaagaagcatgaacaaaatctctcctgcagcctctgctgtcgtcttgattttggacctgtggcctcccaaaactagtgagagaataaatttctgttgttttaagccacccagttggtggtcatttccagcagccacagaaaactaacataaggaggcttaagatggtcatacgtggtagctatttagccagaggttttcaaccttttacacaccctaatgtactcaagggatggaacagtggcagcagaactcgggggcgccagaacttttgagagggatgcgtggatggctgaagcgtcccaggtggttctgaaacatgacattccctcctctgcagatcactgccatgggagttagagtcatgagaatggctagctctgggcttgcttgtgccagtgattagaggctgcatgagttcagaaagaaaactgaggtgggtacgcaaactgttacagcacacacacactgatgtcaggaggctgcctgtgtccggggccactttgccagtctgagcgtcatgtccactcttgggaaatttagagaaggttcaggcaagaagggtttcaagggttgaaaaaatacagtctgcaacatagcctcttacagacagttctctttatttctttgataaaagaagcttgatagtgctaaacaacagtcaacaaacacatagcccgaatgagtaaaaagaaattaaaatggaataattgttgttttgttgtattttataaagtcagcatgatctgggtatagatgcagcttacacatacgcactcaggtttacgttgcgggttggttattatagctcacgtatatttaagtcagttgatttgtctcatttggagtttagttcccatcctcacacatgatcttgaacttaacaccatttattctagaattcaagatattagatgaaagcagtaaaggttagaggacctgggctgtagccttaattccattactgtgtgactgtgattcaagaaa

SEQ ID NO: 100200 - DNA, 1906 bp, Homo sapiens
cttcttatgacaattgtacagataatgatttagctagaaagtcaccatttattccagattagctataaaaatggccagttttgtgctactcttggttctggggggagaaagaagaatctaatttatctatccttattcttcctgttagcaccaaacaacaatgtttgtggattaatttagcactgaacattgcaagcatcttaaataagtttgaaagattaaactgagacagcataagggagtaggaagaggccagcatgtgtaacagatcgccctgggtttgagtttcagccctgctcattgctagctgggtggtctcagagcatcacttttgttgcctgtctctgctttatcatatgtggtttgagttttgcaggaggacccaatgggctcttggctacaaagagcttcatgagtggcagccaactgcaccaacattgggtagcttgtttttatttcatagagattgtctcttttattctaagtgagatgttgccccaacagaactcaggctaattatagtgtaatctcactatgatgggttttagaatcctccaatatactataatactcagtacaacatttgaatattataggatcaaagatttagaggagggctgagatgcaaggaagtactttccttacatctgaggagagaataatggatatgtaggaggcacttagtaaatatcagatggaagggttggtgagtagatgggtgaatgggtgggtgggtgggtggatggatggatggatggatgggtgggtgggtgaatagatgggtggcaggcacaataatgggaagaaatgagggattgagagaagatgaacctgggctctctgatgtggatgggccaccacatttgggatcatgtccagcctcctggccttgagaccagtgatacaattctgcctcacatatgaattgtgaggatcatctccatggctcttcaaataaaatacaaaatggctccaaaggacattttcctcatctgggtcatgtctcatgccattaatataaaactgctgatttaatggagctgcttttgatctatcaagaaaagacgtaccgaattcaatttggctatttttttttctaagagtaagtgtcttaatttgcaagagaatgatttgattataattttaagtaatactgcagttatatttttagtcacgaagatgatatcaagtgactctatgaggcttaaatgtggaaagtcccagagaattgtgtgggttgggaattttatctttaacagcactgggggctgtttctgttatttgtatattttatgagtttaggcagaatagatgggatctgttacaaggaattttgcatataaaatataaaagcagacagttttcattgaagagtaaagtagaattatcccagaatataaagacataaaaagttaagataaacacccatcatttttttctgaaattttatttttaaagcatgtgttattatgagagaatttctaattctgatctctcttctgactgcagcagactttttaacctgaattccttctgccttactcttaaaagttgaaaagatttaggtactcagaggtacctgctgaaatggagtagaaatgttgaatctgttgttcaaatgtcagattcaggaaggaccaagtatctgctctgcacttgatgatatatgttgtccagctacaaaagaaaacaccccttacaaaaaaaaaaaatcttttttcccttgcacaatccatcctgggccagatatagtcatagctcaatagaaaattgctttcctgttactggcaacctgtgcggtcactggtatgacagtgcctcacgtcaaattgcaagccgaggggccactgcagcaggtgcatggtaacggtgcccaggagcactggaggacatgaaggacacacaa

SEQ ID NO: 100201 - DNA, 1704 bp, Homo sapiens
gaaccatcagataataattgcatatatttatggggtacagtgtgatgttgtgatacatgtatacattgcaggttgattagatcaggctaatcaactattacttcacatacttacatttatttgtggtgagaacacttaaaatctgctccctttgcaattttgaaatctataatacattattacctacagtcaccatgcttaatttttttgcatatggccatcctcccatctcaaggataattttagagtaatttattgccagtttgcaaattgtgtcatacattttaaaattatataaagcctggtgcatgtttaagttttggttttctcttgcatcatccattaaacctgtctggtctttgaaatgtcctctacctgcctgggatcctctccctctgcccagagccactttccaaggctgtgtccagggctttctgtacagatctctgtgctgtggcacccttccttctcccccctccagcctcatacctggctgccagactcaccaccatgcattgtcagcctgctgtctaccctcaggagcctcctcgcttccctaacagcagtgtcagtctagactccggcctctctccagtcctacttcttaaggagccctgtgttccccagttctctgggcatggcttcttgggaaatgccccatgatgttttcctcctgcctcccccatcactcctgttctggcctgtgtagattccactcagtctcagagctacgcttcagggggactcgctccacaaagcccccaaccacaccaaaagggtatagccatttccttctcatgatgccttgcacatttgttcacaccaccaagaagccctgggaagagtgtcccaaagtcattcctgtcatatcagtagtatgctgggagacgatagggaccatgagttaacgtctttatgtcctccatgaactcacaaaataattacttctgattgaaaatatatagaggcatttaaaaagttctctcgctcatgtactgtccttaacctttggggtctacgtagagtatatactgagaccaggtgatcccagtgatgtacatacgtgatgtttcatgaaaacagtgagatcttgtgtctgctatcaacatacagacacagggaactccgaaaggtaaaggcagtagagaaatacaaaggaaatttctcaagtgacatttttaatattcactggagatgagtgaaaacagttgaaacatcagtctacaaagtaaatcaccagtatacttgatcaggatcagaacctgctataggtagaggcaagtttccatcatgtacaatgactactctccttatcactggtccctgtgtttctgtttttaattgagaaaaacacttctcatgaaatattcccccacctgttggaggaagcattcaggccatgggacaaggaggtgatgtggccctttcccataaagggaaagatcttgctgccctaggcctccacagggcccacaactttgagccagatgcctggccacggtagtcagtgattgagtggcactgagatccaggcctgcccttgtgtccctactctggaatgccagggctctactccacgttgctgttttgccagctgctccctgttaggttccactgaccgggtgccactaggtccagcagctgctgctgtgatcttgaacaggcacacctgtggcatcattcccctcactgcagcatggtcct

SEQ ID NO: 100202 - DNA, 1050 bp, Homo sapiens
acaagaagtcagaagaacaacacaattttacgcctttttttctaaaggatttatttctcagcctccattttgcataaataagtactctgtaaggatgaagtaaatatatatgaatttagttgtttggggggaaatacatatatataaataattagtccgtcttttagtctgatagcttgaaactccattttgttttcagtcaaatgtgagagtcttcctggcaaccccagcttgaccctgtctttggatctggagctagaaacccagattggacagttggcgtgcgtgcagtcccgagcgcactgcctggcagccccgggcccatgctgcctgtggtccctggtggctgagtcaccctgatcactgcctctgagggctgtaccgtgaacataccctggaacttagcagggacactaaaagggataaagggagtcagtcccaaaggcaatctctcaaccttctttgtgccatggatgtcttgcacttctcagaatgtttgtaaatgcagaacataaagcatataggattccagagtacatcagttatagtgaaatgctttctaaagcaaatgcatatatagtaatataggaatgcctttattcatgcattaaataccaagctctagtagtaggtccaataatcattataattttgaagcagtaatgagcagaatcaatattttgagacactggtaacaatataatgcgtcatgaaaatatctgatttctactggtgacacagtcacaggtagtatcactgtggtatgttcctatttataacggaaagaaatgtttcatttcagctagaggataggatagtgagaatgaagatgtgcttttttaccatccaagttcagggacccctggaattttgatcatcacccagaagatccccatggggtccattgacccatattaagaaccactctttgcgggattcataagaaccacggagtcaggatccactggaaccactgcagtgttgttccttcagccagctagcctgcgagagtggtttctgagactctgtaggtatggggcctgttctctg

SEQ ID NO: 100203 - DNA, 1105 bp, Homo sapiens
gtgagctcttacaatgtgtacgatgtgataaatattttatgtgtactttaccatcactagaaagtagggttgttgtcccattttgcaagaaagaagcgaaagcacagagagaagctgaatgacttgcccaagatctctcagccatcaagtgagaagtgaattcacaccccggcttggtgctcactctcttagccactgctgtctgtcttccaactgcattgtcactaattgctaaaaatattttcacagactactttgaatgtgcaaaccaactaatatttatgcctttttctctaaatttattcagatactctttttcatttctgaaaaacagtaaattttttttcttaaatgaaagtgaaatccaatagaatttctttcttggcttgtcttatgttatttgtgataaataatgtatacttcaggataatttcactttctgttgatgctgcctctaaattaaaaaaagaaaaatcctgttttaaaatgatctccaaaacagctcagactacatccctaggacagcagtatttaaatgactctaggatacctctgtaactttgtttttcttacatttcttccacttaaagctttcccagcacatgtcaactctacagctctgtatctgaggctgatggccagtgctccaaccatgggcaacctagagcattagccaggaggagagagggagtgctcctccagcaacccccgctggtcttgagggagagaagcagaggatgactgacgactgaagggagggagcttgcttctgctgctgtcctgccttgacctgcctctgctgtcattgtggtcactgctgcagaggcccagggagggcaaggtgacattctagctgtttgtttgtttcaacaaggctagccacaggtccacccacactcacctcatcccggtcaccttccacctaaacattggcagcagttccctaacttacagattaacggctgtcccacttcccacttgtttccttctctttcattttctgttatgaaaaaggtcctcatgtgaaacagctcccaaaaagcatcttatgtaaattcatgccaaaatatgtgagagtcctcttgcaaaagaaaattggaatgtg

SEQ ID NO: 100204 - DNA, 1050 bp, Homo sapiens
aagggcttaacaatagctgaaaaagtgaagaattaattagtgacaggggaaagtatgattgaaaaataatcttaatgcccacattagctggctagctgcttttgctaagccttttagtttaaaaagcccaagtacctgacattttgcatctgtttttctgtgaagataaaaggaaacttgagtgtcttattctcaataatggattttatgtgacaaaaaggtttctgctcccttcatttccatggccaggcatttttatattattgccccaccgactgtcatttcatgtttaactctttgtagactcacacagctttcctcaaccctggggatggtctgggattgaatgatgtcaaagcctctctgtgtactaggtgcttccatgcatgttggtcttcttgttaccatgttgcaggacttgttgccctataatccagctcttctctcaggtttgtttacttgtgatcactatgtaatcattcattttatggagcttcattaaggactgcaaacctctgtcccaatttagcgtcattcaagcgtaggtagcatccatctgctccacccgcactgtttaattaatgaacttcataatgtgtttttgcctgtgaaaagctctctgtctcctcaggttgttaaataagatgtgcattccaggttttctgtgttaagattctagaaaacccgccatgggaggtgctaattatggactcaccgaactcctgttaagtcgtaacttgaaggcagatttacctttttttttttttttcaatatacattcataaacccaaagtcaggtcgctttttgagtaagtaaatcactggtcagttttcatagtcattctcttcactgagagtaaagattaacatttttttaaagctatattttctttcagtaccctaaaaatatatttgttactttgaggtttttccttctgaaattaaagttgtagaaatgcttgaatgtcaaaaatgctatttctgttttccaatatcttttcgtagaattgcctgggaaactttgtaggatagattctattaaaaataatg

SEQ ID NO: 100205 - DNA, 1886 bp, Homo sapiens
ggcaacagaaatttagattataaatttatattaaaatgtccatttttcaaactagaaaataaatacatgggatcttctaaaagaatgtccctcctaaactttggatcagttgtgctaatagatagctacattcaatctgagaccttaagtactaaaataaggcagttatttgcatttacacaatcaggcctccctttgaagtagtgatcaaaatattggttcttttataaataaccttttactgaacattttatttaaacatttcagagtcaggaattgcaaccatgaaatgattaggcagtttctaattatggatcagtaagtgttttgtagccagtctggcacatgagcacttttgcaatcagaatttggcaaatgaatgaatttataaaggaacttcaacctaagagggtaatatagatttttttaaaaatagattactttttggaagcccaaaagatgtcttttggggagcaggctagacactcagaattgatgtttcattttggtttcatgtttaagtctgaagtttttgctttctgatctacagataggaattcaaatgcacatctaacttataaagggcattctattctctgaaaatgaaacaaaaatatataaaatttctaagtgggcctcactttctatattccagttttgatgccatttttcaagcatgctctctaattttgctctttgccattggaaataagctggtgtgtatttggtgtgcctaaaaatttattaggcacttaaaattctccacgtttggcatatgtgaggatttctagttttgctttcactgccttgagtttgagagctatgtttgttgttgctcctactagtacttttattttatcctattaccactcatttttatgaaatgagggcaaaattcactggagtattcaaataattacctaaggacagaagtggagacactgctgagcctgaactcttggtcagtagttagtgtctgcatgtaactgataaaatgctttctcatcagccaatggaccagagagtaaactcagctccaaaaggcagtttggaacatcagtgcacgatgtgcaaaagcgcaggctgatcacaggcacccagaaggactgttggaccattattctcactcttggcgacaaccctgcagaatgggactgtgttaacccacagatggggagagtgaagctcgaggaagctgggtcttggcctggggcccacagccagggcagggctgggatgagagcccagaccaacctgactctatggccgcctgctgtttctcatttgtgcacacttttgacctaagaataggagaccatcaaaatgatatagctttcagaaagtgaagcaattccaattagttttagcttgttctctcattattgttaccaagtgaatcctagccttttaaaccttgattgtatggaataaatatgaaaacaaaattatcgttaagttaggatggaaagtattcccgttttgataccatgtgtacatctcttacacctaaatacatgtagcttccaaattaaaaagcagtgaaaatattaagtttaaatattcttactggcatatcccacttagagtccatcccaaaataagcatctaattgatgttagttagtgtgcttttgccttgagaaatagttgaggacgcagttccatcacagtgatttttctgtctttttgctagcaagatatttatttgtatatgtggaatccatttatattctacctctctctaaaatagatttgaaagagcttacataaaggccatgtataatgagaaagagaaaatcaaagcccaggaagcgaggatgaaaataagagtatcatctgaaggcatacagagaatccacagtcatggctctggcagcagagcagggc

SEQ ID NO: 100206 - DNA, 1050 bp, Homo sapiens
ttgcttataatgacatatgcacatcagaagactacatcagaaaacaacatctaaattatttgaataaaaagaaacagattggttttgtacttatgctctataattttgtcaaatgcatataatttttgcagaaaatttgactaaggaaagcacttcacataaaccaccccattttttgtagaattttagcctaagtgtgggtttcagctcagattgggatgagatgcgctttccttttaacttatattggctttctctgacataaatttccagactctgattccacactccttctctctggattaatttgcccagtgatcacttttttaggtcatcaagattcaataaggtagcaggtcagtcatgctttggagttccagagctgctgtgtgctgtcagagctggtatgcccatatgtgtgcacgagctgaaccgccagtttcctcagtgggtttgttatgtagaccaattgtttaactaaaatgcccctgacaataactcagtaggatagtaaacatgttttgtttgttttttaatttaggggaaacataaagcaatgtaaaacctttttctacgtctcatgttgggccgtgtaactgacaccataacactggacccttatggtcaagtcttggttctcagtgagaagagttcttgcacagaagagtttggggatattctctttccttcatggcagcaattttactacaagtgccagataaattttaaagtgtatcttgtttattgtcatgcccagcttagcaggtaacatgtcatagctgacctcagaccttgggttttgatgttagtttaaattaaataataacttagtttttggctttgaatactttacctctgtcagtttccttactctaaaatgaggaaaataatccctccaagacagattattgtaaggatgtatggaatgaagtatatataaatatgagactgaagaatgaatgaacggttgagctgatggatgcagcagtgtagaggagggcctggcccctcgctcgttctcccagccccaactagaagaacatctcaggg

SEQ ID NO: 100207 - DNA, 1097 bp, Homo sapiens
tggccatgaagcatagaaaaaagtctggccattacaagactttttataatcctaatgaatcctaataaaaatcataatttaaaaaagcacaaagtagtctaaatttattaattttccctttaaatattatctagtcattttcataggctttgatacttatatcacacggctcctttgttttcagaggagttcttaatattatcaaaagcgggtacaaagcctggtgagatctaaagctgtctgaaccgtttatccatgccaaatcacttactcaaccaggaaggcccacccttggcatttttggaagaagacttttatttcaggtttattttgttctctcttaaatagttaattcattggccccagcttcaaagtgagaaaacaaacaaaaaacagtgagacagaaaaaaaaaaaactgaatcctacattataaactgttgactacaaactgaattctttaacaaaaaaaaaaaaagtcagggttttaagcccatcctcctattctggaaagggaagggaacaagtttcctaaagacaatctcttctggtgcccacagactgaaataacacattgcagtgagacatcagaacctcttaatccaacattaatcaaatttcagtttactaattatcagtcccatgttgaaaggaacagaatgccataaacagcatccacagaacgtttagtggactctgggattataagcaatattttgaaagtgagactttctgttattcaaatctctaaaaaggataatacataccttattagaataagagacgctgcaaagccaaagaaggacaaagcaggcaagtccaaatggtggtcccttctgtgcagagtctgccctggcgtatacagtgagctcccagcaggtttccgtgctggagtaatttgcaacacactcaagtaaattttttaatgaaagcagaatacttttttggtaatctaggggtgagtacgacccaaatgccatcatgttagccttgaaagggtgtcctttctgttttactactgaggaattttaccacactctaaaaggggtactttgaattttgtgcttcagatacatttctgaggccctgtgctttgaaa

SEQ ID NO: 100208 - DNA, 1054 bp, Homo sapiens
taaattctgctacgaattttcacatcttcaaaaatgactcctctccctaaagctataacaaccttgtttctttcttgttcagtgggatctttggttctttttcctggacagatctttattttttccattcatctccatacatttcagaaaataagtcaaatggtaccatgtgttctattttgccgggcagcaccagttagcattcgtcaacatttacagtgcccctgccatgtgccaggcacagtcgttgccgctaggaatagaaatgtgaagatactccaaatgaggggccaatgtttgttcatggaccaggctttgaaagagcacatcatattatcacatttgagaatgacagatgcttccatatggcagagtatagaatacacacacacacacacacacacacacaaacacacacacacacacacacaggatggaggtgatggaaacatttaaggggccatggacggggttctgagagagagcaggggtctcgtcgaaggcagtggcagggatgatggattggatatctaggtaaaggaggtggactaagtcagtgtgggacctgctagatttgtgggggtgtggagagaatgagaagaatagaacggtggtctcttggtggtatgagaacagaatcgcagacagaactctctgggccatttgaagaaatggcttgaaaggagggggcagagataaagaaagacgggaataggagagaatggtttcacagaaaagcaggaaagagagaaatgaagggttagtttcagcagactggccaagaaagagacatcctactgggtggttttattcatgactggttctagcagactcaagtcttcacctggaggattgggtataagaggacctagaactgaattactgcaaggtaagatgttaaaacatatcagatagtagcagcaccacaaagaaacactcctgagtgaggtcaacacgtgcctgtgaatgaaaaatgcatggggagaggggctgcattgaagagcggcagccagaatggagttatacccccagatgggagggatggccatgcttt

SEQ ID NO: 100209 - DNA, 1049 bp, Homo sapiens
acccttccgcatccgctttgtacagcagcagcactgttttccctggcaggaccactcaccctgtctatcctggagcctcctttactgcctcagtgtccagtggtctgtggagcctaaaatacctgaccatcagtttcctcttcccactgagaacactgtatcttcttctaggaagtacttaagtactaaagtactccttaagtactaaaactaaagtcagagactatcatcatagggataggaaaaaaggacataccataccttatgggtcagcatccccaactcatggggtaatatatcccacttagcttggtgaatgattttcagcagtcatcaaacaggcaggaggctgtgtgggtaggccctcctgtaactccactggtcccgtgtgccttactcatactgtatttcttaccacaggttgggatatatcttgctgtaaggcaagtccctacccagttcttctttggctttttttagccaatttcatttctacaaatgtcttagaatcagctagtcaagatacatacatgccatgcattaaatccataggtcagtctaggaaggaaagtcacaacaatattgagtcttctagtccaagaacacatctatcatttcatttatttaaactaacatctctgaataaagttttgtaactttctttatactttccttgttagatctattttatatttttatgctgttgtaaataatatttccttttctaaccatttgttgctggtggagaggaatgcatttggatttttggtgaatgtattctgtatccattgactttgataaacactcttactaattctgaccatttgccatagattatgttggagattctgtgagtacagttataccatctaaaaaaatgacagtttttcttcctttctaattcatagtcctctatttgtgtcttgcattactgtattggcaaggatctccagtgcaaatgttggtagatgtgatgtagggggacatttcttttctccttcacagtctcccacatcaagttctcaatgtttcaccatttagtggttgct

SEQ ID NO: 100210 - DNA, 1072 bp, Homo sapiens
attcattgtcattgaaaatcagtgatacaaatatgttaaaggggactctcatccagttgttgaatgtcttacatatatctgaattatgcatgctttataggaattaaatatgaattgggattttcaaagaatttttcatcatgagcacaaaattgtattattgtattactaggcctctttggaaattataatgtcaaatttattattttgtaaatgttttaagttttctaaattttgtacttttgaaaaattgtatcttgaaattttggttatgttgattaataataagagttgaaggaaccccatatcacatctagcattttgtggagaaccgtgggtatggaatccagccttgcctggtgtcgggcacttgccaagcctctgactgtgctaatggggtcaatcctgcagaattgcaggcatgtccacgaagaggccgggactctggagcacggcccacgtgatgagtttcaacaattggagcaccttgctgcagaatcaattcagccatgtcaattggtattgatcatgggaagagctggaacaatccaatgatctgtgtgctgtgtactaaattggctgcagtttcgatccttgtcatacctttagtggtattttagccatgctttatgtagcgacttgtttttgttttagaattactaatagaagggcgtttttaaagttcttaaattaaacattagcatattaagccatccctcaagaggaatgacattgtgtttttcagcttgatagtatgtataatcttcattttcatttcaagttgttctcctgaaggagctgaaagttacccttctgaaaactctcttttaaagctttgaaataataggcaacagatttattgttcatattgggatttatgacctaatctaaagggttaaagttgtgaggattaaatgagctaataaatagaaagtgcttcaaacagtgcctggtccagagtaaaagctacttaagtgttagctattattattattattgttgctgttgttttttgttattactactatggagagagaatacttaatgaattccaagtttaacatgcttatta

SEQ ID NO: 100211 - DNA, 1051 bp, Homo sapiens
actcatgccgtaactttgaattatgactcataaactttcggcagtggtgtaaagtggttgttcaacccttttgaaaggcagtttagcaaggattgctaaatatttttaatattggtaccttttgacccaacatcttagaaaaacactcctttgagtgtgctttctgttttgaaaaagcagaaacccccaaaatccatcaatagggaacctatgtatacacacacatatatgcatatatacacatacatttatacatacaggtgggaaaaaagttagagattatataccaaaagtttggtagtggttttattcagttgatatgattgtagagcactttcatttttaatgttttttatttctttaacattttaatctggtctaactttgtattacatttgtttgtaatcagaaagaaagatataaaaacgaaaataatttattttttttctgaattcacagtcctgcttagtgaaagagcagctcatttttgatcctcactctttcttctttgtgacctttgtcaggtggatctctccacccactgtgggttcatgggtggccttcagcgcaatggcagcaccgggcagacggccccttactatgctacctcaactgtggaagtgattttccatgtttccactcgaatgccgtcagactcagatgattccctcaccaaaaaggtaaggggtctcctcgggcaccattcttagctgccctggtttgtaggtgaggctctcctaggacagacaaatacaagggtagaacgcacactgagatggtttctctgaactctacgaccctgagattaaggtttggggaaagaaggcgtcttaaatgttattacttttggatcttccctcccgtgaatattacctgatggaaaatgacatttttgatctcacagattgtcaaaggttacaaaatatgatgaccctgtactggtggggctctgggaaagcaggcccctctgaggcttgctgcggggcgatttggcagcatctgtcaacataagtgcaggtgtgcagctgctcagccgccccactgttgcccc

SEQ ID NO: 100212 - DNA, 1050 bp, Homo sapiens
gactgagtagataaaataatattaaacttactcacagctatgtattgtttccatccttcagaagcatatggtattaagatggatttgtttgtattgaccattttgtgggaatcagaagggcataagttttcttttcttttcattttttcttttcttttcttcacccttctactttcccacctgtctcccaggtcactgagcgcctcttattgcatcatatagctacatacatgttgaagcatgaactgttttgtgtatgtttccaagtcttgggaatgtgacaggatggctgttccaaacctgattccctctgcagaaggggacatgagggccttttttcctaggtggccttaaagagtgataaatatttcagtatcaaatatgcagacatttttttaaaaacacaaaattaaaatattcatttgtagttttacctggataaaggagccattctctgtccagaagcctgcagctccattgccattttaaatgtctttgtttcctgacttatcaggtgagacagtaaaagatttgaatttgaataattttttaaagtcattagaaatgaaaaacctgaagctgccatttctcaccttgcccttcactgtattctgtttcctgattcttcttgtgattccttttctctagaggaacatagatcaacttctctatggaaattctgtaagggatttattctgaagaactcaggggttcaccacactctccctccttccttcagtattaaataagcagtcatttgggttccacactcagctttttaagcgtatgctgaattattccaggcttcttagtattaagtgaatacttggtttcatgtaattgcggtcaatttgttgagcgttaatgcactttagttgcatgaggtacaattgaattagctccctggggtactgttgcaacgaaatatggctttgaatagctgagtggcagtcccctgccccttgatcaaccttcacttaaaaccccaactcctggatttagtgtcttcttgacatcaaatgggtatcaacttattttatggtgaagggt

SEQ ID NO: 100213 - DNA, 1133 bp, Homo sapiens
gtgaatttactttacataaatatatttaacccaatggtgttttcttattttctcaagtattaccttgattcttataaaaatcagtgtttggagttgatgatcttgaatttatgattaaaaagggaaatctgttacaattattacctcatttatgcattttggcatattcaagatgatttgtgtttgcatggcttgtatgtgtacaaaggctcaaatgagtagatagatcttcaatcaactgcaatttgtaaacaaccagtgaactttcaggaactaatcttgtgaaaataagaataatttaaaaattgtattaagttagcccttacaatttatggcgtcatgagttatactaatttaaactcattactggttatgacgtgcactaatggtctctgcttgttgtgctcattccaccctccaccgtgattggcctgtcccaccactacccttcatccccagattagttccttctacctgtgccgcctttggtggacaggagggggacttaggtatgtgcaatcacacagaatgtgaataagtactttttaacttttactttccttttgccttgagaacatatttcttggcattgatatgaaaggagcaaaataaatttgctaatagcaagaagatatttaagagtggtcattccatttccagctaggaccaagcaggagtcctagctgccaagtgctgcagtagtttgacagattgtcaggggacacgcggtgagtagcatccgtggtgcacatggcctctgttttcacaggttttgcactgctgtgtgtgtggctcaagcacgtacacccaacagagtcactacatactgaccctggctgacttgtcatccacggattatgaccccttcctgccactggcaaatgtgaagagctctgagccagtccagtatcattcatcagcagaattgggtaacctgctgactgttgaagagggtgagtattctttcaggtatgaaatcttgtgggaaggaaaaggaaggatttagcctttagccatgcttgctctatttttttttaatctagttgttgaagttgaaatcctagttcctggagtcctctgtgatggcaaattctgccttccttgtttcttctttttttctcctctgttttccc

SEQ ID NO: 100214 - DNA, 1050 bp, Homo sapiens
ctgttgagaagaattaacagtgaaatttattttgaaagttgtatttaaatatactttaaaataaaatatagcatttgttttatgtttgtggtataggtattgtgcatattatggtaaagaaaacaattacaaacacaatttttgacagttttctcagatttatgtttcttattcttcctcaaaaatatcttgaaacagtcaaatgtaataacctattagtttcaacaaaactaagtgatatatatgggctgtgacaattaatagaaaatatgccatttgtttaattaaatatttaagtactaaaccattatcaatatttctatttgtcctgaaaattggcctattgagggttctttatcttttctttcaagaaaacattctgctaatagatctataatatttgctattttgtataaatagatttaaagtgttttgttatttgaaaatactgagaaagtatattaagtttcatgagagttttcctctgttttcttctttttaaaaagatgcattgctgtttgctcccttggggtctggatatgtgaagagcttgcacagtgtacaagccaccctcaggtgaaagaggccatcaatgtgataggagtaactctgaaggtattaccagtttgtggtgctgattggatattaagccatatctgaggcatttaacagtttgagtttgaattagccccatcttttttatcccccaaatgacagagggattgtgattcccattgcatgtgctgtgaggctcccgggaggggcaccaacggatgctcccctgctggcagctgcagcctggccacgagtgtctcgagtcttcctggaccagtggccaaatgggttcctctggtggctgggaagctcctgtcgcaaagaggtcacctgtcacctgttggtgggggtgacaagagagtggggtgtcgtgctctggcctcttcagcaggcctgggagaggcctccacaccttccagttaggcctctcagtgttcaccatctggctgaatcttgggcactttaaggacatctttgtttctttgttttgttaat

SEQ ID NO: 100215 - DNA, 1037 bp, Homo sapiens
atagagactactcaaatcaaagatggtataaaggtaaatgtaaaggtcaaattcacatgaagtgttgccaagatgggaaaataaataatgaaagcataaccagaacctggaaaaacacaaactagaaaatgtggagggaaggaagtattgaaatataaacttcaaaaaattcagaaaggatgaaatacaaaaccagcttgcaataaagaaaaaagtgttatgttctttgaaactacagtaaaagagacatgagtgccttatcttttaagctttctgacggtatcgaatttgcttggtctttagcacatatatcaatgttatgtaatgttatatacatttaactatctgcctgaggtatgatagtaggaataaatgttacagccatgaatcgatttttaattctgttttcaaatattgcacatgagtgtgtgggttagtgaatggttgggtactgggtgtgctagtcataccatttttcctacacatcttcatccccgtgtactacacttttggtgggaaggtaaattgctgcagccattatggaaaacagtatggaggtttctcaaaaagttaaaaatagaactaccatatgacccagcaatcccacttctgggtatatatccaaaggaactgaaatcagtatgttgaagaaatatctgcactcccatgttcagtgcagcagcattcacaatagccaggatatgaaagcaacttaaatgtctattgacagatgaatggataaaggaaatgtggtacatatctccagtggagtgttattcagcctttaaaaaatgaaggaaattctgtcatttgcaacaacatgaatgaaccatttttccaaatgaaagaagccaagctcagaaagataaatactgtgtggtgtcacttatatgtggaatctaaaaaagtccaactcctagaagcagattgtagaatggtggttcccaggggctgtggttggggtagggggagatgggatgatgtttgtcagtggatcaaaagtttcagttatgccgaatgaatgagttcgggagatg

SEQ ID NO: 100216 - DNA, 1576 bp, Homo sapiens
tcataaggcactgtccaccccgctttttctccctgggttttcctggcttctcaatgctggtgggggacttcatcacggccgctgccagggtccttagcacagacattttgacggtgagtatgacaatgctcagcatcccagctcccaagaggcttcacaatcgctaacaaggttcagatttctccactcttaacaggtgttgactcattagtgcaatgtgaaactgggctctcagggtagataccctggcagctgatgtgtgaaattgtaggataagatgacacactggttttggaaaggcgtttcatcaaaaggccaaagtgtgagaaatcatatcctcactaatatttcagcacatttacacagtcagaagcaggacttgtctcttagaatattattagcattttccagtaaatggtgacacagacataaatgtctaaaatagagagttttaaaatgtacattagcagtaagtttttttttgtttttaaattaagtcttggttattataagtctcatagaaaatattttcttaaaatgttagaacagtaaagtcttaactagaagtaaatatgtattctcttaataacatgccagaatactttggcagaatttttgtaataaaaaattagaagtggactaaatgatcagtaagggctacaaaaaaattatttttactctctacatttacctctactactaaggcagtatcttttcttttctttttttgttgttgtttttcaagagatagggtcccattcattctctgcccaggctgaagcgcactggtgctgtcatgcctagctcactgtaacctcaaactcctgagctcaagtgatcctcccacctcagcctcctgagtagttaggactgcaggtacacgccattatgcctggctgatttttaaattttttgtagagattggagtccctccatgttgcccagattggtctcaaactcctagccttaaatgatcctcctgcctcagcctccaaaatgttaggattacaggtgtgagccactgcacatggccaaagcaatatcttaatgcctttttgagagaatactgttatacatttaaagttaaagggccttttccatttgtgctctataagctgttatatattcagagttatctttgccccttcaaatggtataaataaaattagctttactatttgctaagcattggtgtcgaaatcagtgttgccatccaacaacctaaatcttgtttgatatgagattactttttcacttatttcttctttgcagggtaaattcaaacttcaagcccttggttttaaattaaattgtttaaaatacttcctgtagctggtatttcatgttggcgctttcacacactaactttttcttataaagataaattagaaaacaaagagaagtgaaaagagacaggagcaaaagagaagaaaggtaaaagagaagaagaggccaggcatggtggcgtatgtatagtcacagctataggagactcaggaagccaaggtgggagaatcacttgagatcaggagtttgagttcagcctgggcagcataacaagaccccatctcttaaa

SEQ ID NO: 100217 - DNA, 1076 bp, Homo sapiens
ggggacttgggggaaagggtggaaggggatgagggataaaagactacaaattgggtatagtgcttactgcttgggtgatgggtgcatcaaaatctcacaaatcaccactaaagaacttactcatctgaccaaatagcgcctgttccccaaaaacctatggaaataaaaaaattaaaacatgagtcactttgaaaaacctgttaggcaagtaatgttcactttggacagggagatggcaaaaggcatgaggattgcacatgaatgactcatgtctgagagcatcattctttcccatgtatatataaagccctggaggctgtgaggaaggtttcagatttttattatatttttcaaagacttctgttatagctgtgtcttaatgtatggtggggatggtgaaagaaggattctactgagttagaaatgagtggggcattttgtggatgtcccactattgagaatatgcagcggctcttctttgagtaccacgtggttattcctaattttaaaatgttatcacaaagatacagtcttcgagttgttccacttcagtgtggagaagcaacggaagcaggcatatggccataatttggctgactggtcatatagttccctctttaacccccccatttaccctcccccagtgctgtctttggcgacttcacacaggcgctgtgtctcctcagggcgctgtcttacgtgggtggcagggtagggtaggctagccatctgttattttgccctctctttccaaccttcttgctcatagtagcaggttccgttgaagtgattggctgaggtccagggggtgagggagccatgtgactttatctcagctacatgcctatctgctgtctttagcatcagtatagcaacttagtcatattttttgaatgccccattttacagattgttgcctttacacatacaaatcttacaatgcaaaatggattcatttacaaattgtggtattagcttgttaaaggatttagttcataattcccataaatttagcctagaaaagcattttttaattaaaactctaaattccagtggtgaaaaggggcttatttgat

SEQ ID NO: 100218 - DNA, 1865 bp, Homo sapiens
tggcatacatttttcagttgagaacatgttcttttgctctgaggtttctctctggaaggagactctactgtggcctgtcacagagcccagatcaccggaatcttttttaatagagtcactggagtgcattctgtcttttcccagagagggtagatgctcagtagatatattgattgatagaaaatggaagaaaaaaaaaaagaccttcttctgagactggctattccaaatctacacagcatcatggggaagaatgggtaaccaaagcagctgagctgagccactttggttgcaattttggctccaactatcagtttcaaggcaggcattaactttctactgtggtgagctagtcaactttcattaccctagaacagtgattcttgaggggcaggggaattttgccccctccagggaacatttggcaatgtctggacacacttttggttgtcataaagtgcactgtcatttggtgggtgaaagccagggatgttgttaaatatcctgtagtgcacagaaacacaacaaagaatttatgaccaaaaatgtcagtactgctgaggttgagaaaccttgccctaaaggagtacttctgcagatgacattgtcctaagaaaagagctaggtaatataaattaaatgacacaactcagtaatcaaagacagtatgaaagtctcactctgttagcttaaccaagggaataaatgcatacaaaaatttaaccagggagattaagagagtcaatgtttcaggttgagttaaatgagttttcaaaaagggggtacaatttcataatggttcagcttactaaattctctgtctaaaaaaatcagtttaagaaataaaacatggaacgttctgattaattctgaagttaacatgaaaattatctgagatgaattttgtctggaagcccaaagtagaaagttgtgtggcctgcatctgcaaagcccaaggcactgtatgtatgaaaggaggcaggaagggggctcaggttccacttcttgcatgagcactgcctgagtagctaagaggaagcaggatggctgagagaacagcttgcatggaaaagggctggtgcatggagacagataattgcctttttcaaatgtctgaagcagtgctgtgtgagagagactgttttacccagagccaggactaataggtagattctagctcatcatcaggagacactaaatccagttttctgttcaaatatggcaggtgataggttctgtgtttgtaagcctttcaagctctaaagtattcagtccaaggctgtctgacgctctaggacagcctcagaaaaagggaacattcactttagagcttgagccctacctagccttgcactcaagtcactgcatccatgaattggtgaacagatacatagcctgtttggcttgtgctgcttattccatgaaacgggtttctgatgactctgggactttgggaagggaaagatagttaggccttcagtaggcaatggtacatttcattgcagaagggattttcctgctctttggaatatagctattgacctgtaagaccatcttttctcatttagagttctatgaagactttaagaaatgttacatttttctccaggcacagaggcactgagagacacaggaatagcttctagagacatttcaggtactaaagttatacttggggaaggaggatacattaactcccatttggagaggaatgatttttgaatataagagatttaaatcatgactgtggtttataattcataaagagtagacttggatagaaggatataatgtcaagaaaagcattttaaattgcaatttttgtttccgtgagaaaagtgctctccttgtggggaataatctct

SEQ ID NO: 100219 - DNA, 1996 bp, Homo sapiens
aaataattttaatacatgtctctaaagtgctcattctgtacagcaagtgattttaccaaggttttaatttataggattttaactcaacactagcagataaagtacttatttgtgaatttaaagatctaactgatgttccgaggatgaaataataactttgatgtgtatcagtagaggaactttagacctttagaaggctaactttgttaaagcttcatttaaaaacagtttaaaaaaaactataggtttatacaacaagtaaaaataggactaatgtggggccttattcctaaggtttctaagaattggaaaatgtacttccaagaattcaggatataagatggcttcagaatatattgactttcaagaataacatatgactctcatggatggcaggcctgatactgggaactaaaataccttagagctagactcagctttgtcactcactggccatggggccctcacctatccacaagtagtcaagtgaatgaattgggctagagagcctctcagaccctttcccattaagcattcttagatcctctgatttatttttaggcactttattattagggtcacatcactccttcctaaatgtggcacaaagttcaatgatctttttatgttgaatattttttcctgccatggtaaagacctagtcaggttatgagagtgtgagatgcataaacaagtatctgtactaaccatcaacttgtgcagaagaccaaataagtagtgatatacatgttatgaaaattgaactgttgaatatccttttagctaagttgatttgaaagcagctcacaaaggagaggggatttagcaggactttcaagaatggataggatttaaatagcaggacaagaagcatgatggagtttcacatcaaagatacagaacttttcaggctgtgttcaggaacaatgactagagtggctttgatttaatgccagatatatgcgtagaaataatatatggtcatgaatccaggcagcactgtagagagccttgattcaaagtagttttcatcccatggacagtggggagctgttgaaggtttttgagcatgatactccacatgaccacaagagcattttaagaagcttaaaccacagtgataaagtgggggtgaattataatcatgaaagaatgatgacaacaaacacagaaaggaaattattataatagcccaggggcaaggtaatgagggctaacaaggactgaggcacagatggggtttgtgtgtgtgtgtgtctatgtgtataattcattatatgtgtatatattttgtatatatatgcacatatgtgttttgtgcatgtgtgtgtgtgtgtgtttgtctgtgtgtgagaaatatgttggagaggtaggatgtagtactgattggtaagcatcctgagaaagtagtgtcctggcacgattcccattatctgtcaaggcaaatgttggttcagaaaggcaagaagatgaattgagaaaaggaagacatgtgggcatgataggataaagggactgtaagtttcgactcatgtcttgatgacccttcctcaccttggacattatagcataggacaggccaaatgggtgcatccgaggatacaccaaggggtgtccccaaagaattcttgcctgttaggaattagaaatgtgcaggaaagatttccagggacattttctctgtacttaagagaacatattttctaattctgttggaattcaagcagttggtatgcaaattgtaaatgtatttataattattaaaatgggacatctaaagggctctgtaattgatgtttttgttagccaagacatatatttgttactaattatttctgaaagtaatgtagcacttaaaaacaagtccttttatttttctaaaaatacaacttctgacctgaatttactttactcaagttaatgaaatattattgaatataaggggagtttactgtagcaataaacaaaacttccaagtttgacttaggtttgattg

SEQ ID NO: 100220 - DNA, 1033 bp, Homo sapiens
aaaatttggcgtgactttcagggctacccggcctgcctgtgaaggagtctcccagtacgcttccctctgctcagctgctttgtgtctgagggtgggctggtgatggtgcttaggagtatttatttcttcagcactcacagtgctggactctgtgctggggactgcatgatgttgtactattgaatcttctctgcaattcaattcaataaataccatggcctattttattttattttattttattttattttattttattttattttattttattttattttattattgcttttttttttagagatggggtatcgctccattgcccaggctggagcgcagtgacacaatcatagctcactgggctcaagcagtcctcccgtcttggcctcccaaaatgctgggattacaggtgtgagccatagtacccaggcccctgaggcccattttataaataatgaaacttcaaaaaaatatctaaaacttttgcccagtgccacaggctaaaaagcctgttagaattcacatacaggcttggcttattccaccaggtatgttttcttttattgattcacagcaagcgtattggtccaacagccttgatgttgtttctcccttccgttttattttgcctgggctctgcccttggtcctactccacttcagaatcctccttattaaactaccctgccccaacctggaaagacctttccacagttgccttctcagttcttcatcatccttcagtttctcttctaaagctgtttcttgttgttctcagtttttcctaacacttaagcagctttttcacatcagaattccccaaaatagtttgacatgaaagaacctatgatttggatttattaaaaacagtttttattaatttcatgattatttaaaacagatggaaagatcaatatgtgtgaaatggaaaaggacagttgaggaaaggaattttattttcatgtttgtaagaacatgtatcagagactggaaggttttctttgcttaaaataagtgagctattttttaacaat

SEQ ID NO: 100221 - DNA, 1040 bp, Homo sapiens
tctttaaccttaacaattattgttatatattttagaagcgctgactgtctgccaaacagaattactctaagtaaactttattcctttgccagatgaaaattacgcagaagacctaatgaaagaaactttttttcatttaagttaagaaatgtctctggtaattagtttaacttttgatccacacgtctaaatagatcatagtggttgtttcagaacttatgtaattctggaaacacatgttatattaattataaaaagaaaagaaagcatttatggtagagaatacagttaaattcaattttttaattaacaaactatgtacctgtgactggtaccatctcagggcttctttctattttgtgagaattctcaaagggccacacttttatgtatcctagcagcaaaaggatttatttatgcagagagaaccttatgaaagatgtcctgtgtttttaaataaataatcataaataattgtttaaaattgaacattatcagttttgtctcacaaataaaatccaaggtgggtttcttccttttgcctctgggtggcacacttgtctgcacgacgcagctttgtggttcatgggcctttgaacattatgctttgtatggcttggttgtttcatgaagttctttcttaaatctgaaggtatcaaaattatgtcagtagtgaccaataaagtgttgaattaaataagttataagatgctaaaaagtattttcaaacataatgatgttcatagtaattgaagacattttttagtttaaaaaacaatttgtaaagtagatgtctcatgagttgtgttctctggcaatcctggaaagttatagtttcatctaatatgatagcaaatttattatgtaaacagacatgaccatttgtatcttaaaaaataataatacatataccaaacagccagaaaaatgtagtgcattccaaagcaactgtttttagtatttttaaccagttttggttatcctaataacttatgtaatactaacacaatgaatttatcaagtagtatttcccccggtac

SEQ ID NO: 100222 - DNA, 1078 bp, Homo sapiens
cactcaggcctttgagtttgttttttatgtttagttttcaaatcaaaaggaaaatttttttcagagaccgaggctacatttctttaacactgtgcctagcttatataaaattgcagccatattaaatcaccatttggccttaaatgcttattttgccaactaccaagacttattttgtggctgaaatcctttctatatttgcaaagttctaaacttttagatctctttgtaaaaattatttatgtgtttggagaaagatgatacaattatgcttgtaagagttttcactttaataaaaaaattttaaacacccgtatagcattaagtagtaataaaacaaaaagatagcaggctagcatactaggctgctaatgaaaaataaaataaaataaatattgggtatttttagggtgaacgtgaaattgtctgaagtctcttaaattcccatttttaattaagtgctccttcactgaggaaccctctacatgtaaaatgtcagcatctgttctgtcacttacgccaccagcagagtaattttgggcaaaacatttcaactcattaacatttttgttcatagtaatactgaggaaactcatacaggcatctcagaaactcctaaagaagtcagcgtaccttgataattttatggaggatgttgcctaggattttatcattgaggcatgaatttttctgagtgtaaagcagtactgaagcagattttctatgtgggattctttcataagtaagggcatattcgttggcaggttgaaaagaggtgcaggtgatgatgaggtatctgtctacatgtacttggagtggttactcaagcaaatctccagtgtgattgggatgctggggaccaatctctgttttggatagctacatttttggagtgaaggtttaaccagcgatgaaacaaagctgtaaattatctaatccccttactttttttttctcctcaagggattgaaaaatgccatgacatcctttatgagaaaaataaatgccatattatgcttcttgttcacttgggggctcatgttgattcataagcatttattgatgcttcagcatacct

SEQ ID NO: 100223 - DNA, 1048 bp, Homo sapiens
cctggtacccagtcctaggatgacagggcaggggatattgacttagtatgtgagaactagagaaaggaggtagttggagggtctgaattttgaattggtaggtttgcatgtgaaagacatgctgcctggtgaatagacttctatctctaggaattagctaaccctggaagtggcagtccttccctgatcagtgaggccctaatgccagagcattgagaagacagaaaataagaaaatatacttaagacatgcatacatttagttctgttgaaatagtcaggggagggggacatttatgagtctacagctaagaatcagtattgtcatttacctcatcccttatttaacaaataagcttatagtctagaaatactgatttagatgctctgagaaataaaaagatgaataagtcataagccactatagtttttaagagcttataaaaaggacagaagacacaacatttatcctaatagtcacaaataatgtgataaattctatgacatttacttaaagttgtaatcatagagatagacaaatagacggatggaacagaagataaaatatagcactgagtgcacacagacatggaatcatgatatatgatatatgtggcttgtcaggtctgacaaggaaacaatgtattgttcaacacatttctgtgggacaagtacttagccatatggaaaaaaatgaaatagaattcctacctcacgccatgtccaaagtcagtttcagagggataaagtacataaatgtgaaaaggaaaatttaaaaacttttggaagaaaacgtcttttttaaaaggttctatgattttttttaaaaaatagctaaccataaaaaaagtgtcagtaattcaacctcagcaaaatgaaaactgcattaccagagaaacttttaagaattctgtggtttagcagaaccacaaagggaaaaagccagctttgttgctcttttctttccatgttcttgttagctcagtgataacttttaaagtaaggtttggtgagaaatgttatctagcatcttggtttagttgggagat

SEQ ID NO: 100224 - DNA, 1036 bp, Homo sapiens
tagaaggtctgcatttcttatttttgtccttcttcacctgggtgccctgcatggcctggtataaccagcatctcttcctgtacatagaacttgctgattaccacccagtacttcctgccttgaatcccctcctgtcttccctctaccacttcatgtccattgctgtcttgaacagctctcctataaagctgagccaattaaggcaacagtttattctgcatccccttcagaggcagtttatttgcatattttgcttatatacattataattattttgtgtaatttgtgtatgttttgtctctccaagcaaattataacttattagaggatgcagatttcctcctgatttttttttaatcctgtgaatttaatacaaggttaagcaatgctcaggagagtctgtggcatgcttaactaggaagacactgaatggacctttagatctctgggtggagtttgcgccttccctaccagcacacttatcatttgtgtgcataacttatgcctcctagagcattgtgttcacaatatatgtgtgcctgaccagaagaacaaatagaactttaaaacaaattccttccatataatttagcattccttcttagatcaatttaattggatggatgtaagttgacaaagtagaggatataaattaaagtttcagatcttgagtaacataaaattaaatatagtgatttgtgaaaacatatccttcaaatggaaaacatcaatttatttagctattattattatttgtttctttttctttagaaatttgggctagaaacttaagtcttataacaatgaaaactttcctgtagtaaatgcaatatttctttttgtctgaagatcttagttcgaagaagcagcagccctgctgaattggatttgaaagatgatttgcagcagacacaaggaaaatgtagggaaagacagaagagtaagttccgggaaatgtctgttcctccaactacagagttgatatgttctattttctttttacattttattattattattattagagactcagtct

SEQ ID NO: 100225 - DNA, 1060 bp, Homo sapiens
cttgttggttgacatttagattgtttccagctttttgtttttgtgaaaactgtagccatgtacattcttgtatgtgtttcagcatctgcatgtttaatgttttctctatgatggctatctaggaatggaattaatgacttatagaataaaataatttctttacaagataacccctgttctctaaagtggttgcatcactcatatttttgccagcattgtgtagagctcccattcatcttcattcttgccaacactttctattatcagattttttcatttttattggtcaactgagtgaaaataagatgtcttattttgtatttcttagactactaataaggttaaaaatcttcccatatgtttattggccatttttgtttcatctgtgaaatgcctactgatgtcctttgttgtttttctattttttgtctttttctctttatttatatttactagctctttgtatggtatgaatactgatcctattttggttatgtttgtagcaaatatcttcttccaatatatggtttatatttttaccttctctagggtatcttttgatgaacagaagttcttcattttgatattctctattatcatttttattgttgaggctttatggaattttttaaaagtctcaactacacaggaataaaaatattatatttataaatgtttcaggtttgctctacaaatttaagtcttttatatatttggaattgattcctgtttatggagtgaggtagggatccaatttcattttttttcctgaatagataactacttgtgtcaggtcccatttattgaattaatttttctttattgatctgaaatgccacctctctttcatatgtgctatttctgagatatgtaaggcctccttttggtgtttcttatcttgattcttggttactttatctttcggacagtacaacatctcagttactatagttttcccacctctttctcccttttccttctaatggaagttatttttccataatcttttgtctttctttgttgctgagaagtcttctgtccatccggtcctgtctggtta

SEQ ID NO: 100226 - DNA, 1103 bp, Homo sapiens
ttttatatatctatatgtagatatatacccacttttttaaaggttggcatgtttgaggacgagacaggagtccaagtggctggagtagaaggaagacggaggctgttacaacatgaagtcaagtagggcatcaagttaggtattatggaaggcagggaggcaggatgggggcagggacatagggaaagggctgtgagaagagccgttaaagttgaaaatgagaatggaaagctgaccagacttgtgaaaaagtttattaacagcttgccgactctgctgagatggaaaataataacttttaatagcattaatctacacggtttcaccaacaacttgcagcagcaacagggtgtggaaagcagggagacagatggtttgacctgtaaacagtgaagaatagatttctcaatgaaagagtgtgcttaaagtgtgtctagtatcattggaaatagttattctgttttggtgtcatgaattagttaagaaatcaactctatttatcaacaagttatctcatatcttttaatgtcaaagtcatgctagtctcatcagatgagtagggaattattctgtcttagaaatcctctggaaataagaaaatacagtaaaagcttcagaaaatgtattatctgaaagatttttgaaaggttttgtataaggctttttttttatacatatttggtagaaactaccagttgcctgcatttttcttgtaggaatgttttaaaatatcatttatattttaacataatttcacttatggaggaggaataagttcaagaaatgtgttgtacagtatggtgactgtaatttgtaacagtgtattgtattcttgaaaattgctaagagagtagattttaagtgttctcaccacaaaaaagtatgtgatacatgttaattagcttaatttagccgttgcacagtgtatacacatatttcaaaacaatatattatacatattatattaatataatttttatatgtcaagttaaaaaattaaaaaagttaaaataaaatagttataggactatttagattttccatttcttgttctgactttgataaattatgtttttgtagaaaaaaattttttttttttttca

SEQ ID NO: 100227 - DNA, 1849 bp, Homo sapiens
tacaggtgtgagccaccacgtccggtctgttctacaattttaactgctttttaggttaaaacatttatcaatctgtagcacttacagatagtagattttatttttcttttaggaatattgtaatagtagtaatgagaggatcaacaatctccccttattctaaaaaagcatattggaatggtatggcaaaccttgcctcgctgcttctgcatctggtttgtgtgcttctaggaagtgcttttttgtcaggacctggtctgatttacccttgggaagtttgatcttgtgggaaacctcaagatgctgagctgatatgcatttcctatgctttttataggatcagattggtatcatgcaaggtgttttaaaaattaggaaattatactatttattttgcttatgcaaccttgtataagggataaatggaactcagaattttggttattgaagaatgagcctcactccacttactaaatgtaagactgagtaaggaagacttaaaaagtgagtgaaattgctgtgaaaaatagagatctggaaaaaaaaatagaagttactgaagagcttacacacttaatttgatcacactgccttttctcagtggaaaaaaatgaaattaagtaatccttatttgatcatttttcggtgtttcgaatggagctttagaaagtaatagtttaggccgggcgcagtggctcactttgtaatcccaatactttgggaggccaaggcgggtggatcatgaggtcaggagatcgagaccaccctggctaacacggtgaaaccccatctttactaaaaatacaaaaaactagccagttgtgtgcctgtagtcccagctgcttgggaggctgaggcaggagaatgccatgaacttgggaggtggagcttgcagtgagtcaagatcacgccattgtgctccagcctggccgacagagcgagactccatctcaaaaaaaaaaaaaaaaaagaaagtaatagtttagtaatggtattgtgtaacttacactgtcaagagacgagaaagttagtgcttttaaaatctgggtagttggaactaactaggctttagagagagtacattatttggtgaatctaagatagaatttagctctttgaagtgatttaaacaaattgtgtgatattcaaaatagaaaatgcaatagatctaggatgtattatataattttattgtaactgatataattctttctccattttaaatatcagataatcctgtcttttggtatttgcatatcactattaaaatgattttcattcgttatgaaagagcaactgctaacagctaaccccacagaatgagagcagatttaacataaattgctctttcttaaataaaatgccagcagagggagcccaagaactatttaaaaaggaaaaatagtataaagaaattgtttctgtcattcatgtattcatttatacaaaacatgtatttaatataaaatatgagaaaatcccaataaatatactgttacaaatcaggaaattggatttaaattgtgggataaggagaattgaaaattctcttttcacaccatctcaattgatagtcaactacaggagtaggtagctcagggcacctacaacccaacagcacacttaagcatcgtggctctccccttccttcccactaaatcacgagtgctcctgccctgctactgaccgctattcctgaaggcttggactttctccatctgatacgtccctcctgacagctttataaaaacaaagccttaaaagctgcattaggccagcctgttgggaaggcagaccagctggtggtggcaggctctccgtccgtctgctgtgttgaggaccagtgggg

SEQ ID NO: 100228 - DNA, 1596 bp, Homo sapiens
ggcctacttacttcaacagaaggatttacctttctctatattgaataattaggcctatgtctatttatttttcagtgattctaggatgaactgaatcttcttccttaaaagagaaagatcattttcatgatcttttttattttcagaaatttggcgttgtagattagtattttttgttgttgttgtttttgatttttttgagacagaatctctctctgttgcccaggctggagtgcagtggcatgatctcggctcactgcaacctctgcttcccgggttcaagcagttctcctgcctcagcctcccgagtagctaggactacaggtgtgtgccatcacacctggctaatttttgtatttttagtagagatgaggtttcaccatgttggccaggcaggtcttgaactcctgacttcgtgacccacctgcctcagcctcccaaagattagtattttttttaacattggagataacctaattgtggctttctgtagtactaaactatgtcatactgtgttttagcaaagcaaaatgaaagcttacgttctctgatggctatgtaaataccatattactttatagaatttaagggaagaagttttaccaagagcgaggactataatgtttcttagaaaactctttttctccagtaactattaaaggtgaaaaacagtaagaatggtacatgggaaaatggtcactagtcaattacattactgttgagttttaactgcccaattatttggttttcaaaaaaagctattgtttggagatgattaataaagtatttaaaatgattttaccccctgtttggctaatacacaccccaaaagaatttttttcatggtgaaaagttttcttatgtcacagtccatttttttctatattttgtttctcttaagtttttcactagtttgtccagaacatgttcccacaagaaatctcttcctattagtaatttaattttggaagcttttgttctcattcaatattacattttattttactaagactcttggttcctgtatatacgtatacagttccaactgaagttaaatgtgatttagagcagtgattctcaattggggacaatttcaacaatgcctggagacatttttaattgtcacaagtgggacagtgctagtggcagcttgtggatggaagtcagggatgctgctgaatagtctgcaatgcacaggacagctcccaaacaaagaattgtctggcccaaaataccagctgtgccgaggctgagaaatcctaagtcagagtgaaatcaagtggcctgggctcggtctgcagttttcctgcctttgccatctttgttcttggttttgtagcacaaagggtgaaagaactttagagtatagtgactttgagaacaacctgacattccaactatgatagtgagcttcttagcctgatgccattggttctttactacttaaaatgttgccattgtcctttatgactgtcctatcaagagactgacccaagggcagattgtatattctccactggttggcacattagagtattgaatttgccctccaatttaaatccaagtatgtaggcataccccaccaacatactgcta

SEQ ID NO: 100229 - DNA, 1061 bp, Homo sapiens
cgcgtgccacgacgcccggctaatttttgtatttttagtagaaacagggtttcaccatgttggtcaggctggtctcgaattcctgacctcgtgatctgcccgcctcggcctcccaaaatgctgggattacaggcgtgagccactgcgcccgccctacattttacttttaaaacaaaaagtgaactctttaaaaagaagcttgtatacggcatttaataagaataaataaagccacctcctccccagtgactttgagcctgtaacttaggtttaagacaattgtaattgatatttaacatgttgacttcagaaagtcgcaagatcctctggccataaaacaaagattcattaaagcttaacatattctatagtgcttagtaaaggcttaatacagatggtttagaatcctgttggagtttttatgaaaatatattccaccttaactgtaactctctcatacttttttgctgtagcatttgctggaaattatcaccttatttacatgcacagcctattctgcttctttctttctttctgtcattctctcccctgaggagagacccaattctttgttagcaggcaacttttgaggatgctcattcactgatttcctttctcattccaattcctaaaaactatttgcttttatcattggattctttttttgttttgttttttgagtcggagtctcatgctgttgttcaggctgaaccgcagtggagcgatctcagctcattgcaacctctgcctcccaggttcaagcgattctcctgcctcagcctcctgagtagctgggactacaggtgcgcaccactatgccaggctaattttttttttcttcagtagagacggggtttcgccatgttggccagactgttctcgtactccttaccttaggtgatctgcccgtctctgtttcccaaagtgctgggattacaggagtgagctgccatgcccagctcttctatcattggattttttttttattttttattttttttgagacagagtcttaaaaaaaagcccaggctgaagtgcagtggtgtgatcttggctcattg

SEQ ID NO: 100230 - DNA, 1047 bp, Homo sapiens
ctacccacagattcatctaaagagacagacttatcttaggaaggcaaacaacttcgaaaacactgttttcaaaatgtaccgaacacattatttaattagtgaccatgactaatatttctgatttatgttgctttattctaaaaaggatttaaatatttattatagaaacacttgccttctaagggctagactactagaaacaaaaagcacaggcagaggaaactgggtgtggaaacatgccacaggtggcagccactggccacatcatacctgtgcagaaatctgtaagtctgccattctctttcctcctctatttcttttggtccatagcctctcattgaaataattaaccagaacaatatgaggaaaaataaaagttgaatctcagactacaatgttttattgttttggacctttgctaaaataggattttgtattatttgtagattttcattatcctgcccatttgactgaatccacattagagtttataggcatggattgctctggggatttgtggaggggttggtgtctacaggatgcagtactattctaacatcaggatctctgagtttttggtttataagtagtggtttttggagtgtcctgggaacagtagtataacttcatttgatattgttcttgtattgagaaaggtttattaatactttcttttgtatattggaatgagtactatgaagatataataatatccataagactgttttagattcttgaaaatattttggcaacaagaattcttaaattagtgacatatgagcaacttcctaaattgcagtgtaaggaagtggtacttaatttgtgacaaggaaacctgctgattatatatagttgtaggtacaccatttgctgagcaacacaagcgtgaaatgaataataatgaattcagcctttagattatttttcttttcctttatcaggctgtgttctagatcctcagaaaggaaccaccgtggggaggtccttttctctcagctggcggagccacccagatgtgaccgaaccgatgcgatttaggagtgccac

SEQ ID NO: 100231 - DNA, 1047 bp, Homo sapiens
aatttttccttcaaagcttcttaaagggtacacactgcttattgtgtagactaccctttaataataccagctgccttatagacagtatcagtgtgcttttgccatgtgacaaatcaccccaaaacttatggcttaaaataacaaccacttatttatcttgatttgatgagttggcaatttgggttggactcagccagtcagttcttctgctggtctttgcttctgtgtttgcagtcaaccacgctgtgaaatagtcagctaggcagctctacttttacgggttgactggctgtcagcaggggcaatgaggtgtgactgggccacgtgtttcagcagccagaggctagctcaggcttgttcaccaagtggcttagagtttcaggggcagtaagagggtaagctcaaattttcaagtgcatttcaagtctctgcttgttcagttttgctaccaagtaagtcacgtgatgaagcctaatgtcattacaggagagaacaacagaggatgtggatacagggaggtgtgaaccagttacagtggttagtaaaccatatacacgtataataaatgtggtggattcttatatcttcattgaaatctgagaatggcttgccaaagcactaattaataaaagcaagttagtaagaagccaaaataaagtagttgaagtacatggcaatccagtggaacagtttaatcccaatgtagatttagactgtctaatgcaatgattttctaacatttttaacagatccgtttttcttcccggttgaaggtatacacaactcctttctaaagaaatagactggagatttaggattgaagtaggggcagggagccaagagtctgggcccttggcgtccatctagtcctctctgacagctctgaggacctttgtgtaaacccggggcctgagaggacccagatacttccaactaggaacttgcctccctaagacagtcgttctcagcccagaagagaacttacctggctaaggatacctttcaggccagaggaggagagctgaaataggagataaggacctacct

SEQ ID NO: 100232 - DNA, 1078 bp, Homo sapiens
agctttgtcctgaaggttatgatctgttctttacaattagtgctgggcttttaggcttttctccctctctgctacctacttcctcttttaatttgctcaagggtggtaggaattaggaagctctgatggccttggtggaaggctaggtagatttggagaggtaaaggatgaacgaaagtatgggaatgggataaaactttgagagccatcagtgtgttgggcaattgtatttaaagccacaggatgggcttacctagagaggacaatgtccacaggtgatgggagagatgctgagaaagggtggccagtgagtgaggaggaaaaccagaggagtgtgtatcctgggtgcctggggatgagtattgggtaggaggagagcagccagttgaccatgggctttgacagatgtagttggttgagaatgttctatgggatgagtcccacctggagtagatggaggagaaaatgagagctgggcagtggaagttgcaagtgtagttaaggctttgcagagttcttgctgtggaaaggaagaggaaaaggggagctagctgaagtcggtggcatacatggtgggcgaggtttaaggtgggtggtactaaagtatgtttgctcaccaatgggatggtccagtgagggaggacaagatggtcttggggagacagaggataagtgaggtcccggatatggtggagggctgggccggtctttggtgcgagcagagagccaaagagatgcctgtgcttcttgcatctcatgtggtgagcaggtgaagaccaagagcaggctgatacctggtgagctgcctggggaacagatgtgccagagagtcctgagcatggcagcctactgtgatgttgctaatatttatgaggaccttagagtttatgaagcattactgaaagtgaacagtgtgaaagggctctggaaaaatgctacattctacataaataaagatattagtacagtggatggacttgactttggataattacataggtgatagttgtggggaggagaaattaacttccctcctcagttgacctgaaggtggttttggaggatatatgttaaaaag

SEQ ID NO: 100233 - DNA, 1048 bp, Homo sapiens
ctactcctcccattccccctctacagtttctcactcatatgcaacgatcctacttttttcccttgttttcctttttttgttgaggggttgttgaaaagtcttcaaaagcttttctgactcataaaatttctgtagttgcaattaatatgtaatagtgattttttcttttcccctagggaaaggcttttcaggtgtctctgtatttaagtgattctaaaaggtgaaccaaaaaaaaattttgaatatgtgttggtaccacttgccttattgaaatagaatcttttggaaataactgaaaaatgatttcattggtagagtgaaattaatatctgtaagcaaaatttattcaaatgtttatgttcagttatattttctaatgtaaagttgttgattttaaggtatttttgacgaactctgcaaacatctttttgttggaaccatgtgctgaagttcctgtgctcttgaaagaacaagttgatgcttgtaaagctgttttgattatttttaggcgcatgataatggagcttacaatgaataaaaagacatggtaagtttatatcaaattaattagtattgtaaaacagatgtttctgtttttcaacataattaaaatgttaaggcttgcatttatttaatgtttttacgaacttaacaacaaaatgtcttttgtaacagtttctgtgaattatgaagaaggtagttacccagtactttgacagatcaattattttcattatatttttaaaaaatgttcttgaacaataagtattttacttaatagtggatttttccttttaaacgttaaacatagttttgtggaaaagcagcaactggtgttttataatactcaccataagctcaggagagtttgttaattgccctgaaatgctgtcaactgatttttattgcttctaacttgacgttttaaattcattttggaaaagcaattattttaaatgataaattatcagaaactaaatacatagtgcagtcaacaatctgttcctgtcattaaaactacgttttttccttttcatctttgtttttg

SEQ ID NO: 100234 - DNA, 1078 bp, Homo sapiens
taaatgaataggtaagcaaattatcattcattttaaagggctgtattccatgctcactcagtcattggacaaacacaactcattctttcagcacatactaagtgctgagcactattttaggtgttgacggttgagtggggagctctctacctcctagaacctattttcatgtgaatcctggtgagtttaaggaattaaatatgccaactaaatataacttagtttatataatatatttaattatatttatagttaaatgcaagttaaacacgtgcatcttccactctgttaatggatcattatcttctgaaggcctcatctgaaagttctggtcataaacgatcttccagttggggacgcacatactccttcacaagtgcaatgagcagagggtgtgtgacagaggaggaaaatacaaatgtgaaagccggcgtccaggctttgttgcaggtatgtggctggccaggacatgaagacccctccaccgcctacagctggagccattttgtctttttgtttattggggataatgtcatataaagtatggtggtatttgtagccatctgtcagtaaacgataaacagcaatttaattagctattacattctcattctgagttttctttctaattcctacccacaatttacaaaaatttttttctagtcaaagaagacataaaaactggttacagtctttttgagattattatatagtgaatatgaaatggctgatatttaaatctttaaattatcttccaaacacttatgagtagtaagttatctgggctctaatttgcaagacaagcttggcaattataaaatcttataagtaatattcctcttaaaattggctgtgtttacaaagaacaatgactgatgtagtttttagatttgaatgaatatatgaaatagaactgactccatttgggaacatttgaaagagcaactttggaacattacttaacctccccagagctcaggattttacctcaaaaatgggaattgggagatttcctctcagatctcatgtagcttgaagagtaagtgaaaatacagggtgcctctcattccctgctcac

SEQ ID NO: 100235 - DNA, 1033 bp, Homo sapiens
gcaacctccacctcctgggttcaagtgattctcttgcctcagcctcctgagtagctgggattacaggcacacgccaccacgcacagctaatttttgtatttttagtagagatggggtttcaccatgttggccaggttggtcccgaactcctgacctcatgatccgcctgccttggcctcccaaagtgttaggattacaggcgtgagccactgcgcccggcctataaaagttatttttaacgccattttttagggctctcttatgagaatgtctttcttgctgctggtaagtttggtgtgcacaaagatttgtggccctgtgtagtatatttataagctgtgtgttccaaggaaagtgaaatgggtgatgctcattgggaatgtccgtgatgctgccctatactgatctgagtgtgtttgtagttaaagggagttttctcttttcctttcaggcatttttgttgccttcctgtgagatagctgtaacaagaaaagtagttcaagtgtacagaaagtggattctccaggacaaacctgtgttcatggaggagccagatagaaaagatgttgcccaagaagatgctgaaaaattaggattttccgagactgatagcaaggaggtaatttttttcacttgtcttttgagttgagggtaaatatattttagtaaagtatacttgctcagtcaagagtcttgtcaatgggacaaaggcaggtggatctcttttttatcccatctgatgcttctgagttgctgagttctgtgaggatctaccaaggagagtagcttctgtactcccattctagattggcagtcatctcctgcaactctagccagggccatctgcgtgttgcatctttgttggtcactgttgcaggagagttgtttaataagccatcatattttacatgtctatttgtgagactaaaaaaatcactaccttctccttgacttgtttaaataaatatcttttggagaaactaaattgagaatgtttgggtagacttttgttgtgcagtggcctgtaccagaa

SEQ ID NO: 100236 - DNA, 1083 bp, Homo sapiens
cccttagagtggtaaaggtgggggtcaaatcttcctctccctattatttaaaacaggtaaaactagttcaaatgaataattaaaaacagttttggaggggaagtggtgacacgagatgttacttttttggggaacatggtcacctgattcagttgtctgtactctgtgtgtttctatgtatgcgtacacacacacacacacacacacacatacacacacacacacacacggggagagaagccaaaacttggtgagttttgaaagatgtagaattactgacttttaggtgcactgggacatgtatttctttagctatatatatgtgaatattttttcaaaatttgtttctgattttatatgtagtctaaattcattttaaaaacatggtatattgttaatattcctagattaaaagttatttgttgatcatttttctgcctcatacaggtattccagatatacaaaaattattaagatagagagttgaacttatggcaagtagtatctcaaatccaataccatataattttcatattgattatggaatttaaagaatgagaaactgacttcttattaagtctttggaaaaggtagcatttgatgcctcaaaggtgaaatgtgactttcttaattcttttaaatataaagtagatgatattgattctgtttcattggattcatctaaagggaaaaggatataaacctctaaagttcagtggatttaatcactgcagtgttagatgttaaaatacctaaaatgatgttttaaaagttcatatatacttttacatttgttccagctataaaataaaattaaattaggtataatgtatgtgaaaagatgtttactattatagtctcatgtaatttatcaaaattgttaaaaatagttgttagcttagtttttccatagctgtatatcatagatacataaacaatcaccatcatcactcattctcagtcagatcacaaggcggaatcagaaaggagcctaccaaaaaaatgccattttaaataattgcggttcttcattcttagttgctatttagacaaccaaaaattggatttaattggaaaccaaaa

SEQ ID NO: 100237 - DNA, 1015 bp, Homo sapiens
tatgatgataacaaaaaagaaaagttgaataattctgttcagaggaattgaggaaggcttcaagagaggtaactttgatctgagccttgaaagatgaacaggtgcagtttggaaagggttttctgggtgggagatcaatatgtacaaagttgtggaacctgaaagaatgcaacatgattagtggatattccaaaattctaaatcctaaatttcatttaggattattcaattattaaaattgaattgactgttatagaaactgaattatttgaagttatatgttcttaatttaaaaaagtgtatatgtcaattgaaccaaatgtgtaaatcattactttaagatagtgcctttatctttaaatatttcaaatacacaaagaaagttttcctttaaattttagagagttctccattgcatttctgcttaattgagactttcagcttgtgtttttaaattaaagtaaaaataaaaatttaaatgtaaggtataatccaaagagacatcatggggatttgtggtgctccatggtaccgtaggaatggctgacaatgagaaataactgcatgcagtattttttatctgtgctacatataatccttcttcaattttgtttatatcatttgtatgaaaactatgctaattttctttagatagcactttagaatgtctgaagattagtaggctcttcacagcatgaataaacttattaggactatgtgtgaaaattaatttgcatttgtgttgtgaaactatgtgtctagtaggcagtgtgtagtattattttaattctgcctaataccacataaactggttaaaattgctggtacaagtagctttttacccagtttggcagcatcttagcaagaacaatgactggaggcctcagactcctcaattgagattgccaaatactgagtttcctgagccatctaatagcagtatgtgttgtttatctggtgtgcagaacaagctggtgctgtaaagtggtcagaatgaataatatttcagaatgtt

SEQ ID NO: 100238 - DNA, 1023 bp, Homo sapiens
atttcatgaaattcttgccaccaatttcattttcttgtctcactgagttgtttacagtctcattctctttgttttcacttttcttcccaatcctgttctttgtccagagactaatagtgattataatgaaaatgggaaggagatggtgaaaaagaagaaacctggggaatctgtcatttgggaaatttttattttaatatttaagaaatggctattatttaattaagataaaaataacattttaggttttttcttgttttcttttggagggaattaaacttgggacagtgatctctttaaaacattcaggtaagaaagcttgcctggggcaagtgaaagaaactatctcataggaatacagcatgaagtgcagtatttatgttattgtacatagtttccttttcctcttctagaacttacctacagtgagtaatatgggcctgtcatgaaaatgtgtaatttcatttgttgtttattttctttatatctttttttaatagaaaatactgcagtttctacctgaacgaattttctttcgatggcattaccagagtataggtaagaacaattaaaaattttttagtaatatgaatttcttccagttgaattttcagtaatgttttatataattgatatcatcaagatagcttatagaaaggaatattaataagggtatggtattatggtaatgaaaaccaagacaagttcaaccctgactttggagacaaatatgtctctctcttcctctgtgtgctccttagagtatagttcataggccagcagcataagcctcacccagaagcttgttagagatgcagaatctcaggtcccagccagacctcctgaatcacagtagtgtgtattttttttttttttttttttttttttttttgagatggagtcttgctctgtcgcctaggctggagtgcagtggtgtgatctcggctcattgcaacctccgcctcccgagttcaagtgattctcctgcctcagcctccagagtagctgggattacaggcatgc

SEQ ID NO: 100239 - DNA, 1079 bp, Homo sapiens
taggactgagatcctttatctctatagcatgtggttattctggtgtctgattttgattgtgaaatgtctatgatctgtacaaaccggaaggtgggaacaaaatataaacatgtggtccattttggagattctttgcatgcacttttcctggttaaaatgtgattatcctattatagaatgttagtaattttaattagacaaatgtttgagttgaaaggagtcagtttcaatggatagtttaatatgcaaatttagtattaaagactgcagtctcccttttgcatcaagacttataggtgagaaacttgggattgacccaacgggatataccaaattactcagttcaccttggaggaagggacactggagataagatgttcgtggaagtctgaaattacattcttgttgttatctgttgcagtccaggtgccctgagcttcctggcatgctggcctctttcacatagtgtgccacttgatgtgttggtaactgacactcttaagaggagatcctgtggaaggcaatactagcaaaaatgcttccaagaatcttttaagggcagatggtagaaactgcattagggctaaagatatgggaaattcacactgaaacctgagcatgtttatttattgttaggatagcaggagacatgtagagagcttttttctctttaattaaaattaatctgttaatgcagttttggtaagttgattttttttaaattaatatatacctttaggagagagttgtacaaaaacttgctattataagtctattacttgttttctgtttggatatgtagtgtggtggctgttacagagtgacatctagtgtttgatgtggtttgtgacactgtacaggttggaagggtctggcttgaagcctttgtgcactggcttttcctgcaggccttgggcacttgctgaatgaatttgacagggtggccagtcccaagacaacctgcaggtgtacaatgctttctaattgtgctgaggcaggagtttaaatcctctgaatttatggggtggtgggaaccaagtagtggcatctcactggggttttgttattctctactcatc

SEQ ID NO: 100240 - DNA, 1064 bp, Homo sapiens
gtttttatgaatgaaatgttggaggctttgtagggttaggtgacttgcccaagggtgcacacttagtaaatgggagagtagggatttaacctttagtctaactctagaacctattattctaacttactggcatgctgcctaccacttaggagtgttggtattctttctaagctgtattccataggctgtctatatcaacatatactattctttacaattcatttattcatcagacacatttattaggtatgcactgtgtcagacacacgtaggtgctggagatacaacaatgagcaaggtagccagagcctcccgtcctcatggagtataaattaccatttcgtggtgagcggaagagtctactggtaagaatgaattcatgtcagagctccagtaatgaccttctgaatcacagaaaatcctgaatggttcttttcagaagtgatattttggtgatggttcttgaattagttacctgcataagggaaaggagagttggtgtagaaacacaaggtacttggtgaatgggtctcaagatcaaataattcacattgagaaccttctggattcaagcttgacaggttattttaatggtacctgagattcgttttaatcaggtgtggtaaggcacagaaacatgaaaatgattgttatgaaggaagaagttttaattatgctcacaggcctctagaaacagacatgtcacacagagccaaacagggaagcaccaaggcaaaatcagtacgcaaagaggaaagggagcgacagagacagaactgagggcaggagcttttattgtgtttttttgcaggaaggaatgggcaaggccaggtaagtaaactacataggcttaggactggatagtttgaataatttcagctgacagggctgtaggggtagctcctggttgtccagcacctggcccctggatgattgaggggagggggatagagtccataaaaggatgtggttggggttacggatttgggattggttggtttgcatatcagaaacatgctctgagccactatctttgggaatttgctaacccttggaggggcatc

SEQ ID NO: 100241 - DNA, 1022 bp, Homo sapiens
aaatggtaacctcagctgcaggtgttgtaggttttattactgttgttattatcaataggacagtgtgcagttgccccaaaagatatactacttttatagttatctgctctatgactttttatattaccaacttagaaatttttcgtttgtgctgtgcattctgccacaatttgagccaataagtaactagttgagaaatgaataaattacccatcatagtttggtaacaagttggaaaacatggaagctgtgttcaaacagctagcaaggggcagctctgctggatgtggatctgagcagtcgggctcggttgtctgtttgcaatcctaatgtgttctccatactgcctcttgctattttttgaataaatgaatgtatgttgaggcttactagttttaagctgccttttagcataatttgtagtgtcctgaagtttaaatgatgtcatgataactaattattttttaatattccagggaataataagtcacaaagggaggagctggactccatcctcttcctttttgaagtaagttttgatgagtttatttagcttttataattcttgttggaaataaagtatttttgatctttaattttatttgaagacaaataaaaatggctgttggtggacatatatttttttctttccttccttcctcccaccctcccacttttacaaactgtgctacaaataattttctcgtgattttctttttttgcaagcatgtgtgatagtttttcctgtatgggtacctagatgtgaaattattagatggaggagtacacacatcttaaatagtagcagatattgctgaattgctctccaaaaggtcatatattcacactgagaaactgccctgtaaaaaataaaaaaatttaaaaacccaaaaatgttatataaactgatatgtaagtcttatgtaaatttcctatactctaacattagagatgattcgtctcatatatataaatacatatatatataaatctgacatgcaaaaactttttttgatatatat

SEQ ID NO: 100242 - DNA, 1477 bp, Homo sapiens
atttaaaggatttaccatatagattcttagtagatttgtttctgagttcattctgaatcctcaattcagggttttagccttaattttcagaaaagtgatgtttcataaccattttatgtcttttatgttgttttagaaactgaagccacagctattttaaaaatagttgtaatctctttttttttttgagatggagtcttggtttgtcacgcaggctggagttcagtggtgcaatttcgcctcactgcaacctctgcctcctgggttgaagtgattctcatgcctcagccacctgagtagctgggatcacaggcttgtgccaccatgcctggctaatttttgtgtttttagtagagacaaggttttgccacgttggctatgctggtcttgaaatcctcgcctccagtgattagtccgcctcggcctcccaaactgctgggattacaggcctgagccaccatgcctggacaaagtagtaatcaaattttgatattacaattatggttaagttaaaaaaatcccttttgataaagttcaggagcccatggatattgtgtttgatttcaggtgatgacacatattcattgaaccttaaccatgcctgaaagtacaagcatggtacttgtgacattgcttgtgcctgactatgagagccataagaatgtgctgcttctcctgttgtggggagcatgattgactgatggccccagctgctgctccctgaatctaccaattttgagccaaagcttagtttcccttgggaagctcttagcccattactgagcactgcaggagtattaatgctgcctgttcctgcacacttcagatgcctctgaagggccactttggcttgaggacttcctattggcctaagaccttctcagacctatgttgaagtctgacacttcctactcaaccttccttcattccccttctccttcccaggggtcagacctgcatcgtggtctaaatcctctccctgccttcaccagctccttctcatttatccttcatgggcatttaccccaataaatctcttgcatgtctaatcctgtcttggcctctacttctcagagaacccacactaatctaccatccatttcctggatggtgttgtccatcctgccatctacagtttttccaggagacattgccaacactttttatcttccatgtgggctttcttcatcctcttgccctgaatgtatctcttctcagaattcccacagcactttgtagcttttgtttggtattaatggcctttggctttgcaccatgcttcttttcttttctttctttctttctttttttttttttattgagatggagtcttgctctgtcgcccaggctagagtgcagtggtgcgatcttggctcactgcaacctctgcctcccaggttcaagcgattctcctgcctcagcctcccgagtagctaggattacaaacacctgccgccgcgcctggctaatttttgta

SEQ ID NO: 100243 - DNA, 1971 bp, Homo sapiens
tcccagctcctcgggaggctgaggctggaggatcacttgggcccagaaggtcaaggctacagtgaaccttgatcatgccactgcactccagcttaggtgacagagcaagaccctgtatcaacaacaacaaaaatcaagtcacaaacattgttttaaagactgtgtgagtgcatgcctgatataagtaagtctgtgtttggatgttaataaggcacaagcccaggatttatggtttggtaggagaaatagccatgtaaacaatgaaatttaccgtgagggttttgagtggcacagaggagtgtggtggaaccatagaggtgggcacaggtgcagaggaggaacagcagcaaagcctcctggagacaccagccagtgcttctttagggagcttaggtctgaggtaggttttgaataatggataaaggattttaccagatggacaagttggggatgagggttctgtagagagaggagcttgtgcaaaggtaatggtgtgtagcaccatggagttaagtgcacaatggcttttatcctgtggcgtaagtagatgttgggactccagtgaagggttttaagcagaagaggagccacatcctatctcttcccatttagtgtctgagaatcccattctcctctgagatttgaaacatagatgctgggagagagagagctcccttcctttggattgcaagccctgaagatatagtctgggctgctggcatttgtttttcccaccatgtggggagcatgtgccttaaattgaatcctactctcagagggaatgacaatagagaggtggagagtgagaggaagcccatgagtcctgagtttggccatgtctttgccaggaccttcttgagctgctcagttgcaggaactggtaacatgttaactagcttgagtcatatttctgggtcttggagttgaaagagtacctaacatggaggtgtttgtgtatatggagatttgacttttatatttttttagaactggaggaatttgagtttatataggagaagtagctaatgaagagcaaaactgaagaaacgggggataataatgcagaacggtgtgatctgcagtgagactgagagcctggggtgggagatcaggcttaacaagagggacacctcttcctctaaggccacttgaaagaagcaggaatggggtgctagatgatggggacatggagggagttctcacaccatggcttctgtaccctctgtgaaggtagcaggtgaagtcatttgctgagccagttttcttactcatgtggtgataggaacttgaatatgtcttgctccctcttctgtgccacataacctcttaaaaaaaggacatctgttatctggaaggctttgttttttttccttagggagtgactgaaaaatgcatttaacgtttatgttaaatattcatcaagaaggcggaaaatctatatagaatgaggccagtttaagtagcacagatgttgtgtgcccttccactcaatgaacatgtgccctagagtggacctaaggtgggacataggaacccgccatgtcgtccatagtcttctttcctttatgcctttcattgtgagaacatccccctgctgggtatgactccagagttaaaggatcattttaattttttctacttttgcctttcttgtgacttaaccgcatataaaatgtaactctgttgatatctcatgttcatgtaccagtttacacttttgcaaaatgtcttctcatagtctcatttaatcaaattactaccttaagcaatcagttcatattaattataaaagaaatttattaaatatctatttgtgaatgtattttaggtggtctctaatacaggttatctttacatagttaaagcctcctggatgtgtcaatacaaatagcattttcaggtgagaggatccagaatccgctagcaaaatctagcaattgagaatttgataaagttaaaataggaatttta

SEQ ID NO: 100244 - DNA, 1100 bp, Homo sapiens
aaggccatgttatgcttctgctagttatctgattcaaaaggaaatttacatatcagaaaatgtatttatctagtagaatgaatgataacatagaaacaaaatcacaacagtttttgcatgcctcccagaaatgttgctgtgatattggcctctctctttctggtccatttttctgcatttttctagggagacttgggattatcatatttgatttgagcatgggcagacgataaacaatctcctccggtgttttagtgttcattgccttccctgtaaccttggcaggcctagcaggtgataaatatttgcgtggacattaatgccacgtggacattctacaactagaacaaagctgggaggtgtaatttcaaactcttcaggcagtcttagtatggtctctctctgttgaccttatttggtacaaagtgattttgtcgtaatgcttcctttgctgttttttcatcaattacatttataacctctagaatgtaaatggaactttggacacgtatatgtagcacaaatacaccatccatccctctaaggcttgaggttgtctagacttctgatgtgagaaaagtgaacacagggtaaatgtccaaactcgtttaagataactgaaaaaggttggcttccatcttttactctgagaagggagataattggtaggtctagaatattttgctgtaaacttttataatttggatttttattttgtaagtactttatttgtggacaggcataatacttttactaggtatgtagagtactgatttttggttaccaaacggggtatcaatataaaactatagagaattttttatttagaaaaaaccttggcggggtgcggtggctcacgcctataatcccaacactttgggaggccgaggtgggcagatcacgaggtcaggagttgaaggccagcctggccaacatggtgaaacaccgtctctagtaaaaatacaaaaattagccaggggtggttgcgcgtgcctgtaatcccagctgctcgggaggctgaggcaggagaactgcttgaatctgggaggtggaggttgcagtgagcagagatcgcaccactgcactccagcctaggcaac

SEQ ID NO: 100245 - DNA, 1056 bp, Homo sapiens
gcctttctaccagaatggctgttaaaatgggattcttatgacatttcctgaaaggactcaatagtcttttacttacatctctctcttttttttttttttttttttttttaagatggagtcttgctctgtcgcgcagtctggagtgcagtggcaccatcttagctcactgcaacctctgcctcctgggttcaagtgattctcctgcctcagcctcctgagtacccgggattacaggcatgcgccaccacgcccagctaatttttgtatttttgtagagatgtggtctcgcgatgttggccaggctggtctctaactcctgacctcaggtgatccgcccgtgtcagcctcccaaagtgctgggattacaggcatgagccaccaagcctggccttttacttacatctaagtagccattttgccaaggacagggagtcaaagatgaatgtgtttttaaaaatcatatgaccctcattttaatttaaaccatctagaaaccaagatttcaagatgaacataaaaaaattaatgtaaactgcctttaaattgaagatttttccccccactgggttacaataaagttcccataagtctctggagtatagcaaaaaaacagcgaggttgtcagcgagggggagaactagaaactagaatgagctggttgagtcctcatgagccatcgaagtccaaagtttaggaattcagaggccatcggggtgactgcagtctctcaccccgtgcgcaatgcaggacgaccacgctgctccgctgggcggctctttctaaacctaagaacccagcatacgacgtggctctcttgattcccttatcagaagtccttctgcatggacaactgaaaggcctttaaattcaaaagctcttcaaggttagtaagtaaacctggcctgtcttaccccaaaagcccgatcgctgcgaaggggagatttttattttctggtccacaccgccatctgctggcctcgccatctctaagtgaagcactcgctgtattttcttccaggaaatccagtagatcgtttagacttcattctaaaatcc

SEQ ID NO: 100246 - DNA, 1049 bp, Homo sapiens
agagtaattaattctcagcattcacaccagcaaaacgataaacaagagggaaaacatcccccaactctggaagaggtggtgtagatgtgaatctgcaaaccaacttaaaaatatatatacctagtttgaaattagtctttggaagaaatgtaattcccaaattaagtcttttgccaccttagcataaaccaaggctagtttttagcggaagaccagttcctctgggcaagagctgtgaatttcaataagttggcaagccaagttttctacacaaatcagagattaaatcaagttgttttccctttttaaaatataaagtataaacaaataccaaactggggcatgttccaaatcctctgcagctaaattgcatttaacttttccaccagaaaatgtgatcaatttagtaagccaataagtacataaatactacccccgcttatgttttatcgcagaatatcattgataatattaaatgtgtccaagaccgctcatgagttattttctcttctgttaatctgttgtctgcatttttctactctgtccactaacacacaaagagatgggtatcaaaactcaacacacacacatactgctaggtgaaattcatacatcctaaagaagctagtgcagagggggaaatgccataatatggatgtgatattttttcataagccaacggtgaaaaatatattgactatctttatccaggcagttcatgcctacgtatgctctgcagtgacaaggacatttgttgtcagggactgagagatggctttcaatgccaggagctttttctggtaaaagtgggccattggctaaaaaattgtatctgaagactttgttttaaaactggagattttgaacataacctgaattatccagacaacatggtttggtgaacttggcaatcgtgtacttcaagattacatgagaagcttttgaaaaaaattaaaacataaggttttattgagtagagtcaccaaaaatgggaaaaaataattcctttcactcatttgcctattttcttcattgtactgtttttgcat

SEQ ID NO: 100247 - DNA, 1034 bp, Homo sapiens
tcaataatcatgctttgtttgacctcctttcatttctggaaaaaaaaaaaaaccccacctaattgtttatacacagtatgtttaactcacatctcttttggtgttgcaggttgcagtgcacgaggggattaactcaggaacagccatgtcaagaggattgtatcaaccagcaacaatctttatgggccgccaaatgtcagccatcttaagcatgagagatttcagtacagagcacaaatctccccagcccacaaagaacttttcaattcctgacccacattcacaccgacagacagcccagagcagtaatgtgacagacagctgtgtagtacaaactagtaatgacacacagtgcttaaataagtctgacaacatagatggaaaggcatctcttcagattggtgagaaaatgccagtcacagccagtgtattgtctgaggaggaacaaactcattgcttggagataggaagtaacacacgtcatggcaagagtaatttatctgaaggcaaaaagtctgctgaactcaattccccgttacgggaaagattaagtccagagaacagaaccactgatttaaagtgtgacagttccagcggatcagagggagaaatactgacacgggaacatattgaagttgaggaaaaaagagccagcccgccagtctctccgataccagtttcagaatactgtgaatctgaaaataagtggtctcaagagaagcattctccttgggaaggtgtttcaggtgggatgagaggctgagtttggttgctgatttttctgggtggtagtgatcttatgtaaggacaaaatatactaattatctctctttcataaaatagtatctttgccaacaaattccattctaatgaactcttaaatatgtacatgggagtgaatttgctgatttttaaacccactgtgatttttttaaacatttgaaaacgtgtttaagcttttaagttccgtaatgaattgtgtgtgggttgcttctccatgtttttaactgatgagtaattctgctgtgtgttac

SEQ ID NO: 100248 - DNA, 1099 bp, Homo sapiens
cacttgaatcttgtgtgcctgttattattccttcccagcataaaggtacacttcagagtagggctaagcctgagtctgcagttgtcactcaccctccaatagatggaccacatctccttcatccttatcacatcaggcacatagccatcaactaggtccagtaacttcaccaactgtagtgctatttacaaattagtaccttgcaaattaacatattgctttataagttgctttgtaactaatcttcattttctttttggggtgtgtgttgaatattcccaactacaaatgtgaacagctcctttaaagtagaaacactgttttgtcttctcctatagctttttagaatcatgcatccctcaaaatagtcattttttaaaagatggtaactaatctatttgaaggctactgtgatacaacgacagacctaacctaaaacagtgaccaaatttttagactcttatcacttactcagtagactggatatagataataaaagataaatccctctttccatgccttcctattctgattaagaataaagaaaatttgactgcaataggatctgaatggaaaactaatagtcatttttctacattcagaaatagaggatgtaacctatacttcagccagaagttttcaatttcttagcagtgacaatttaagtaaatttcatacgagttgtggggatctaactttgttatgattgacaatataaaattagccttttctgctgttaagattatctagcatacctgtcattcaggtggaatgtggaacgagattgcccagctgtggatttgaacatcattaaagtcaacaaagggttaaaagttacttcctctgatggatttaaaattgccgcatacacgcaaacaagtttttcaaactgccccattttatgtctttgttgagagacagtatagttgctgcattttaatgtccagattatattacagatatatttcagtaaaccatgaagaaccatcatagattctagaagctggtgatctgtgcttaaataagcatctcctgcagcatcttttttattttataggctctgtaatcacaatggcattctgaaagaagaccttgaagc

SEQ ID NO: 100249 - DNA, 1053 bp, Homo sapiens
gaccagcctgggcaacatgatgaaagccagtctcatgatccaatgagactaaataaataaatagattaaaattttaaagtaaaatgtttaaaaagtccactggccaagccataccccagaccatttttcctggactctgtagaggtggccccaggcacccagattgtgcagagctccccaggttgttctgtgtgcagcaaaagttgagaatgctcatttagcaatgaaataaccaaagtttttaaaagtttaaaaaaaaggatacttggactcaaaactcccttagaccagaatatgttgagttccagacttctggataaaccatcttctactaacgtaattgaggcctttaaaaatgtgggaatcttataatattacaaatctatagtgagtgtcctgtttctgttttatagacctggacaaacaccagactcagacgtaccgaggcacaggtgggtcagcatgttgccaccttgaaagaacatgataattctgtcaaagaagaggtaggtagctaaactgtctgaagttttcccaatcacaaatgtggaccacagggtaaggttagtaatttttatttaaaaaaaaaaaaaaaaagttttggccaggcgccgtggctcacgcctgtaatcccagcacttttggatgctgaggcaggtggatcacgcggtcaagagatcgagaccattctggccaacatgatgaaaccccgtctctattaaaagtacaaaaattagctggatgtggtggtgcgcacctgtagtcccagctacttgggaggccgaggcaggagaattgcttgaacccaggatgcagaggttgcagtgagccgagatcacgccactgcactccagcctggtgacaccatctcaaaaaaaaaaaaagtctcaagatgtgcagattattcatttgaggaaatgttatgtatttgaaaaaaataacgataagaaaagtagtaagtgaggttttgtggttggttggtttttaactttctgaccttgggccttttgcataatgttttatgtaggaatttattttccaagaaatttcaaa

SEQ ID NO: 100250 - DNA, 1153 bp, Homo sapiens
aaactaaggtggaaaatcaccgtgtctattgaattcttcatcaccatgttatatatttacacctgtaacatcctccatcatgtgccctttcagcacctgcgtctctgtaaaaaggtccatctccctggggaacacccggtcattacacagcaaactatagatgtttctgattttactgttttctttcctgtagtaattgcatatgtatattaaaataagcagataataaaaaaatgtcagataggaagcttgcgtttgcctcagttacaaagcctgtctgataatttaaaaattgtaccaatcgggcttcatcaagacctattaagatttctgcacatgtattaggcttgtttaggtggaatctgaacgatatcattatttttttctttttagaataagaacagcagcaattagtattctgtacagagttctacttgtcatacatctgaatttactagtaccttattttgtgaagtggtgtactacttcattataaattcaaaggtctgactttaaatatttacacaagtaaatacaccattgcaccaaggtactgaggcatgcatctgcatatgtggtagttttgttgtttataagcagaaaagaatggcttgcttttatggcagtgcagttcctggcatgattaattttttaaactcatgtttctgtgatgaactctggttttgaaaaagcagtttatggtagagcagttattgtatatattatgcattcagataatatttcactctaaaatgcagagtttttttattttaaacattttcaccaatgatatgtttattgtgtttttagtctgcattttctgcaaactctggtatggctccctgctatttttattaatagaaatgtagatgatcccaaactacagataaccatgaagtcatttggatacttttctcttgcatttacttttggatgcagaagtatctaatggcctctgaatttatttcaattaaaattacaaaggattattgaggagaaaccaggaaatgaccttgttcattcattcttctcttttcagtattctttacaatcatcccttgctgggagtagttgactctccccaaagttaatgcaaatgtattttctcatatactttctttataagaaaacggataattaagtaccagggttt

SEQ ID NO: 100251 - DNA, 1019 bp, Homo sapiens
cataaatgccaagagaaattctccccagcggttcatggtagaatcccatgtagagttttagaacatacccatgccccagccacacccttgtgcaattatttctgaacctctgggagtggcacccaggcataagtactttataacacatccagataacttcttaggtttgagaactgtggagcaggggtctcagttcaaaagagcccttgtaggtcctgttttgaagcaccctcattttacacaggagactcagagacaaaatcaggctttaaatattttaataaaatgaggggttggagtgtattattttcctagggctgttgtaacaaagtatcacaaacttaaaacaacagaaatgcattctctcacagttctgagagctagaagtctgaaatccaggcgtcagcagggcccttgcctctgaaggtgctagccagtggctcctggcttgtgggagtataagccctgtctctgcctctgtcttcacttggccttctcttctgtgtctctgtgtctgctcttcttcttagaagaacatcagaaattggatttaggggccactgtaaatgcagaatgatttcatctagggaaccttaactaatatatctgtaaagaacctatttccaaataaggtcacgttctgaggttctgggaggacatgagtttgtcgggttgaggggaacaacattattcaaccaactacagggaatgaggaaggacttcttcatattttacatttttagcatccagttcatcttctacagtaattattcctgaacctactataaataatggtaaagataagattgccatttctaatttctctcattaaataaatcattgagtacaaatggctaaaatatactgttttttaaaaagctatttaaatcaataaaatacagctttctgatgaagattactcaagttttgaaaagttaaaggtttcctgaggttgagagttgaaaatccacctctcacgactgaacagtgttaaatggcaagacgcaaaagtgtttcag

SEQ ID NO: 100252 - DNA, 1039 bp, Homo sapiens
tatctgcataagggtgtgagagagagagagagagagtgtgtgtgtgtgtgagagggtgtgagtgtgtgagagagtgtgtgtgtgtgtgaatgtgtgtgtggacacatacattttcaaagggagactggtaatgactgtgaatatgccctctgctcatgcatccccagtttcaggaagcaggacctgggtgaacacacttgcagagagcctcactggggttctttcctggctgctgtcttgtctgctgatggaaaggtgtctggcttcgggccctgaccttgatgagagctcttggcacatgctggaggcctggaatgtcatcccacagttccactgtcatcagttctcagccaaccccactgttgccttttcagccaatttcatggtgtttattctggtgtcagtctcctcaccggagcgtgggcacctcaagggcatcgagcgagtctgtcttgtttgctgctgcagccccagcacagagtccgatgccttgctctgcccctgctcttggaaggcctggctgaggcagtttccctgtctcttcccatttcaagggcacccactcatcaggttcctcgaggaagaaacttcacgcatctcaggcctgccttccctccatctgtccccaaacctcccattccttgacccctgtgcctaagtactcatcacttccacttagaacccacggctgcacatcagcaaactgagtacatgcttttgttgatccaaatgtgctgacagtgcagtggcactgcttactgaagtctgctgtctgcaggctgtcacacaggattgtctgtaaatttatcagaacacttccaggaaggcattactgtccccattctacagacaagaaaactggtgcttggagaggtagggaacttgcccaggatcatgcagtgagcagagtctttctggccccagagctgattctgtctcagcttctgaaagcagctcacatagccaggcacatgctgtggcagggttctccctgccctactgttttactgcttctcaggaggccctgtggggcgggtgt

SEQ ID NO: 100253 - DNA, 1021 bp, Homo sapiens
atgatgtggaccaaagtcctgtctcagggtaaccatctctgcttattcctctgccacgtctttcccttctcctctctgctctcataaagaagaatgggagatgaaagtggaggggcagctgaggtggggcggcatcaggctgatacaacaccccagggaaccctgcttccatgtaaccctgaccttaaatccctatcctataataaagagttgggcacaacagaagggaaaaggaagtattctgcaaattgttttccataacagtgcagaggacacactttgcaatgtgtaatttgtgcagtatgacatgcatttgggtgtgtctggtcaggtacatcatgtggtgtccctgttatgcattttgcagactgacactctgcttaaccagtccttccgtgctgtgctgttttgtaagctcttaaccagaatgcaaaaatgttaaataactgtctggttttattttccagccctctgggatgagtctgatgacagtaactcagaaattgaggctgctttacgccccagaaaccataacaccgatgattctgatgatttttatgactaacgtgctgtgacattggtttcaaataaagtctttaaacaaactaaaatcctgtgttaatatgtgatgtccaaaataaatatgttcttttaagttttctcactgttttatgggaaaacttaggactacattgctattcaagtgaaattttatgacataaatatgaacttgcatattcatttttaagttcatcatgaagcaaagtgatgaatgcaatgcccatcaaaattcaaggtggtttctatgttagaaattagccagctgatcttaaattcatatggaaattcaagaggcccagaatagccaaaacaatcttgcaaaagaaatacagttgggaggccgaggcgggtggatcacttgaggtcaggagttcaagaccagcctggccaacatggtgaaaccccatctctactaaaaatacaaaaattagctgggcgtggtagcatgcacctataatca

SEQ ID NO: 100254 - DNA, 1793 bp, Homo sapiens
atagggttccgaactcgcaggagggtcgctcctcccctactcgctttttcccggcaccggaaggccccgcccactgctttgtttcctctccagaccgcgcattttgggtctcggaagaggttcagaggctgttgttgagcaatgcatgccaggtcagctgagctagcgggttatggatgcacggattcggaggccagctttttgacaaccttgtaaaggaatccctggcggcgaccttttcgttgtttaccaattgtgccggaaaggttttctcctagtgttcaggaccatttgttgttctggttagattggacgctgaaagcagtatgtcaggtccaggatgagcgctatagaattctgagaagttacccttctctgtgtgccctgactactgaacggggtgggtgcttgttgaaaatttcaagattactggatgtacttgagcagtacaatttttgttgttagttaatacgtaagtagatttttggccattattgagttttgtttttattgttttcgtcattccatgcggattcgattttgtgctcttaattagaatttctggattggaaacgttcagaggcacatcacgcgtacctcactccttagtttttgaaggcagtgcttgcctgtcactgtgaacttatttctgcttttttttttttttttaactttcttggcttctatccaaggaggaaccaaaagccttgtcttagtgacattcccactatttcttgtttttttcaaaaagcaactgctaaattgaatacttgtttcctttgtaaaattttaatcgaactttattgaactttacttgcacgtgggttaaacaaaaagcaacagttcttgctctaccccttctcatcccatttctccacctttaactgttttggttctgtctctaagtatcatacttatacgttatcacttttagatctgttgaattctagctggaataggagaggatttagtcacctattcagccctccctctatactcttaatggagtaaatcactagatatatatttttattggtaagctttataactaagtaatttgcctttttcattccatcgcctgtgtaacgtatcccttgactcaatgctttctaaggtcgatcttagcttttcttccctttcacctcaagtttgtcagctgtacttttgcgttgtgggcatccaaaattaaatgatcagggctttgactatacagatttaaaatgctgaaaaatcagataggatagttgactattgacactgtgtagattcaggttatgtactgtgattttgttttttgtgctgcttttgtctttttccctggggctgtctttctttttccactttacatcttgccgcgcccggactctattttaccaggtagtctatcaagagtcatctttcttcttgaatagtccttcttggggtcttatttatttttgttgctgtcacacctggctattctgtaggcttgctggaaagctgcatctgggattttattattattattgctatcatatctttcttcagtgggaggtactgttttctggatcatcatcttacttcatttgtttatttatttagagacggagtctcgctatgtctcttaggctggagtacggtggcatgatctcggctcactacaacctctggcctcctgggttcaagccattcttctgccacagcgtccagagcagctaggactacaggtgtgcgccgccacgcccagctgatttttttttagtagagacggagttttgccatgttggtcaggctggtctcgaactcctgacctc

SEQ ID NO: 100255 - DNA, 1509 bp, Homo sapiens
actgaattcatggacaatcttgctaaatgccttcgctattacatagctgatcgtttaaataatgaccctgggtggaaaaatttgacagtaagtttcacattttgatacttcagaaagattagggtgatcattcgaggctgtactttgatatgactgacattatttatccttctgccctgccccataaaatgctagttgactgttggaagaaagaaaagcttccagggtttttggagatggggtatccttgcatggttaggttttagatagctgaattttctcttaaagccaattttgtcctcttaccatcactatgaagctataaaatgggattcataatttaaaaaatatatataggaaagtaatttttaaatggaaatttccattattacatatcaatatacagcaaaattagtaagttgtggggctgtcttaaatggctgtgttcccaaatatttaaataatatgtaaatgaacttgtttgtaattttaggttcataagctggcttccctattaatgagaaatggtaaattatattttatagatatgtgttattgattattcttggggcatatatggttcagcactatatccttgcatagtagtgaaaataggagcttgtgaatgatcagtttttctgatggctaggtctgacccagacatttcattcctttccattacatgtagtaagtcaatcaatgaagtggttttggtgtctctcacacacacacaccccttctttattcagaaaattttcagtgaagtagttttggtgtttttcacacacacacacacacacacacacacacacacacacacccttattcagaaaattttcccgtaacacttatctcagtttttcttgagacatataattcttttgatttttgtgcctatagaaaattggggataatctgaaagtgttaacaatttttttataggttattttatctgatgctagtgctcctggtgaaggagaacataaaatcatggattacattagaaggcaaagaggtaaagcttacttaccaatatttgattatatgttctatttttaaaaagccattgcatagaaaatacttggtatgaagtgatattcttgtggtatataatatattaatataaatacatgtttctctcttgtttagcccagcctaaccatgacccaaatactcatcattgtttatgtggagcagatggtaagtttcttctttgggatttgcttcttttggattaaaccatagcaagttgatgggttggtgtgcagtaatggattattcatggttacctggaagttccaaaatgccttggttattttatgttcgacagggaactagtattgagttgctgtttaatctgtggtcaatgatctttaatttcttttcttctttcttacatttttcaaccttttaactccccatacctttaaaatggagaatttcccaagtgtttaatccttagtggcagtctatgttgtaggtccacgtatctagaggacttcctgttaa

SEQ ID NO: 100256 - DNA, 1443 bp, Homo sapiens
taaaatggattgtgcgttagaaaaagccttaaaatttgcttggttggaaaaaattactggacgtagagtagacttgtttcatcttcattcctgttcttgcagcatgatgaacttgccgatagtcttccttgtgcagaaggagagtttatcttccttcggcttaatgttcttcgtgaggtatgtagcaataatcattgaaatcagcactctaaagcagggtgcctttgatagctgtaatggcagcattcctttttggttgtagtatttggaaagagaactcacaatggccagcctaccattcacatttgatgttgagaggagcattgatgactgggttttcatgtgcttctttgtgggaaatgacttcctccctcatttgccatcgttagagattaggtatgtgcatttgtgtagcttttcaaacgactgttttaggcttcttgactttactgtgcctactggtcctaatgcataatgtttgtctcttgctgacagggaaaatgcaattgaccgtttggttaacatatacaaaaatgtggtacacaaaactggggtaagttcattcttgaatgatttcaaaacagaagtatttgcttttataagaagatcattttacatatattttatcacttacagggttaccttacagaaagtggttatgtcaatctgcaaagagtacagatgatcatgttagcagttggtgaagttgaggatagcatttttaaaaagagaaaggatgatgaggtaaagtgtttctattgcagtagctaaaattgctcctgtctctaataggctatgatgatcctgtgattacttttaatctctttgagtgtgtttttatatcattatggtgtgtcaacactaatgtaatcatgagtggtcagtgctttgattattttataaaggttgtgctgcttgctctgtggaactatgtattgtaccctgtttgagttgcattgtaatgttttttctgtcttcataatctgaatataaatccaaacacatttctaatcaataggatttgaaatgcgggtaccaaggctggaagtctattgggattgaactagtggctgtcatgttttgaaggcaggaagacaggttaagaagaattgacaatgtagggagtgtgggttggattatatcagccagggcagagggttgggagaatgtaggatctgtggagagctgaatctcttaaaaaattgaaacacaagaaggaaataaaatagcaaagcatttgaaaattgattgcatattatggatgagcgcttacatgaaaagtccaggttctggcttgggcagttaggaatttgctggtgccatttactaagatagcaagcactaggggtggaatgggttggggtggggacaaagtaaaaactgagtttcattttggagatgtttaatgtgagggggctgtaggacacctgagaggagaaaagt

SEQ ID NO: 100257 - DNA, 1199 bp, Homo sapiens
gatacttgaaactatgagtgtactatgagtgtgaccctgggagcttgtgtggagtaaaagtacctttaatagaagcctagggaaccacggacatttaaagagaaagaggagccagttatagagaggtagaaggaaattcctgaagagatgggaagccatgctcaaggggtcacagtgagatggacaggcacttcgtccgtggacagggtttgggatccactggtgagctgataggagtggaggagcagcagcctggaggcagagtgattggagggtgattgcagggtgtagcaagggaggccagcagtgggcaaaataagcaggtaatagcttcttagaaacagcaaggaaatcctttcagaaactgattttataaaagtcatgtggctattttaagcagataacaacatatattactgctacattgcttcatgatctcccagcacattaaaatgtgtcattgaatcttattttctgttttcatcaactttgtatactgtagctagtgatctcttatttttaaaactttgggtgtcattttatgtaacatagtgggttgactgtaagcattctttccaaaagccttcagtacttggtaatgtttttatgtgatgtcaagagttttttgcatatagaattcaaattacagaactagctttgtctggaagatcagatgtcaattggaacatttttaactactttttcaacaattatggtggcatcccttgatctgctgctacatactttgtaccacttggtttaaaaaccttgagttacagtagcttctactgtctctttagccgactctgcaccttgagttggcattagaggaggaagtatgggatttggtagacaccatagtgttacagatttaattaatacgatttttcagctgacctggcaggagagggcattttaaagctttggatctttgttggtgttcctgaagtcatgccatgtccttcagcatgattggacaccaggggaaaccctcaaaaacgcaataggaaagtttccagatatatgtatttttctgggaagtatgtccctggcatttgacagatttccaaaggagttcatagcacaaaaaagggagagatccataaggtccacccaggtggtcttctgtttgtgcgtgactaccacccttagagataggcatttaacagaccagcagaacaaatgatagaaaaggaata

SEQ ID NO: 100258 - DNA, 1452 bp, Homo sapiens
ctactaaaaatacaaaaatttaagctgggcgtggtggtgggcgcctataatcccagccgcttgggaggctgaggcaggagaattgcttgaacccaagaggtggaggctgcagtgagctgggatcatgctactgcactccagccagggcgacagagcaagtctcttgtctccaaagaaaaaaaaattgttattgaagttgagcatttaggcaagaaatgtgttgctttttattgtatgagctttcatgtttaccttttaacttgggaatgttgttcatttattaagcaaatatttaagtatttaccatgtgccagacagtgttctgagtgctagtgatacagcaaaaaacaaaaaaggagacagaaatccctgccctcatggagtttacattctcttgggagagctggaagataaacacagtaactaagtaaacctcattaagtgttagagaataagtgccacaaagaaaactaaagcaggtgaggaggcatctgggaagggagaggttgggcattacagttctagaaaaggtgacgagagatggcctcactgacagctgaccttgattaaagttgtaaaggatgtgagggagcacactgcagatgttttcaggaagcacattacagacagagggaatcaccagtgccaaggccctggggcaggaacatactcaggatgttcacagaacacaaaggagccagtgtggaaggagcagaggaggcaaaggaagagcagtaggagatgaactcagaaagaagacggagggcccagtctggtaggacccaacaggtcatcataggactgttaactttcattgtgcatcagtgtaaggttttgagtagaaaagtgacaagatttgacacatactgtaaaaggatcactctagctgccatgttggaagtactgtgtggagggaaaggtcaaagcagtgagccccaggccagtgaggagccttttttacagtaatccaagggagcctggatggtagcagtggagatcatcagaggcagttggattctgaacatgttttgaaggtagaaccagtgggattggcaaatggattaaacatagagtgtaagagaaggaaaggtgacacaagactgaaagatgttttgagcaaccctcatggaaagactgggaggtgcaaaggtgggttggggattctatttcagacatgtgaagtttgagatagccaaatggagatgctaagtatggagaggctctggttggggagtcatcagcatgtagatggtgttcaaagccatgagaccaggtgatgactcccatgggaggagagaagtggagagatccaagtactgggcccaggggagcaccaacattaactcatttctgcccagtgttccattattggaacgataagcttgtgggagttatttatatcctactgctaaaggtcatcaccaaggtttgatttttcacacaaaaaacttg

SEQ ID NO: 100259 - DNA, 1068 bp, Homo sapiens
tcctgtgaattaaattggcccagagtagtaagccgtgcatacacctcaatttccttcctttttttccatcggattgatatttttggaatctggccagggtgagggataatgtttgcgtagagtcccacttctctcttttctccattgtgccatgcatgctatagaataagagccctttttagataacagagtctaattaaattgtcttgctgatttttttaaaaatggataccttagttattaactaccttcaactaaaccttaagaattgttgagttgtttattttattttattttattttttaacttacttgtatcttctccatattgacagcctgtttgctccaggataaaaccaagggtctttgtaatggctttgcattttcctaaaatgattcaaaagctttctgaacagaattaccaagatcaattgaattgtatctaaattcagtcttccattgttaagttctgataagcagcattttgaacatatagtcttattgcctggtttaatcatgtacctagatttctggggtcgtcctttaaaacttaagttgtctcccaaatcattcctggtaatgcttaactctgacatttttgtgtaattatttgacagaatatgtggattttatacttttaggacagttttagaagacgacagaaagaaaaaagaaagagaatgaaggtgagttttaattaatttcatgagattggcaatagcgtaattttacaatttatgaggaagatgttcattacagtagctttattccttgtccagtaggacttagtcagggacgtaagtgtccacccagttacctttttacctgtagaaagaacactggtgtcgatttaaagaaggtcctctaggctctgatgtctgaagggatacacttgggaggtgagaggtgggtggcagttagctatttgaatggtttacagcaatcaagtattgttttttaagtaaaaatggtcaatattttgtatccccttgaaagttactgtactcttatttctacctctttgtcagattaatctttctagaacacaacactctaaacttgtttctct

SEQ ID NO: 100260 - DNA, 1146 bp, Homo sapiens
tttatatcttgttagtaattaattttgttaaagtttgctttttacacaacttctctgtagacagttaatgggaatgtcactctcataatttaatacaaatggattagtgtagggttgaaaaaacaatagtgattacttactgaatggttaactaccatgtaccatgtaggcagcatgccagtaatctttcacatgtattgatgcatttaatccttgcaataacttgtaaggaaacagaacgttatcatccccattttaagatgaggctcacagaggttaagtaataaattgttcaaggccacacagccagtaaaggttgaatttggtatttcagactcagatctgtatgactaaaatacaacaatacctgcctcgttttccaagtacaacagtgccttcctgtatttatttttattgggtttttttttgacaatattgtctgtaccttttcattaataacattgacattatgtttttaaaagagatgtgctctaagttctatgtgaaatatgatttcgtattattttaacttttcttgacctgtggtatgaactgtgtttatgctgtggatactctaattattatatcattcaaatggccttctgtgctctcagtttaaaaaaaattcagtttacttgaaatagctaatatactgtgagtaacagaagaaaaacttgactgtggaaatgtttctgccccttatgtttttggtgatgtggtcctttagcttgagtaactaaagttgcagaacattttcttttaatttttaaatattaaaatatgttagggttatattaaaatatgttaattaaaattaacgtattatgttaattgagttaggtacaaagggaagataatactgaatttaaagtgacagctaagtctttgaaataccaataaaatctgcatttttctaagatgactaatagatttttatttgttgattgatttttaaaactgaacatataaagtaatttaagttatctaacacagtcttattaaacttgcttttcagagtggttgtactaggttgaagacttaaccatttagctgcattctcaccagcattgactattttatatattattacatctatattattatatattatatgctatatatgtaatgcattttatatatcacata

SEQ ID NO: 100261 - DNA, 2633 bp, Homo sapiens
tgattgtcacaaatgattgtgaaccaccaaaggaaaataaaattcaagtactataatttttaaaaatctataaaattaaaactttttttttcttcagaaacttttttttttgccctaataatgttaattgtttttagtttaagcatagaaagtttgggtattacattacttcttttgaggggaagtgaaatggagcaagatcagtctctgtaccttctaaatatgtttaccatctctatgtagtagctttaaaaatgttactgtgaaacatggtaagtagtggtggttggatgtaccttcttatgtaaaatgaataatgaaatccttcttctgtaatgtcatcattgtctgcagagtccttcgatatctcctaatacgagtttcacatctgatggctccccgtctccattaggaggaattaagcgaaaagcagaagacagtgacagtgaacctgagccagaggataatgtcaggtgaagccattttttggtagcactttgttagcaaattgctgaaatagatgcagtctaattaatgctatttagcttagagcagcagtgccttcagatgcttgcctgtgatctttttatccatcagtaattaatgtggagggttagaatagtcagtaaattccagtgagatgtgtaagctgtagctgttaaacctaagtgtctagattagtatgcgtgcaggctttcgtcctccaatccacttttccctctgagaccaggcacaagatcggctagatatcatatctaggtgtttagctctgactatgtgatctgaatgttgctgtttggagactgattaaattttcaagctgcttaacctagaaagttcagttatacttagacacttaatatagtttgccttaatcttctctattgaaagagttcttcctcaaaatgaaatatgcagaaatcattctgttaagagatcaatatgtatgttttttaaaaaccacagacttgcatatgcgcaattatatttcatgacagaggagtttccctttaactgtatacttcaaatttaaaataggaagctgattctttaattcatcctgaagtttgagatcattatataataagattaacaacctctcatgtaattaaatccagatttgaaccgtgggctccaagtgcaaaaggccaacaatctcaataattgtagctcattaagaatttaggaaaacgatctatttcaaaggtaaacaagacagtagtcacctacagctcatgcttcttttacaggacatggaaagtgtgtgatttgtgtttatgattagaaactttgcaagggtcacgtgtggttctgcacatttttctaacattctttgatttcagatccatgtctacttgtgattgaacatttactctgtatatctttagtttctatcctctactttctgtactttgggttttcctcttacagcatgtctttggttttgtttactatgtagccatcatgatcaatactagtttaataggtaacttgatttgtttagtattttattgtttaatcctagaggaaattgtttaatcctagaggaaatcattgtttaatcctagaggaaatgcctctaccaagaaatgcttggggcttttagcattttttcattaaccttttctgtaaaatagtgataatccaccttatgaatgggggatatttctaattgttattctgtgactcctttgtgttgtgggaggggcagattaaaattgatatggtatattctgaaacatgactgcaattaatatgtgaaatctggcacatggaaaagaggcctaaatggagaatcatcttgatgttcttgatctgttctgatgtttgtaaagtgttatttggcttctttatgttccttaaatgttaaatcttagagaataagaaatggattcttaaaaaaaataatacattggatgaaaatgtggttggtcacattgtattttcagtgatgaatgataatttagtggattcattgacctgcttctagattttaccataacatacatatgtttgtgtgtgtgtatgtatacatagatatatagagatatagaatgtgtatgtctctctatatatatctctatctcctttccttaagccatcaacaactcttagctgaaagagggataaggcccaagcaaggatagagagagtaggtatacacataatttctgcctaatgtctagattattcttttataaactatttttttacatttaaaaaagttacctgtgtgcgtcttaagtaatttagttgactttctttgtatggtttaaatatattttaacaaactaaggaacttgaactatttaaaatatcttcaatatttgaatcttaaaatgtagctttagaattgtacaaagaaacatataaagtagtattaaaatttgagcaaatgtgttctgtatctttttcaataacatttttgaaaatgtggttttataatggtcttaccagaatcagtgattggggtgtgtttaactgtctttaagttgataataaatcctatgaaattagactttttagaaatagttaaatgaatctgtgttagcatgactgtttaactctttcacatttcccctgggtattaaatataaattgatttggggtataaattagtagacagcctgtta

SEQ ID NO: 100262 - DNA, 1469 bp, Homo sapiens
gagtataacttgcttttgttttctttttgctgtgtttactcacatgtttttatagtcaaaagaaacttgtcaggtgaaaatataatggtgaattttaaaatgaaactcatggctgttttactttcaactgctgttccaataatgtctctaaccaccttacatgctcagtaaatgtctgctgtgactgcttttggttttacttgatgatgacagctctagagatggaaagaaatgtcaccaaatgtattttaaggataaaaatcttaccaaattgtgtttgtgaatatgaagtttggcagtaactactgatttttcaaagatgctttgtagcatttttaaagtcaaagagccattgatatgaattagaaacttcaaacttaaggaatttttaggagtcatggaaaagatcagtatttggaatatatgccagaagtcatgtgttttataagtagaatattataggttaacagtctaatttttgttttttttaattgtgttcatcattaacataggtttttgattttgttgttacttttttaatgattctagggctgtgcttcctggaagtggtattatccatttcattatgcaccatttgcttcagactttgaaggcattgcagacatgccatctgattttgagaagggtacgaaaccggtaagcttaattacttaaagtcataaagtttatagaattctggattagataataatcttgggtctttaatgttttttcttttttcagtttaaaccactagaacaacttatgggggtatttccagctgcaagtggtaattttctacctccatcatggcggaagctcatgagtgatcctgtgagtctcagtattttgagtgtgtgggtgacaggatttttgtcacattttattcatatcagttacaattgcttttgcagctgatagttaaaacagtgaagtacagaaacagtatgttttttactccaaacacacatatatttcctgctttctttggccctgcacagtaaatcagtttgttttggggagaaatttttttgtttagtttttgatttttttgtttgtttgtttgtaagacggagtcttgcactgttgcccaggctggattgcagtggcaccatcggctcactacaagctctgcctcccgggttcacgccattctcctgcctcagcctcctgagtagctgggactataggtgctcgccaccacgcccagctaattttttgtatttttagtagagatggggtttcaccttgttagccaggatggtcttgatctcgtgacctcgtgatctgcccacctcggcctcccaaagtgctgggattacaggcgtgagccaccgtgcctggccggggaaaaatttttgttctctggctacctgtaagtctttaattttatttgttccagccatatttggtagccaccagagatgaggaaactgccttacccaaaatcacctgtgaacttgttttgt

SEQ ID NO: 100263 - DNA, 1021 bp, Homo sapiens
tggcgtgaacccgggaggcagagcttgcagtgagtcgagatagcaccactgcactccagcctgggcgacagagcaagactccgtctcaaaaaaaaaaaaaaaaaaaaaaaaaaaagaaatatctcttacacagtaaaccagctgttgtttcacactaaagtcatcctgcagcaaattatttaaccttttcttccaccatacattttcctagggtaataaacacatttggtaaaatcatattttcattttttacttattgttctctgtggttggaatggccaataaaatgacttacggagaatcttgagacaaagggggaataaataatacaatttacaaattgaaaaatcaggaggctttggagttgacttgatttatttagtagcagaaatatcatatcgcttcagtggaatgatcatggaagtgcacccattggggttatataagggttgtgtgcttcatgatcatgtattattacatgttaaatggattggagattcgggtttttcaaggtgctttgtggaggatgtcttgattaaagcagagagagaagatgcatgggacagtgagggatgtaaaaatactaagtaaattaagaagcaaatatatttttgtgtttgttaaataagtaaattattaaatcgttgtctgggtttattaagtagataattaaatatataaacatgcaggtgacttgtcaactctgtcattgtggtatacattatttctttcactgacaggatattttcaatataacttaactctaggggaaaagtgagataatgtacaagagttcagatttcttcacatcctctccaacatttgttattttgtttttattagtaataaccatgctaatgggtatgaatggtatttcattgtggtggcgatttgcattttcctaatgattagtgatactgaacatcgtttcatgtcctttttggccatttctaaatctttggagaaatgtctgttcaaatcctttgctcaattttgaattgggttgattttgttgttgcat

SEQ ID NO: 100264 - DNA, 3446 bp, Homo sapiens
gatgtcttatttgtggggaaacatcacccactccatgacttcattttagagctgtaccagacaggttccacagaggtatgttacgcaatttggttaattagaaatgcactttttaaaattttggtaaaatatgcataacataaaatttaccattataaccatttttaagtggttattctgtggcattaagtatatttccagtgttgtataaccattagcactttttcagaactttttcatcttcccaaatagaatttctgtaccttttaaataatgttaaataatgtatcagaatttcatacctttttatggctgaataatactctatgtgtacttttttatccacttatctattggtaaatatttgggtttgtttctgccttttggctcttatgaatgatgctgctatgaacactcaagaatctgcttgagtcccagttttccattctttgcatatgagatcaggaatgcatttttccacagccagtggaggtaccccctgaactatgtcatgggattcaaggaaagttttctttggatgaagaagccattcttccagatcagtaagtttcattttgtatataattgaggtgactggaaggaagtttagttaggatttttttccttgttgtctaaatgtttattttctaataatagtgagaaaattgtatttaaaataagacaaaaccttgctgactgaaaaatgcttgggttcaaagcctagctcttcaaagtagctgtgtcaccttgtgcagggagctctgggagtccctttcaggatattctgaaggttaaaactcttttcataatgatactaagatgttacggtgttacttgcttttcttacactttctctcttgagtgcacagtggagttttccagaggcctctcaagagatagaagcagaggagagtagctattaaatagatactaaccagatattaatgagatttttgaaagtatacaacaatgacatcgttttgctttgtaaaaaaatagctttttataagaatgttatttatgttaacatgtagggtatcttttagtattttaaaaatttcttagtcataatttttaatgggtaaatgttcataaatataaccactataaacaaaagccctttgagatttaagaatgtaaaagggttctgagaccagagtttgtgaaccacatgtcaagggtacatttccaggaatggaactgctggccatagagtatgtgtatcttcattttttttctaggtaatatttctaggaggtttgtcaaggtggttacactgtgttgtaatcccagtggcagtttgtgagagatcttgttgctctacgttttggcaaacccttgtcacagctttaatttctgtcagtctggtggatgctcattgacatcttgtggtttatagttgcagttctttgagtactaatgagattgaatgccttatggttaatagttaaccatttcatgtatgtggtacttactctttttttttaagatataaatggtttttattgtttttgttagtgcattctaatgatttatcttttctaaagactaacaaacatagcaacatcttatttccacttacctaaaaggttacagtttacagagagatgtttcttctcttgtttccttctagaatagtatgttctcctgttcctatgttaagggatctgacacagaacactgtagtcaggtaagttttccaaaattcatggcattcacccagaacacagctctgaacttgcaaatccattttaaaagacctttgattcacaaggaaatggcagctgttaatccaccaatgcttcgagattggagagtccctgtgttgcagaccttacagcagagcctcttaactctaaattatgtatattgttaaggttactgatttaacatgcttgcttatctgttttctggtttcccatgacaacctgtaattcttcctggattaggcaagtgggaggtaaagagtaggagtatctagcagtttgttatataggaacaaacagaactctacaccccagaggttcacacagcttccctgtattacaacagactattttacttatgtttataatcatggccctgcagagtttgaacacaaaaatattctgtagtatgttttagttaagatgacatagaacagaatatatttgtgaaaatttttattagcaattataaacttaaagggctaatttcttctctctggaaaactaatttatatctcagttctttggtgctgacagcattttctattgagtaaaaataatataaaatgtaatatgaccatttggactaaaatccaacaaattgactactcatttgtattttataatgacaaatcttgatgacagaatttagttgtcattttctccaatctttaggtaagactaaagcaaacacatctcaggtattcaagaatttgataaaagcctgctaatcctgaatcctccttttccatccatttttgtttctctccccctcaggaaatattttagatttttttttagatttccctttgtgaaatataaacatgtttatttcctatcttaaatggattcaggtagtaaatgattgccattctagaaaggcttttatttaaagaaaactactgtgaattcgaaaaatctttctggatgagttgcttacgtttatctttacgtataattttttgtttatctttacacctaatttgtcctggttctttgtctttgtgctcttttgttaagggtggagtacagaattgaaagccacgctcctaaacccatcacaaacaatctggctctgacagattcagtgtgaacactgtgtattaacccttggagtctctggctttcattaaagcattggcgcttcaggccaattaattccacggttctctctttggattgtcacatgtttgcttgtgcttctcaatttttctgcatatattcaagggccttcctgcctaaccctctagaaatagttaattctacttaactttctaattaggatagagaggcttgcccagaggagagttacagagttaatggaaacattttggattttttgtttggatgatgatgatgttggttggttgtttctgagcctaaaggggcctttggtatttagtacatactatgttcacaagattattaaatttataaaacaggccgggcgcggtggctcacacctgtaatcccagcactttgggaggccagggtggtgggtggatcatctgagatcaggagttcaagactagcctggccaacatggtgaaaccctatctctactaaaactgcaaaaaattagctgggcatggtggtgcatgcctatagtcccagctactcaggaggctgaggtgagagaaccgcttgaacccaggaggccgaggcctcagtgagccaagatcacaccacttgggcaacagagcaagactccatctcaaaaaaaaaaaaaatgtataaaac

SEQ ID NO: 100265 - DNA, 4475 bp, Homo sapiens
gcctgccgtttattgctttgcttttcttctaaagcataatttatacagtttttatatatgttgtttccagcagtagtgttgttaggttgttttttttttttttctcatagcacctagcagagttctaaacccatatttaaaaagctcagttgttcatagtgttgcaaccagtgtttgccaaagtctttgaagagcgtaaacttttttcttcagaggagtgtttcttagactttttgtattcacttttggatgaatcagacaagatatagaatgttttattccttcaaggagattttttgttttaatgtgaatgtgtatggagatggattttttaagtaactatttctgcagcatttgcaaggcttatgcttggcaagcagataactcaagatccaaagcctgaaggaagtggaatacatgcagtcagcagtggatttgatggtggaaaacagttgggagggtttcactttcgatgcttaattggttaacctcttctgatagaatgtcacaatcctataaactctttaagtgttttaaaatgtcaagtatatgaatcatgagattttcctgcaagaacagtttgcctttgtatgccaatttagcattaattatggaatgtatcagggaaaggttgtgtaaaaatgaaacttgatatttggagttttctgctttctttctgaattatgttaacactctctaacagtaatacttaaaatagcatttctaaggataattcttaaagcgaatcagaaaaaggtgttctatattccattccttttctattgagactttgctacagtattttcttcttaccagcagtgctgaaagtgctacttgtggtataaataaaagcactgttcagtttccttattttcaaccatgcttaggttttaaatttttatttactttgcccttgatgtgtttatgaagacaatcaagcatttaaaatagtgaggttacctattaaggaaaggatctgttatgctacttgggggaaagctggtctggtacataaaagcttgatgagtcaacagtgtttcacctgcatttggaaaaagtggatgaaaatactgttgtttaaaaatacttcagtttacagaattagatgaagcaatacgaatctaaacacaagtctcttacctcagctggtcagactgttgagtccgtaggctgtattaactcatttccttcctctgcttctcagagcttgcttgagggtgcttctctctttacctcagtgttacttactacttccctagataagccttccacaagtaacccttttgcttctgatgatggaatttaaatgacatagacatgaaaaaaataaaagaccttcaaatgtttggatccatataaaaagttacctttttgagtctttgcctaatgggttcctgcttagtctgtgtgtttgacttttaggaagtttgtttgaatctgagttatggctgttatcacattggaaaaatacatttctaaaaacatagtagatcttagtatacatttttgggaacaaattaagatactaagaatctttcaacccttggaagcttaatccattttaggagagagtgtgtcttcaaattgttctcaaagatccaaggaaaaatgatattaatactttggtatcataaatagtgtcctcatctttgaatggaaacttccaaacttatttttagatactccttttctatctcctaatggtttgtattgtattaagtgtgtagatccttttgttgaatgtggttctgaggggaagtagggatgatcttggagactgtcctattgacttggaaagtttttccctttcagagcatgagcatgaataatggaattttaaaaacaattttattaaggaataattggaaaacaaatggatttgttttctcaaactttagtttcagctgtcttattaaatctcttgttataaccattctcctgcagaagtggttatctctgtgacgctgggattttctcttctccctgggagcttattaccttggctatttccttcattttcttagtttcaggtctttctgtgcatgacttggagatcttcatctgagctcgatctccattctagttccagccttaccatttcatttactttcccaacgttcccatccaagatgtgtgtcgaagactgttgcttaggctctgttggtgacctctttatgggtgtccctctgctctctcgcacactgctgctgggttgttctttctgaaattatctttgatcactttcacgtcctcattgactacttgcaaaggcatcacattatactcacacaaaccctccatgaccataacccacttctgttacctttcttcctgccccacttctgctcaaatgcgtttttactctaatttagcccttctcaactggagttccatgggagaattctgccttgagatcttaaagcatctgttgtatgtatcagattgtaggtagcagtttgtgtcctgtatctctagaatgatactagctatgttttttccttgggagaattgagaatgtactcactcatcattttttgtagggcttaattccctcccacatccccattgagaagggctgctccagtaaaactgtactgttccttggtcctgggaccctttccatatctttgttccatttgtttcctctgccaccctgtgaccaatcctgtctcatcttaaaccgcagcctcttggatgatgttttccttggtcctcaggtgaaataattccctccccgcagtacacacatagctttagcccacactgacaaagatgtttatatggaaggtgtatacacacacatgctttgactcagcatcttttctgtgcctgttgttgcattttccactttcttccttatttcccttattagaaggggaggcaggcttgatgcctggcggtgtgcataacctccctcccaccgtgaaccgtgcatgcgataggtattctaatagtttggcaaagtgctaaaaacgccctgctgaaacacagatacctgcttcaaaacactttatttgcaagtcttgctttgttacttgactttttatctgcaaagccctaatgagcacaaatacttaactaccattttctctgtcatcctcttaaacctttatcactgcctgtcctaccttgccctgccccatgccatcttgccagtacagaaaatctgagctaaagacagttgtcagtgaagagtgagttgtaagaagaactagttgagtaataagtattgttcagctgttgagcttatggtatatttattgtaagtgaatccatttttgtgtacttaaaatgaaaatttctgtaaagcagatagactctagttaaagtggcagtattcagaaagaaaactgctgtctaaaaatgtcaaccaggtcaataaaactttttttaaaaacctttttaactgactgtaagtgtaatcattggaggaattttgaaaaatatgttaaaggaaacaagttactaacttatagagaaaaatcactgataatcgattgatgaatatgtctagtctgttgtatatatgtttcccatgtcattaaggtcattaagtattctgttactaaatttttttttttgagacggagtctcactctgtcgcccaggctggagtgcagtggtgtggtcttggctcactgcgacctctgcctctcaggttcacaccattctcctgcctcagcctcccgagtagctgggactacaggcgcccgccaccacgcccagctaattttttgtatttttagtagagatggggtttcactgtgttagccaggatggtctcgatctcctgaccttgtgagccactgcacccaaccttctattactaaatttttaaaaatattatctgagttcttcctttttaggaaggactagtttttttaaccagtccactgttattcatacacttgggttttacagtctttgaaacattatgaataatagtgttataagtatccttaagtataaatctggtgtataaccagagtcctggaagaagcattgctatgtcagaagacagacttaggtacttaccaacctttgggataggtaaacacacatacataccactaccacggctatcactaccagaaaagaagttcgacccagcttatactcaaagcctgagtgtatagcttttaaaaatagttatactgtccaggcgcggtggctcatgtctgtaatcccatcactttgggaagctgaggtgggtgggtcttatgagtccaggagttcaaggccatcctgggccatgtggggaaaccccatctctacaaaaaatacaaaaattagccgggcatggtgttgtgtacctgtagtctcagctatgagagaggctgaggtgagaggatctctgagcctgggaggttgagactgcaatgagctgtgagtgtgccactgcactccagcctgggcaacagggcgagacctgtctcaaaaaaaaaaaaaaaagcatatttgtgtagttttcaaat

SEQ ID NO: 100266 - DNA, 1342 bp, Homo sapiens
aataacacattaggagagaagggtacaagggtccaactgtgaagtttaattttttttgttaagtccatcccccccgcaccatagatttcttagctatttgtgtgcattttttgattttgcaaatatttctattggtatatccatcttttctttattaaaataagagctaatctgcctcaagatgctttggggtttttgcagtggactgaacaaaattaaaggttattttatttttattttttgttgttgtaaacctcttcgacctgtctacaatatcattttgaaatttgagttggggcaatgtctgttacttctctgtcatcaccaatagtcagctagaacataacttttccctcagagaaagttacatgaaggttatatgtaccaggaattagagacagtttggtgaggaagacatttagccatttgtcaaacccatttattaactaaaataatttttggagaggacttaaacatgaaaaatacctcagtctacatgataagacaggctgatataatcagatcattgaattgtttcttgttcttttccagtattaattttaaagacccacagtttgctgaagattacatttttaaagctgtaatgcttccaggagcaaggtaacaacagtaaattacctagatttattttgtacaaatggttttcatccctattactaagtgttgtctttttaaatggtcagaaagccagcagcagtactgaaacctagtgactgggaaaaatccagcaatggacggcagtggaagcctcagcttggctttaaccgtgaccggaggcctgtgcacctggatcaggcagccttcaggactttggggtgagttgtcagtttttagcccttgtatattttgctttttctgaatcatcccataaaacaagtcagtatttatgccatatatataaatttatgccatatatataatatatgattatatattatatatattatatataatatataattacatatataatatataattatatataatattatataatatataattatatatataatatatataatataatatatatataaaattataaatttatatatatataattacaggagtgagccaccgtgcccggccgaaacccagtattttcataaagtttatatatataatatatataaatatatattatatttatagtttatataatatatataaatatatattatatttatagtttatatatataacatatataaatatatattatatttatagtttatatatataacatatataaatatatatttatagtttatataatatatataaatatatattatatttatagtttatatatata

SEQ ID NO: 100267 - DNA, 1051 bp, Homo sapiens
cctacatattcttaaaattatgaagttatgagaattaagtgagcctaatgtctgtcaagcgcttagggtagttcctaaacactatgtaaacattagttgttattgtcattgttttggaaaaatcttcattcttagtagcagtaaaagaaatgcagatttaaaatagtcttaactttttccattatttcaactgttttggaaagcaacatagtatttcctctgaatagagcagtgagttcagaagatactcttaacctttggtccaaattcctacctcttggatttgtgaggaggaaataattttagatgagcataattatatgcccaaatatttatattgtattgtaatctatactactagtacgaaatgagagaaatggtttagtaaagtataagacatcaacatagtaaagtattctataggtttatgtgttggaattacaaagatgaagaaaagatacaggcaagtatttgatatagtaaattaaaaatagcaagatgtagagtagtcatgtatacagtgatagcaagaacatggatccttaaggacaaaactgaaacataatgcaaaaaaagaaaaatatgcaaattatttttcgtatgatgtaagttgtaaatatttaaatggttatcaattaagagtcttggtgtggcagatgaacatttgctatcactattaccattatgtagttttgagctttaattataaaccacctttttgtttgtattatcttaatcagatctgttagtgaagacgtggctatgagcatttgttttatttgtgtcagctgtgttatgatgggtatatcactatacaatttttttttcttgtgttgggtccttttatagccatgtgatgccaagaggctcaggaactggcatttacagcaatgctgcaccaccacctgtgacttaccagggaaacttatacaggccgcttttgagaggacaagcccagattccaaaacttatgtcaagtaagcttttacaaatcggttattttacattataaattaaatatcacagcaaatgttggtttctaatcttcttt

SEQ ID NO: 100268 - DNA, 1507 bp, Homo sapiens
gctaagcacttaaaatagtacgttgtacataataagtactgtgaaagtattaagtgataaaagatcatctttccttttatagaattttgaactttaaaatttagtcaaatagcttgttttagtaagattgagttctaagccatttattcagtctaaaatatttttagtatcataatcattttcttcgtgtagtatgaaattgcactcaagaagggccatttggtcaaactgacaactgtcaagtgtctgctgtaggtatttcttattgttggtgtttgatttgtctttgatgtgtcagttttggctgatgagtaattgtctgagtactgataacttgttggaatcgagtgtagccctgagtactcagtctgaataaagcatttggtttctgtagcccagagaaccttaaatgtgacttctcttcattttagtctgtaaacttgtcaattagccacgttgaaaagtgatttttgactagtgctatcagtaaacatggaatcttttctgtgattgccacgctgattaggtaaattgtcacttgagaagctattggcgaagcttggtttacatggccttagagctctagaaaagggataagtttttaaagaccaaaggaaaaaattttccactctcgcctgtaccttctgaagtgcaattcactgtctcagaattttttttcttcctctcaaatgggtcttctgttagagccatacaaatgaatgataataagtttgttttaccatctacttcattacagatcagccaggaaatacttctgctttatgaatacttccaggttatatatgttactaagagccatatgaagaaatttggttaaaaatagccttgaaatatttctttgagccttttttctttttggattgaaaacaaggagtgttttaacagttgcatcagagtttattgaaagttttggaaaatttgcttaggttttaacaaaaaactgtaatttttgtatgtgctgagtttatatggaaaaagaaaattgtcctggaggtgagagatagaaaatggaaaatagagaggcacctggcacactagaagtgatatattagaaatgtttgctgttttttaagacatttctagttgtataggttagacaactagttgtataggttagacaattatttcctcctccaaaaaaagcatttacacttagtaaactttacattccagttctacttagaaatactgctgtgcttaatctaagaatagcatgtttgagtctaatgaatatatattatgggtggtgatggcttcatctccattagcacagtttctaggacaaaatatacaagtttttttcccatctttatttttcttaaaacattagattgtttctgaaggtttctcttaatgtagctgtatctttgtattgtcttcattcgattttaaatttattagggagccactgtggaagctttcgtaagtaccatggagaatgtgtatcctgcgattataccatacataaaaagacaccaggcaagca

SEQ ID NO: 100269 - DNA, 1185 bp, Homo sapiens
gggatgtgaagtagaggggtccggatgaatatttgctgtatttcttttgacttctgttacatttgcaaattttgtatatataagggcactaaaatgaaatacttctgggaacattttaactgattctcactaaactaattttgtacatgagctgaaaaagtggctcaaacattgattttactttcagtagattactttctcacaaatggtaactcattgaaattcatatatgtaaatgtatcttaagttttcccatagaaataaaccatacaaatgaaatgattgctattattgtaagaacttcttacttttatctcttcagaaaattgattttctgatagtgtatagtctgtagtaatgactcagaacttactctgggcgtagggtggggaactgtcttcctctgttttctgtggagtgtgtagtagtcagcatcctccacattgttactcggtttgactgctagtagtttggtttttaagaaataaaaaaggaacttaattccaattgactaaagataccaccttttaattcacaatgggaatctgcctggaagtgacagctggtgaagggcttcctgcacctttctgagaggtgggtttggcacccatgggtatggctgcagaaacttttccagctggccatggactgatgtgggagtgggctgtggcagctgcagatggctgccctccttcaggtagtttgtccacataaggaaaactttcttcagtctggccttctcagcatgtcgagatgggaaggaagccagggctgaggctgccagttatgagctagaatcattgtgagcagctagatattttattgattccgtgttctttgtcatggggcttttaaagcatgattctacttttttctttctctctctttcttaagtaaaaaccatatatatttttggtttctaaccagagataagctttcaactcttcttttctttaagtaattttgaaaagcatttttctagtttgtgtttctattaaaatgtgagcctgaatacattatggtaagcgttgtccttggtctcgggagtctagaggaggttactgtcctcacatggtgaactcattagacaacttctggaaccagcagttttaattaggtcacagcagaccccgctgaaggtgaagtgactgcaagctgtggttcgctgatatagacaggcccaga

SEQ ID NO: 100270 - DNA, 1045 bp, Homo sapiens
taaatgcaatacgactagcaatgtgtgtattaatgttttgattttagtatatgttctgaaagcacacagtatgtgctgtttcattttcctcagtaccacaaattttaagcagaaattaagtaagtaaggggtaaatttttcctaaattatatacttggtttctctatcttattgctcactttccatactaataataatggcaaatgtttgtctgcttacaaagtgttaacactgtgttaacatcctttaataagaatgatttcatttattcctcctagcagtgcattgaaatagatgctgttatgtttacatttttgcaaatgaagaaagtgaggcacagagaagttcagcagcttacctaaggtcactcttttgtgccattctttaccaagaaacttttcactggaacaaaacttaccagaatatttactctgagcgtaatataaagacgtagggacttcaaaggaagtaaaggatctgtttccacttctaaggccccaacagctttcctcccctctgttcacattaaaagttttcctaagatcatcatcattgtcccttcccttaccctgctgtccatcaggttttgttcttattctaccctagccaagtactagtattattctgactttgtgaacccagcaggttagtgacaagttttgtgggaatgttttttggtttagttttagtcagatacttaaaattatgcctgaaagcaaaaggtaaatgtgagcataatagagttctatcataaaagtcttacatcacagacatttaagaaagataccattttgttccagaaccaggttttaccagttcttagttcagtatgtttccacgacgctactgtttgttgagaatcctattaagagaattttgagtgtcttttttttattacattgcatttcttgaataatttcctactttaagatggtatgtataatccatatatccagtagatttaaaaatacaacaggaacatcctcccaacacagacacagcctagagttaatagatacccagcattggagttccctttgtcact

SEQ ID NO: 100271 - DNA, 1544 bp, Homo sapiens
atgacatccttgctttgttcttctgtttaattttaattattgatgatttttttcataaaaattatatttgtcaaaaacattataagtaatcaattcaaacaaaaagaactttgcgtttttaaactgtggctttgttcttaacctgtttttggaacataaaatagttttgaattgcatttataatgtatattatttatgccagcagatcttcctaaaactcaattgaattttattattgtaagactcaaaagaaaaactgatcacagttaagatgtgaattgtgtttttagcccgtgggttttgcattaattggcccagttttgatgagactttggttacagcacaaaccttagtttagcccttcactcctgcagagactggaagagaccattcctatctctgcacacggagctcttcttgctaaaacagatggaggcattcttgctaaaatatatttgtgctagtaattgtcctgaaaaataattaaaagccctagccatatgcattttctttctgagataaaaacttatttttaattgtattctgaattacttataacacattgttattagagctctggtttcagctaccaactgtaaagaaaaactttagcctttctagagttctttagagagcagttcatttcttcgaatcatcacacaaaaataattatctctggtgttgttttaataaaaagaaggcaagctccaagtgaagggaggagagtgggggtagagaggatggattcaggcttgaatagctgtgagaagaatgctttacccaatgagcccagcgccgggcttttttcccctaagacctcggaagtgaaattcttatgctgatatggttataactgattaccagctagtcagcacttcagtgaatttaaagttttattgaattcctcctaacatggtcagtggccccaaagcttctgatgttcaagtatactggagcatttgcctctgtttattctttgtagtgccttccataaaatagaagttatggaaagtgccttaaggagaaagtaaagtcttaaatggtgattgcctttagaaggtatatccttgctacattgtttatgtgacagtttttaattaagttatgatttagtacattatacctgttgctttgcatctgcaaagttaaaatagtcacttgaagacaattaaaacatttctttcgactagtaatctgcgacagcaaactgggttataatagccgttgaatctgtgttcccatgtaaactgtacaccaaatgccagtcagcccatgccaattagtgctcatgttgctaggtcaccgtggtcaattgaaagctgcatcaatagaacttgaaaaggtttcctcccaatcagaccttctgacatattgaacagaataatggatgggaaaaaacagccaagtctcctaccctggattcaaaatactcagcagtaagaattcatttgcaacctgcaattaagtagaaagaatggatccaagaacgagtctggacatttttgaaaataaagcctcattctcctgtcttgtacatgtttact

SEQ ID NO: 100272 - DNA, 1027 bp, Homo sapiens
gaaagtaagtctgctttttcagctgttgtcttttagaagtcattttacaatgttgtcattttagaagtctcctgccttgattcatctgatatccctcctcataaaagaaatttctgcttgataatcttccacatatttttcttctcaatgtaagcagctgtatcactgaatgactatcataattcctagacaaatttagtatatgtaagcttcatgtccttctctttacagcatccagttttagcagcatttaagactgaggtctatttgacataatttcctccagcaatttgacaccctggccagtatttacatgctcttaatggaatccttactagagaacaagattagaatgctgtgattcagagtaatgtgtatggagtttggcacctgcagtgatgtgaagtggtttttaaattgcttacctggtgttgcctccaggccttttgcagtgcttcacatattaattagtaagacctctcttctcacagctaaggaacatattttgtatgttttttgatgtattcttacaagtatctccaccttacaagaagataatcaccttaattgcaaataatttcttctgagattttgttacagtttatttgaatcagtttatcgaattttgctttgaattctttcagcccaggacctctaaaaatcgtgtcagtgaactaaggctctttatgttactatggttagatggcactaggccgtttcagtgatgagcatttttgaagtgaggactatttgtaactggaagaaaccttggagaatgtgtagtctagtcacctcattttccaagtcaggaactgaaaccctgaaaaccccacacggttcagcaggagaactggtagctggctgcctagactgctgaccccagttcatccattttcctctctcctttggagatcttccttttaaaggaactctgtgctgttacaggaggtaaaattcttatttacttagaagatataaaccaattggtaaatttattattcttttaggactttttgaaaataacatt

SEQ ID NO: 100273 - DNA, 1038 bp, Homo sapiens
aattgagaaccactgtctgtacatgttgtttacacagaacactttagttatttgtgtgcatttgtgattgttaaggttttttgttttatttttcagtaatagcatttgtgctagcctccaactttgcaacaagtctgtattaaagctctggatcaaagcaccttttatggggcctttccatgtgctgtacctttaacacatactcagtttccttatgatgtgtttttccatagaggtttaaagttaactgacttgcaggagtatcggtccagaaaataaactctttcttttgtttattttcagggatatcccagagaaggaaggaaataccctttgccaccaccctcaggaagatacaattggaattaagcttttgtaaagctttcccaaatcctttcatcattctacagttttatgctatttgtggaaagatttctttctcaagtagtagtttttaataaaactacagtactttgtgtatttcttttaactgtgtatatttctactgatctgatctcactgtttatgttgctttccaaagatgtatgttgcataatacagtggatctgaatttattattgcttataaaacacatttgatggaataggagtactggtttttcataatggttaaaaatgaaaccagctgtggatttcaaaacacagtgtattctagatcatctaagatccatgctgatttttattgcacaagaattaggtttgaactcgagctggaacctcagcaaactagagtatatattgttcagtatttctttggaaacatttcattaatgtacttgtcttacagaaatttctgaactttagtaaaaaaaaataaagttaaacttttaaaactctgttttgtgttgttattttgcagtatttcaactttgaaaatcttgaccaagcgtggttttttaaaattaacttttgcagaaaactatttctgtaatcagatgtccaaaccaaaggacaaagaagtcaatgaagaagtagattttaaaagatagggtcagcaagacataacaaaagctttaac

SEQ ID NO: 100274 - DNA, 1036 bp, Homo sapiens
aaaatcttagaacctggaaacagcctgactactctggggctaagggcccgtaatgagcagttgtcttccctttaaagatcaaatggggtaatgtatgttaatgtacaaagccgtctacaaactggtattagattgccatttagcgttacaaaggcaaattgggtgtaatgagcgataggttaattttcgtacgatgacgtgggatgccaggaacgggccgggtgaggccggggtccctgcactcctttgctgggcgcgcctggaccgaactgaagggcccgggcgccgcgacctcgcagccgggggcgggatggtggcggcgcccgggccccgcgtgctactcagagctcaggtcctaggtgcttggctcaactttctcccagcggggtcgggaagcgccaggccctcggtgcacgtggggcacgcgcccggcgcctgggtctcccctgcggctcgctagtcgcccggcccagcccgcagaccccgcggctggccctcccgggagccccgcgagccggccgcacgcacaggatgggcgcggaaagccccttcctctaccctcgggcgcaccctccttcctcgtccgcggcgccgcagcttctcaacctgccgctgcatctcaactccctgcaagcagcagagctgtagaataccagaaatggtcttccttccgaggctgccgttttaagttccaagtgtgaaagtaaccgaattttgctatgcttagaaatctaaaatctggacattccctgaagagtcaacttagagtccccagtttctcgatctggctccgtcccactgactgacgcctcctgcccaccccgaaaggatcctggagctgcgatctcgccagactctattcctggtgatccactgctctgctatttcccatcaggaaaaagtcaccaaacgaatgaactagcaaacggcccattctcgatggatttctcctccactcagtaaagcagaatcctcctgtggcttgtttctccacgccttatttatggaatgagggccaaaagagaacaggcttgaa

SEQ ID NO: 100275 - DNA, 1056 bp, Homo sapiens
aagctaacacaattgttagtacagtgtgagaatgaatagtaggtaatcacattttgttgtcaaaattattataatatggtccaatgaaatgattcctcctcccatccccctaaggaaaaaaacaaacaagaaacctccccttctagggtcaagctgtaacactatagtttttacagtcagagtagagaataacactgggctataacaggggagtaaaaatagggaaattatccagtgtgtcccaattctctcaccctaggattaggagcttgagccacaaattcaaatttttctatgttaaaaatcattttttagagtaataatacatgtatgggaaaaacaatggcaatattgaaatataattttttatttctgaattacaagtttattgtatattttgtgtatatagaaagtttaaaatattttggaacatagtggtatttccattgaacaacattttttagatgttttggagtgtcattaaatggctgttttataggaaaaagaatcctctgaattttaaacaaaactatatttctgttggttattttgtgtgaggagttagtttttctaagtgttccaccatgtttccaacacaacctaattagagtaaatacacaaagcttttaaaaatacttactttataacttctcacatactgtcacatttttcgaatctgagatttagtggctttaatgtaaactctttttctcctacaagtctcattaaagatgtgtcatcttgcatttacaaattactttgtaattatcaaggaaggtatcagtttttaacatctgggctgagtaattgggctgttgccaccatcacttacttgaaggagaactccaatttttgatgttttggtaaattgattattaggttgttggatttgttaataaaaagttttactgtgtacattttagaaggaacagctatgacaatatagtaattagagaataatttgctcaattttgtccccttttgttcttctgtgtactactaatgttgagggaatagttgacagatacttgtattcacatgtatctgtctgaattg

SEQ ID NO: 100276 - DNA, 1048 bp, Homo sapiens
cactgcctatatgtcccaaaagcaataaaaatccttgcccagttttctgagtcaactgactactgggaccaatactgcctgaacagctttcctactgtatatacttctttggatctgtcgcagacacagtcatatgtgtggctgcaagtcgtaggttgtgtttgtgtatgggtgatgaatgtgactgtctccattggaagtgtggctacaaccaagctcaggataagaacaccagctagatgaacaaacaagctaagctgacccctgttggcaaaacagccaccactcagctcactccttccctcccttttctttttttttttttttttttcagctaaaagagcagaagaggtgatttattatatggttgttacactcggccacaaataaacacagaaatagtccagagtgtcacaggtccagggcagaggaccaacatgggcattttgtttatgagcaaggtgggtctcagaggtgatcggcgatcagagggcgatgaagttctagatccattgagacaagctctagacagtagcatgcagtcccacaacttgtaccagcatccccagcgtctggcattccatgtttctgctcctgtggcctccacggtgcaacaagctagcggtttacttggacctctgcctcatctttcttcttttgcgcttcagcctgcgcattcgcttcttcctccacttggctctcatggcgcagaggtttccaaaaaaatggcgctaaggctgagagcccttccctccctttttgacatgtccaaacactttcactgttgccttcactgaggtgccaatccttagatgtggttgatacatggagctggggagtcttaaataggacttaatttcaaaagacctggttcaaattctggttctgcacttaataggcatgtcaccttgagtaaatcattcttagtctcagatttataatctacaagacgagaatttattctttaaaaacagggggtgggggtagagacagagtcttgctctgtcacccaggctggaatgcagtggcacaatcaaagctcactgca

SEQ ID NO: 100277 - DNA, 1048 bp, Homo sapiens
tgaaattaagtcctatttaagactccccagctccatgtatcaaccacatctaaggattggcacctcagtgaaggcaacagtgaaagtgtttggacatgtcaaaaagggagggaagggctctcagccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacactctggactatttctgtgtttatttgtggccgagtgtaacaaccatataataaatcacctcttctgctcttttagctgaaaaaaaaaaaaaaaaaaagaaaagggagggaaggagtgagctgagtggtggctgttttgccaacaggggtcagcttagcttgtttgttcatctagctggtgttcttatcctgagcttggttgtagccacacttccaatggagacagtcacattcatcacccatacacaaacacaacctacgacttgcagccacacatatgactgtgtctgcgacagatccaaagaagtatatacagtaggaaagctgttcaggcagtattggtcccagtagtcagttgactcagaaaactgggcaaggatttttattgcttttgggacatataggcagtgatacaaatggtaccttaggccggaaagacaattggctaggcctaaaagggattaggcatgtaagtgctttattcataacataaatagtgcaagccacaaaactactgttaccatgttccctcctccagggaccaagccaacagaaatcaccagtgtgggatgaagtttgacctgaattggagccaca

SEQ ID NO: 100278 - DNA, 1054 bp, Homo sapiens
atgactctccacagcacaggatacggccatgataaacatgagcaaactcaacagcaagctgcctggaggcccgtgacaaacggaaatggtgcttttgggatgcggctggatcttgaggagcactctgctctgtttggcggaagggagcttggagtggaatccacaccctctctccagtgcttggagtaaaggatcacgaagtcattatggaattagcagcttgcccagggacatactcaaccctctagtttctccaggtggtgtctagattccaggatacttcttttcagatccataaggtcaagagggctatagcttcctatgtaaattggttgaggtctcctagtctggggggatgaactcgggaaatggtataaccaggtggcctccatggatttggggatagcaccatctccaattctgtacctcctcaggtcctccccatgctgtctgtgtccttcctccttggccacaaatcacagccactaagagggaagtagatggtgaccaaaacagtcccgatcttgattggggcaacagttagttgccccaatgtaaaatgtaaaattgtaaaatgtaaaatgtaaaaatttgcatgtcaaaattcatagaactgtacaactagaaagagaacactctaccatatgtaaattatactccaattaaaaatagattaaaaagaaattacagcctcttcagaacactaatgaaagcctgattaaaaaaaaaaatggaaaaaaaagacacccaactgtgtaccaactccctcttcctccttctatatcatgaagtagtcaccatttgaatggtaaaccttcctcccctgggccaggaacatggcctttgtgtgtcactgtgcacctgcaggtggatactgttgctctgccctctccacacagtcatgcagccttccctgggccgctgtgggctggaagtgggagagccggaactcagtcctggtttgtgtgcctctcaatttgttctttctccccatctacgacacgttcacactgggtgagtgctgacctttggcagccccactctttaggcagag

SEQ ID NO: 100279 - DNA, 1432 bp, Homo sapiens
ctttacttttaaacagtgagcctgaattttgttgctgttttgatttgtactgaaaaatggtaattgttgctaatcttcttatgcaatttccttttttgttattattacttatttttgacagtgttgaaaatgttcagaaggttgctctagattgagagaagagacaaacacctcccaggagacagttcaagaaagcttcaaactgcatgattcatgccaattagcaattgactgtcactgttccttgtcactggtagaccaaaataaaaccagctctactggtcttgtggaattgggagcttgggaatggatcctggaggatgcccaattagggcctagccttaatcaggtcctcagagaatttctaccatttcagagaggccttttggaatgtggcccctgaacaagaattggaagctgccctgcccatgggagctggttagaaatgcagaatcctaggctccaccccatccagttcatgagaatctatatttaacaagatctgcagggggtgtgtctgctcagtaatttgaggacaaccattccagactgcttccaattttctggaatacatgaaatatagatcagttataagtagcaggccaagtcaggcccttattttcaagaaactgaggaattttctttgtgtagctttgctctttggtagaaaaggctaggtacacagctctagacactgccacacagggtctgcaaggtctttggttcagctaagctaggaatgaaatcctgcttcagtgtatggaaataaatgtatcatagaaatgtaacttttgtaagacaaaggttttcctcttctattttgtaaactcaaaatatttgtacatagttatttatttattggagataatctagaacacaggcaaaatccttgcttatgacatcacttgtacaaaataaacaaataacaatgtgctctcgggttgtgtgtctgttcacttttcctccctcagtgccctcattttatgtcattaaatggggctcacaaaccatgcaaatgctatgagatgcatggagggctgccctgtaccccagcacttgtgttgtctggtggtggcaccatctctgattttcaaagctttttccagaggctattattttcactgtagaatgatttcatgctatctctgtgtgcacaaatatttattttctttctgtaaccataacaacttcatatatgaggacttgtgtctctgtgcttttaaatgcataaatgcattataggatcatttgttggaatgaattaaataaacccttcctggggcatctggcgaatcccagctgtgtgtccggtgtatggtttggcattatctcctctgcgagatatccaaattcactgtagtcatgaagggtctcagtttgtggctctcattcaaatattcatttctaaacgtctcatccagtatgaaatcat

SEQ ID NO: 100280 - DNA, 1062 bp, Homo sapiens
ccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctgagcggcctccgtccaggagcctggctccgtccaggagcctgtgcctcctcacccccagctttgctaccaaagcaccttagctggcattacagctggagaagaccctccccgcaccccccaagctgttttcttctattccatggctaactggcgagggggtgattagagggaggagaatgagcctcggcctcttccgtgacgtcactggaccactgggcaatgatggcaattttgtaacgaagacacagactgcgatttgtcccaggtcctcactaccgggcgcaggagggtgagcgttattggtcggcagccttctgggcagaccttgacctcgtgggctagggatgactaaaatatttattttttttaagtatttaggtttttgtttgtttcctttgttcttacctgtatgtctccagtatccactttgcacagctctccggtctctctctctctacaaactcccacttgtcatgtgacaggtaaactatcttggtgaatttttttttcctagccctctcacatttatgaagcaagccccacttattccccattcttcctagttttctcctcccaggaactgggccaactcacctgagtcaccctacctgtgcctgaccctacttcttttgctcttagctgtctgctcagacagaacccctacatgaaacagaaacaaaaacactaaaaataaaaatggccatttgctttttcaccagatttgctaatttatcctgaaatttcagattcccagagcaaaataattttaaacaaaggttgagatgtaaaaggtattaaattgatgttgctggactgtcatagaaattacacccaaa

SEQ ID NO: 100281 - DNA, 1009 bp, Homo sapiens
tgtatgaaaagaaagaaaggaggaccaagagatgaaagagggctgcacgcgtgggggcccgagtggtgggcggggacagtcgtcttgttacaggggtgctggccttccctggcgcctgcccctgtcggccccgcccgagaacctccctgcgccagggcagggtttactcatcccggcgaggtgatcccatgcgcgagggcgggcgcaagggcggccagagaacccagcaatccgagtatgcggcatcagcccttcccaccaggcacttccttccttttcccgaacgtccagggagggagggccgggcacttataaactcgagccctggccgatccgcatgtcagaggctgcctcgcaggggctgcgcgcagcggcaagaagtgtctgggctgggacggacaggagaggctgtcgccatcggcgtcctgtgcccctctgctccggcacggccctgtcgcagtgcccgcgctttccccggcgcctgcacgcggcgcgcctgggtaacatgcttggggtcctggtccttggcgcgctggccctggccggcctggggttccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgag

SEQ ID NO: 100282 - DNA, 1009 bp, Homo sapiens
cgtgggggccgcggcccgcgctgaccctggacgtcgccgcgcaggtacgttgccgtcccccggcggtctgacccccgagacagcccctagtgcataccccacgccctcctccattgtcgagaatgagacacggctgtgcctttgtccacgtggtagagttgccgccgcggtgaggctctcgcctgtgcaaaaagcgtggcagcgaattctcatcaacgaggggaggcgcgtcccctcacagcgcagctctcgggtctgaggagggccgggcagggcgtgcgtctgtctaggtttgaattaaaggcgactcacaggaaataaggccatgccactgtggtagcttttcccgtccatctccggacactcgacggtgtgggtcgtgcgaggaggcggcagtcttcacagcctcttactctagtcctcacggtcaggttctttttctgatttgacacagacagcgggactgacgacctcataggtagctgaaaaccgtaagtggagatggtccttctatggtgtgtgggggcgtggccagttgttagattgtgtttggaaagacagccaggggcggagaagaggggcatttctgagatgatggggggactggtgccatggagggaggaggagtgaggtggagatcgggaattccagccaaagagaaatggggtccctgggagaaaattcccactctagcagtcctggagttgtgctcatggagacttgcttacgcgagtacaaggacagcgttgtattgacaaaatttcagccctcagtctagtcttgtaaacgatagatcaggagtgtacttaaccgtcgttactttgatccagccctaggtttcccttttctcatttgtaaaattgttatagtaatacctttttcatccatttgtggtaacatttaaatgaggtaatttgtgtgaagcccttagcaaacacagcgcttcttagtcgtgggttccgcgtggggtggattcaaccaacctcaaatcaaaaatattcttcagaaa

SEQ ID NO: 100283 - DNA, 1031 bp, Homo sapiens
aatcgcttgaagctgggaggcaggtgttgcagtgagccgaggtcgcgccactgcactccagcctgggtgataaagtgagactgtcacaaaaacaaaatggcatagcacagtcagcccaacgtatttgcaggtttcgccctgaggttggctgaatctgtggatgcaaaaccctcagatatggagtgctgactataactaaatgtttttaaactaaacacttaaggtatactatctcagtttgccacagtggtaatcccatcttaacagtgagcaaactgagtcttagtaaaattaggcatttttaggcattgggtactatttgagcctacagtcattgttctgcagtctgtaactattttgccagtagtagaaaaggaggaatgttccattgtcagggcagaatgaactttggcattcacgtggcttctcttcaaccttacttccctgcagcccctggttccccaaggcagaggaaataccctggtggagccctccttccatagaaccagagatggcatctgtggatttcaagacctatgtggatcaggcctgcagagctgctgaggagtttgtcaatgtctactacaccaccatggataagcggcggcgtttgctgtcccgcctgtacatgggcacagccaccctggtctggaatggcaatgctgtttcaggacaagaatccttgagtgagttttttgaaatgttgccttccagcgagttccaaatcagcgtggtagactgccagcctgttcatgatgaagccacaccaagccagaccacggtccttgttgtcatctgtggatcagtgaagtttgaggggaacaaacaacgggacttcaaccagaacttcatcctgaccgcccaggcctcacccagcaacacagtgtggaagatcgcaagtgactgcttccgcttccaggactgggccagctagtgggggtggcagaggtctctttgcttcattcagccctagctctgtagagaaatgcaaacctcgactctcaaggatgtgaggaacacaagttcatttc

SEQ ID NO: 100284 - DNA, 1035 bp, Homo sapiens
ggggtaggtactaagccctgatcctcacccctgtgcgggtgcttcctattatgctttctgcctttagccctcctcctccctcacaacctggtcaaacacatcagacagggaaagaagcaacatgtgtattattaaattatttgtcagaatttccagaatcagagtctctactgggcaagtagaaaaatagaaaagtttactactttgaaaaggaaactatgacaaacaagtatatattcaggaaagggactcctagaacttgagcaacaaaaaagagttcaacctcggcacagtggagtctgcagtgtctccgcaacaacagaaatgaacttgtgttcctcacatccttgagagtcgaggtttgcatttctctacagagctagggctgaatgaagcaaagagacctctgccacccccactagctggcccagtcctggaagcggaagcagtcacttgcgatcttccacactgtgttgctgggtgaggcctgggcggtcaggatgaagttctggttgaagtcccgttgtttgttcccctcaaacttcactgatccacagatgacaacaaggaccgtggtctggcttggtgtggcttcatcatgaacaggctggcagtctaccacgctgatttggaactcgctggaaggcaacatttcaaaaaactcactcaaggattcttgtcctgaaacagcattgccattccagaccagggtggctgtgcccatgtacaggcgggacagcaaacgccgccgcttatccatggtggtgtagtagacattgacaaactcctcagcagctctgcaggcctgatccacataggtcttgaaatccacagatgccatctctggttctatggaaggagggctccaccagggtatttcctctgccttggggaaccaggggctgcagggaagtaaggttgaagagaagccacgtgaatgccaaagttcattctgccctgacaatggaacattcctccttttctactactggcaaaatagttacagactgcagaacaatgactgtaggctcaaat

SEQ ID NO: 100285 - DNA, 1037 bp, Homo sapiens
ttgaaaagaaccaactaaataactactttccatgaggaaaacttcttggaaaagtagttcacaattcatcgcccattcccaacatcctaaactcctcagaatttgaattattgttactctactgaaataatgttaagttccacagcttttacaagctgtgctactttgagcaagcaacttctctgaacccatttcctcctctgaagaaggctgaccggctgttaccagggttccatgagcctgaaacttgttggctagtttattggtttcccacacataggccaaggtgctacagtgatccccatttcatagatgaggacctatcaaggtaacagtcaatggctggttgggacatgagccagggcctggtgcccggattcaactcagactactcaacacactcttcccctcagccttgccaaaggcaaagggctatctttagcccctaaatctttccactgcagcgggcatgcaaatttcaccaaccccacctaaggcctccagataccgtcaccccatcgtcatttctgctgctttgccacaaactccctgaatgtgttttctccctgcccttcagctcctgaatctaccttcctctttgattcctgtttccatccatccaaagcacatgccttccttctagcctccttcggccagaccacagatgtcacctcggattcaacgtgtctagaaaaaaagttgtcatcatcttccctgataaactagtcccacccctctccccttctccagtctcatcaatgagaccgctccccacaactagcagtccctcaaacatggaaaagactgccctctgggagttccgctgtaaacaggtacctatgaggcttgatcaatgtcgcctgaaggagacgccccagtaaaactgtgagaacactgacaaagcctaaggaagggatctataagagtggggctcttatagagccactggggtttcagtggtcccagccccagcctggggaaacaagactgcagagggctctctcagcctgatgccctgacttccccagacctctgcc

SEQ ID NO: 100286 - DNA, 1075 bp, Homo sapiens
agcttcgcctcctgggtcacctgtgtgacgtgacagtcagcgtggagtatcagggtgtccgcaaagacttcatggcccacaaggcagtgctggctgccaccagcaagttttttaaggaagtgttccttaatgagaagagtgtggatggtactaggactaatgtctacttaaatgaagtgcaggttgctgactttgcttcatttcttgagtttgtctacactgcaaaggtacaggtggaagaagatcgggtgcagcgaatgctggaagtggctgaaaagctgaaatgtttggatttatcagaaacttgttttcaattaaagaaacagatgttagagtcagtacttttggagttgcaaaatttctcagagtctcaggaggtggaggtgagcagtggctcccaagttagtgctgctcctgcccccagggcaagtgtggccaccgatggccctcaccccagtggtctcacggattccttggactacccaggagagagagccagcaatggcatgtcttcagatttgccaccgaagaagtccaaggacaaactagacaagaagaaagaggtagttaaacctccctaccctaaaatcaggagagctagtggaaggctggctgggaggaaggtctttgtggagatccctaaaaagaaatatacgagaagactccgagagcagcagaaaactgctgagggtgatgtgggggactacaggtgtccccaggaccaaagcccggacagggtgggcacggagatggagcaggtttccaaaaatgagggttgccaggcaggtgctgagttggaggaattgtcaaagaaagcagggccggaggaggaagaggaggaggaggaggaggacgaagaaggggagaagaagaagagcaactttaagtgcagcatttgcgagaaggcgtttctgtatgagaagagcttcctgaagcacagcaagcaccgccacggcgtggccaccgaggtggtgtaccgctgcgacacctgcggccagaccttcgccaaccgctgcaacctgaagagccaccagcgccacgtgcacagcagcgagcgccatttcccatgcgagct

SEQ ID NO: 100287 - DNA, 1034 bp, Homo sapiens
tgatacattaaggtagtaggattatctcatttctgttttccaaagtctttatgatttattaattatgtgacagataaaacttaagttggctttattctgcttcagcacagtaaccctgaggtttagaatcttgtggaagatacagaagcatacagcactgaagtgttccaattcttctcagtttcttctttgcttgcattttttattcttacctgtaaacactggcttacaagcctcaagttcaaatgcatgtgagacagagatgacatgtctctgactcattagacaccacatctgtgtgattagacaccagttctgctcattctgaagtcataattcatgtcattgaatgaaaatctcatttaatgtcatgaaattagcatttaatgacatgcattatgactacagaatgagtagaattgtttaaagaaagcttgggattggggacaaggtcaggttataatgaaggattaagttagaattggtcctttgataatattaacatggtaagattttattaaagtcactatttttattttgatgtctgtgaaatcgggcacagctaataatttggtaagtctgatttgtgggattaaactacaaaaagtgagatatttaaaactcttgtcctacaattcaatcaagttgattggagttgctactctagaatagtgatatatatccattgtcaacttcccctttattctgataaagatccatagaagtgttcctttgaaaataatccagcagttcctccaaacagaagttgtgaaattattttcttgtttggaatgagtaaatttctaaaatgtgagccagctgaacaaacaatacctctttgattctagtcaaatggaatttttcttgcaatttccaaggatattttacaccaactttcagtaagtagcaagcatcttacatgaatatatattttatgatagtttttactggaaaatgtaacatgctgcctaccaaggcacttttgagttcacgtgggttttaacagtggagacctactgttccatgtgttttta

SEQ ID NO: 100288 - DNA, 1484 bp, Homo sapiens
ctcaacgccctccagcgccaccgccgcatccacacaggggagaggccattcatgtgcaatgcgtgcggacggacattcaccgacaagtccactcttcggcggcacacctcagtaagcagtgggttggcttatttgagaaacaagctgctgcccttagatgcacggaaagagaaatacctaccaccattctccaaggtggttagaggtcgagacaacaggtactttctccttgggttgtctctgcagtggaacgctcacggaatgaatgaagtggaacaccaagccccaaggcccagggaaagcaccatccacgatgactactctgtaacagtgagggtggtggcaggcgggtacttattagtgaaagttgaaaattgaagttgtagagggactattgttttaaaagatgcacttgtccagagacacattcagtgacctttgttttgtgtttaacttatagatacacgataagaatactccatggaagtctttccttgtcattgtagatggctcgcccaagaacgatgacggacacaagactgaacagcctgacgaagagtatgtgtcatccaagctttcggataaattgctgtcttttgcagaaaatggccatttccacaacctggctgcagtccaagacactgtacctaccatgcaggagaacagttctgctgacacagcctgcaaggcagatgactccgtggtgtcccaggacaccctcctggccaccaccatcagtgagcttagcgagctgaccccacagacagactcgatgcccacacagcttcactctttgagcaacatggaataagagcttcaagcagttcccatcctgttagtctgcgtgtgtggtagctgaactcaagatgatgtggggctaagaaaaataattgtccatgtgcaaagatgtgggcaagaatggcctctgcagattttcctgaacttctgctaacttgcacggctttatcacagcatttttaaagctttccctcaaaaatcctgatctgcatgatctcagctactttattgacaaaaaggcagtgaacataacctcacttaattctggtgtagggtgtatgtgctaatcgttctaattcttgattacctagtttatagataactgctggtcttaattgcagagtacagagaactgaaccagctcctgatattgtagttagcagtcttcctggcttctcactctgccttatatttccatgtgggtttacttctctcataactactttcaaggtatttttcttccaagctgaaataaaactggggccacatattttcagtcatttcttccctgttgaattgaagcaaatcagattttctgtggggaccctcaaatgcaactgaagaaatagattgttgcattcattcctccccaccccccatttgtaggcagtaaacaaagtatgactgacagattgaacacctgcaaaactgctagcgtaatctcagcacatacgcagctaggaagt

SEQ ID NO: 100289 - DNA, 1181 bp, Homo sapiens
ctctttaaaccaaacgtaataaacttggagctgtcactgtatgccagcatcataaacaccatcattttatgatagggaaaattttttggctcacttgtttagaaaattagtaaaatttattagcattattatttattagatttgtttcttcattttgttagtatgctacaatttagcatctttgaacattatacagaatgttgactttgcttaagggttgtttgaataggcatttcaaagtgcttttgcttttggctgcatggagagtagaatctattgaggtgattgttcttgtgatgtggtgccatgttccaaaattaatatatatgcatggtattaatgaggaatatgtttgcattcatattttagcagatacaatttatcagtgttggtgacaacctctatggttttattttctttataatacagtcttttgcctggatggagtcctcactttaaggttaagagtaactaagccaatgttactccagctacagttccctaaattatactatagctgctgggaacaaagccatgctgatgaatctggacttgtgcatgatttttgtttgcttctcattaacctgcccaccctccactccaaaattatacctcattaacgttctgataacagccaggaagacagcctcacctgaaccctctttgactgaatggatttttcattgtttttcttaaatgcctacgcttcagaggctatcaactgcttaaatgcagccatcgacatttacacagacatggtaagacattgcattgcttgagtggctgtggggtggagtcttgagatggcttagagttctatctttcttttttatgttcccaaactggcattcagataggtaaaatcggtgtgtgactgtttcttgttttttcccctagggaaggtttacaattgcagccaagcaccacattactattgcagagatctatgagactgaacttgtagacattgagaaggtaagcagtgggcacacttcctcagatgtgaagcaggcagataagctgactcaaagaactctcctctcctcagtctgagagtgatcgtaggtgtagagtggtcatagatggccttgcctggagactttctggcaaagtctactagctggctaagtagatgggctgttttcctggagtggacatctaagacatgagagctgattaag

SEQ ID NO: 100290 - DNA, 1051 bp, Homo sapiens
ctaaggaggctttgtatgtgcaccccgcgtcatctgttgcctggggtgatgctctagcctcctgacattgtcatactgctgcacttttccagtctgtttccatttatgtctgaggttgcaattttttgaattttggaaatcagaccttggcgatgaccttgagcagtaggataggatataaataactcccacgtgcctagcgttccagtgaaggaacactaggcataaatgtgttaatgaagtaacgtaacacaagttaagtaaggtcatatcattccaaataagagctgacgtctctgtagtggccctcaaagactatccccttccttgtgcacccagctcccacttcagagcctttgcatgtactgttccctctgtctccctactctttccccaaacagaatgttgctgggtccctgcttccttcagctccctcttcacatgtcaacttattggtgaggtcttctctggccaccccttttaaaaataacaatcttgtccttcctggaaacttttttttttttctttctccaacactgttatcaccatctagcaaaaataaattacataatgttttattcatttatatttacatgtttttattatatggtgattctcattagaaagtaaaccttggaaggccatgtttgtgtgtttttatctctgctgtatctccaggccctggattattacctgcaaagtcataggtgctcagtatatttgttgagtggatgaatattagactccttgaagttctatccatgttgcattggtgatgatcataacagcattgcatctctttatagttttaaaagttctttcataatgactaagctaatttgtttgatactcagcttttgagagatcatcctcacaggtattataccagttttgcgggtgaggaaatttagcctaagttgtgtggcttcccagagaccatttaatttaatatatgatcctttaaagacagttccaagttccccctccacctccgagaatggagtcttgctctgttgtccaggctagaatgcagtggtgcgatctcagctca

SEQ ID NO: 100291 - DNA, 1037 bp, Homo sapiens
ttgtggcctgtgtgctaggccctgtgctgcttcctcttccccagagcatcagtctagtggctaaggagatactgctggtaaataatgagaagaaggaggtaccatgctttgtggggatccccccaggctccccacactgggcaagtcccttttcagtcttttggggtggcttgacacaccccttcatggcatcctgatgttagagctgaattttgcctctggttctacatgcttatcttcatagtactgtcactgtcactttttgtggtatttctactctaatatcttgtgattttagaggcaactttatttctatctcaggagttgtcagcctttttctttgaggtacatctcatgatgtgtgtgtcattagttctcacaattctacgatgtctccttcctcccacccacagttttaaaatagtacggactatagttgtcatagttttacaatgctctgcaatagttattattcaggatgggggaaatcaagattttagattatttgaagatgaattggttttcacagctctgctgttcactggctcctggtgggacatttgtggctttgacaatgtttcctcaggggaacatggggaattgataggctttttctcagacccttctggccgtgaagcttgatattctttcctcagtgtcgtgacctccttgtgggcaagaagtttatttccttagtgttttctggcacatatggatctcagtaaatatttcctgaataagtacggtcaagaagaagagagtctgccttgcctctggaatgcaagggtggttcacctgggccagccaggtggcagtggtttttgtgctagctgggcagtgttttctttcacggtggggaaaatgttttcttcttccaagtcagattcctgtaatacaaaaaaatagttaatttagctcagtttagcttcttaatgtcaattgagtgctaagtgtttaacttatgttgctgcgtaatatggattccccacagaatattttttccaaggatcttctgcctcactgtgagacctctggat

SEQ ID NO: 100292 - DNA, 1145 bp, Homo sapiens
ataatatttcagtcatatggaattgttttcctgtgccttgtgattgttttagggaacgtattttaattcttgtttcttttttgttttggggcttttttggtatggctcatttttattttaatatttgttccttttttacaacttttattttagagtcagggggtacatatgcaggtttgttaactgggtatattgtgtgatactgaggtttagggtacagatgatcctgtcacccagatactgagcatagtacccaatagtttttcaactgtttctctccccataccccgctagtgtccccagtgtctacggttgccatttttatgcccatgggtatccagtgtttagctaccacttataagtgaaaacatgcggtatttggttttctgttcctgcattaattcacttaggatcttctttcttatgtagtagcttcatatggatgctgtttctcctttctgtttagtgtagagagtcacagagtttcttggacacacaatagcatgtgtttctgtgataggagatgagcggtttgtgtgacttcatgggtttcttagtttaaatgctgcgttgtgtaggtacagttaagtgcggtttctttaatgaatggtgctgtggaggggtaggtttgtgtgacttctaattctgtgatactcttttgtttcaagaacgtatttccatcacttgccttctttcctttcactgccaaacctccatagagctgcccccaccttctaagttgccttctcccagaagcagtgtcttctggaaactgcagcctgtggcaaagcccttctattcagttcccaactgcagtgctctaacctgccaggtcttccacctggtctggggtgtttgcccaccctggtagggcacttccttgctgagagttcttccctggacaatgattgccaggttaaactcccctctcctgtcgacagacgcccctctgactggcagcagaggcagtgttgctagctctggtagttttggattttttatttcctaaattatatttaatggaggcttgctgaatactgcctccttttgctgtaggcacggattatgggtggttgtgtatgctttttgttgatctataaggtttttggaggatgtgtggatatatttatctaagcagccaccat

SEQ ID NO: 100293 - DNA, 1067 bp, Homo sapiens
acagtgaaaccattggggcttttgatgggtatttctttgataactttcttgtttttgtctctggagtttgtaatgtttaaattttctatctctactgaggtcaattttggtaaattgtgttttcctaggaaataattcattttatctaagttttaaaaaatgtatttgcattgtgcatagtagtcttttctgacttttaaaaatgttctgttttagtaattttcttctgtcactttatttttgtgtttgtgtttttccccttttttccttgattctttttctctaaacaaccaatattttgattgatttgttctactggttttgtgttttctgtcttactgacttatacttttatctttattgctttctttggcttcttttgtttttccctctggttcatttttctagggaggtgtttattcactgttttcattgctttatttgtatggattaaaatattcatggctatacatttttttcttaaaactgcttcagttgtattttatagatcctgttacataatgtttttatcttagtttgtttcccctttgttgcaagaggcttttattgtaagggttttattccaggtagaaagaatggcctttctttgtatattattacttaaactttttttttttcattatgatcagagaacttactgagattttcgttgccacttaatatattgttggtgttcatgaatggtccaggtacactttacttaaaatttttttttcgacacggaatcttgctgtgtttcccaggatggtctcgaactcctggcctaagcaatcctcctgctttggcctcccaaagagtgctgggatcataggcatgagccacctgcacccagcacccatgtacactttatttttttggagacagagtctcacgctgttgcccaggctggagtacagtggtgcggctcactgcaacctccacctcccaggttcaagcgattctcctgcctcagcctccccagtagctaggaatacaggcacacgccaccacacctggctaatttttgtatatttagtagagacacggtttcaccgtgttggccaggc

SEQ ID NO: 100294 - DNA, 1030 bp, Homo sapiens
ccaaggacccaggatttcttgtgacgtctctgctcaggggagagccacactctccttgtcatctcctcaccaccccatgtgctatgacttggaatttccagttccctgggttcttccctctcgcccttcatagtgctggcctgagggctggaggtggaaggagctgggggcagtgagctgcctccccctgccctgtacccttagggctcccgaggccttgcacaggctgctcctcacagggctgtgctggggcaggaatcctgcaggctggggtgggggcccagtgccaccaggtagagttggagccctgggagagggatggagcagtcactgcccagtccagcggtgctctgggatcagcgggggtgggtggaggggtagataagggcccagtgtttcacctccatccttcttcactcccactctgatgtcccgtgcctgggcatcttctgctttgaactgtaacccacactgattgtcccctctgtttcctttcacagaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggctctgccctccctccttccttcttgcttctcatagccccggtgtgcggtgcatacacccccacctcctgcaataaaatagtagcatcggctccctctgagttcttggctgtctggggatgtgcacacaggcagggtttccgcagttcctttatgaagcctccttgtcctgctggtgtgaagatgagaggagtacctgggagctgacgcggccacagcaaggccatcaggcaagctgctgctataggagtcctgagtctcagagcagggagagcagcc

SEQ ID NO: 100295 - DNA, 1200 bp, Homo sapiens
gttttggggcggcactgtgcagggaaagcattcagttctcttctgaagttgcaaccctaagacatgcaggtgtgtgactcactttagaaatattgccttgaaaatcacacctggaatggaagcacgtgggaagcaatgtttattggcctaaaacatcaatgtatgtgagcatctcatctcctagtgagaaatgaggaaaaatacctctgggttaaatggcaggaatgagatgctctgtggactgaatgccaggaactggaagtttgccgaaatttcatcatcacatgagaaccttcctagaatagatccagtgtccctgccccctgggtcataggtagcggaattcagttaatccttggcattggcatagagaaacaagttaccggggaggcctggggcatggcatccctgccagctggcaggaggaggtggcttgtgtgccttgcaggtgacaatgtgggcagctcatgaaggtaggcttgaagccccaggcaagcccagtgacccggtcacagtgaagtgcctgtgtgtgtaagaaactgacagaacgtgctgtccctgcctcctgctctttcacatgtgtagatcgtagctggggtgaactacttcttggacgtggagctgggccgaaccacgtgtaccaagacccagcccaacttggacaactgccccttccatgaccagccacatctgaaaagggtatgtgccttatatgggtccagggccagtcatacactgcagaggggtgtgtgtgtgtgtgtgtgtgtgtgatgcacatgttctgcagggtacgtgtgcatgtgcctgagtgtgtgtacacgtggagatgcatatgtgtttccaagtataggtttgtgtggggaagtgcacgtgagtgtgtgcaagtgggtgtgtggatgtgttggggaagtgtgggggtttatgcatggataggtgtgggtgtgtgagtatatgtgtgtgcacatatgtgtgggggtgtctgtgcacatacattcacatacatgggggtttctgtgaacatacatgctgtattatgaggaattacctgccctgtgtgtgtgtgtgcatgtgggtagatagatgtatgagggagtatgtggattcatgcatagatccgtatgggtgaaggttagggtgagttcatgtagatgcctatgtgtgtgcatgtagacggggtggtgtggagaggagtgatgaatt

SEQ ID NO: 100296 - DNA, 1342 bp, Homo sapiens
gaaaggggaaagggacagaggagaaggagcctgaagagtggcggcatggaggggcccgaagtggggaggtgggaatggtcggatggatggggaggaatggggaggataggagaggcaggggaggctggaagacagtaggagaggagggggaggggaggggaggggatggatgggaatggatagggaaggccagggagactggggggccaggggaggaggggagggagaggggaggcgggaagggagaggagaggccgggaggggctgggaggggagggaaggggatggatggggaaggacagggaagcctggaggggcaggggaggctgggatgggaggagactgatagggagggacctggaggcggggagaggcaggggaggcggggagaggcaggggaggcggggagggagaagggaggtgggagggacgaggcgttccggaaaagggagtgcaggccgcggtggggtggggcggcgaaggccggaagggataaaaccgcagtcgccggcctcgcggggctcacggcctcgcctcggtatcgcagcgggtcctctctatctagctccagcctctcgcctgcgccccactccccgcgtcccgcgtcctagccgaccatggccgggcccctgcgcgccccgctgctcctgctggccatcctggccgtggccctggccgtgagccccgcggccggctccagtcccggcaagccgccgcgcctagtgggaggccccatggacgccagcgtggaggaggagggtgtgcggcgtgcactggactttgccgtcggcgagtacaacaaagccagcaacgacatgtaccacagccgcgcgctgcaggtggtgcgcgcccgcaagcaggtgcgtgccgccccccgcagggtccgaagccccggccccgccgtcccagcctccccccgcgctgctcccggaccccgtgctgctcctctccggcgcctgggcttctcacccggaccctgttcccggtcttcgctgtcacccccgagcccttggcgggcgtgtccgggaatgccctgagtctggcctggcctggaaccgcacggacacgtcaggtccgcgcccggcgcctaagatcagcttccaggagccagctcgagctgcgccgcagcgcgggggcaggcacaggacgtcccacacagctctgtcccgacctcctgggacgctgggctccgggtgcgctgctgaatacgcaggagaaggaaaaacagagcccctcatctggctgcctccttgttcttccaccaaataatttttaagcacttttgtttcttttaactttttattctcccgtaatttcagacttacagagcagctgcaaaata

SEQ ID NO: 100297 - DNA, 1049 bp, Homo sapiens
tggcgggcacctgtagtcccacctactcaggaggctgaggcaggagaatggcgtgaacctgggaagtggagcttgcagtgagccgagatcccgccactacactccagcctgggtgacagagcaagactccaactaaaaaaaaaacaaacaaacaaacaaaaaaaacaaaaaaaaactgtggatattaagtatcacacactttgttcacaatgggatcatcaaggctctgctggaagcctctcctaactgctctggacttggtaaggaccctgcagcctgcagcacagctgtcccactaaagtagcctggagcaaggagagtcatttgtccagctgcatctctgtccttctgccatctgccatggccctgctcctgtgggtcctcttgtgtaacattcattggtacacttgctaatctgaatgttctgggtgtaggtgtattagctgtaaatcggagccctagatatatttgaggacatcacagtctattttagaaccatagacatgaaatgtatctgttgactcaatatgtgcagaattctgtagcttccttccttgcctattgctagacctcgagtttctgatttgccacatacctttccaggaaaaacatgcgtcacactcttgggacacaaaaatgagtttgcatccctaatctcagcaacggttctctctgttgctcttcacatgcctacagggcaaagtggcacagggctgcttagtgagtgctggggtgaccaggtggccctaccgtctcaccattgatgttgggccatagcccgtcctcaaacacactgttttgttttttttttctttttttaccagagcagggccacatggacacctccctcctccctaagctttcctgcatcccattgattgtcttcagtcacctatctgtcccacccagagtctggcactgcagttaccagctagtctgttctgctacttcagccttgcccccggtgcacctgggactgtagcacccagactcatagacagtgggaacaaagggcttcctgatggtctctggatcagagagccaagctg

SEQ ID NO: 100298 - DNA, 1119 bp, Homo sapiens
tctcaaggagaaggaagatgcccagggtgtcatatttgtctgaggtcaggcctggtgggcagaggcggtcatcctctggactcactggcgtttaggaccccctcagcggggaagaggggggctcagagtggctcctacatatccaaaccccagatctgccccccttactcaacctagcagctaaattggggtggattttaggaatccacatggattgttcccttctggggtttttgtaaatggcactgcaacatttttaataaaatttaaattgcagagcagactgggtcctcattcttaggcaatcttaggtggcttccgcccatatttgctgtcttcatgtttactccactcgcccaggtcagctgtttatgctgtctggatgcctctcagtgttctccttaggagaccaagtcctggacatcagggcacagtggagctgggacttattttagaagatcagaaatccgaatatagaaagtgggatgctagactttccccttgcagcacttgaagcaaagttgcaaaaaatcctgacaatagagacatgccattaaaagagttgaagcattttcagttgtctcattctccctattctgccaaattctgtggtttggtagtagctagatgcagtcatgaaaacaacactgctaaggggaaatggtttctttgtaactggtccagaacataggtgccaggatggcaggaatcagagaggagtcacagcaaatgctgaacctccagtgccgaccccaagagtatgacttagctcccaccaactctcaagtcctggccccagtttatcctaagtgccttaatttggcaccgccaggtctggttcataaataatctccgggaggaatttccatgaatgtgaactcagctgcagctgagaacatacccattgcccaggtaagagtctgtctgtccagccatccatatccttagcaagttataagacaaggggcatgtggaataagatgaggtgaaacctctatctaactatgccacatgccaggtggcagcacacccacatacccaaaaagggaaagtgtgactgtgatgccacgtctgagttgtcaggaaaccactccaggtttaggagacagaaattccccc

SEQ ID NO: 100299 - DNA, 1044 bp, Homo sapiens
agaaacccctgatgcagacaccttagtgtgagtttacaacctgatgggttatgggcatgttttatttagccccttgagggatttagtgtacacacatgtgtgtatgtatgtatatgtgtgtgtgtatttcaattatttgtgattataaaataattctggagctccagtttctctgaactgtttttcttttctctgtctactggcttatattttatttctatcattagatgttacccttaaatttttaatatgcatttcttaatgtgcaaattctggagttaatattgtccatccttcttcctaacaatacaaggagtttagaatccccttgctttcttatgctattgttctgtatttcagttccttctaacttttgttccagtagaattaaccattgtgagtgtggttagttttgctgttgttttctatagtcaatgctcattaaatatcactcgtgttctttacttactttccaccttgcatctcatttttactttgtctgatcagttttctttttttctggagaatatgctttagtagccttaatgaatggctgttagtggttcattcagtttttgtacaaaggccttaagttttcatttgtgaatgatagtttaaataggtgtagaattctaggataaaatgttctctctcacaaatgctgaaattatttttgatttccttaacggtttctaacatagtttggatgtatgtccccagtccaaatctcatgctgaaatgtaatccccaatgttggaggtagggccttgtgggaggtgattggattatgggggtggtttcttcatgaacggtttagcgctgaccccttagtgctgctctcaccataatgagtgagttctcctgagatctggtggtttaaaggtgtgtgccacctccccgctcactcttgttcctgctttggccaggtgacctgcctgctcctcttttccttccaccatgattggaagcttcctgagtcctccccagaagctgagcaaatgccagcaccatgcttcctgtacaggctgcaaaaccatgagccaa

SEQ ID NO: 100300 - DNA, 1057 bp, Homo sapiens
tctttataaattacctagtatttctttatagcaatgctagaacagcctaatgcactttctgttgctgttgttgagaaacctactcttggtttgctttttttcctataggaatttgaaattattttctctgggctgggcgcagtgactcacgcctgtaatcccagcagtttgggaggccaaggcgggcagatcacctgaggtcaggagttcaagaccagcctggccaatatggggaaaccccatctgtacttaaaaaaaaaaaaaaagttaggcatggtggtgggcgcctgtaatcccaactactagggaggctgaggcaggagaatctcttgaacccgggaggcagaggttgcagtgagccgagattgcgccattgcactctggtctgggtgacaagagtgaaacttgatctcaaaaaaaaaaaaaaaagaaaagaaatatttttctctgtttgagatcatatttttgtcttttgtattgtatagttactacatttagtgtgggatagctttaatttaccttgtattatgtatgtctgaatctgtaaattcacatcttttattagttctgagaaattctcagatatcttcagatattgcctcttccccattctcaatgttctctcagtctagaattcccaatctattcatctggattttctattagtagattgggagaccttctcatttttatcttcctaccttttaatatgtctttcataatttccatattatgctgaattctaggtagtatcatcagttccatattccagttcaagtccctcatcagatatttcaagtttgcttattaactcatccatcgtgtcttaaattcagtagttatttttatttcaggaaattccaatttgccttgtctcttttaataatgtatttttccctgtgtggatttggtttctccttgtgtgctagaatatcttaaaagagacttactttatctatcacttgaaattcttggaaagatgctttccctgctgactgaggctcagggcaggccatttcttggtaaattttaaaattttgaatgtcaacctttctcc

SEQ ID NO: 100301 - DNA, 1057 bp, Homo sapiens
tggtgatgtaatggtggttgtggatttctggtagtgatggtggtggtggtggtggtggtatggaagggatgatggctaggaatcagtaaaatttttctgtaaagagtcagataatattttaggcttcatggacaatatggtctctgtcacaactgctcaactcttcccttgtcatgaagaagaagccatagacatatgtgcatgaatggttgtgggtgtagtccaataaaactttatttatggacactgacatttgaatttcacataatttttgtgtgtcatagaatattcctattttcttcaactacttaaaaatgtgaaaaccattcttagcttgtgggctgtacaaacgcaggtgttagatgtatttgttctgtggccttgattttccaaatcctggcagtagtgtcagcagtggggatgatggtggtaatggtgatggtactcctattgacagtttcagtggtggggacggtgatagtggtactcctgctgatggtgtcagtggtggggatggtgacggtggtactccttctgacagtgtcagtggtggggatgatggtggtgatggtggtgagggtgatggtagtactcctggtgatggtatcaatggtggggataatgatggtgatggtgtcagtgttgggaataatgatggtgatggtggtggtgatggtgtcagtggtggggataatgatggtgatggtcgtggtgatggtggtaatggtgagggtggtggagttggtaatggtggacatggcagtgtcacaggggaagaagcttcctccctccacattatccttaaaaatgaagtggagacttacaaagctaaagggagttggcacaacttttaaaagcagcaatggtctgaatctgcaggttttcttgtttccaaaatcacatcatatctgctatatatgtctgactgcttataaatcagatttggagttcctgtggattgtgacccagtggtgctgtgctatgacaaagcatcactcaccagcagaagtttgggttggctttgtgaacaggaagtcccaggccaccaaaaatgata

SEQ ID NO: 100302 - DNA, 1016 bp, Homo sapiens
tatttctaataactcataattggaaaagcaaatgctcttcatttttggatgaatggattaaacacatcgtgttacttattatggactattactcaggaaaaaaaatgaatgaactatggatacacccagcaacctggatctcgagggtattgtgccagtggaaatggtcagcctcaaaaggttgatatactgtatgtttccattcctatgcctgctcgaaaagacgaaactgtaacaaccaacagcagtgcagtgattgcaaggggttaaggatggggaaaggtgggatatgaaaaggaaaaatgagggagttctttggaggtgatgaagcatttctgtatcttggcatacatctatacatgcaacaaaatccatagaactacacactgcaaacacacacacgcacaagaatgaggcacagatacactggtgaaatccgattaaggtctgtggtttagtcagaagtgttataccaatgtcattttctggattttgatcattgcattatggttatgtaagaggcaagcaagggtatatgggaactctctgttctatctttgcagttcctacaggaactctgttctatttttgaaaattttatgtaagtccaaaattatttcaaagtgcatatatatatatacacacacacaatatttcaaagtgtatatatataacttatacatatatacacagatatacatttatattatatgaagtcatgtttaatgaatttgaatattctttctgtagtcttcaaactgtaactaaaaatatcacttaaatacatgcttttctttcaacaaagcagaacattttagaacagtgaagaaaaaaaggaagttagtgattattaaaaatagctaatgtccaattacctagaacaccccagcccatcccttgataaataaccagaggtttactataatttggttttacacagaggcaaccttttgaaattgacccattgacagtttttttgaagaaacagacattgacccttctgatcttaaagcctg

SEQ ID NO: 100303 - DNA, 1142 bp, Homo sapiens
cgtgtctcagcctcctgagtagctgggattacaggtgcccgccaccacgcctggctaatttttgtattcttagtaaagacggagtttcaccatgttggccaggctggtcttgaactcctgacctcaggctatctgcctgccttggcctcccaaagtgctgggattacaggtatgagccaccatgcccagcccatgtcttcatctttccttactgcacttgcaaagccacattgcatctgaatggcactcttatcttgtatcaacggaaaaatttccaacatttcactgttaagtaggctctttaggtaactcatttttaaatcattaatggctgttggatttaccgaaagctttttgtgcaaatggaaaacaattatatgaatattttcctttaatctactaatataaattacattgactggtttgaaatgttaaaccaaccttgcattcctagaataaaccctaattgatcataatttgtatatgttgctgaatttgtgtgctcttttgcttaacatttttgtgtttctgtttacgagagagattgatgtatattatcctttgtggtaatttcttcattaagttttgatatcaatgttactctggttgtgaagagttccctttttctgttctctgaacatttatttaaaactgacctatttttcaaatctttgatagcagtcattggtggagctctttgagcctggacttctcatcataggaagattttaaattagtgatttcctttctttaatatcgatatctctgattaggctttctgttgtttctcatatcggttatggcaagttatatttttctaggattttgtcagtttcatcaaaataatcaattttaataatatttttaaaatatgaatttgggcctttaagaactaaagagaagattatcttttctggggatggatggatagacagacagaaagaaatacttcaaaatgacaatgttattgttttacattgttgatatttatctgtagaaatccctagattccactactttgctcctcatttcttcctaaattttttaatcttccagcttgaatgatacccttctgcctaaagaacatcctttagaatttcctttagagtggcttttcttgtggtaaacactctctgttttat

SEQ ID NO: 100304 - DNA, 1166 bp, Homo sapiens
caataatttcattacagtaatgttttccctaaaaatggacatatcaattgttttcaacttctccttttgcaaatataggatatccacaagtgaaattccaccaagtcaaaggttattcacatgtaaatttagctacatactgtaacttctcctccagaagtccgtaccagttttcattcctattaacaaaatgtgaatgcctgtctttcccacctgagctcagtgttccattttcaacaatctgatagataaaataaaagatattgtcagtttcagtttgtgtttcattggttactataaagctgaacatctttatgtgtgttattttttttcctgcttttatttcccgtataaatttctagttctacatttaccattttgtattgggtgttcacattttattaatttgtagaccttatttttctgacacagtttttagtctgctgttcatgagctttactgcaaacatgtcctcctgccagacttggctgtcagtggtgcctcttgctgtagaaaggagtcctggagtatcttcagtggttgctggagggaagcttccagggcactacagtccagttctttacagctgctgagcattggttgtgcggtgtctcacagtgactcagcagaagacagagcctgcactagtgtctcccaggcatcatcggatcctgcagctcccacacggcagccccaggagcagcctggcagtgtgactcagcagctttccttgcctgttctgagggggcgcagctggggacagcacgggcttctgcccactcctcaccctgccagcgggaagcctccaagacttgggaaggaaaggcagtgaagacctcacttgtctcctgctgggccgtgggcccaggtgctggcttcacggtggtgactcatgaacacacgaagaattgggtgtgcagaggaggagaaaccatgcagtgaagagccccatcgtcctgtcacaaaatccactgctaactttttatttctacacctatctcctcatgcttcacagaacctctgaccaaagcagcttcctcttatcattcacagattttataactttctgcctttccgaacgcgctcttcattcctggtcatcttgcataatttcccgcccgtgattctaaagaagagaacctattgctatgataaaagctcactgc

SEQ ID NO: 100305 - DNA, 1104 bp, Homo sapiens
tgcttgttacagtggagtgcaggaagagggctctgtgtgacctcagaagccaggaatcattgaggccttgttgcttctgcctcactcactgggacacttgctcttggagtcctgagctgcaatgtaagaaatcttcctccctgagacctccatgctgtggggaagcccaagtcacatggaaaggccacttgtaggtgttctggtcaacaggcttagtctcttagttatctcagcccaggaaccagctatctgagagaagttacattggacctccagaacagcccattctccagctgagtgctccctgaattcttgactccagaattcataagcacccagtggtggttgtcttaagccactggggtacttagccacagaacaatagatcaccagaacactcactactgtgtcctaggtactgttctgaagactggtgtatattaacaccctagtactttcaaagaccccatgacacagtaactcattatcttcagcttacagatgaggaaattgaagcacagagaaggaaacttgtagaaagtcacactacagtgaagcaatgggtttgaaaccggtcagtctgaccctggaaaaatgctcttacattagcaaaaatgcttgagaggcagtttgggaaggaactgttagagaaattaaagttaccaagcgtgcctcctgggatccatctgcagccaaatgaatgatgtggcggtgcactgctctctcctggtggtgaagtgagcctcctgttggaatgaggaagccaaactgtccttaaggatcttgccacattccaggcaaaacacccatgttaattacttttttcataattatttcaatgggaagcatctgcacccagttgggcctagataatctgagtaggaacacagctcgtttacccacaactcgagatgagcagaccaaatagctggttttccaaccattagacgagagcccacgctgccggataggatgctgatggctgcattggtgccacagctgtggctgtggctctcactgaaacagctcagcaaggaaaactggcacagggctccagagaaaagagggagagaggacaacggagagtgaaagagggaagtgagg

SEQ ID NO: 100306 - DNA, 1119 bp, Homo sapiens
agcaaatgtgattctcaagcagacacaccagcttgagcatgagagctctggtgcgtctatatgcagaacctgcagagttgggccagaactgaggtcaagagtcagccccgtgccactgccttcctcctcaacaccaccagagagactggaactgtgccccagttagagaagtatcgcattcctcctgtccccccagagcccagcccaggccccagggagaccacaacacacaagagagacatgggctctgccttggggagcttacaagtgagcaggaaggcaactattccgcaagtgggtactcagatgtgtgagccctcatgagctcgggaagcccggcatgggtgttcccacaggggtcagggaatgaatgctgctggcaggtgcccagtcagctgtagcagctccaccttcctctctgcacccctttgcatagccctggggatggcactaaggctggtgatcatggcggggacacaaagccatgaccctaatgagcaatgactctttcagttagcgctaaggaaaggcaattacaggaaattgtgttcgaagatgtgggcgtgtgtgggagcactgctgcatgaaacagacttggctcaccacgacttcattcattcattcatttattcattcattgtcctaggaggcttcccattttgcatccctttatctctgctccctccagaattgtccatagtgagctctgaagctcagttccaagacaaaaagttggggaggaaaaaaataaaaactagcttttaagatccgaaagttagaggagcgagaaggaagccaagcagcggcaggcatcccttccccacacgacacagacttccagagctcagagaccatggaagatgcaggttcacgtcatgagccatctctgagtgtgagcctttctggtccactgcagaggtgttggtgtgttttagctggtgtgtttgagtgaatgacatgccgactcccatactcacctataaaacctagtaatgtcactgaccttaggtggaaatgggacccggtagaaatctggctttctggagacggccatgagaacgagctaggacattctgccagggtagtcctgaccacagggggcccgcgggtggcttggga

SEQ ID NO: 100307 - DNA, 1048 bp, Homo sapiens
ggagccctctgcccgtggaggggtggtcctcatggaggagctcttctcctgcccctatttttcattttgaaaaatttcaaacctacagaaaacttgaaagaacgatttaagaaaatgtgcttttcacctctgtaattgctaaatgttgctgtgttcccgttctcttgctctctctgcagagatatgctatatatgatatacatatgatacatatcatatgtatgtatatgatacatatataatttctggattgtttgaaagcttttcttactctaaccctctccactcgcaccccaggacgctcttccagagctgtgtctccgcctctgggacgggaggatgtcatctgaggagctcctggcacaggctctacctcctgttctcccggatcctcagtcgtgcgggagtctgggaggcctggcttcctcaggggtgaggtttggggcgctgcgttagagacgtggtgacggtgtttttcacagtcctgggagggagtgggctggggaagagagggcacatctgagagaagggcctgctgctttacctgcttcaaggtgtggttggtttggaagtcacagtcatccagacgcaggtgctggtttttcttgcaggtagttctgccaatttccacctccagcatatatttcaggcctttcactatctggagggagcaaagggactgggttactgggcacaggggagggagggcaggcttctccactaggaagcagggcctcaagacagtggtgcaggtgcccaccgaggagaagggaagtgggccagcatcttggggcaatgcttcgggcttacggcagagcctgcagacccctcccactcccctccctgccccgtgctgggtttgtgccccttcctgagacagatgtctcctttctggccagagctctgcactcaggagggacgtcacactaggtctcctgcatgccctgctgggcccgccctgcagccctcactccagccccatgatggctgtttcttgtggcctctgtgtcaggcctggggtctgcgggcttcccctctccattcctgg

SEQ ID NO: 100308 - DNA, 2317 bp, Homo sapiens
ctgtctgcttgaacatttccagtgactgggagacattattcgttggacacttgtttgggtattttcccttgtattaaaagctagaaatctgtctgttaatttccattccttggtcttaggcagtggagtgctttgtcataatttccgaccaggtgtccttctgctctgccagaaatcacgcctctcgccatctgttctctgcttaatactcttcaacagtcccgtgtgaccacagagtccaggtctaagctcttttgcctccgtccctgtaggcgtccctcaggatctgcacgccccgctttgaggaaagcagtgggattttgctttttgttttggaagccatgttgtgtggtctgtggacctgcttgctttttttgaatgtgagctgctctcaaatctccatcatttgcaccttgcctatttgaaatgttttaaatctaaacagaagacttgtgtattccagggaagctgcgctggttgtgatctggtgagtggaggtcattctgagccttggctgcagtgctgtgaccacgtcggatgtgatatgtctctctcagttcagccaggccatccagagatgtgcttgcgttgctgtccttgtgctggggagcctctttggcctgatcttcacagggacaggggtggggtggggcctgctttggggcccctgggctgggagtgggagctggattagctgtcctgtggggcactgccctgtggggctgccctgtcatgggaaggagtcagaccgttcctggatggtgggggcggcacggttgatctgcgcacagtgttcttggccagctggtgaactttccctgcactgtgcttccctctagctctttagtcaagagacggtgatgaagtttgtgccgcggtacagcctcgtcctagaactcagcgacagcggtgccttccggagaagcctgcatgatcccgatgggctggtggccacctacatcagcgaggtgcacgaacacgatgggcacctgtacctgggctctttcaggtcccccttcctctgcagactcagcctccaggctgtttagccctcccagatagctgcccctgccacgcaggccaggagtcttcacactcaggcaccaggcctggtccaggaggagctgtggacacagtcgtggttcaagtgtccacatgcacctgttagtccctgagaggtggtgggaatggctgcttcattcctcgaggatgcccgggccccacctgggcttgtctttctgtttagagggaagtgtaacatatctgccatgaggaacataaattcatgtaaagccattttctcttaaacaaaacaaaactttctaagtacagtcattctctaggatttgggaagctccttgcacttggaacagggctcaggtgggtggagcagtaaggcactacccagagagcttgctgctgcggccctgtcctgcggcctcaaagttcttctttactatatataacgtgcggtcatacctttcttcgttgtggtggggatggaagagcagagggagcatggcccaggggtgttgaggccagcggtgagagccgtgttagccaagacatggaactgtgttctcaagggttatgtggggcgtgggctctccatagtgtgtatgaaaagcttgttgactctagcggctcagagaggactttgctgggtttctttctgtgaatatctccgtgctgaccatgctggaattggatgattctgcaattcgggacctactgcaggggtccgtttagtaacgtcttgtctgtgatctttgttcttgacctctagaccccaagatgtgaacagtgcacgtgttaatgtcatctttgctcatgtgttataagccccaagttgctgtatattttcacaagtatgtctacacactggtcatgattttgataataaataacgataaatcgacttctgctgattaaccttttttgatggtgtggcctgggagtttcttctctactttaattaacagtactgaaatttaattccatcaggtgtcaatgtaaggattgtcttggtgaggatgatgttttaaggccaaacagtccatccgactagctcaggagggaagctgtgggacttctctcaggcagccgtcttcaggcaaggagcaggcgaccttagaccatctgctcttgatgccgactccctctggcgtaagttgatattacacttccctcctgttttccagcctacgaaatggggctgacatctgttcctttctttcctgggtatttgtgagagtaacaagagattgtgtctccaaagatgtttggaataacttcacagacagtattttaaatagat

SEQ ID NO: 100309 - DNA, 1912 bp, Homo sapiens
attattgagaagttcctagttcaagtcaatctttttctttctttttaaacttcaggtgaagtgaaactgctgctgtcctccgagacacccattgaggggaagaacatgtcctttgtgaatgatcttacagtcactcaggatgggaggaagatttatttcaccgattctagcagcaaatggcaaagacgagactacctgcttctggtgatggagggcacagatgacgggcggtgaggccttgctccaggtctcccatttgttgagttcaccagccaggccagttgcttcagcagagcctgttacttctagggaccaagggagtatttccagcatcatatttcagcttctaggacaggaccttagtggcttctggaggcaggtgatggatgtcacaaaatggaacaaggtgctttcgttttctctgaggaaataaaacaggccagtccgtctgagggtgcaagtctaggcagtcgagagagaccccggagccaggcctgggctttgggttgcctctctgaggggtattcctgtccagctcccaggtgagcaagataactgaccttggggttccctggaggggacactggatctgctgtggatggggaagggcccccaggggccagcctcgaatcaagtttgagcagggcacccagggcctgttgctccggggtgaggcggagtcaccttcttcaggcccataccctgaaggcccagagtgggagccagggattctcccccataaccctctgcttttggtgttccacagcctgctggagtatgatactgtgaccagggaagtaaaagttttattggaccagctgcggttcccgaatggagtccagctgtctcctgcagaagactttgtcctggtggcagaaacaaccatggccaggatacgaaggtgtgtgtgggattagctgagccatcagttactggccagagcgcatcatggccggggtggggtgggcatggaaatgggatcgacagaaatcagaggcagcagcgcaccttctgcatggcatgttaaagaaaattcaagggtgcgctttctttctcccattgcgagtcgcagtccggaagagtgtcttaaggctgactggtgcagcccgggccccattcccctgctggcagggccttggtcctcccctgacctacttcccctctgttcatactgggccctgtgcacaaaggtttcttctcagcagctgagcctttgttcatgatggtcatagagcactttccatatatatatttggaccaagaccagtttggtgcttggctaaaattttttttctgaaattgaggggctatggttcactctctgcttgggtgaatttttcagagtctacgtttctggcctgatgaagggcggggctgatctgtttgtggagaacatgcctggatttccagacaacatccggcccagcagctctggggggtactgggtgggcatgtcgaccatccgccctaaccctgggttttccatgctggatttcttatctgagagaccctggattaaaaggatgatttttaaggtaactgtgaaaactgttattccaagaaagaaaatggaaatgaattgaatcatatttttttgacccttatagcttaaaaatctagttctgcttgtagtatttggctctgaatgacacttagaaacacatttcattcttcatcctgaaatgcagatttaaacatttggaccctttggttcttatggttttcctttttctgggtgtttttattgtcaccctcaccatcgtggctttgggcatctgcctgcctgtcagtctctggttccctgtttctgggtgttttgattgccaccctcaccatcgtggctctgggcatctgcgtgcctgtcagtcttgctcctccatctgccatggctttgccaggccttctgtgctct

SEQ ID NO: 100310 - DNA, 1029 bp, Homo sapiens
agggaggaggtcccacgagatgctggggtcctgcctcgttatccggcgaagagatggcttctacacttgctcttctgcacctgcccccctcacgctgcgtgaccagtcctcaccgcggttcttggaaagagtggagaacagtagtgacattgtaggcaatttttgtgagaattcagcctggcagtttttcctgatagggatggagaaacataggaaactgtagttgttgacacctaagaaatatcaggttttgccctttgcctcctctcccatctttcagaatataagaatgctgtgttttgttagctaaaaactgaatcatgattcgtaagcatagatttcaatataagatacttaaaattcacttttcaattctgtgtcctgaatttcataacttttaagtttcagggagaatcaagaggccccatagaccaagcttgaagttgtgggactgattgacttatatttgatagaaatactggaaatatttgttcatcagtagtgtgccaagaggtggtggggtacatatgaatgagaggcagtttttgcccctgtagactgagtttattgactgatgataagaggaacacatttgaaggagagcgatggcaggaaggagcatttaggctctagagaggcaatttagagagaagactttgcggtgatagttgactccttgggccagtgaaaagatcgggaagatgctcccatatatcctgaccaaccatcctgcgttgccctggactggggtttccaaggatgtagaactttcagtgctaaacctgggcaaactgggacaatctgatcaccctacttactgtgaatattgtgaattaatcatctgttgatgattgaggagccatttagaatggacatgcaagaattggcaacactttcctacagaaatcttgaaaacaaggcatttttacctgagaaatggaagagcagtggcctgagtttgtcattaggtgcagtgtgttgaaaaccagggcctacagcccctgagggcaccggttaggtagtcccaac

SEQ ID NO: 100311 - DNA, 1089 bp, Homo sapiens
tcttcagggaagctattagaaactcaggtgacttgttagagcactaacttggtcagagccaaatcctggcaaacgctgcctgaccttcactctgtggttggggcggtgagaaccactgaggtccaatgatgagacttggaggtctggatccagtctctctttgttttaatgtgacttaggtgctgtcaacattagcaagataatggaaatcacgacgccagtgggtgcttacctccctgctaggcatgcaggggctggcggttggcaggggaaggaggcccagtgagccgggtcccttaggggagggagagtttgtcctctttgccccacagtctacccttcagggccttgtggcagtgccagtgttcggggggtgtctgggccactgagtacccactcggtcgtggttgtgctggcctcttgggtgagtgaacctgtgaagcccaggaggtggtgttggctgcagggtacacaaatactgagtggtggtcttttgttacaggcttagcaacaaagctgtgccctgggcatggggggctgtagtgtagctacagttgtgcgtttgtgaaatggcttagctttccatgttgctgagaggaacctggacatggtcccgggcatctgaatgatctgtaggggagggagttcaaataaagctttattttgttcattttctctttgtggtgatttttttgggtccagtaatgctactctttttttttcctgaatataatcctacagacaaaattggaaggggccttttctcctggggggttcacactcacagccctgactgctccttggtgagctcacctgccttaccaaggatggctgactgcgctgatgcatcagccacacgtggccacttaactgtaacttaaacagaatagaaatttggttcccagtctgcagttgctgcatttcaagtgcccagaggccatgcacagcaggtcagataggcgcactaccaccatcacttggaggccgcaggcggcactgggctagagcacaggcaagagcgagggacaacctggctctgagtagcgtgcatgaggagcatggcctggtccctgggtcatccctccgcta

SEQ ID NO: 100312 - DNA, 1029 bp, Homo sapiens
ctggcctggcgtgacctggacacacactgaccccatgccagggcactgctgggcagactggcttctcctgccctgcccagtggcttggggtcaggcttgccctcccgctgggaggccaccctgtgtcacagtgtgtcccagatgtcaccttcctccctgcacttctatgtgccgttattccattatttacttaaatgctctctttaaattgacgcattgcaagattgagaatttgtttcagtgctttacaaacagcattttcagttgccatggaaaggctatgctggtaaggctgggatgtgggagagagctggtagggacccctgcccggtgacatgtccagatgtgatcaggagggtcagagaggacggagacgaggacagtttctcaggtgtgactagggtaacttagtgcccccctgaggttacctcgctctggcaggagcctgggcccctcctctgaggactcctgcatttcacatctctgggctgggggtccacagggcactgacgtgtcctgggatttgaaagccccatctatgtctgagtccagtggctgagccagtactccctggggccactgagaggggtccgggcatggtccactgtgtctggggattcagcagcccctggattgaactccataaagcaagtgcaagatcaaggaaaggacaatggaagtgacctttagacaaacgtttgggcatcacaatcactgtctttcatagggtggcctagccttaggtctgttggggtggtgttggggcatggtctgctgtggacgctgctgcccagggcacgttctgcgtgtgtggagctattgcaagtctggtgttgccaggcttcttaatgtctgccagatgtgtggggataatttgtctatcatgtgtatgatgatgtgcattttcctgatttctaatgaatttgagtatccattctataattatgaagagctgatgaacagctcttggttggctctaaagctgcctgtgaatatcgtatatttgtccccactctctctgttttgcag

SEQ ID NO: 100313 - DNA, 2338 bp, Homo sapiens
agagtgtgtgtagccacggctcttggtgccagatgcaggggtggctgcatctgggcaggtctagggtatctctctgacccccggatggtgctgtgtgtgctggaaaattctcagggaaccctcatggccatgacatctccagggctcttaggaggagaaagggtgggcctgttgtgcaaaagtgctttcagatttatttaggtaggactctcccagaggggacattgaggccagagtctgtcttggaagtgtggtagggcagtggtggctctggacgggaatgtggcacacatgcctcaaatggctccatgcaaagggtagggagttgcaggatttgtaccccaattatggagagccattggtcgagggttccccagcacttctgcccatagctctgcaagaggcctttggtgcagaatgactgaaaggcccaagggatgtgggtgaggccctgccagtcagggtcacagctgggcatttgtcccaggctcttcctgaggggctgtgtagtaaccccccgcagctgtgatccctctgggtcatcccgcactggggcacagcgtggaggacacctccttttcctggggtcttgaggcccactgtgcgtgcacccctcttctctgctctgggcctacccctaggttagccatggaagctagggtcctcctggcttccccctgggcctggctgagcaacattggtcattgaagagcaggtgtgggatcaggagggccttctcctgaaggtaaggtgggcaggcagctcccagtcatccactggggtgtggtttctgatctctggacagtgaaggctcttggcccacacaagtcactctagacagggcctggccacatgggacacctttgggcttggcctctggttgtccagctttcttgttctctgcctctcggtatttctctgtcaccttgattgctgcaggtggcatgatggcctctttcctggggtttgctcctgggcagacaggagagaaaggtggaagtctggttgggaaattgtctttatgctgctgactcaaggaggaagagctgagcttcaaagtaatttatctctggttccttcccctcagcctcagaactggacaaaggcctggtgcttcttcatggcacacaaaggctggagagcaggcagcccctcactttttccattgagtcttttactcaagattggactgagtttctcacactcctaggcctggatgtcctatgtgagtcagagctatgagggttaaagtcgggaggagactgatcagaaatgtctgtgttgtctctgttagccaagtgcaaggtggttatcaccttcaaccaaggactccggggtgggcgcgtggtggagctgaagaaaatagtggatgaggctgtgaagcactgccccaccgtgcagcatgtcctggtggctcacaggacagacaacaaggtccacatgggggatctggacgtcccgctggagcaggtgggttacctcgctttgcacagtttgaggcgaggtcatatcaagttagctggctctgaggcttctcgggttgtggttctcaatttgggttccctagaggtgcccagggttcctctgtggtatttggtgagcttgagtcctgactgggaagataaaactcctatacgacaagcatgttggaacacttactgtaacacaaatgcttgcacccacgcttttgttttgtgtcctttccacatttggaattgaacttggacaggtcagagcaggtgaattctgaatcctgtgtgtggagtcctgctgcggagggggagtgctgctctcagagaggctgagtgccctcggtgggctgtttgtttcttctccctgccaggaaatggccaaggaggaccctgtttgcgccccagagagcatgggcagtgaggacatgctcttcatgctgtacacctcagggagcaccggaatgcccaagggcatcgtccatacccaggcaggctacctgctctatgccgccctgactcacaaggtacaggcctgtgcgggcggtgctgggcccttggcagggatccaggcaggggcagggctggaagtcctcctgctgcagagcgaggcctgtaggtgtgagaggtcagtgtttcttcctggcctattcggggcagggccccctcgagtcctcccaccctacagctcctcagggccctggctgcctcaagcccccactgcactgtctggaaactcccagataatctgatcatgtaacgcggcagcaggacactaagggccattcgcccaaagatttttaaaaactctttttagaacagatagagaaaaccacccaaattaaatgcatggcttaatgaattattat

SEQ ID NO: 100314 - DNA, 1034 bp, Homo sapiens
ccccaggagccctcaggcccatcacagctccaccagcctcggccagggctcctttgctgacccgtctcccccaccagccagactcacagcctatacagcacgcatttcttatctctagtccctggttgcagatgccgtgtggcccataggccagcagcattcttctgccctggatcctcgggccccactggacaactgagcggccccccaggtggcccctgcacactggagtgtgcttggctctgaagacccaagctgctgcagctgcccctcgccacggtgggcccagctccatctgcctgcgaacaaagccccttctgagaaggaacttgaggctgctgcccctggagtagttcttcagtaaaagatgaaaaccctctgttgggggtcgggggctaaggagctaactggacacctggaggtccggcagggagggcccagccatggcactccccgaagggccagtttctctccatcagtctctcaggtgtgcctggaccctggggcaggcaggttgtgtgccacgccccctcggctggacgctgcccgtgggagcactgagtgtgtgctaagtagcggttcggtctgtgagcggggctggagccctgtggagacgtgtggttaaacataaaccatgtgagaattctcaggaccacagccagcctgtggaagctaaggacagcttcaggtccatgacactgaaatggccctggcaaagtacttattactctgtctctaaaaataaacaggggccggtcgcagtggctcatgccggtaatcccagcactttgggatggtgaggatcacttgaggacggtgggtggatcgcttgaggtcaggagtttgagaccaacctggccaacatggtgaaaccccgtctctactaaaaatacaaaaattagttgggtgtggtgatgtgcgcctgtagtcccagctacttgggaggctgaagcaggagaactgcttgaaactgggaggtggatgttgcagtgagccaagattgtgccactgcactccatcctgggtgacagagt

SEQ ID NO: 100315 - DNA, 1039 bp, Homo sapiens
attgctttttgtccccctccccttgccttggagagagtggctggctagtgtgtgtgtcgtctgcctcctgaaggttcgggtaaaggaccagggaggtgggcagccctttgtgtcaggagatctggaagcgcctcccctcccaccgcctcctgtgtaaaggaaacagcaggtggtgttgacgggcggttcacgcaccggtttttgccaaggagagaaaaacctactgaaacccaccaggaggatgagtggaagtttctaatgtgcttcattttttgatacagcgtgcatggcaggcatttgcattcatgacccttccgtgtacttgaactgaaaacctgaagaaactggccaacagattaggcagccatcaatccacatcagatggcccctgtatttccaagaggtgacctgccatccccatctagaaagccaaccaggggacagggtagctcctaccaccaacaacactgctctaccctcagattctcttctctgactcctgcctccacctgctggagggtggcctcagcaggagccacacctctctgtttgcctgtgtgcaccctacttcctacccctgccttccctcagtccccacccgctaccttccttacagcctcatcccaccctgtctctcctttaaagaacagactgagatggcattgttttcctcaaagagtctgtcagggagaacctgatcaacacattcacgctgtggtgttagtggttcccacagaaaccccatttcctctccggcaggtgtctcagccatgggcaaacaccttaacctagtggaatgaaattgctgtttagatctgggacacaggtacatggagatgacctgttccttggggagaggggatggtgaacatgattataagaactcttcttcccacccttgtgcaagagcaaggctgttcctggttctgtgctctctcagtactgtgttctagttggactcttgcttttgtcttcctgaacttggtgtgtaacttcagtaattatgtctatgtaaggtatgtctatgtatgtgagtgtt

SEQ ID NO: 100316 - DNA, 1042 bp, Homo sapiens
ggaaggaattgggaaccgggctgccgcattcatcaggtggtgccatgctggggaggcctggggcaggggtgagtgaaacacctcagagttcctgacatcctgaatgtggctgcttctgggctgggcattctcttggttgctgtagatcgttgcctgttttgcagagctcctatgcaatattttaaccagtctctagttgtttttagtgtttctctgtgggggaacaagggcctttgagcttcctcttttgccgtcttgctgtgtcctctccctgtttatggattttctacaggactctgttgtgtgtctggtgacgttatagaaggtgcgggggtagaggagcagcctcttccattctagagaagggcttggatgccatgctgggcagcagcagcacaagacaagctgagtccctgccctgggggctcatggcctagtggggagacacagacctacaggaatcaggtctatgaatactggtttcatcactgctggtggtgggtaaagggagctcagagagtgcgtgatggggcatgtgcaggttgggggcatccgggaagggggtggcagtgacatttcagtggaggtttcagaatgaagacacggtgccagtgtggtgggacaagtattctgggaatgcgtatcagtctgtgccaggggcctgaggcagggagaggctgagttctaggggcagaagaaggcactgttctcagagcactgtgggcaaggacgaaagaggagtgcgatgaagccacaggggccagcagggacaggggccggcagggacaggcccaggcagaggctgcaacatgatcctgagagctgtgggaagcccccgagtgtggtgggacccaggcccagaatagggctggggaggggctgcacgttggcacctgccaggagaggctttttgcagccctgcccgtggcagatgctcagggaagggtggtttttcctgtctcctgctccagtgtgggtggccaggccactggtgaggcctctcccctcggcacggggcactgtggcagtgcttgtcttacct

SEQ ID NO: 100317 - DNA, 1041 bp, Homo sapiens
agatctgcaaatagtcatttaacggtcctgtgtgttatgctttcagcatctcaagtgattaaaataatgcctgtgacactctcttgcaggcgtttcggcgtggatcaccatcaacttcctgacaggtgtgtgcacactgcatcacagaggctagccgatcacagacacctgcggagggctcgactgggcctttcgagagcaggagcctcatttctgctctttaagataacccctcagggtttggcagtgttgctgactgaccatagggtgttggggatgggtggggtcacccacctgtctcacaggtgtagatgctaggagtggggtgcttctctgcaggtctggggcatttttctcccagcacagcccctgccctgtcccctgcagaacatccaccaggacccccatcctctcatttctaagagaagtaacgaatcaaaccagtcatatcttccaatattgaatgtgatgtgaatgctattcaccttctaattggattcctctgctgtaggtggaacagggaacagaaacatctgtttttagaaacaagtgacaaggagtcatttttcttagtgcatgtggattttttgtccctttgctggaattatgggaaagagcagtgtttctgatgtacagacaaaaaaggaaagaagtttcctgtcaggtttgcccatttgccactttgggggatagaaatgttaggagatgggttgggagcctccgcctgagatgctctggggagtggagatgggctgatcagagcagggcccagctcttcctgggagctaagccagcggcctccctcccagctgatacggcagtttcagtatctcccctgaaggttcatgctgtcccatcaggatccaaattaaaccacagctggtggagccattactcttgtcccttagatatatagtgtacccttaaatggagatttgtcaatagctgagctacttctctgtcttttctttcccctgagggcctggctttcaccctggcttttctgctgttctcgcgatcttactaatgcccctgtgctgt

SEQ ID NO: 100318 - DNA, 1700 bp, Homo sapiens
agacccagtggcagccggggttgccgcccacctgcctgtgctgtgcactgggtgccttctgcgctcagctgcggccttgtctgtgaatccggagtgcggagccagcgggtgcctgtagtgggtggaattggggtctgcacttgcccctccgcccccaggtgggagtcacctggagcgtgaagggacgtgtctcatccccagtgtgtcggaccctggagacacagccgcagagcagccccttctcatgcatggacctcacctacgtcagcctgctactccaggagttcggctttcccaggagcaaagtgctgaaggtaagggtgccctcaggtcacgccccagcccctttatggagtgaggggcctagaaccacttctccagttgctggggtcatgtcccccagcccatccctggcttccaaggagccacagcctcctgatgcacaaggctttcctgtctgtgtgatggtcccctctccctctctgtcttttcaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcaagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaag

SEQ ID NO: 100319 - DNA, 1033 bp, Homo sapiens
cacatctcagcaaatgatgaaagttcttaaattgaaacaagttgcagaaaaacctcaaagcagcaaaacacattgcagtccccaaggacagagcctgtggcccggcaggccctgggcagtgccttgggggctgtgcttcagcaggaggctgcagaaccctcgatgtctgcatgcaacctggacaattggagacgcacaggcttcgagtctaggcccagcacttcccgtgtcagtcctgtcccttacaaacagagataatcaagctcttgggacataactggtaaactttttccccacagtagaaaagttctaagtagaagttaggaacttttgcagagagagcaaactacaacctaaaaatccacattttagccaggtgtggtggcatgcacctgtagtgccagctgcttgggaggctgagacgcgaggatcacttgaggccaggagtttgcagccagcctgggcaacatagtgagaccgtcatctcttaaaaaaaaatatacatttttagttaaaggcaaagtaaaaacattctggtcatgttcctggcctgtcagctttttataaaacctcttgttaatacttgacccacagtattttctcagatagccagggtctagttgggctcagtatgatttcgcactggttaataaaccctgcctggacagtgcctgtggcttcctctgccagaggggggaggcaggtgctatggaaaccccatagaatattaagttcgttcaaatgtagtgtaaataaaatccagcatgatgaaagtccacaagaggcctgactgtgagtgacagcagcagtagttgtacttatagcggctatgaggactcattaattatgctgctgtaattcctgtgacgtaaaggactttggaatttatacagtaatgtagaagcctatattcaaatgatcaaaaaagtaaaaacaggccattgaagacagagctatcatttgtgtgtgtgtgttctttcaatttgtagatttaggtatttatagagtattcttaagttatgtattaaaaact

SEQ ID NO: 100320 - DNA, 1033 bp, Homo sapiens
cttcctcagtgacctgagggcacacaggcaggccccagtgtcaggcagctgggctgggctcctctcggccttctgcctgcacctttgagccaggtcgctgacctgggcttcctgggggaggagaatggcccagcctgcaccctccagcttgctctgctgtgtgcagttctttgaggggaaggagctgcggctgaagcaggagtacttcgtggtggccgccacgctccaggacatcatccgccgcttcaagtcgtccaagttcggctgccgggaccctgtgagaacctgtttcgagacgttcccagacaaggtgcatggtggccctgggagggatctcagtgccaggggctgggcgccttcaggctcttgaggttgctttctcatgtcccaaaaggggctagagtggaatggtacatgccccttgtcttggggtctcgtcattctgggccaggatcccacctgggccctcccttccagaacaagggccaccggccttgttaggagtcaggtcagcaagggacatggtgaaaggctcctgtgcaaagtcagatgtgctgggcaggctaaatggggttattccaaacaaagccctatagttccagtgagagagcccccagccccggtggccacggctcctcccctccggctgcagcacatacccgcagcagagcacacagctgtagggcactcaccagcaggcacatcgggcacagcgcacacctgccacagtgcgagcccgactgtcctccctgctccctccacagaacccctccctgttctccaggcttctcgggggtggggtgggctgggctggctccttcacttggggagcttcgtatgccaacaaccgtgggtgcccacgtgggatgaaatgactgaatggcaccccttgtgcgaccttcaggtggccatccagctgaacgacacccaccccgccctctccatccctgagctcatgcggatcctggtggacgtggagaaggtggactgggacaaggtgagcatggaggaaaagggcggcacctccccagag

SEQ ID NO: 100321 - DNA, 1088 bp, Homo sapiens
agggtggcggctacacccatgccaacggccccccacctggcctgggagaggaggtgctttgctccttgaacgaggcaccctctgttcagcagaggatgcttggggctgggggctgtcccttggcagagctattggctgatccccacgcctggcccacagcctcaggttcctctttgtaaattaaattgcacgtcctctccctcagacccatcttcctcagacagcagccctgtgggtccctgggccgggctgggccctttcctgggctggggagttgggtgagcgagagcctcctcctcaagctgggcctgggctcttgtgagatgccttggaggtgcctgctgggtctgggagcacttgagggaggtctggctgtcacagccccagaacttccctggaggcagcagagcttcccatgggtggtcatggagtgtcccctggtcatggggagtgctgggtctccgtggggcctcctgtgcccacccacctgcctctgtgttttggcaccagcacgtggccgcgctgtttcccggcgatgtggaccgcctgcgcaggatgtctgtgatcgaggagggggactgcaagcggatcaacatggcccacctgtgtgtgattgggtcccatgctgtcaatggtgtggcgaggatccactcggagatcgtgaaacagtcggtgtgagtggggcgcttgcccgagcggggccagctctgtctgacacccaggcctgcgtctaggaccatccaccaaacacatggacccagctatatagcatacaacctgtgccactaggcccctgcctccataggaatgacagagctgcccagaacaccctgtcagggtcacgccttgttgtgcgttcaccgaccagcacacgggggcctctggagggctctggctctgcgggcaacggggagacggctttgtctcctgttgctctcctgcgcccctgccttcctgggggtccagtcggaggctctgcaccactggtccacctgccgctggcagggcttggacagggcttgaaggtgggattcttaggtcagatcttgttcttgcccctcttaggtggggcgtgatctaggaattac

SEQ ID NO: 100322 - DNA, 1119 bp, Homo sapiens
ccagtcccaccagttcaaacgtccacaggaaacacacgaccctccctcagccaccgatcccagggttctctgacattgaacatcccatcaccacccaaaacccaaagccatcctcccgctgccctccaccagcaccttccctgcctgaagcaggcggtcccctcaaagccagcacctcacccaggtgctgcctgcaaacactcggccacctctcctcactgtacccaggcccatctcagactgcacaggagccacgctgctttccaggtcccaggggcccgtcccccagcacagggcattgaaccagtttgccccagagcactgctcactctctcttcattccctcttcagacctcagctttcctgggaaggcttccctgaccatagccccaggtgggcggtcccaccctcccagcggctggtccttgcctgtagcgcagggcctgacacctcagcactcatttcctcagggagcttgcataggagccaacatacaaacaggaaataggtgcccagcctagctggcagtcagctgcctcttgactcttttgcagtggccccgtggctgcactcagccacaccccagccctccctaaagctcggcttctgaactcgcacacaggacccgccaggcccaatgggtgactgcccagctcagcgcccatgttcaggggctcagccctcatgtccagaagcctgcaggtcaacacgtgagggacagactcctgcctactcagcaaccgctcagcaggggctgatgacatggcccgcggttctcagcccaggcatctccacaggcacgggtggggcccgggactcacctccacgatggtatcggccagccccgggttgcacagcagcagccaccggcggggggtgatgccattggtcttattctggaacttctctggctccagttcataaaaatccttaaagctgcaaacacagagaacagggaactgtcacaaatgctgtgccctgcaccaggtgagcaacagaccttaaagtccttttaaggaggtcccaggagccctcaagctcagtggttctgttctgttttctaaggagaacagagtgaccgcggcagctgcaggctctgggagccatacgaaggcagca

SEQ ID NO: 100323 - DNA, 1011 bp, Homo sapiens
tggtggcctgaattgcctcccagtgctgtatatcccgtgagtaattctactgcaaacttctgcttttctccagttgcctttggaagttccagaggcaaaactgtgtccctttagcacaggtacctgggttgctaagggggcagtgggctcagagtatgggtttgctttgcggttataattttccccattataaaaggaagatatgtgtagaaaatttagaccagagaatagctctgaagttgagggtcaagaatcagagaccttgtctccatgcctgtgtgttgggctttgacttggcaccacactgcttgttccctgcctaactcactgagtgctgctctgggctacagcgcatcctcatggggctcttggctgcctcctctctgcacagcctctgcttccttagatagcagtgtgaggactgtggagaaggatctttggtctgagctcaaatgattggctcctgattgtcctgtggtctagggaattcctggggaagtcggagcctgagcaccagcactgagcctggccgtgggaaggaagcatgaagacctctgccctcctcccgttttcctccagtcagcagcccggtatcctgaagccccggggggccggcacctgcaatgctcaggagcccagctcgcacctggagagcacctcagatcccaggcggggaggcccctgcaggcctgcagtgcccggaggcctgagcatggctgtgtggaaagcgtgggtggcaggcatgtggctctccttgccgcccctcaacctgagatcttgttgggagacttaatggcagcaggcagccatcactgcctgcttgatgctgcactgagctggacagggggagtccgggcaggggactcttggggctcgggaccatgctgagctttttggcaccacccacagagaacgtggggtccaggttctttctgcaccttcccagcacatgcagaatgactccagtggttccatcgtcccctcctgccctgtgtacctgcttgcctttct

SEQ ID NO: 100324 - DNA, 1056 bp, Homo sapiens
gtgctcccagccctgggctgaatccgtggacgaggcctgcacacacccaactagtttgccctgccattaccaagacccaggctgccttctcttaccctactctgagccacaaatccaatccaacttgctgacagtcaaagcaaattcagcaaaagcaaacactgaggccccacagacagcatggtctggttctggtatcagcgcaattccaaaggcaaggaaacaggctagaagtttctctatcaattttgactgtgacccctgcaatgggcttgggagatcctcatcaaggggttctttgccttcagcccataactgatgagcccttccagctgagttcccaggttggcctgggctctgataacataggcagcccactctgataacccctgtgtgaggactgggaactatctgcttatttttcatattcttggagacagcatcagtgggcccctgccccaacctttacaccagacctcccatgtccttccgaagcagcctggaggtgacgcagggaggatgaggtggcctcctgagcctgacgtggctggtgcgcagcccgtgatgcagcatgcaggggctgccttcccgcctgcccactcccagcctggtccacccacactggctgagtgtgcaagatgccagctacaccagaggcagaggccaggacccacctttctgccaagctggaagggcaccaccgggtcgtcctcagcgtgcaggatgagcaggggacaggagatgtgcttcacgctgtaggagggagaaggggctagaccaagaccagggaaagggcagagttgcccagaccctctgtccatggcagggatctgggttcagggtgtgttttgggaaacagcctgatttctgctggatttctttttactagacaactgaaagttaactcttcattatctctatgaacatctattacagctagatgacaggtgtcaatcacagctatataactggccctcggaatgtcttctgaaaattgaaaatgattatttttccaccagatatatatatttttaagcggaataattcaggtgggcc

SEQ ID NO: 100325 - DNA, 1036 bp, Homo sapiens
tatgtggtttgctgaaggatttggatctatcaaacctactgaaaatcctaaatcacttctaagtgtttagagttggagtgaccataaatgtcacttacacagataaattagagaacattgactttttttaccaacagattcctagtaacattcatttacactaagtttcttggcccacctgaattattccgcttaaaaatatatatatctggtggaaaaataatcattttcaattttcagaagacattccgagggccagttatatagctgtgattgacacctgtcatctagctgtaatagatgttcatagagataatgaagagttaactttcagttgtctagtaaaaagaaatccagcagaaatcaggctgtttcccaaaacacaccctgaacccagatccctgccatggacagagggtctgggcaactctgccctttccctggtcttggtctagccccttctccctcctacagcgtgaagcacatctcctgtcccctgctcatcctgcacgctgaggacgacccggtggtgcccttccagcttggcagaaaggtgggtcctggcctctgcctctggtgtagctggcatcttgcacactcagccagtgtgggtggaccaggctgggagtgggcaggcgggaaggcagcccctgcatgctgcatcacgggctgcgcaccagccacgtcaggctcaggaggccacctcatcctccctgcgtcacctccaggctgcttcggaaggacatgggaggtctggtgtaaaggttggggcaggggcccactgatgctgtctccaagaatatgaaaaataagcagatagttcccagtcctcacacaggggttatcagagtgggctgcctatgttatcagagcccaggccaacctgggaactcagctggaagggctcatcagttatgggctgaaggcaaagaaccccttgatgaggatctcccaagcccattgcaggggtcacagtcaaaattgatagagaaacttctagcctgtttccttgcctttggaattgcgctgataccag

SEQ ID NO: 100326 - DNA, 1074 bp, Homo sapiens
gctctgaccctgactcctctccctttttctctgatgaggacccttgtggttattttgggcccacccagcttgtccaggatcacccccatctcaaggcaagcagttagtagctttcattccttccatacctttcattccccagccatgtgacccaacgcgttcacaagttccagggattaggtcatggacacttttgggggccaccatgctgccaaccacagggaagaaagttccatcaggatgacagttgtgggctgggaaaaactccagaatgaggagcaaggaagtggtttgccctctccttctctccatgttgacactggttctcttctgctgcatgctagagaccttaggagagggagaatgagtggcttcttcccattcatctccccgcacttctgtcaggaaatgaaatcccacgcagcactttctgtttcagttctcgtggagtctacgtttctaattggcaccaagactgccagctccatctccgactgtccctctgtctctctcactgcatctgcctctttgtccgcatccttctgcctcctgtccctgtctctgtgcctgtctgtctgtccctgtcagtcttcttgcctgtctctgtgcctctctgttcctgtctctcagtcttcctgtctgtctctgtctcctgtccctgtctctgttcttttctttctgtctcatgtccccatacccctgcctcccagcctggccctagccctctgcatggcctcctccctcctctagtgtctgagtcgggaaacagcaagttctgcactaactgtttgcttacactgcacaacctgctctttctgacctttgtggtgctttcagatcatctgatgatgactcactgctgggctgctggaaagataattgcactccacctttgctggagactgggggagggacccttgggaggttgtaattttggggggcagagatggtagtgttttctgttatggaaacaagatgctaattagaccctaaggggaaacagcccctttccccttcctgggtcatggttgccttgaacccagaaatgccctccctgttctgggagcctccgga

SEQ ID NO: 100327 - DNA, 2876 bp, Homo sapiens
gcaggccaccctacagtgtgagctctctgctcaccctaacgggctgttgctgaagttcatgcactctttggttaatcagccctgcccagttttatctcagatgcttttcctgagtgggtctaatggcttgtcctttccactggctgccctggagttggcctccctgccttaaaagggtgctccttccacaccatgtgattgctgttcagaagagcctctgtgggagaacccagggtgggtgcggaggggatacattttctgaacaaagcattgtttgaaaaccaccaaggtcttcgtgtgtgagagaggcagccaggagccagcacagaggcagacccagcacggagacagggctgctgcggggccagggccgaggtcccgtgtggcaccagggtatgtcagggctgggggcaaacattttataggcagagccagcaaggagagctgtgctgggcccttctggaagggaaagcaggcctaggtggggtctgcatggtggaaccctgcagagagcattgctgaaagagcctggcggcatggcccgtgaagcggtttctgtgtcagggatggcgtgtctagctacagaatcatgcatgtgctgcacagtttcctttcttctttgtctgggacaagctgcagagggtttctcttctgcttttcaaagagcaagtggctacaaacagctcttgcagcatctttttataaatgacagaactgtggttggctgtgaataaggttcagttctgcagtgcccatcacatggttaaaaaaaaaaaaaaaagatcctgcctataactttaggttagaaagggatgccgtgactttcagtgtttgctgccccctcccaatcctgcagagactgcctggctgcagtcctcgccacccccacgttgcctgctttctttgtcctgtgcatcccactggggtttcgctggtctgcgggatccaccacccgggtccccctgaggtccagaccccctggattcccagcaactgttccttttttgcttaatgtaggaaattttagaaacttagagccactgtgaactcttacaatgataactgaaaatattttgcagtgtttcctccttgccttgaaactcattcctttattttttattttaatttttgagacagagtctcactctgttgcccaggctggagtgcagtggcacaatcctgactcactgcaacctcagcctcctgagttcaagtgactctcctgcctcggtctcccgagtagctgggattacagtcacccaccaccatggccagctaatttttgtatttttagtagagacgggtttcaccatttgaccaggctggtctcaaactcctgagctcaagtgatctgctcacctcggcctcccaaagtgctgggattacaggtgtgaaccaccgcacctgaccctttatatttttgtttctgtactttattggcttcctcctccatctcatcctggtgtccaaccagcaacactcccgcccccatacctgaaatgttgagaccgctcctgaggaaggaggagcacggctagggagtgtggagagtgtggacccgccctcctcccaggtggcccatgtccctgctgtggggtcggtccaggttaacagctggccaacaactggaaagaaagagggaagggagcctagacaggcctcagacaaggaagtacaaatgggagggtgtgtgccgagcccacttagtctcagtagcgacatgcacggtgaagctgtagttggctgtgaggggcgggaggcagccgttccggcacttcagggcctccctggggagattctaggagcatatcccatgtgcagagcacacacatgtgaagggctgtaaggcagggtggccacagcagcaaacagaagttagtgccaggtgggaaacagtcaagatgaccatgagaggccagggtggtgtggctaagcagagttctgaaggtcggctgagacgtgcggagcaagaagtgagggcagaagtcgcccatacgggtcctgttggagcacagcctctgtctacacagggtgtccttggcacagggaagctgggagggtctggggtgtggtggatgaggccttgctgtgtttcctttagtgtctttctagtttggggctgtaggtgtgcattacctactgaaaaataaaagcagtcattaagaaatctcccccaaagtgctaagaccatctcccccttggcacagcactgccagaggcgagtgtggggctacttagggggacccaaggaagaggttctgccctctttcattggcctccccctggtttggggtatggaggacaagttgacctggggcccaactctgagaagatgtgctcacaccatgtcctgttttcttctccagaggaggcgaccaccgcgtggagctttacaaggtgagtgcaggcagcacccacacctgttccctgggctgttctttccagggcaggaagtgaagggagtcaccagactcacagcttgagagttaactattgctgggctgtttgtgtgtgtgagacagggtcctcctcctctgttgcccaggctggagtgcagtggtacagtcacagcgcactgcagcgtcgacctcctgggctcaaactatcctcctgcttcagcctcctgagactgcaggtgcatgccgccaccacgcccagctaatttttgtttgtttttttgtagaaatgaggtctccctatgttgctcaggctggtctcgaactcctgggcctcccaccttggcctcccaaagtgttgggatgacaggcgtgttgagctttttaacactgcctttggatgggcgtgctggaaggtagggccttggctgcctctgctgtgactgcccatcacactgcttctaggcctgggccccaaca

SEQ ID NO: 100328 - DNA, 1024 bp, Homo sapiens
gttaaactgtggacaatttaagcatggggttaactgggatgtggggcacgtatgaggaaaatgctattactcaagatggactaagtgctgcttctctgccaggccccagtggtaactggcacattgcaagcctttgtggcccagaggaggctggcctgccagtcagggaacgctcctgctgaagctgtcagtgccatccacacagcctgcagttccgtggttattgattctagtgatggggatagttttctaccacccacccccatctgttcccctgtagttagatggggtctgcagctccctgctgtctggacttgagctgattaagtaacaccacgtgcagtcgccaggatgaggacagaagggacatctgatcctgcgctcccctctgcttctgtctgcaggcacaccgtccctgcagtctggtggaagaacgcccaaggcaaagaccagatgtggtatgaggatgccttggcttccagccaccctatcattctgtacctgcatgggaacgcaggtaccaggtgagggagaggagcccatcatctttgctgtggagcatggctcctttttggggtgggaatgtcctggcccggtctgccggaaaccagcaggagcaacctgcggtcccacaaaattgggtgtactgacccactgcaatgagggagagcctcccaagaacgaagggaaaggcagagttctgaaggggttgagggaaggcggagtttaggtgacgtttacatgaagcagggttcccacaggctgaggccagcacggctgtgttccgtggggaccaagtgtgggaagctgtgtgcagaccgtcccctatctggagctgcagcctggattgggatgaaggaggctgagtctcagtcaggagctgagctccccagccagaggggcatgtttttttctccttgttgtaatctcaaaggtcacagcatctgctggtatgtgatttggggagcagggtttcttggagagtgagggctttggggtccctccgaggaggggtcatagtggc

SEQ ID NO: 100329 - DNA, 1049 bp, Homo sapiens
cgagactcttgtctcaaaaaaaaaaaaaaatatatatatatatatatatcttttccaagaggtgaacatctagatactgaaaacagcttgatttcttttcacatatagcttcgcaccagctgatgatgatggtgttggctgtcttctgagtatttacttttttaagccataagtttacactggacataagccttgtgacttctctgtgtctccttggaatacattttaatgttttcttctgtacacaagtggtgcttctgaacagctgaattaaaattgaccaacctcactgtagcatttccgtttttctctgagaagtgagcctgaatcacagcccttttatctagctgaatttatttttcagtagccataacgtcgctttccactgtctcagaaaaccactgtgtatgtgagaagcttctaaatgaaatgctgtgagtagcttcccagtgtggatgagagaacattcagacatttctaacagtggtccttggtaaagaacataaaacaagaagggagatttttgttcttagtagttggtgctgggattaaagtcttttgtcacttcctgatttgatttaatctagcatttactgaccaatgtgtgactgtgggactcctcaggtttctgtctgaagcatgacttgttttgcacagagctgctgagtgggacttggtcagccctcttcttggttaacatgagtctgtcctattgcaggagggtgtttatggtggtgagacttaggctggaagtactaacaactcctgcatacattatcagctaccagaaaaggttttgtttagtgatgtcagtggcaagtgtcaaggcagtgacagccacgctgtgtgttgctgtgtgttggtgggtgcgtgttggtgagtgcggctgctgcccactctcatgccctaggcagtcacaatgacattgggccctcaggcagcagcaggcccagctcaccaactgcccccaccatcgcttcatcagaccctcccaccagcttcctgaaaggagggcctcaaggcctagagtggagcctgggggccattcc

SEQ ID NO: 100330 - DNA, 1975 bp, Homo sapiens
tttcatggtgatgtctgattttaggggtagtctttttactttaatggagatttagtttacatacagtgaagggtacatatcttaagtgtacagtttatatacctatatctttagagatagataggtagagctaccacccagattgagaactagaatgcttttattacccaaaaaggtccctgtgccccttcccagctggaggactttctgtgctagtgttgctccccagcactggatttctgtccacagaagactacactgccctgggggaccagcgtatctgtcttcagctgaggtgagtaaaaatgttgacaacatgagaagtcagctgaagccatcatgttggagatgccttgtcagttgtgcattccaggagcctagctgcccttggaaaagatgaccactgaaaaatatagtacctttaaaaaaaaatgaggccttttttcttttttaaaacaaattagttttttatacccttaaaaaaatccagatacacagtactttggtttctgtggaattttgtgctggccttgtaggtattgtagtctccttgagtgaacttggaccttgtgtgttttttcacgctgtgtatttacttttggagatgtgggaggagaaaggtgcagaagtatcaagcccatgaggtcaaaggcagaggctctgggcacatggccctgggaacagtcctacaagcgaggctccaaggaaagggccgcatctgtgggttcgaggtttgagaacaacggggctcgcacacggtgggtgttctgtgaaggacagcctgagaggcaggtgctgacagcattagaacaggatgaggcaggggctctggggtcactctgtggctagattggtttgcacatagtgagtctggccttatgcgtttgggagtttgaggcttggaaagctgggcctgatattgctgaggcagcaggtaagctggtggagtgggaggaggaggaaaggaggaggccgcagaggaacacaggaggtactgagaggtgccggactccctctgcaggcatctgggcttatgagtttgggtgttcagtctataatagacttaatcacagaaacttaggagatgactggctaaaaaaggaatttctgtttctttgtttttgttttttttaatgccggtaagaagaacataaattataaggctatttaatactttgtaaatctgagtttttatttgggtgtcttaaaataactgtaaaacacatgtagtatactaagaggcatttgatttttctaatggaaaagtagaacttctaggaatttttcatctctaagttttgtcacttgtgagaagcacaaactcaaaaagaaactaacagtataccaaaatgatgggagttttgtttttctgactttaatgttccttaaatgtacacagtacagcccagaaagcatttggggcttaggtataaacacgaagctacaagggctgcagattcaccatcagcagacctcagacttgaccctcatggcttttctacctttgctggcccccttgggcaggtgcctttgctgccaggcacatgagctggttcttgaagggagggtgtggggtgcattgccctgcgtggcctggtacattgtgggctcccagcaaatgtttgaattgaatagattttctttagcttgattgtttgggctactgtagacacacagcctacagattttgttctgtgggtttcctaaggaggtggtagactgctctgagggaggagaactttgggttctcctggtccagccccatggcatgggagaggagggctgggcttgggcaaggggaggctgagcctcccaaggtgttgcccatccttaacgatttccttccacctgtttgccacactggagttaggtgagcctacagtggcattttgttttgttgttttgttttgttctgagacagggcgtggctctgttgccccagctggactgcaggggtatgatcacggctcactgc

SEQ ID NO: 100331 - DNA, 1053 bp, Homo sapiens
tgcatgctagggtaattgtatacttgtttgggagaaaatagttttgtcatctcgtatatgctaaaataattccagattaatttaacagtaactattgttaacattttggttataacttttcacactgttcatacacctatatttttgcattttcacatatgattttataagctgtaaaaccactatattctggattttcatccaggtcttcacatagagatggcattgctttgaatgactacatagcacctccttatcccatggatgccagcctcccttggcactggtgtggcacagtgctgtctgaccctgaaaggtgttctggggggtggccgatatggacaaggggtccaagttcacgtgtgcccggagtgccaccctatgcactctgcataggtctgcataggtctcctgccacctcctagcctgaggcctgcagatgtggagtttgtacctttgttgcctcttctgggtacttgctgtgttttgacacatactgaagagggtgtgcaggtgatggtgctagtttgcttgtacagaagcaaagaaagagggataaaatgcagaccagtgaggaaacaggcagtaatgttaggaggccttcacaaacttcactgttgcccatgaggatagaccaacagttggtggaatggtagctggaagaaactcctgcctgcagcatatcatgacttcagggaaattttagaagaatagtcactgactttgccagtaaagatcctatatgatgtgcacccagcatccttgtgctaaatgggctcatcgtttatttaattagcttcctattgatggacaattggcttcttcctagttcttcctgctattattagcaactttcatatgtctaacttttgttcctttgttagtgtccaattatttagcgtaatttgagatttgatgggtcaaagagtatgaatatttaaaattttgaaactgttgccaatgtgacttccaacatgattaggaaagtttgccttcctaccaagagagcctcagtgcccatttcccccacccctgctgtcattagatggtatt

SEQ ID NO: 100332 - DNA, 1760 bp, Homo sapiens
gatggttcgtggtacttgaaatctgtccgcacaagttcgcctccttgggaatcatctcgcagtcctgagtcgtttggttattggcgttcaataacctttgggttattgggtagaagatgaatgcgtttatataaagccactttcaaaactgagatgggaacgtgtttcatagggacagatttctcctcccatctgctggtttcctaattatctggctgttgtagaacgtagcattcctgacagctttgaagccttgctacttcgtggtggtttgaagaagttactatatgatgatctcaggcgttgtagcagaggcacttcttttttgaccatctggaatgcccttagttgacgctggccacttgagtgtaaaatatgcgtatcgctcctaaggaaaagtagaatttcaacttcattgcttaaaaaaatcatgaaattaaactatagacacttctaagtcgatggtttgacagaagggcggagactgatagttttgtgtctttatgtgtaaaattatgtagcatctgatcaatatcttttgtgaaactaatctgttctctttgctatggaaagatttatctgcattaaaaactcatgatttaactttaatacaattttattaacagacatggcataacgcttagataaattggaaaattcttccttcgaaaaaatcaaattgccgggcgcggtggctcacgcctgtaatgccagcactctgggagaccgaggcgggcagattatcagaggtcaggagttcgagaccagcttgaccaacatggagaaaccccgtctgtactaaaaatacaaaattagccgggcgtggtggcgcatatgcctgtaatcccagctactcgggaggctgaggcgggagaatcgcttgaatctgggaggcggaggttgcggtgagccaagatctcgccgaaccgagatcgcaccagtgcactccagcctggacaacaagaacggaactccgtctcaaaaaaaaaaaaaaaaaagaaaaaatcaaattgttttacacaacgtttggggaaacagcggcgacctggcaccttcttgaagaatgtactgtattaaaattacccgattaatttttattttcgtgtcaggacaaagagagacattccagtggtgtccatatcctttggataagcaaaaggctgttaggggtaaaaagcaaaacaaagggaaagaagaccaaatttgttaggttgtcttccttcccagctggctgtctcagacatccttgagctttcttctcttcctcgctcaggctctgcgccaccatcacctcctcctcactgaggccttcttagaccagcccactcctgtcgaccttgttatcactcgagattgtaatttttgctcgtgtgcctcccccgcaaccagaatggaagcgccatgagaacaggagctttgttttctccacttaagtatctccagtacctggcacgtagtaggtagcagaaaatacttgttgaatgaacaaatatccatagaacagatatccattgcgccacagagccggctcgtttgtgtcttttatgatccttctttggatccttccgcacattttttaaactctttattgtcgacatacgtggaagtagagaagacaatctaatgagccttcttcatgtgtccatcacttaaaagttttcagtgtttagccaattttgaatcatccatccctcttctctttttttttgtaggatgaaggattggatttttttttttttttttttttgagaaggagtctc

SEQ ID NO: 100333 - DNA, 1067 bp, Homo sapiens
cacagataaggtccccggagaaggggcttcccctcctttctcgctgggttgacgttcccagcgagtgaagccttttctggaatgtgtgtacgcaccctccaccaagagttctaataagctaagcttaaagcagaacagtgaaatggcaaaactgtacagagccctgactttacatttcactctgacagccagggtcggaagcaccacatggaaagtgctgtccataactgctcacttacctgctccttgctgacagctcccaggatctggctccagagagtggcaaaactgggaattttgccaagggaaattactcaggaccgctaataaaaacgccggcttctgcaacatgcatattcccccagcccccacctccatcttgcccagggcagaccattcattaactatctgcggggtgaacaaagaatcccaatcctcagatgtcccaggactcatggctcatgacccacggaatctaaggcagcacagtggcttaatttaaaagatgtgctttcgaatgaatcctagaaaataatctgtctttacacagagagggctgcgggggcaatcctactgacgagtttgttgagagcgcgaactttttcttccaagaggcggctttgtttctcggcgcctcgctgcttctcctcggtggcctgaagtgctctcaccaggtgggcgttctccacgtacagctccttcagcagcaggtcggacttcgtgttcttttcaaactagagaggggaggaagccatgctttgcatgaggccggtggagaaacgctacagatcagcctgctctcttttatcctcccaggtttacgcaaaccacagttttgggctcttagaaatctgacccaaggccgggggcagtggttcacgcctgtaatcccagcactttgggaggctgaggtgggcagatcccaaggtcaggagatcgagaccatcctggcgaacacggtgaaaccccatctctactaaaaaatacaaaaaaattagctgggcgtggtggcgggcgcctgtagtcccagctacccgggaggctgaggcaggagaatggtgtgaacc

SEQ ID NO: 100334 - DNA, 1832 bp, Homo sapiens
tcccagcactttgggaggctgagatgggaagatcccttgaggctaggagttcgggaccagctttggcaacacagctagagaccctgtctcgaccaaaaaacaaaactaggtgggagtggtgacgtgtgcctgtggtcccagctacttgggaggctgaggtgggaggatcgcctgagcctaggaggtcacggctgcagtgaaccatgaatgtgccaccgcactccagccagggcaacagagcgagagcctgtcttgaaaaacaaaacaaaacaaaacaaaacaaatgactacttaataaaaatatagccaatgatgggcaaatgtatatataacatgaaaattaaaaacatttttttcttatgtatttaaaaactttttcccccagaatcagaactacaaggatcaattatcccagctcaatgtcagggttcttcaactgggacaggaggcttctacccaccaggcccaaaacgaggagcatcgtgtgaccattcagatgttaacacagagcctggaggaggtggttcgcagtgggcagcagcaggtgggtggcctcagccgcagggagctgagctggaggctgggagctcagggtggggaggcggctgcaaataggtcaggacacgcgctgaggagcctggagggaagtgagggacttcccaagcatgccttggagaagtaggtggactgtgctgtgttggcaaatcccagtatctaaagaaaatagcagaatagctttatatgctgctgacagaggagtgaattggtacaaagttccccgagggcagtttggcaaaatacacacttagaggctgaagaaagtccacatgccttgacttcacgattccgatggggatgttcccgagagccttgtggaaggatgcagctgcagcattttccttgctgtgctgtttataatagcaaagcagaactgaaatcggccgagtcaccaacagaagctgagggagtcactggatcacagcacagccactgaaaaccatgttttcaaatcataactaatgccccaggaaacgctcccactgcagtgaggagaaggcacttcctgcagtgcgtggcgcacctgacactgtctcaccagggagatgcgtgtgtgtagaggaggggccggggagtgactgcaggacacagggccggccttggttggtgggttcacagggatttaaattttgtactttttttcttttctgtaattttctgaggtttttgcacgaattacataccagactcttcagatacttcttgacttgtgcaattgattttttaaaaacagagtgaccaaatccaaaaacttagagttgaacttgaatgcctgaatcaggaacatcagagcctgcagctgccatggtcagagctgacccagacccttgaggaaagtcaagaccaggtgggtgtgagcgatggctggaggcactgggtccagtcccacctgggagcagcatcaccgcagtgccaacggtgttgccaggcctcctccagcccaaagaagtagttgcgctgctgggcacagctgtccaggtgcttaccgggccaggaccgaagctgctcccagtgcagggttggtttgactgtcagcaagccccgtgaagagtagtgactgtttactcccgagggaaggagtgcgggcaccatgcctgtgggtgagccctccacagaatggaggagccagaggcaagcctggggactgtgtcgtcagaaccaaggcagcaggctccagccctgggagtggggtgacatgggcactcatgggcatgcatgacactggcctctgtacacgcctccgggtgccacatctgctggccccgcaggtgaga

SEQ ID NO: 100335 - DNA, 1018 bp, Homo sapiens
ctctataccatacacaactgccacacgcttatgtcgtggtggaagcttctcttaacctgaggcttgaggttctagggaagggatgaggtgaggttaatttgcaaggaattgcatgagaaaaatgcgtggactccctaatcttgagtaaatccaaatggaaaaacgtcccagttttcttacatgcctgtaaaacctatagaagcaaaggcagtggttgtgggcgtcactctgggaaggtgacgtgtgcgtggtcgattgtgctgagagcgggtcagaggacatcactccaaacccccaggagctgcggtgggaaaaagcaagtaagcagaaatatggttgcatgaagatgttcctgacaggtggctgcagacagcagagcctccgtggtccagaccgcagggccactttcctgccgctgtcactgcactgcgccctcacaggttcccctcatgaacgtttgctgaaatcctttgtctgtgggaggtgctattgagaaaaagcaaaacatacaatttgatgaacctatgtaccctgccaagagctacgcttgtgtgttcaatgactgagatcagaggagacttaagagattcatgtacctcaagtttaaataggttgcttttttgttaaaattgccatatatttttaaatatattaaaataatcgtggaggaaatgagaaaaacgtgaaaggtcttccaaacagtggtttggacggtcatggcatatactcccttctggtggcctagatgtgtgtgtgtttttcctaggggctggagcagggctttctgtcctcggcactggtgacgtttggggccaaatcatctgtgttgtagggtgtcaagtgcccccatgcctccatctccagctgtgattaccaaaaatacctggagacattgccagacatttcctcaggagcaaagttgtacctggttgagagcaattacaatgatatgaattgagctgctggcttaaaagtattttagggggcaaggtggggctgggctcagtggcccacacct

SEQ ID NO: 100336 - DNA, 1033 bp, Homo sapiens
gttgtggccgggtgtggtggctcacacctgtaatcccagcactttgggaggcagatcacgaggtcaggagattgagaccatcctggctaacatggtgaaaccccgtctctactaaaaaatacaaaaaattagccgggcatggtggtgggtgcctgtagtcccagctactcgggaggctgaggcaggagaatggtgtgaacctgggaggcagagtttgcagtgagctgagatcccgccactgcactccagcctgggcgacagagcaagactctgtctccaaaaaaaaaaatgacaccatgttgcatatgcttttctgatggccacagagcatctcacctgggtctttgtgtggatctgccataatttatttaaccatttccctatttttgtatatttcaaaagtttttaaagagtaggctgataggaaatatgtagctttaacactaccccaaaagatttatggagtattaaattagtcagattattgtacttccttcatactcttcccttttgagtgttgtttctttaaagttctaagccaagattaaaagcccgggctctggggcttaggtgtctcggacttggttatgggcgtcaccaggcttctgcagaagtaggagcctcgctggtcttcagtctgggtagacgtggtttgagaattccagtgaagctgctgtttcagaaagagatgagactgagcgttgaacactgtttttcctgctaatggaaacagttattgtaaaagatgaatgtagcagctgagaaaaaaatatcccccacctcttcctcagattgctttgggaattcactgtccatgggtttcatgctgcctccctccttgggagggaggtgattttcatgtgcatttggtatcgaaagtctttatcaaagggctgttacctgccatgcacaccgggtggaggggccaccttgggactcaccccagggagctgtgctcctcgctgtgagggggcagctggtggcatttgccatgtgacccaccagatccccttgtctggggtcacctccagca

SEQ ID NO: 100337 - DNA, 1054 bp, Homo sapiens
aggggccccacagaaaggtgggtgtgagaggatcagtgtggtggccagacgctgagctctaaggaactacccaggtgtgaagctggcagcctggctaacccttgcagcaggcttggcataatctgagcatccctcctctcagagcagcttggggctcaggagtgaggtcttgccgagcttgggaacaagagctgaggttcacaccaggcccttacaatcacagcacaagcttttacactgctgctgcagagcttctccaaggagcagggctgcagtgctcaaggaaggattggagaaggtgagagacttaggatggactgcattgcatctggggcctctgttgggacacttgaaggctgggtctgaaatcatatgaagcgtcactgatgcgtctgggctggaggagctcagctgaggacagtctcggaggggttgcagcaggcctcagcgtggctgggcttccttacagcatggcggctgaagatagtcaactgtctcacctggtggcttagggcactaaggacatgtggtcccaaaaacagggctgggatttcctcactgagttcaggccagcctcaaagtcacaaagcatcccttccaccacattctattgatcagagctgtcacaagcctaccagattcaaggagaagggacacagacctgaagggaagagtgtcaaagaaatttgaagccacatttccaaactgcctcacatgggcaggctgaaaggaagagggaaggcaaagaggggcaaagttagaacaggggggtgtcatgtgcttcaggaaagaggaaggccggaggcattgatggacgtgtagggagcaaactgcgggatccttagcagccaggcatgtacggtgcaggtgtagggagtgcaggatgctgccatggcctttgaggaggcagtgatgaaaggagctagtgtttcagggtgcagggatgcaggtgactggggaggagaggctggagcccggctgaatgccgagagccctcttcaggctgccagcgccccccagctccccctgttgtagaaggaccagggtggcagca

SEQ ID NO: 100338 - DNA, 1035 bp, Homo sapiens
cccccaggctccctgggtcatttgctgcaggtgcctgggatgcagggatcacccaaggagagggggatgggcccaggagatggctgccagagtctcgtggggcttcacgttaagaaatatgtccatggggcaggtccacagcttgtaagttaatcatggattgggtcgaaccattttcaaggattccaaaaggttcctggttcctgctctctgtgctctcagcttctgccaggtgggtctcgatcaggagcacatccttcttagacaggtcgggcccccaggtggacttgtttaccatttgttttcaacatttgtggagacaaagagggaaaacaaccaaaatatatttaaatcttagagtcttttttctcaggggcatgtgacatctaggcgatgccagtaaatccagaacattccttttttgttcttttttaaaaatttggacctcagggatggagagatagtgaatctcctccttgtggtggatcttcattggtgccattctgcttcttaaatcatctttgattctcaaaacctgaacacggggaaagccgcctttagggttgtcagtggagttgaactcattaaaaaaatggggttgcgtatttatcaccaactcacagattctccctgatcagagccagtgccagctttgaagcatacagagtcttggtcaccaggcatccattccacagtcagttgtggggacacacaacacctggacaaatcagactttgattccagttggctgacgcagtcactgcagcacgaggtttttacttaagtcgcgtgtttcttgatggcccgggctcttgtcttgggtacagatttgcaaaggctgctggagtgtgaggtggttaccaggcgctgtgctatcccggagcccttggagggatacagaaacctgctctcaccttgcgactgtttgctgaactgatatggttggtgagggaaaggtgcagagaggcgtgttgcaagccttgtatggcgagcgtgtcctgagactgaatgattggctgtggctgcagggctggc

SEQ ID NO: 100339 - DNA, 1209 bp, Homo sapiens
cctaaaggccactactgtttagtttttgttttatttttaaaaatagagacaaggtctcgctatgttgcccaggctagtctcaaactcctgagctcaagcagtccacctgcctcagcctccaaaagtgctagggttacaggcatgagccatgtcacccagccaaggccagtgctgttaccagcttcatgtatacctgcatatagaagtgtataagactatatagaatcagttgaattcaggcagatttttaatttctgtatttcagtttaggaaacagcattcttgctcagataatctaagagtcatgcagcttgtgtttaagccatttgtgttaggaacataataccttcatggtctcagccatgtgcgagatctctgtagttccattgactttcgcataccaccaccctggtgattctctttgcctcttatgttaaatttcctattttctgtgtcctgtgtattcctattttgacttattccctctttttggtggcatgcatccttgcgtaggttccctgtaaacgtgtgtaggaggtaaaagttttgagatctgaaatgtctgaaaatatctttattctcttctcccatcattgatagttttaatagtgtgtatttcgataacatttttacttgaaattttgaaggcattggtctgtggtctagcagccatttgtatgtgaccactttctttctctcttgtaactcttagaaccttattttcctccagtggtccatgatcacatgccttggagagggtgtttccatcctctgtgcttggcacgctgaaccctttcaatcaaaatcatattttcttggtcctggggaatttaatgacttcattgataattgcctccctttgtttattttctgatttctctttatgatttctgattttttttggtttctcttatccctgttattcagatgttagaactcctttactgaccttccactttatcttttcactcccatttttccatctctgttactctgtttcttcaactttaccttccaatccttctatgatttttccctctactatcataccttttaaagatttccaagagcttgatttttttttttttttttttagacggggtcttaactcggtcacccagtgaggagtgcggtagcacagtcatggctcactgcagcctttaattcctgggctcaagtgattctcccacctcagcctccagagtagct

SEQ ID NO: 100340 - DNA, 1004 bp, Homo sapiens
agcactttggaaggccaaggcaggaggattgcttgaggctaggagttaaagacaatcctgggcaatatggcaagacccgtctctacaaaaaaaatttattagctgggtatggtggtgtgcagttgtagttctagctattcgggggactgaagtgagatgagcccaggagtttgaggccacagtgaactataatcattcctctactgcactccatccagcctgagtaacagagcaagatcctgtttggggaaaaaaaaaaaaaaaaaagacccttttcctttgttgtgattcttttactctgagggaagaaaaacacatgcgttcctctctcagtaggtgagttgagtttttggtgtgagtggcatactgtttattccctagtcccattacaacagatatattttaactgtagctgggtgcatttcaaagagccagcattgcctggcatgtttgactttcttcaggtgctcacctgaacacaggatttccagtgcagacagttcttgaggcgatcccaggatacacgttaaggggtcggggagacaagaaggggaaggagtccaatacgggttagagcagcttaatgaccaggttactgctgtgagcagctggagatttctgggggacagtacacagaacagggttcagttttgctccccaaggggcaaggaagctgtgatatttattcgccagtttctgccctacatttgttgagggctgctcccagggcaatactttttagccccatcctgtgtgtatagatacccttgtgtgtggccaagtaaagcccacaagcagagaggcccatacttggagagggaagccactggcgagtgaatatagtgtgtgccaaggggatttaggcagcacctgctataacatggggttcaaggcccttcacaaactatctgtgaacaggttccccagttgcatctcttggcatcttccctcacatgcctccatttgggctcaactcagcttcttgctttttccacaaaatttta

SEQ ID NO: 100341 - DNA, 1029 bp, Homo sapiens
ccagctactcgggaggctgagacatgagaattgcttgaacccaagaggcggaggttgcagtgagccaagattgcaccactgcattccagcctgggcaacagagcgagactccatctcaaaaaaaaaaaaaaaaagtacctgctttgtggggtttttgtgaggatgaaaacatgtaaagtacctagaacagtgcagtaatgttattgttattactattatcgtcagatttcaggtctcccattctttttttttttttttttttaatggaggcagagtatctccatgttgcccatgctggtctcaaactcctgggctcaaccgatctgcccaccttgacctcccaaagtgctgggattacagtccagtctcccattctgactcagcattgcagcatgggatatttataagtcacccgcaaaggagaccagagtcctctgtgtaatggagaggatctgtccaaccttggtttgtcactgaataagattaggcctcttcccacccagggtgctgagctgaattgaaaggaatatgtggaaatgagccataatgctggtttgtaggtgaagccacagagtcctgcgtgtcctttgacagccctgagcctctgcatgtgcatatctttctgcctgataagcacttcctttccttgtacacaaagcacactcctcaagccgggcatggtggctcacacctgtaatcccagcactttgggaggccaaggcaggcagatcatctgaggtcaggagtttgagaccagcctggccaacatggtgaaaccccatctctactaaaaatacaaaattagctgggtgtggtggcaggtgcctataatcccagctactcaggaggccgaggcagagaatcacttgatttgtagtgagctgagattgtgccattgcactccagcctgtgcaaaaagagcaaaactccactaaaaaaaaacaaaaaaaaaaaactgacaagctgactcctaaacccagtcagcatttgtctggctccagactaccagacactgtgcttgaccatcaa

SEQ ID NO: 100342 - DNA, 1013 bp, Homo sapiens
ccctgtctctacaaaaactacaaaaatccatcctggccaacgtggtgaaacccggtctctactaaaaatacaaaaattaactgggcatggtggcatgtgcctgtagtcccagctactcgggagtctgaggcaggggaatcgcttgaacccgggaggcagaggttgcagtgagctgagatggtgccactgcacttcagcctggcgacacagcgagactctgtctcaattaaaaaaaaaaagtatcaattaaaaaaaatatgtacatgtaggcctggtgcagtggctcacctgttatcccagtactttgggaggctaaggtgggaggatcacttgagctcaggagttagaggccagtgtgggcaacatagtgagaccccatctcattcataggtaaataaataaaccgattcatcaataatgtacatcatttaaaaaaatttgttgccagcctaggcaacagagcaaaactccgtctcaaaaaaagaaatatttttttcaacctaaagtacaaatgaaccataatcctctccccaatacagtttcctgtgattctgtcatgcataaatctatacttatgttaaattatatatatttttatatgtatcaaatacatgattcttaccacggaggtatttttatatcaacacagtcaaattaccccattctttcattctttttttttttttgagacagagtctttctctgtcgccaggctggagtgcagtggcgtgcgatctcagctcaatgcaacctccgcctccctagttcaagcgattctcctgcctcagcctcccgagttgctgggactacaggtgcatgccaccacacccagctaatttttgtaattttagtagagatggggtttcaccatgttggccaggatggtcttgatctcttgaccttgtgatccgccttccttagcctcccaaagtgctgggattacaggcatgagccatcgtgcccagcctctttcattctttttaacagctgctcatggttctgttttacagtgt

SEQ ID NO: 100343 - DNA, 1032 bp, Homo sapiens
ccctgtctccacaaaaaatacaaaaattagccgggtatggtggtgcgtgcctgtggtcccaactgctcggtaggctgaggtgggatgatcgcgtgaacctgggaggcagagaggttgcagtgagctgtgatcatgccactgcactccagcctgggtaacagagtaagaccccatctgaaaaatataaaaaaaaaaaaaaaagaataatggatggccataggcagaaggtatgcttaccatatggggttaaagctggtccactaaaaaatttgatggggaccaaaaactgtcagatgaaggaaatcattattgtaaaattaacatgaaaaagaactgaatccagtgaaaataattttagtaagtaggggatgatttgatcatgctttttagaaagttggtctaccaattaaatggatgtttcaattaaatcgagttttcttaaatattttctcaaggaaagtctacagtgttgttagaattttgatcagctgcctgtatccacaaacttagaccttcctcaggatccaaacaacagatccaaaggtttaagacagggaaattgggctcagaggggttatgtaaccaccaggattcacagctggtaagggcaaagtgaggttttgagctcaggtctgtctgactccaaaacccctattctttacagttttggcaaaagtgaagtggggggagcttaaagagggtgggctggccacctcctgccattgagcctgtggtctcccaaggactggcagaggagaggcctgctgaaaggctgcagagagctgcacccgagctgtgacagcacaggctgaggttctcaggattccctccacctccaccaccacttcctagcccacattaagcctctttggaacaaaccccagcctgggggattggaggaaggcaggggccgcagcctgccttaccttgtgtagtcaccaagattcaaacccaagacatccttcctgcaaagggaacctcggcttacttcatcatctgtgtctgagctcgtgccccacccagctgacctta

SEQ ID NO: 100344 - DNA, 2059 bp, Homo sapiens
aaagagagttcccttggccgggcgcggtggcttacgcctgtaatcccagcattttgggaggccgaggtgggcgaatcacgaggtcaggagatcgagaccatcctggctaacacagtgaaaccccttctctactaaaaatacaaaaaaaaattagtcgggcatggtggcgggtgcctatagtcccagctactcgggaggctgaggcaggagaatggcatgaacccaggaggcggagcttgccgtgagccgagatcgcgccactgcattccagcctgggcgacagagtgagactccatctcaaaaaaaaaaagagttcccttttccctccctttatcactgtgacctgggtacctcctggcctgcctcatccctgctaaagactccatgccaggcaaagcattcatcctgccttctttcatatcttcatagcaatgctctgagacagatggtattgttagccctgtatacagatgagaagattgaggtccagggagacagagccactgaaatggctctcccacagccacatggcagagcaggcctcagtgctgggccacccaggcatgtagccactccacagtactgccaccaggctgggtcaagaggccttggtttgctaatcttgctctgaaaaaagtccagaaaaggtctctgcttccttcctggctgggaggtggggcatgctgggtaatcagagagaatgcttctagagacgaggccaagctggtcttaaacaactgaggccttgtggaaggagtgaatgtgatggtgatcctgcccaggggctatgattcatctggctgattgattccagctgagtctgtaaaaatctcagtcctgctgttggaaagcagaatgtcaagtcatggagtggggtgggggtgactgtcaggtcatctaacttgataggtttggaagggagtccacaaatatgcttcttgacaagggactcatataggtggcatgtgggccagactttgggatcctctgctctcccaaaaatggtattttgccttcagtctatctgcttctgctttgcatttctttgatgttaacaaaaaggcagtagagaaatcactatgagtgcaaaaacctaggtttgagtcttagctgagatataggacccctgtgtgactctgggcaaatcacttaccttttgagggcctctgttttcacatctgtagagtgggaacagtaacacctacctatcaggacagctgtaagggtgccagctgtaaatggggcaggggtgtgttaaggctgactgcccatgggggctctgtttgccgacttgctttgtctttccttccagccccttcatgaataagttttttccagccagctttccaaatcgacagtaccagctgctcttcacacagggttctggggaaaacaaggaaggtcagtgctaaccactttcccctgtagtgtgccttgggtgtcttcctccaccattccctttgtctctccaatattggggttctccaatagagcaactgatgaagtgggctctggaattccatggcctggattcacattccaactctgctattgtctagacatgggaccctgggtgaacgccttacctctctgagcattgggtgtttttgtttttgttttttttcccatctgtaaaatgaaagtgttaatctagtacctccttcacagtcatgttgttaagatggcgagtcaataagtggaaagcattcagcatggtgcctggctcatagtaagcactcaaagtcggccttcatgattattttattcgtatatatttttagtgtgatcactgcctcacctaaggtttgaaaagggggttccacagctcttttttcaaaaataaaaactggccagaaacagtgtctcatgcctgtaatcacagcaatttgggaggccaagacaggatgatcacttgaggccaggaatttgagaccagcctaggcaacatagtgagacctcatctctacaaaaaaattgtaaaaaaatgcaaactatggggaagtgtggagatcctgggatttgtaggttagttagggtatggattcaaatgctgtaacaa

SEQ ID NO: 100345 - DNA, 1044 bp, Homo sapiens
accctggatcatgttcaagaagtttgatgaaaaggaaagtgtgtccaactgcatccagttgaaaacgtcagttattaagggcattaagagccaactggtagagcaatttccaggtattgaaccatggcttaatcaaatcatgcctaagaaagatcctgtcaaaatagtccgatgccacgaacatacagaaatccttaccgtaagtggggaattattgttttttagacaaagaaaggggcctttttgtccaactctaaggttgcttcacaaatacccttttatcctgccacaccagcaggttgataaaggagctatcaaatttgtactcagtggcgcaaatattatgtgtccaggtttaacttctcctggagctaagctgtaccctgctgcagtagatacgattgtagcagtcacagcggaaggaaaacagcatgctctgtgtgttggggtcatgaagatgtctgcagaagatattgagaaagtcaacaaaggaattggcattgaaaatatccattatttaaatgatgggctgtggcacatgaagacatataaatgagcctcagaaggaatgcatttggggggctaaatgtggatattgattgtgtcgtatgtgtgtttgtgtctgtgtgtgacagcgtgaatacaatgcctctgtggttatgctaaataagtttaacagatactttatagaaaacaaatcagggtgctcttaccacagatgaaaaaacaaattaggggacaagcagcaagcagtctgctaacactctggaatgtgaaaggagtgtctggactctgtgactcccggcaaactccacagcctctagttgtcttcttaggaagcttggaagcaattgagaatggtctaacatcaagatgtctaccacagggccccccacaaaagcagcctcggggactccggcctttccttgagacctgcatctcttcccttcttcatcgcctgctagtgaactgaggctgccgctaaccttcttcatcctttggtggcaaagtagaaagattccagaattaactcgacctttctaa

SEQ ID NO: 100346 - DNA, 2998 bp, Homo sapiens
ccaaagaccacttcccgctgacactgtgccaggcttgtaagtctctctctgggcctccattccctcctgtaggaaattggaggggttggggtggctccagtgagctctccccttctgaaactcatactaatctggggcagccaaggcttagccccgccagcctgtgaacctctcacagtgcccacagccatgccctcctccgtccaggggctgacaggtgggaggggtagccctgcctcagggagtggacttacctggcctctctgctcagagatcatcaattatgaatttgacaccaaggacctggtgtgcctgggcctgagcagcatcgttggcgtctggtacctgctgaggaaggtgagtagtcaggacctgggcagaaggggaggatggggttgacagggcagggtgggtcacagcaagctggtctcactccccgctttcctcagcactggattgccaacaacctttttggcctggccttctcccttaatggagtagagctcctgcacctcaacaatgtcagcactggctgcatcctgctgggcggactcttcatctacgatgtcttctgggtgagtcaggcagggatgccaaggatgtctggctccggggccatctcatctcatcaccctgcctctctggcccaagttgcagtcatctgacggagaagagctgttttgggctgaagttccggaccgcagagcaagtcctctctgggcccatctgtgagatggagccagagagagcagattctacctctttctgagagcacactcatgcccggtgccttccgaccacctgcctctcttccttgctagcaggggtgttacctaatcccatgtctccttggcaagggagttgagactcaaagaagttcaggtaggggtggaagaatgttgatgaatgggcccagcaagggcattcacattcactctgagaggcatcacagagggactgacgtcagcctgactcaggtacccttttcctggccccaggcagcctcttcccctctcaagtgggtagcgctgggggactttatcacttgggaggaacagaactgtgaacaaacataggctgcctggcttgggccatcagaggtcttttctatactccctcgaatttcccctttgttgcccagaaccagtatcagtggccacctcacctcagcttcagatctgcactggagcccctcccagctcccctcagatcccaggcagcagcacatctagaagcccagggacagccattcttccccccacagcccctcacttcccttcatactgctctttttttctccttctaggtatttggcaccaatgtgatggtgacagtggccaagtccttcgaggcaccaataaaatgtaagtgaccaccctgccacagggaaccccttcccccacccctgccgggccatgcccccacagcccgtttcagtcagtgcatctccctatctcttccccatgtacctcttcctcctgtggctccccagcctggtttccttatcctcaattgattcatctggctgtgttcatcctgcccaggtcccggcccctggccacttggtcgtggtgcagcatggcgtgaaatgagccaaaatgggagcgagcatggaggggaagtgtttaacccagcccggggggcacgcgcaggggctttccaggagagaaaacctctaagccgagacccctcactggggtccccttggcacctgagtgtcgggtgctgtctatcccgtgcctctcaaactgccttggttttgttcttcagtgtatccactgtttataagtaatagaaaatccacctacaggttgagcatctctaatccgaaaatctgaaatccagaatgttccaagacccaaaagtttttgagcactgacatgacaccacaagtggaaaattccacacataaggacttaacacatgtgaactgtgtttcatgcaggaaatagcattttaagattgtataaaactctttaggaggctgaggcgggaggatcacttgaggccagcagttcaagaccagcctgggtaacagcaagaccctatctctacaaaaaattaaaatattagctaggagtggtaacacacatctgtagtcctagctacttgggaggatctgaagcaggaggatcacttgagcctgggagttccaggctgaagtgagctatgatcatgtccctgcattccagcctggatgacagaatgaggccctgtctttaaaatttatatatgtataaatatatatgtgtgtgtacatatataaaactaccttcaagctattatgtataatgtgaatttcatatttaaacttaggttttatccccaaaacatttcattatgtatatgcaaatattccagaattcaaacaaagtttgaaacatttctggttgaaccatttcagatatgggatactcaacctgtataactgtctttaaacaagggggaaattttgtcatctcacactacagcaagcccaggggtagaaggctcagagtgagttaatgaccctctcttcaccaagagccaaggttacttcaggactcccaccccagcattctcagcatgtccacctgccccttaggtcatcccttcatggtcccaagatggctgccacagctcccagcactgactcctcacatagctgtgtccagaaaaagaaaggggaaattatgtctcagggagggatggtttttcccaagtctcctgtgcagtctccctcatactttattggccaaaactgtgtcacaggcccaagtctaaaccattcaccagtgagggggataggaaacatgattggcttagagtttaagctttagactagtggagaatcacctgctggtattacaaggctcagagaggggaacagaatccgtcaggcatgctagcaaggaagagaggaagatgctgccgggagggcaggcaacagtgagtgcatgccatggaagcactggctcgtggcgacaggcagtcgttgggggagactgggggagattcc

SEQ ID NO: 100347 - DNA, 1061 bp, Homo sapiens
aggaggcaggagaatcacttgagcctaggagacagaggttgcagtgagccaagatcgtgccactgcactcccgattacagtcctcattgccctgggcaatagagcaagccccgtctcaaaaaaaaaaaaaatacaaagtaggccgggagcggtggctcacgcctgtaactccagcactttgggaggtcgaggcgggaggatcacgaggtcaggagatcaagaccatcctggctaacacggtgaaaccccgtctctactaaaaatacaaaaaattagctgggtgcggtggtgggcgcctgtagttccagctacttgggaggctgaggcgggagaatggcatgaacccaggagatggagcttgcagtgagccgagattgcgccactgcactccagcctgggtgacagtgcgagactccgtctcaaaaaaaaaaaaaaatgtaaactgggctccagctgactcctcacattcccgcctcccgcttcagtggtgtttccccaggatctgctggagaaaggcctcgaagcaaacaactttgccatgctgggacttggagatgtcgtcattccaggtgagcctgctggtgtgggggctatgtgaaaggggtggagagggtattccccggagcaaggggattactgctaaacagacaggcttaccagctgagaaagagaaaaggtaaggctggatcaggccagggattggtgaagggttcccccttaacatccgtttacggagggccagtcaggtgccatgccccaagctgggtcctggtcaggtgtcagtgaacaagactgtcttcacagagcctctggtctaggtgagcagatgttgctcaagaactacaaaagtaaaagtctaatgacagattgaggtacactctgaaaaagcacgtttcatgacaatcttaacagactggacccctgtcacacacacccacacatacacataccccttcccagcatctgcaagcatcacagatgtaccagaattgccctagcccccttgctcctcctccctgtgccaagacatctccagggagaacacacacatgggctcctgt

SEQ ID NO: 100348 - DNA, 1728 bp, Homo sapiens
acttatctttgcagtttctgtatctgtgtttctcaaagcatgatccaacggtatgagattcacctcagatgtttttttcaaaatgcagattcctgggccctgctctagagctattagatcagactccctgggggtgggacctagaatcctgcattttttcacaagctttccagatgatttttatgctgactaaagtcttacagccactgttataagttgcagcatttgatattcataactaccaaggagatgagctcattttcccattttgcagatgagtaaactgaggctaagagaaggaaagcaacttgtccagagacacatagctgggggcagtatcagcgtgcacacccacctccagactcccagcccagagctcagtcacccccccacaacctctagggtcttccccagctccctcagaaggggtattactagttcagtccctatatctaaccctcctcctctttcttcacaccttccctgcagcttgaagaagaatacccacacctacttctacaccagctttgcagcctacatcttcggcctgggccttaccatcttcatcatgcacatcttcaagcatgctcaggtgggcaggacggtatcagagtgtcaggaatgcctcactgcaaatagagggacttacagagggatttatttgtaaatgcaagcagtccagagataggcactccccactggtgttggagcagtcatgtctgtgattctcttggccttccatttgtggttgcaagatggctgccactgctctaggcagcatgggcacgttagaggcaagaaggagggaaaagcgtaacagccatgcctgctgccttcatcaggaaggcaggaactttcccagaaccctttcagcatctcatgggccagactggggtcctaaagccaccctggctacaggagagtccaggaaagaggatttggcttctcagccttggtagtgggaagcaggcagagaagaacaggattggagtgggtgttgggtattggggcgtccctccccctactccctagtagaccaggctctgcctccttctcccaccaagatgaggatggagtactgagctgccacagaatgaagcaacatagcacaaagactgggagccctcagtgtggcctggagaggggaagattcaggggaaagtgagcagacaggattgccctactttctactggaaataataagagctcctgtttgttaagcacttccacatgtcaggctctgcactcatgaggatccttgtgaacaggtggggaaactggagttcaggtgacacactgcaagtatgtggtaaagccaggattcaaacctgggtcagcatggaaaccacacccaggctctcaagccctggccatgggaaacgcagcattgaacaggggctaagggagccctgttgtgaatcccagcaccacccagtaaccatggaactctgggcttgctgcttctgtcccctttccccttccccagggcccaaatacagacgagccatctttgaattaatcacaaaagctggggtttttttaatcactctgtgccaggcactgtgctaaactcttttgctaataactcatttagtcctagtacagtattactttatagaaggtcaaaaggcccctagcccataattagaaaaaccaagaacaaccattgtggaactgcctctcacttctgctcaagggcttcaatggcgtgtaaggtgagagtaacat

SEQ ID NO: 100349 - DNA, 1102 bp, Homo sapiens
ggtcttgaactcctgacctcaggtgatccacctgccttggcctcccaaagtgctgggattacaggtatgagccaccacgcccagccctttaaaatattttctggagatgagatctcactgtattacccagtctggtctcaaaatcctgcgttcaagtcatccttccaccttggcctcccaaagtgctggaattattggtgtgagccacgtgccaagccagactttaatgttttttgcagggtgacacagcagttgcctcctgctgacatcccagatatgcaaatgctggggctcaggagcatcggcctaacccttcctcactttgtctgtctcagctggactatcacctcctccttcaggaaggcctccccagtctaccttagctgactggcagcttcccataacctcgcgtgctttcccatcacagcactgggaacttgaggggtgactgtctcattatggtctgtcttccccagcggactgtgagctccccaggaagaggtcacatttgcagggccattgaacaggctgaaaggaacacaaagttgctacaaatagtacttttgtggaaggctccatctacttgaagtaaggagttcctttctctaattcctacaaagtacgcccttgggatggcagtagctcacctacccaccacacctctgtgtcctcagcatctggatacagcagcaaggaagcaccacatggctggtggtgtttattcccatttgggtaccctcaactaaatgtagctctgaagagcatgagcctaggtcatgttctttccatgctttgcctagcacaaagcaagtgtacaataaccatttattatttaatgattctaaagctctgtatttcagtggtggaggatatacccaattagaggtattatagtcactgtaataataactagtgcctactgaatgctgactgccaggaacctgtgtggtttttttcttttcttttccttcttttttttttttgaaacagaatctcacccacgctggagtgcagtggcgcaatctcagttcactgcaacctccacctcctgggttcaagcaattctcctgcctcagtctcctgagtagctgggattacaagc

SEQ ID NO: 100350 - DNA, 1038 bp, Homo sapiens
atggactcggcattcccccgggctctccaggagaagagaggaggtgctgcactctcggagtcccgcgtggccgcgtccagcggtccaggaggggtctgggaaaagcggtcaggagctccagctggagggcaggcctggaggtgggacatgccccaggcgccccgccccgccccgccccgcccgcttttcggagtgggcttcactgccccctggtggccacaggatgcgacctgagagccagccccagctcaagctgctcccgctcagtgcacacgacctctctcgccggggggccactttccccaatgtcctccatcctctaccctactcaccagaaaaacagctacacttccaacccttaggtactggattcagagcttgtatgggctctctggagcttagaatcgccatcttgtttggttcaagaccaaagcctccagcctcccactcacgccttcccccacgatgtgtcctcagctcctgcccctagccatagccgttcaagtcccttcctcacattctccatgtgcttccagaaatgtcttcactcgctcttttatttatttatttatttattttttattttttgagagagggtctcactctgttgcccaggctggagtgcagtggcctgatcatagctcactgcagcctcgacttcctgggctcaggtgatcctcccacctcagcctcccactgtgactacaggagcacgccaccatacccggctaatttttttgtatttttgcagagacagggttttgccatgttgcccaggctggtctcgaactcctggtctcaagccatcacttggccccggcctcccaaagtgctgggattacaggcgtgagccactgtgcccagcccagaaacattttttcacatattggcacagatatatattttgatcctccactaattttttacacaaatagtaacatactaaacacactttcccttgctttttccacctgcatactgtatcttgtagaggtttttttttttctttgagacagagtctccttctgtcgcccaagc

SEQ ID NO: 100351 - DNA, 1658 bp, Homo sapiens
ttggaggtgatcttaccaccattgagaatggactagaacataagctccatggaagccttgctcacggctgagtctccaatgccagcctcagtgcatacccctggtataaacagaagtccaaggagtctgggaacagaaaggagacattcatcccagaggttggggagggatgagcagggaagaggggactccaaaatggagtcctataggcttagtaggggttggttaactgaggaagatatggagtgaccagttaaaggacagtgttggcaaaggcaccagggcctgaagcactcaggagtatgtagtgtggggccattccaagtgggtggccaggactgttgaagcctcttgaagtattggaagaaggaccttgaaagtgatactagcctgggcatctcctaggggccaagtcaggagacccagttttctagtgtaggctctactacaaaccagcagtggaaacgtagaatgggcaggtgggttggccttgctgacttcatgggcctacctggctaggaatccatgactctcctgtggaggtcattagccattgcctgtcgccagtggccctacaaacccccacatggaagtcagctaccccactttcctcttaactcaagcagaggatgcagacaggcccttgggcctgggtctcctagaaacctttgtgacatcagagacctccctacaacccactcttaaacctcatcccctgcctaccatgccagcctggttaaaaccagtgggagccacccaaggtgcagtaggggcttatctctgcttttccagaccagggctgctctgcaatcctgtttatttatccagagcagccgcctgctgagaaaatggctctgtttatttccaagtgtgtcgtgtgaaccatgggctaaatatacccacgccaccgcctctccagcacccgccctggaacagcacgccccattttgctcatgctgtctccgcaaaagcaatccttagaatccacaccccttggaaatactactccccttccccaggaaaagaagctgaaatggaaatgaaggttgtcatgaccaggaacacatgagtggaagctggggcaggtgaaatgagaatgtttctatggcactgaaatgagaatgttccctccacccaggaatgactgtttctggacagtgaatgctttgtgcccttgtggggacagcgcctgtttactccaacccagccccagagctgaaaatttcctgtggctgccagccgtctacttcaggaaagttcccatcaagggagccaggcctctcccattttggctgcaaccccagtgtccctggtttcttgagagacatttggcctcttgggataaccagggccttctcctatgctcttcatagtgtggaactctcccccatcacagataagcctattttgtgactccacctgggtgtacttgggagcaacaaaatcaaacctcctgtaagaatatttttgtctgccaagacccgcagaggctagctaggatggagagggagacagggaagcatagccacggccctagtgccctcctttccccagatcctccacctcaaccctgctcccacattccttctcctggaaatccatcctttcagcactactgacaggacaggtccctccagcctccaacttcagggaagtgt

SEQ ID NO: 100352 - DNA, 1348 bp, Homo sapiens
atctgaatgcagtgagggcatgagctgtgcggatatatgggggaatagtgttgtaggcatagagaacagcaagccgtaaaacaaaaaaaagccagatgcagtggctcacgcctataatcccaacactttgggaggccaaggcaggaggatcacttgatgctgagagtttgagatcagccagagcgacaaagccagagtttagttgggcatagtggtgcatgtctgtagtcctagctagctactcgggacactgaggcaggaagatggcttaaatccaggagtttgaggctgcagtgagctatgatcctgtccctccactctagtctggctgacagagcaagaccttgtttcaaaaaaattaaaaaataaagcaagtacaaaaaaagactctccaacatatttaaagtacagcaagttggccagtatggccagagtagagtaagccagtggtaggaatcaggtctgagacgtcaccaggggccaggtcttgtagggccacatgggaccttgctttaagggcagtggaaaggcatggaggatttttaagcaaagaagtgacaggttttagaaggatctctctgatgtggagaacaaactctatgggtaagagcgggagcaggagaccagtgagaagccaggtgggtgataacagcagtttataccagggtggatgggtggtggaagtggcgagcagtggtcagagcttcaatacaatttgaaggttggaccaactggatttgctgatgtttgctggataagaggtgagagagaaaggagtccaggtttttggcttaagaaactggaaagtccttactgccatttaataaggggaagatgccttggctgatagtgatttcctgctagggctgtggagttgaactgcctgcattcaagtcctagtttgcttactgttttgtttttgttgttgttttgagatgaggtctcactatgttgcctgtgcttgtctcgaactcctgggctcaagtgatcctcccgcctctatcttcctgggattataggtacgccaccaggccctgcttactgtttgactttgagcaagtgtttgactttgccaagccttagtttccttcaatgtaagcctactgtctagatgataggcagttgggtgctgtgaaaactaaatgagggtaatttgtatgaagggcttaggacaatgcctggcatatggtaaaccttcagtaagagttagctctaatccttattactattgttggaagacaagaagtcccagggcctcaaggtcctctggaaagcaggcagcaggtcacactccacctccaccaccccctcaaggagcccgccctccaagaggcagctcagacaccat

SEQ ID NO: 100353 - DNA, 1066 bp, Homo sapiens
tagcccatgtcaggtactctacatgcattttctcatttaattccctcacctagactgtgtgctaaatggtccattagccctactttcttttccagtaaagaaactaaggtttggataagtgaagttgcatgccagggtcctgcagctttacgtggtgaatcctggatttggacctagattgggctggctctaaagccaggcttctttcccctgctccactcttggaataaatgaaggattgttggttcaggatatgcagaaagctgcttagcaaaaggagagttggagaagcatcttggtttgagggtcttgaaggacacctactgtactcccagctgagaggactctttctcctcatcttcaggaggatgcctccagagcctggggttactgtaggcctttgccagaggcatgttcggacttagccagctgagtatcccctgtttcctgcttttaccatctcagctgctggtcaggaggtttgggaaggtgacatcatctagctgaatcagctgctgcttctagatacattactggaactgaaagtcattaccccttccttcctgctctgcaagtctcttcagaatgaggctggagtatgggtgttccacctgtctgcagggtcatgactggaatggtacttgctgcttttaaagagctaaaaggtttttaaaagcttgttcatggaaaaagctttcctcaaggcttctcaagctaagggaacagagcgtccttgagaggcaggaggattcacaggaaggccctccccgactccctcttgtccacctacatttagccatatgacccttctgatctcctttgcctaagtccgaggcttaggcctagcactgtaggatgggtaaacaaaacgttatttgtggactttttgaccttaagacttttagagtctggtcaaggggacaaaaaaaaactgcttacatttcagagcagaccagccaccacactattggagatatattggagatctccccttgactcactaattgaaaagcaaaaaagggcaggtgtggtggctcatgcctgtaatctgagcactttaggaggc

SEQ ID NO: 100354 - DNA, 1114 bp, Homo sapiens
ttgtaaggatttaagagccttttgtaagaatgtatgtaagatcatatggtgcaggtattaaggtaattttagtaatatttaacaatgagcacttgcacttaagtgttttatatgagatagttcattgaattctcaaaatagtaccactcaggtaggttctcttattattcctatagagaagttaagaaagttgttcaaagatgcacagcgagtaagtggtaaaaccatgatttgaacccaggtagtctggctccaaagccaacttgtcctacctggataaggaaggccctagtaaatgttgctgttataactattgtatccagcattgtagttgtctgtagtttttggtctatccactgaattctgagctcagtgaagactagaaacccatttaatcaccttgcacccccagagaccaacataatactcataaaactcattaatatttgcttaatggctgagaatattctctttctttagtaatcaatcagtaactctttatcgaccagttcctgtaggctagctttgaactaaatcctaggaggaatgcaaagtacagctatgcctgtgtaaacggaagattgggtgtgtgcgttgggggggtgcattccagagagcactgtgtcattggcagaaacttccacacaggaggcagaaacaatacaggtggtttgaggatgttttccaagatgggattcccacccctccctgagggagtcacttcctccatctcctgcagaacaaggtgacacagattccctactccggccaagggcaaggaaccactctaagctcttcagtcactctaatccagaaactgtgtctttatggctcaggcaaccagttcatggcagcctagaatgacagggaaaaagctgggaagggaccttagaaaatcactcttgcccaatactccagccaaagtggtcttttaaaaaccaagttcaggctgggcgcggtggctcatgcctgtaatctcagcactttgggaggccgaggtgggtggatcatcaggtcgggagttcaagaccagcctggctaaggtggtggaaaccccgtctctgctaaaaatacaaaaattagccgggtgtggtgcacgcctgtaatcccagct

SEQ ID NO: 100355 - DNA, 1811 bp, Homo sapiens
cagctgctgagacttctctgtaattatttcatgggacacccatgtcccaggataaacagtccctccctcttactccagttggtgattaatattattgttaacattactattaatagtatctaacacttattgagtgcttactctatgccagccattgttcaaagtgctttacatgtattaatagatttcattctcacagcagcactctgaagtaggttcttttatccctgtttcacacatgaggaaactgaggtacagagaggttaagcaatttatgcaaagtagcacagttagtaagaggcaaagcctgggagggtagcttccaacctcccccttttaaacgctccactgtgttccctcgtccagtgcgctattgtctaggtgactgctggcattaatccagtgctcactatgtgacagcctttagtgacgctgtttttgttactatcccaacaaccttatcgttataggcactgagatttgggagggcttatagttagccagaggcagagtcagcatttgaaaccaggtctctcttactctgaagcctgtcctttttatctccagtccttaaaaatcttgcaaagtaggtgttgttaccttcattttatggttgagaaaattgaggctcagagaaaagtgatatacccagagcttcacaggctagtaccaagaagagctgggattcacactctactgtcttagtagtctgtattgtcatgattattctttttatgtgcatgataatactttcaatttaccaaactccttttataagttatttcccagtgaagtaggagaggtgggtatgttcagccctgtttccagaggggaaactaagataaggggtcttgtcccacagtaaatggcagcatcagacttagaattcatgttctggcttttaacacagtattatcaatactgtctgcctctcctaaagctggatgtgtggcttggagctgtccttggagtttcatttcttttgttaaatcagcaaatattgacaaatgctttgtaatgtgctaaatgctagtgatactgtggatattgtggtaactgagactgagtcccatccctcaatggtctgtttccatactccacaccttgggtcttgctggtgtccctctgccatctgaatcagtctacatgtgccatccatccttctcctcagctgccagacacaccaggcaagattcattatagttgatatgtattaatcaccttcaacacatacacagacaaaactctggcctcacatttgagacagcttgactccttgctggtggcataacacaaagcaaatcagcttcaaattctcatccataagcctgagagaataatgccaagccaccagagtaagtgaggcatgaatgagaaagtgaaatgtaagtgtgttttttggtaataataacagatactatgggttgagtagttacttgctctgtgccaggtgctgtgtttatcccctcaatataatcatcttacttggttctcacaaatgctctcctgtgaagatggagaatctagggttcagagaggctccctaatgtgtccacagtaacagatcttctaagaggcagagctgggtcttatactcagatgtgtctgatgcaaaagcctataagcgtcattgcttcttacaagcccagactggcttattttaccctgactacctggctcagggcccgcggttgggtgaggactcagccagggcctgctcaatgaacatgaagggttattattagatacaggttaggctacaaaaaaagtttctgcccctaaggaagcaaactcatttgaagcagtaggaa

SEQ ID NO: 100356 - DNA, 1136 bp, Homo sapiens
tttttggtatttttagtagacggggtttcaccatgttagtcaggatggtctcgatctcctgacctcgtgatccgcccgcctcagcctcctaaagtgctggaattacaggcgtgagccaccgtgccaggcctggtctgtattcttaagggtggcaacagggagcccagtgaagaggctggtgcaattgccaggtgaaaaagaatagtggcttggacctagaggtggaggtgtagtgagacggggactggagaataagaccaggcttgcacatggtatattgatgggtccagccatcctggaaaccatatttttcaactacttggaggtcctagaatcaaagttaagtaagatagatgttctttgggaatagttctctccaaatgtgatattctgatgaatggtcctcttccactccaacagtatttctgtctgagtaaatgaaatttgtctgagttcagttcccaactcatccgtgtctacctatgcaagctccttttacctctctgaatcttgggacaaataataatacctgcctcacagggggcgatggtaaagacacagtgaggtatacctgagatgcataaagactggagccatgttggtatcattattcttattatctttccacagaacgcatgtcagagacccattcacggaatcttgagcatccactctcctttttctaaataccatagtgacccatcagcacatctcagagcaggcccttgcagcatttctgttgtagtaggagctccacagtgtttgtgtgcaatggtggtgtaagcactggtcttggagttggaatcccagttctactctcagtctcaccttggccaagtcacttcacccccagtccccagtttccctttatgcaagatggagggtttgaagtaggcaataaaggaatgctggttctctctatccttaggccttgtggcggattccaccattacagcatatttcacattagttatattttaaaatggctctctcctgttgacagatatgtcagcaccttaactaaacccagtgtcaaggcaggctagtttatcactgagcccacaatagtgctaccctatatttatgtaacaccttacagcttccaaagcactttcagatccaccttgcctttttga

SEQ ID NO: 100357 - DNA, 1030 bp, Homo sapiens
ttgagaaacaaagtccctgtgatactttcctggaatgttgtatacatgaccttccccgaagggacacaagtgtttctggtgctttccaatgggaatgtgggaagggacccaggtgggccttgccactttgggattgctgtccctgaagaaatcccttagcctgatagaaacgtaattgttgggagcaatgaactgtgttgggggagaaaacataacttggcctttcttaagctgtatggctcagtggtctgagtttctgtagatctcttattgcctaatgtggcttcttcagatggatgtatgcttagttgaagcacctcagctccctttgcagatagtggcagttctgtggttttcttagggaaaccccattagaaaccccaaatgtggaaatttttagtaatctcattcgggtcccaaaattaagtagaagtgtctcaggggctcccccttgaaacacctacttcttctgagtgtacatttgaggttgctcttaaaattctgttaccatcacagggttttccagacttcctaggaataatttccccagtagccccacagagccctttagcttctgtcgaaaattacccgggtattttttcagggggctccaatggaacctggagggttttcttgacttttgtatgggtgtccccagatttgtttgggctgcatgaaacagcagttgttatctctgtcccttcccccagcagatatctgtcctgaggccagtgggcttgagcgtcctcctctgtgtccagtctccctggttttgccagtgccctcagccttccatcatggggctttcttgaagcaactgtggttttgcctgagtttaatgtggatagacataggggtaattcccagtgtactgcttttctacggaagtataatctcctactgccttaattaagcagaggccctgtccccacccaacctccaacctaattccacagagtcctccctaaggactccctcttttttctttgaaggagtcactctactcctggatcctcttctcttctgcccc

SEQ ID NO: 100358 - DNA, 1021 bp, Homo sapiens
gtaggcaagttttgctcttcagtgaattcagtcctgttttcttgcttatctccctacctagcggaggtgcaggttttatgagagatgttctatcccctcagagtatgcagaaaagcatcaagctgtggaaaataagtcatccattgaaggagctgaggtggaaggggacatgcaccatggactcaggaatgtcaagaatgcaactgtctataggctgggcctagggtgtggcaggcacttcactttaccactgagcaagagacctcctgagtttgccctggaaccccaccccctctctcattttgcatttctttgcaatttcaactcgtctgtgccagctcttgtaaaaggcaagggggtcaagtcaatagaggtcagataactggggtggggtcaggggaggtaaaggtggtgggttctcttgagctagctgactagacttgaaagccattctgtaaatgaactctctagggggataaatgattaaatagttcctgttggtttgtgcagtgacctctcctgttccctcctgctttgattctcttttggggcaaatatttgttcagctgattacaggagggacaggattccagtactgcagacacaccctctgaggcatctccaagtagggattgaggctgcttgcccactttgcctgactattgtctttggccagtggtcctaataccaggtgggttgttgccagctataaacaaaaggcagtctgggagaggtgcctggtctgctagccagcctctgcagaaggctacccctaccagagaattgccagctgcccagtggtgcatatgaaagaggtcttagacacagcaactctgggtaagtttattagatctccatggggttgaaattccatcttccatctctttgcttaagaatcatcagagcctgttggacaacataccacatgtcacttcctcttggtgaacagaggggatgtgtgtggaagagccagttatatcagaaccatttctgagcacacattctctccctaaggccaggg

SEQ ID NO: 100359 - DNA, 2211 bp, Homo sapiens
gatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaatgtaggtggtgcgggggagcgggagtggggcgggggggactgcccagggagtgactttccgaggaaggcatttcggagaagacgggggtagaaaaggctggtgggagattcagagtccactggtgctttcgatttgacttaagtgaagtatcttggaacctagacccagaccttcgtaagacccacaaagaaaccagttctggtacctggagggggaatggaatttttagggtaaatggcatgcatattaattatttttttttcctgaagctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggtaagaaccaagccccttgtgtgtcccttttctttggcctctggtcagagatccccaacagcccttcttctgtatctctttctgttgtgttgggtgattgttggagacgttgatagttgaggaaacctgactggcctcatttcaccacaagaggttaactccttggaaatacaaatgaccctgtgcttcagagatcaggcatctttcaccctggtcacccccatgactccactattccatacttgtgttccagtttctcagcaaagaaaactgtagcctatgtgttcattaagtcccaaacctgtgagggtaggaagttagttcggtgtttcccttaccttatacaatggttcacacacaaaggggtgatgagtataatgcctggagaagatgatgagcatcaatgacccacagacctctccatctgttccccccaaggggtctcagtcctatcctgggcttctctcccccaaatcaagttccctttatttcaaagtttgcgtgtatggcactctcctctcagactagggcatggccataggcaggagttcccactgggttgaatggctgagaattgtcagattttggggcagtgtaggctgtgcagattgtgtttgcactgcgccccctaagttcatttcccccaaagtgtgcgactttctgcatggttgccttgtttgtggagcacttgctgtgtcacacattaagccaggggactttgcacctcattgcctggggtcggttggggagctccagctgctctgcctgttactttccggccagagcccaggggcctcttcaagcactgtttgctggcaaagcaagaacctagtctttggggctctgtgggacattgagatttagtaacagacttcacatgcaggtataagttccagttctgtcatgtaactagctgtgtgaccttggacaggctgggttactttcttgaggcttagtttctttcactaaaaaatgtggcaagctctccttgccttacagtgtattgtaaatcttggcgataatgtgagcacagtgactgacaccagcaaattccctttccagggagggagagttctcctgcccatcactgagccagg

SEQ ID NO: 100360 - DNA, 1021 bp, Homo sapiens
tagggaaacttggtaaaaggggaataaagaacagtgagaaaagtataaaattgtatctagaggttactttggaaattaaaaataatgttatttgtacttagtaaaacaaagtagtaaaagtttgctctttttttttttttttttttgagacagtctcactgtgttgctcaggctggagtgcactggctggcgcaatcttggctcactgaagcttccgcttcccaggttcaagcgattctcctgcctcagtgtcccgagtagctgggattgcaggcgtgcaccaccatgcctggctaatttttgtatttttagtagagatggggtttcaccatgttggccaggctggtcttgaactcctgacctcaagtgatccacctgccttggcctcccaaagtgctgggattataggcgtgagccactgctcccggcctgttaacccttttttactacagagaacttggaacctgtttcatcacttttctgcttcttccaggttcttgatacatatttgccagacttcaagatttcagaaaaggggtgaaagagaagattgcaactttgagtcagacctgtaggcctgatagactgattaaaccacaggtaaggcagtgaccataggaataaggaacattaatatatcagcttcataagtgtttaaatgactaatgtaattttataaagtaacacatattttggaaggaaatttatttattatgaaaagcaaaaagaaaataaaatcacccactatcccacctctcagataaaccatggttagccttttgatagatttctttataatttttttctatgtctatatagtcattccttgatatccatggggaattggttctaagaccttcccaggatatcaaaattctcatatgcggccggttactgtggcttatgtctgtaatcccagcactttgggaggctgaggcaggcggatcacctgaggtcaagagtttgaaaccggctggccaacatggcaaaaccccatctctactaaaaatacaaaaattag

SEQ ID NO: 100361 - DNA, 1100 bp, Homo sapiens
atagcaaaactgagtttgtaatccttaaaaaagggcaatatgaaacatacaagtttgggagagaaatgataggaaatatatttgcttgaagtttctggacagtgatgaattagaacaagtgtccatgtgtcctgtgctgacttctgagtgttggacagtgagggattgtcattggattttaaattgacccaattttggaagcttcatagatctgtttctgtaaacagatccaatttcaacatagaagttagcaaacataaatgtggaaacacaaagtccattaaacttccttcagacttagtttgtgactttgattaacagttaaaattgcatgctggattatgttgccatttactgactgctgctaatcccttatatacaagaaaaaaatgtaggtgttttctctctgggtaagatgaaagtaactccactctattttacttgtggtaatgtaacaggatctcttatcccttgtgaaagtaggagaggatgtccctggagaaatggcactgcctgggatgggaccatcttaactaactatacttctaatgaagtcttgtcttactctgtttattctattatattaccagtttaactcatgactttctctttaatagaaataggcaagtcatatctcactgactggatagcaaggtgtttgagagcatctgtcacaccaaagtctttgttttgctcaggagctggtagtcccctatttcaccctgcttagaatgcaccctcttgcagctttccccaacccggtctgaacctgcaccttttgatttatagagcttgtcaagactagttatttttggtttgagagtgaagaaagatgggaggcaatgggaggttaatttcagatgaatgtgggaacaggttacattgctttgtctgcaatcttcctaatttgtatttgtcttccccttccatttatctcttaccctagaaaaagtcaacgttcattcttagcttgtagaactccgcaggtctgtctgtatcttttaagtattttttacatcaggaaaccatctctgatcctcttttatgctgttctccttctctgcacttccagagcgctctctgttaatgccctcttgcag

SEQ ID NO: 100362 - DNA, 1045 bp, Homo sapiens
agtagctgggattaaaggcacgtacccaccacgcccgctaatttttgtatttttagtagagacgggtttcaccatgttggcctggctgatctcgaactcctgacttcgtgatccgcctgccttggcctcccaaagtactgggattacaggcataagtcactgtgcccggccgagattttatatctctatctctgtctgtctgtctgtctgtctgtctatctatctatctatctatcgttttagtcttcgctttttggaaacaaaaatgggctataagacacgatggatggcattgaataggcagtttttagaggaacctaattggttcatagcatacaggataggctttttccttgggtctttgtaggaatattggtcattaatagctatttttccatgcagaatatttctagttttgcaagaatctgaagctgtggtagattcagataattttgaaatgtgaagctgattctcttgcttggcaacttgatttgtttgggggaatgtggttgacgcatgtgccttttttttttttttttttttggtgagacctgttgacagaaattcaatcttgattaagggacgcaggaaggcatccagttcccaccatgcctggggctctctcatttaaacagctgcctttggctctggcctgttccatttcccactaggccctgtggactttaattttggaagatttcacatcctcatatttattatttctgggggaggtagtgtcgtgaaaccgaaattacccagtagttagcttttcgttttcttgatgtacttgtcctatcagccttaattgaagagagtcagacttctcaatggatatgtatttatttattctctttttccagggagaggggatggtctcctgagttggccattctagaccaaaatatagcttaaaagaagcttttttaaagaacaggtcatgttaggaaaataatattttgtttttaaaatttcacctaaagattaagtgtacttaggtttgcacccctcgccgtttgttccccactaatcaaatgtagtcttagac

SEQ ID NO: 100363 - DNA, 1050 bp, Homo sapiens
cttaacttcatgaacacccttctttaattcacaaggtaagagggcagaaggatgtagaaagaacattgtgctgaagtcacgagcctcaggtccagatctggctctgtttttacgtaactgtgtgatactgggcaagtcatttaatctttctgatcttcagcttctaggttgggaataattgctgctttacaggattgttttgcatatcagaaagaatacatatttagtatatcatggcacctggcatgtaatgaacacctctggtaactgtttttaccatgatccttaggatttttgttgtgtgatcttggagaacccctttttgctttaagttaatatcttatagactgcaaaggttaggtgttaatcaaagtttcctcccaattctaaaatatcatgtttctacactaagtacctcaattagagcattgttataaagatacttgtggaattctggctgcagtgagcataggagagaccatgggaagatgatgttctctggggtctagattgatgtcactgtataaatgaaatatttgttataacagatgtttctggccgggtgcggttgctcatgcctgtaatcccagcactttgggtggccgaggcaggcagatcacctgaggtcaggagttcaagaccagcctggccaacatggtgaaaccccatctctactaaaaatagaaaaattagccaggcgtggtggcgcacgcttgtaaccccagctacttgggaggctgagggaagagaatcgcttgaacccaggaggtggaggttgcagtgaaccaagatcatgccactgcactccagcctgggcgacagagcaagacaccatctcaaacaaaacaaaacaaaaacaacaacaataacagatgtttctgagacactataaggaccagaagtacattatttttatttattttattttttgagacagagtctcgctctgtctcccaggctggagtgcagtggtgcggtcttggctcactgcagcctcccgggttgaagtgattctcaccgagtagctggaactacaggtgcagccaccac

SEQ ID NO: 100364 - DNA, 2085 bp, Homo sapiens
tcctatgctgcatgttgtgactcttacgtgtatttcaaagttgtcgtctttatactcagaaatagtattttttgagaatatttctaagaaaagacaacttatatttgacaaaactgtgttgaactcttactatgtataatgcactgtgttaagcaccttgatggttggatggatggatggatggatgaggtatacacaagtgagtaaaatctatctttgtttttaggaacttcgagtctactgggagagacatttacatagttaatataaaattggatgataagtgttacagtggagatataaacaaagcacaattggctttggagaggcaacaattttgtatgataggtggaaattgggaaagagttcatagagatttgacctggactttgaatgatggataagattttggttggtaggcataaaaattagtggtgtattttagaaattgggttattcagggcagagagagaataaattgggctagaggaggctagaaatgagaaaatggtaaattgagggaaaataatgacatggtgaatgtaaaacacctagcacagtgtagatacttatcaaactttgcctcttttaaaaaacatttagaaaatttatttatttattttatttttatttattattattttttttgagacagagttttgctcttcttgcccaggctggaatgcaatggcgcgatctcgactcactgcaactttcacctcccaggttcaagcgattctcctgcctcaccctcccgagtagctagaattacaggcgcctgccaccatgcccagctaattttttgtattttttaagtacagaagaggttttgccatgttggtcgggctgatcttgaactcctgacctcaggtgatccacccgcctcagcctctcgaagtgctgggattacaggcgtgagccactgctcctggcctaaaatttatttttaatttcaattttttctttttggtttttctttatatttgctgattacttaaagataatttttatttttttagagatagggtcaactacttacagataatttttatctttttagagacagggtcaactgttatacttagagataattttaatttatttagagacagggtctgtctatgttttgtaggctggacttggactcctggtctcatgtggtcctccctcctcccaaaatgctgggattacagacgtgagccactgtgtctggcccacttctttctaattccaaacatatctacctcaaggagtatctttaagttacctgaaaaactaatgtttaggttgattggacaaagtaaggctattttcagtaaattctaggtggtttgcaaaattacaaacgtggtagtaaaaccaaagtaatgatgggaatttacttagatttatgtgcaaccatttctttcctcagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttggtaagtgcctgctttctctggctattttaaggattagtggcttgctttgtgctgaagacctttcaataatagaaggggttgcaagaaaagaactaaaatatcaacttctttctgcaccaagacattctgtcatccatgatattatgggaataattgaaatgcccagtatttggggaatggattgtaagtacaaagcatatgttgttttgtagttcagaatggcagatttaagctttagggacctatgggaaagttcagatgaaccagtgttcaacaaaactccatgctcaaatatgtctgtagtgatggcagccacataaaaactttgtctactatcattagggatagattatatcacagctaggatattgacattcatacaatctaccagttttactcagatttctccagttttacttgtatgtgtattaagttctctgtggttttatcacctgtgttggtttatgtgtctaccatcacagtcaagatctttta

SEQ ID NO: 100365 - DNA, 2120 bp, Homo sapiens
tccattgcagctgtacttatccgtatagtgcactgtccaaatgtgttgacaggtgccattttttggaaaaggactttaatggcatctagtggggatcctgagaggagtcgtctgttggaagtggtgtgggaggaagggtaaataaatacaagggccagctgtcctgcggggatcttccccatgcccttgcttcactggaactgtaaggaaatggctgggctgtctgaggatttctttttctaagcttttctttaaaataaaaaagaaaagaaaagattagcctaagaatactgttaaatacaatttggaagaaaaaaaatgaccccactatttttccaaaactaccttagttttaaaacatttttatttttttttctttttgtttttgccagagttcttttggctaacaaaactacctcagttttaatatattactttccaatttctttcccaaataaatagtcacatctttctacacagttgcaatcagaatgtacatgcacagggtagttattgctgtgtctcactgcattcctgaaactatcagtaggctgttggtagaacagacccttcactgctttgtactgacttctgggcacagtagaatctaagataaaatttcttgagagaacctagctctgctctaccctcacacaccccttattcctcccaccaccccactgaggaggaaactctgtaagactatacagtatctcttgtaagccctacagtttttgatggttacagttttctttcgttttttttttttttttttttttgagatggagtcttgctctgtcgccaggctgtagtgcagtggtgcggtctcagcttactgcaaattccaccttccaggttcaagcgattcccctgcctcagcttctcaagtagctgggattaaaggcatgtgccaccacgcctggctaattttttgtattttagtagagacggggtttcaccatgttggccaagacagtctcgatctcctgacctcatgacccacccgcctcggcctcccaaagtgctgggattacaggtgtgagccatcgctcccggctggttacagttttctttaagaggaacatgatatatttagggagtagataaagccagttcatatttgtatgaccctaaatgtgtaccaaacaaagataaggagttattcacaatgcagaatctgtacttttccttttttataatacattgttcaatgttgccagtttttagtgattgttcttatagtctatctcggatgtgtaatgtgtactttttcttttgattgctagaactttgcttgtacttgccacatgagttggaagtgtactggtagggagctttagtttgcattttaaatgcgtgatagtgatttgttttgcttccttgctgatcagacaatgatgatcttcccttttcacagaggagaaggccaatttggagaataagttactggggaagaatggaactggagggctttttcagggcaaaactcctttgagaaaggctaatcttcagcaagctattgtcacacctttgaaaccaggtaagaaaacatcttagaaaaaagctccttgatagaatggtgggacagtgttttagaagcctgaggttctgggaaaattacctaaatgctctatctctttgtttattattggtgaaatgggctaattcatttcatgataaatgtaaaactaatgatgtgctacacttaaaaaaaaatctcttggagcttaagctaacatagaatttttttttttttttctttaagatggggtctggttctgtcacccaggctggtggagtacagtggcacagtcatagctcactgcagcctcaaactcctgagctcttagtaactgggactacaggtgctcaacaccatgcctgactgatttttaaaaaattttagtagaggagtctttgctagccaagctggtcttgacctccgggcttcaagtgatcttcctgcctcaggggcttcccaaagtgctgggattataggtgtgagctactgttcccgggggctaacatagaattttattgccagatacgtaactgttatctttttgtgacaagatttaatgtaacctaacctgggtctgggtgggaaataaaacagcaag

SEQ ID NO: 100366 - DNA, 1138 bp, Homo sapiens
ggctttggttcagtggctgatttttagctttttttttttttttttcgtacttgttcttcaagatgctgctctgtgtttcttagattttttcttttgcttgttgtctcactggcacaagatggctggtgtatctctaggtgttatatttatgtttaagagaagaagaagagtacagtaaaggaaaaagggcagcatctatatcaggaaacttaagtctttcgcagcaacccttaaatttcatttcattcgcctagacttgtgtcacttggattccctagttgcagtagaggctgttgaggcaagtacaatacttacttgtagcttagtgcgttgctgctcctcccgaaattggggttttgttaatgagaaagagacagaatagatattgggatggcaattaactctgccatttgatcatttgatggtgagcagttagagtccctccttactcttccaaaccaccactagataactcttatcttgatagcggttggctttctcaaagtttactcattgaagccattaatatatatgatctaatgatactgttggaagaatcatgtggtcgaagcatgcttgttatcctatagaatgagaaaatttaatccatatgcagtagatttggggaggagggtacaggctatgcttcagggaattgaaaacatattttttgtccttttgaactcaagttctaacaacaaaaagaagccagaggaagaaggcagtgctcatcaagatactgctgaaaagaatgcatcttccccagagaaagccaagggtagacatactgtgccttgtatgccacctgcaaagtaagtttctttcctgaatttaaactttagaatgaatggtataaaattacagatttacatctacaacctgtttggtgtacctggaggttggcaaactcctgaagctttgaccatggtgaggtgaattgttacatgtgtcctgatgggtgctcagatttttaaatttttatttaattaattaattttaaagacagggcctcattctgttgcctaggttggtgtgcagtgatgcaatcatggctcactgcatccttgacctcctgggcttacgtgatcctcccacctcagcctcccaagtagctgggactataggcatgcactatcat

SEQ ID NO: 100367 - DNA, 1034 bp, Homo sapiens
ggaataggaataggcttcttcatcagtctctttaggggatgtatggagagattccactgattcaggaagctgcctgacctgatgcatacccagaggcccaatcaatttttttttttaaagtggagttgagggtgagatttctttgcagtgctttttgtcttcaattctaagatagcttactctggattccttcaaaacattgacatggttggggggaaattacctatgtactattccagaacataagatttgttaagtgctagatcctttcttccatttttaattttttttaatgagaacagattagttataacccttgctcaaggactgacaaacttcagaataataatcttggttttacacaggccttttttattgatcctctgtgccgaatatgtggcttatggtagatgtgagctcttccgtgacatttcatttggggaacaacttttctctttacaggcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattagtaagtttcctaccagtatcacagttggatggaacctctcctacattccctctgcttacatcttaggcacagatttgtctttagctgaaatcctagtttttcaattaaagtatggcgtgtgactatgcagacaacaaatgtatccttcagaatttttcaaaccacccagctgtctgtcttatacccatcaaccgtcttgatcctcctcatcaataattggccaaggggaatgagttaaggtaacctgagatgtcattacacatccttaacggacatttttttgccatgtgtcaaagtgtcacattgcatttagttacctatagaaaatgaaggcatttcattcattcaaggctatgtgctttttattcagtggtccaccaaaatttttactactactaac

SEQ ID NO: 100368 - DNA, 1065 bp, Homo sapiens
ctgggcatggtggtgcatgcctgtaatcccagctgcttgggaggctgaggtgggaagatcacctgagtccagggaggttggatttgtagtgagcctttatgcccctgcactctagcctgggcaacagagtgagaccctgtctcaaaaaaaagaaagtcagtctaggcccgtgcagtgataaggaacctgtcagacatggatggattttcagttcagaagatgacagtagagtttacccaaaggctaccttagtcatacccctcaataaaagaggaataggggagaagtaactgaatgttggttggtttgaccaatgtaagctgagctgactgttgtgggcccaccactctgtggttggtttatccctctctgggctacataggtgaatcaccacttacaagtaaactgggtcttgcggatctagatgaacatctgtcatctctgtttacagacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacagtaagtcccactggcagtatctgaggaagagttccacgaacctgcctactttattttcagttctgttagggtgacagttgctatttttctttccgtaaaaatttatggcatttgagtagtaggctctgcaggctacgcccctgcctatatgatttaaggactatagtgggaatatggagatgttctggagtataaactggtaaaaattgaatccaggctgggtgtggtggttcacacctgtaatcccagtaccttgggaggccgaggcaagaggatcacttgagtccaggagtttgagaccagcctgggcaacatggtgaaaccccatctctacaacaaataccaaaaaaaaattagctgggcatggtggcatgcgtctgtagtcccacctactagggggcagcctgaacccaggaggtcaatgcttcagtgagccaagatcacgccaatatactccagcttgggtgacaaa

SEQ ID NO: 100369 - DNA, 1305 bp, Homo sapiens
gtggtgcctctaagctcactgcaacctccgcctcctgggttcaagagattctcctgcctcagcctccctagtagctgggattacaggtgtgcaccaccacgcccagctaatttttgtatttttagtagagatggggtttcactgtgttggccaggctggtcttgaactcctgacctcaaattatctgctcaccttggcttcccaaagtgctgggattacgggcatgagccaccgtgcctggcccattgtttttcgtttttatttattttattctgttgtccagtcaatgggagcataatcttaatgattactattctttgtggttggcttactttgtttgtgaagttttcattttattaaaattttttttgtggttatttaaattttcaccttacagatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtggtaaggttgaggctatgtgtgctggcagaagtgtactgctcatgaccagatatccacccattcacacaaaagtttgggtagatattatgagcagggcatcatattaggaactgcaggtgataaagagacttatcggaagtggattttgcttttagttaactcaaagtctggtatgggagacaatatatgtgtgaataatagaaaatggacagaagtgttctgagagagatgacagttaaaataggaattcagaggagaaaatggtttcttccagatagaaagttcagggtgtgctttgtagagaggcacatttgacctgagccttgacgatgtactgtagtaatagttattgtgttgctattgttgtcataatagctgacaattttactgtgtgccaggactgctctaagcccttttcatatattagcccattagttttgacaacaacccctttaggtgggttattttatcacctgtttcagatgaggtaaccgaggcacacagaggttatgtagtattcctagagcactcagctagtacatggtggagcaagtaagagttcagacactctagctacagagtctgtgatcctaatacctcattatatgcctctccattacatgatagaattttgacttgcagaaatgcaaatggactggattggcagaacattccaggcagtaggaattac

SEQ ID NO: 100370 - DNA, 1043 bp, Homo sapiens
gaggccaaggcaggaagattgcctgagcccaggagtttgagaccagctgggcaacatagtgagaccctgtctctacccaaaggggaaaaaaggatttaatcttctcatacagcttagtggagatcattttgtgatatctaattgagttgcttactcctttcagggtgttcctgaaaagaaggtacttccaatcaccgtccccaagtcaccagcctttgcattgaagaacagaattcgaatgcccaccaaagaagatgaggtgattccctgggagtaggggggttctttttccttctatatagtcagtcaatctaagccttatcatttattaatcttaatggagttcaaaggcaaccactcttttttggacttgtctttaagaatgggtatgaacatttgttcattttttttgttcctccaagaacaaagtaattggtaagggtatgaattttctgctcttagtgataactagttacaatttatggaaacagtaaggagcagttaagcattggaggcttgtctgctgtagcattgaaaatcagctgctctttgtaacatggatcaaaagttgcactttattttgccttagattgtcactattcagtgatggactttgaaaattcatactaagcaattacatccaccttgtcctatctccgttaacccagaggagttgcaaaggtgactgtggtgatcgtttatggaattgtaatatataaactgtcattggtcaggccagtttcttgttacatctcccattttatctataaatatccagagttagggtaattttatagcagattgcaagcataagcctttttataggttcatttgaaactaaaatacgcagtaatcttgtgttaccagcttgaacccaaacaacttgggtttggcaatcctattctgggtttggcaaccattaagtcccagtcacatgttttaatgaagtctagaggctgggtcaaagaagagactaaggtatatgcttggttgggaccgatcttctgatgttcattttattcataatgttagatcttatttag

SEQ ID NO: 100371 - DNA, 1783 bp, Homo sapiens
atgctgctttgaaaggtttccttccttatttttcagattcttccagatattctggagcagctattgctttccagctagtctttatcttaaacctcatgttttcttttctgttaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccaggtaggggatggggagagcagccaaaatgttaattgcttggttggttgattgtacaggcagacccaccatactgaaatcacctgggttaacatgctacattgtttcaggggctctcactgtaaatcaggggtcagcacattatttctgtaaagggccagataagaaatattttaggttttgtaggttacatatggtctctgtcgcatagtgtgtgtgtgtgtgtgtgtgtgtgtgtgtgtgtgtatgtgtgtgtgtacgcacacattttgttgttgttgttgttgttttttgagacagagccttgctgtgttgcccaggctggagtgcagtggcacaatctcggctcactgcaagctccgcctcctgggttcacgccagtctcctgcctcagcctcctgagtagctgggactacagacgcccaccaccaagcctggctaatttttttatatttttagtagggatggggtttcaccgtgttagccaggatggtctcaatttcctgacctcgtgatctgtccgcctcggcttcccgaagtgctgggattacaggtgtgagccaccacacccagctacatgttttcaactctttttttgtttggtttgagacagagtgtcgctctgtcacccaggctggagtgcagtagtgcgatctcggctcactgcaacctccgtctcccaggttcaagtgattctcccacctcagcctcccgagtagctgggattacaggcgcgtgccaccacgcccagctaatttttgtgtttttagtagagacaaggttttgccatgttggccaggctggtctcaaactcctgatctcaagtgatctgcccaccgtggcctcccaaagtgctgggattacaagcatgagctgctgtgcccaatcaactctttaaaaatgtaaaaaccattcttagctcaagcgctgtcctaaaacaggttgcaagctggatttggcctgtaggccagagtttgctgacccctgctctaagtgatcacctgggaatgtcccctgctccaagtgatcacccggggaatgtgggaaccgacaggcttttctggagttgggagtttctttaagatcttatctattccatctattagactcattcattgtgtttattcctttctgttgatgcattggtaagaaacagtatgggagaatagattgaaatatacaatgctgttttctcagcatgatgtgctatttgctctttataaatgacaggtgatttaaaacaattaattggttatttgctgatttaattgggatctaattctacgtggctggaaaaaatttcccctgaatttctaagttttttggatttttatgtcatcattaatcttggattctttccaaaaggagctctaggctattgtttgtttgtaggaattacccctcctgaagcccgagagttgtaatggcttacatgactgaacgttggtcccctgttagtgtggttctctaagaaaccttaggactgttgccttggaaatagtgaattttcccctctcaatgacca

SEQ ID NO: 100372 - DNA, 1064 bp, Homo sapiens
cttttggtgaatatttatagtcagtaaacttaagactgtactctgggaaattcttagcttgtaacttctctgctatacttgagtacagccctattataccctagtaaatcacacaggacataggtttggcattctttagtgaaagctgagggacttgaggagactgtggcctaaaggaaagctgggggacccaatagagacctgaatagaaacccttttgggctccaaagcacatacacttttccatcataccgtgttgccccccaggccccactccccacacctgaaactagtgactgggacctgtaaaactctacaaacattttctcaaaaagaaaaaaataaaagcaattataagcgtagttctctgacatccctctcactggtaacttttccttactttgcaggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccag

SEQ ID NO: 100373 - DNA, 1036 bp, Homo sapiens
tatatgtatatatatagtattcttttctttttctttcttttttgagacggagtttccctctgttgcccaggctggagtgcagtggcatgatctcagctcactgcaacctccgccttccgggttcaaacaattctcctgcctcagcctcctgagtagctgagattacaggcacgcaccaccacgcctggctaatttttgtgtttttagtgcagatgaggttttaccatgttggtcaggctggtcttgaactcctgacatcgtgatccacccgcctcggcctcccaaagtgctgggattacaggcgtgagccacagcacccagctggtattatttttcatttagcataatagtaactcatttttcctgtattattgcatactttgtaaataccaattttaacagcaggatgctattccattgttctgagtttgcttctccacattgaaagtgcttattttacaaaggatttttcttagctctatttgcaggacagaattgtctgcatttgcttccccctaacacatcatgtttgtctctaaactttattattattattgtttactagtcatcttttatttggaggtttattttcatttggataaaaagattcagcaatgatcacattcctcatggagggattctgggccaaggaggttatggtcaagagtgcggagtgtgctctccacactggcccctcttcggtggttcttatgtttgagctccttataagaaaggcagtggccaaaaggcacgtaagctgccagcaccatggaaaccctggtgacactcccttttttcatgttgtcatgcttgttgtatttaatagtatctgtggtaacctctttgaaacgcttcaacaatgcctttggtggtaaaatcagtatccagcttggcagctctactaatatgacatccatgaatgagtttcttcttcattggtatgactgatgccattgtggagtcctggtgtctgctgtctctaaactttaaatggtggttctcaaaccacttaccagtctatgtttgtaattaaaat

SEQ ID NO: 100374 - DNA, 2196 bp, Homo sapiens
ctggggagaggctggcctctccactactgggatcaagtctgtctggtacaatcttatcctctgcttgcccccctcattttttcagatcaagatcatctggataaagaaatagaaaaactgcggaagcaacttaaagtgaaggtcaaccgcctttttgaggcccaaggtattggcttagcagggactggagataagaaggggagggaatcatcagcatggactttgaagggcagggatgggaagtccgaccctcagagatgggcagtgtccggggcagcctgtgagtggccctggaggtgtgcacagtggttggttgtagctgcccagggacagaatggacagggggacttctacagtcctagtcctgtcatagtttcttttccaggtcccaggaaccgcttggggtgatctcacgttatacatcggggcatggcatggggatcagatagctctgactgaggaaactcagaaggcttcagtgagtgagtgaggtcagagctgaaattcttgataaatgcaagcactctagattggtcacaggtcttggaaaaacctgaggttctttgggcagcagagttacgcgtttgcaggctcttggtgacacaggagcagtggtgatgcctcatctggtgcattgcagaattggaggcccatccctgccagacctccaggctgagtttggcagcattagtgcagcgtcagcccctttcctgggcctggctccagagccagcaggaggcccgacgtgctgatggatcatcttctctcctaggcaaaccggagctgaagggttttaacttgaaccccctcaaccaggatgagcttaaagctctcaaggtcatcttgaaaggatgagactcaagaaccaagatgggggaccagcaaccccccagggtcatggaggacccaggaccctccaaccttgacacctgtaaggacaggatctgccctgtaaggggccagccgtcaggaatctggccatgaaaacctctttgtagtgcttggctactctgtgatggcaggagggaaccttcagcctgtctggctgctggacctggacaccagggctcggtggacacaagatctattgacgggccttggtagccaccagtgggtgtgtggggcagtggctgtgggggtgtaagaatgactgcaacaggcacttcccaacaatggcctgctgttcacatggaccctgagcaaggaaggagggagggaggggcagagtggagtgtcattccagcattcctctcagaagggagagaggttttcaggctggtgccatgcgattggaataaagcaggaggctcatgggtggttgctgaatgaagaacagaatcttggtgctttgtggctcaccacagccatctgtggggcaggcacacacacctcccgccagctccaattttgcactttttccctgcttgattccaagagtaggtgctgcctagcagcccttcgtggccactctttactcaggagggccttgcagagtcctgcaccaggcctgggtgagtggatgcgcctcttaccatatgacacgtgtcaagatgcccttccgccccctctgaaagtggggcccggccagcactgctcgttactgtctgccttcagtggtctgaggtcccagtatgaactgccgtgaagtcaaaactcttatgtgttcattaagggctcaataaatgttagctgaatgaatgaatagcagcaactagtctttatttgcctcatctagtccttcagtaagggcacgccactccatttagaatacaacctatgaacatggttcttgccttgaaataaacctgtgatttgacaggcgggtgataacaaatggcagcatggcaggggcacacctctcctggtccccccgctccttggctctggctcatagttacatagaaacacaggctgtcatggccagttcttacgtgttttcaagagaagctagacatatgggttgtgaagttgaatctccttttaaatatttttgactaatgcagaaacttttaaaacatgagtgtgggtcacaggtgttagctccagatagtgcaataccatacaactataatcaagaataaggaacaagctccaagatacatcaagtgaggaaagcaaggggaaggctggtgtcttataagctaataatttttgtgcaagcacagtgtgattccctcagaacagcacctgcagggt

SEQ ID NO: 100375 - DNA, 1027 bp, Homo sapiens
ccaggccggtctcgaggtcctggcctcaagtgatccacctgcctcggcctcccaaagtgctgggattacaggcgtgagccactgcgcccggccccttgctgttctgaacaccccaagcacactactgatctttgctgttcctgttgtttcctctgtttggctcactctttccccagatgtctgcagggctcacactctcactttccttaggtctctgtgtagatagcatataatcagtaaggccttctcagactacctgctatgattaacaaggtcctcctctggcattccctagccatcttagcctgctttatttttctctacaactcttaaggtctgacaaatcatatctttattctctctcctccactgtaacataagctccaagagggcaggaactttttcttgttctgctctgttgtctgtatctaaaacaatgcctggcagataataggtactcaaaaaaaaattgttgaaggaattactatttgctctttcagaagatgtgatggtttgcttcgggaacatgtttatcaagatgcctcaccctgagacaaaggaaatgattgaaaaaggtaaggcctcctggggatgggtcaggggtgtgctgcctctcccaccagctttggtcttaacccagaacagggagtcaggcttcaggcagcgtaaggagaggcagttctgtcacagggttcagactgctgtgggttttaattccacctctgccactgtgggttatttcctcatctctaagagggggatgcatctgtgtagcatagctgtgcagttgaggtaaaacaatatgtgtgcctagcatagtgctttcttattagtgaggaatcagttgggctgcagataacaaaacccaacaaattgaggcttaaggaaatatgcttcttttactcttgcataagaaattgtccagaggtgtgtactccagtcctggcatagatgcccagcagtggcaccttagcatattctcctggttgttgtttcatcgttgcaggcctcatgtcctcatgccagg

SEQ ID NO: 100376 - DNA, 1078 bp, Homo sapiens
accagcactcgtgcagtatactgtactactgcgtcacttccttagtagctattgtgttgttaccactgtctcagtgcccccaatcctgctgttccaatctagtattgttgggtttctcatattactagttcagaatcagctggagaagtttgtccaaaaataaacattaggcctgcttaatcacagtgtgtaggggaagggtttccactcccctggtgattctgatatgccctaaagttcgagtggataatgcagaatttcccatttagtcagcacatgttttctcagcatcttttctggggagagggcagctgcacaaagcattgtctttaagaccaggaagctgagtgagagaagaaatacattcacacatcaatccattttaggcaggacgttgaatgtaatcaggaataatgcattgcctctgcaacccttgtctgtcaagaggtgacagcttggggcaagagatagctgagttccctcctgtccctgtggttttcagattgtggacctggacactaaaaggaatcagaatcgagagggcctgagggccctgcagaaggatctcagcctctctggtaagttgaaattttctcagtgcagccctggaggcctgttccgttttcctttaaggcctttaccttgttcctgatagagatcaggcaggaggtcacagctgtataactcagccttgtgggaaattgaaacagtccggggagatgggggagcaaattttgcagttctggcacagactgtggttcaggattttgcctgctcacttcagtgacaggtcgttagctcctggcttatcaacgatggcagacactgagagagtgccgggggtgtataaaactgatggttcctgcccttgtgctttacagatgaggaaaacaacgtaaaatgcgtaattgaaaattgtaagaaagccagagatggaattggacttggggtgggtgttgagaatatatatccagaagaatgggacactttagatgaggccaagtggctgtggcagtggaagcaaatggggagtaagtatggctggagagagggacagagaccaggccataatgaaagg

SEQ ID NO: 100377 - DNA, 1022 bp, Homo sapiens
tgcagtagaggttggtagggggagctgtagtttctatattaaagtgctttgcagtgtctcaatggaagggaacaagtgggtgtcaagccgcatgggcagtagtagggttggggtttgagcccccttcccaaccatagaggcttctgagacctggggctggggaggaaaggagcttcaatgtgccattctggttggggagaggataggacatttctgggtccttggctgctgccggtagaggtatggggaggaaaaactctagagtgggagatgtggaagtggaaaaggaaggccctgtccaggcctggcctggtttctggagacagaaaactccccaggggacagagaggttacccccttgtgcttagcttctgccacccttcccttctctggaggagaaggctgccctctcctcagcaaccctggcctttattctatgcataaccactgcaagggcacccctggccaggctgaatgggtgggggtcccagggcacctgcaataatctcagaatggagggtatcctgggacaaagagggggtacagaaggtgccaggggggaaaaggtgattcctccatctctctctcacccaaatccccccagatcgaatctgacccttttccctggtctccattgtgctaaaccaccgaacttggaggagcctcatataaacatagcccccagccccactggctttccgaacccatcatgaaatagctggaaggtatctgaaccgttcccatagctccctcattattttcttccctgaggatcctgtggtttaggagatttttctcccaaaccagcctcatttcttgaagaagaattcattttcccatattaaattaactcaagctgagcttctgattgcagataaatgtttctaaggcctcaagtcaacttctagggcttgaaggtgggggaatatatgtattttattgagttgcttaatacaaaattctcaaaagcacttgtgggcactcattcctgccttcacaggccctcagggtctgggacccca

SEQ ID NO: 100378 - DNA, 1074 bp, Homo sapiens
gtctgtctttcacagtggaaggggctcagcttgcaaggtgaggtggggagtgatgcctgctggggaggccacagggcctgccacccctgggctctcatttcccaactgcttccgtttctaattccacggctccttttcagggatgtcaaaccctgaagtgatccgagctctggagcgtggataccggatgcctcgcccagagaactgcccagaggagctctacaacatcatgatgcgctgctggaaaaaccgtccggaggagcggccgaccttcgaatacatccagagtgtgctggatgacttctacacggccacagagagccagtaccaacagcagccatgatagggaggaccagggcagggccagggggtgcccaggtggtggctgcaaggtggctccagcaccatccgccagggcccacacccccttcctactcccagacacccaccctcgcttcagccacagtttcctcatctgtccagtgggtaggttggactggaaaatctctttttgactcttgcaatccacaatctgacattctcaggaagcccccaagttgatatttctatttcctggaatggttggattttagttacagctgtgatttggaagggaaactttcaaaatagtgaaatgaatatttaaataaaagatataaatgccaaagtctttaccaaaacgttggttttcctgtccttccaattcctgaatatctatttgccttcttgctgtatgacaagtcagaaatggtgaaggactctcccggggaccagaaatacaaagacaagtggggttcagactgggtgctgtggctcccacctataataccagtgctttgggagaccgaggagcgggggattgcttgagcccaggaggtcgaggccacagtgagctatgatcgtgccactgcactctagcctgagcgacacagtgagaccctgtttaaaaaaaaaaaaaaaagatgaagaagaagaaagaaaggaaaggaaagaaaattggggttcaatgcttgaggttttctaactgccctaaaatagttactggctatattagtttcctcttgctcctgtaac

SEQ ID NO: 100379 - DNA, 1020 bp, Homo sapiens
agattggccagatgtattgctgctagttgatgctatttatgggaaaggagattgcaaggcagagggctccagaaaaagttaacttctggttacagagaaatgcaagtgaatgaaataatttttcgttctcagggaaacttcctgttttctttggaagatgttaattgttcacacctttcaaactgggtggggtgaatttggagtggctgggggtacttttgagtcctagcagcccttcattagacagctgtttgggggagatatttctgagtgcccaacccacccccgcccccccaagaataaaacagatggggagggaaagaccttgattcttggttctcttgagctttataacattccaggtcacctgtatctttgccagtgatggcgtgttagattacagcacaaaaggcttctagattgccatcaccttgttccttgatatgctgcctttgaggtctcttttgctacttggaaaccaagtagcaaaagcaaaatgacgttgaatgggctggttcacatctcttaggactctttgcatggctctgaacatgcagaagatgattactaaatatttaattgacttttcagactgaacctctcatgggagttaatgaggcaatcaattaaaaattaaaagaaaatttaaaggaatttcctaagaagcaggtactttgctttttccttacagaaaagaactgcaggccaaacatcctctatcaggctatcaggaatatagaaggtgatgaagtcatagaatcataaaaagttggaacagtgtccaggggttttaccagaaacccatgaacttctagtccttgattctctgtgtattggaatattttttccgagatcagtatctgtagctttgataagtttctcagagggatttgtgacaccctccccaagattaaaaattgctgatctgtctgcttacccacatacctggtgccagaatccgctctgcataattcttaccttagcccactttctgcacatcttctgtggaactcatcccag

SEQ ID NO: 100380 - DNA, 1049 bp, Homo sapiens
ggggagacagttgctgtgtttattcccattttgcaggttaagtgacttgtctttgtttatactgtgggcaaaggcatcctctgttttcttcacaaaacagccagagtgatctttgttttggatccacagtcagtcttcagacttggagcacttggcttctatttacaccgcctcttcttgatttctagatagctcctctcttgcggcttcatcacctcctctgctttaaatggaaagagagagcgagtgcctctgccctgaatgcaagcagagatgccaccacagttcttgctgagctctgcaggactcatgtcaaataatgtgtgaggcacccagtgcagtgtctgacacaagtattccataactagtagccattttattctaatttaaataattctccatttgacagaatttcaggtgtagaggtgtctagtcgtacacagttattagtgcctcctctgtgactgtgttaggtcctggagataaaagcatggaaaggtgtctccctgacctcagggaacttaagagactttcttttcttacaccttaggaaggagaaaggagagaactggttcttgagcaagcccctgaaagggctgccttctccgtcagggctacgcatggctcagatgtttctggaacctctagctgacaaatttatctactgccaggtattgggggtcctggaccagttggaggcaggccttggagccagtttaaccaaaattgggtaggaccatctccccctaataccaactgtgccgaagtcttgccttgtagcgttgaacagagattggcctcagagcctgggctggcctctaccaactgtctgcagtggtgcagcttgtggccctgccacttaccatctgtggaccagtgcctgcctgccattgccctcctttcctcaccacaccatgctatcctccagccaccttgcctctccccgggaagcctgacccacttggtgccccagggtcctgatatcaggcccctcacaaatgtacctcccttctcctgggagctgctgtggaccctttggcaacccaagg

SEQ ID NO: 100381 - DNA, 1055 bp, Homo sapiens
gctcggcttcacagatgtcaacaaggtagagtgtctttggcgtgctcacaggaccgggagccacacctcacgagtcctgagcacttggggccacagaaaaggtggggctcggccacagcaagtttctccaggtgccctgggcatgatggtctgtcagaggtccgagtgctccgggcaagtccctgggaggtgctacagggaggtgaagccacaattcttaggaagttaggttccatttttgtaagattaaaacaacataaaaaaaaaaaccgtggaacttcatcagtatgtaggagagagggctaagtagtggtcaagagcgtgcaggctccctgggtttgaatccttcctctcccagttactagttgtctaagtgaccctgagcctgtggttccttagctgtaaaatgtatgcagcagcagtggcggggtaaattagcacattcgtgtgagcccttcccagcacagccctggagaatcagctaataatgtgatgattatagccctgattctcttatctttctttctaaactgaaagatattagttagggaataaattacaaaagtatgtgttttgaggtgcagcccctgtccccaaagggcgtctgtcctaactgggaagagaaccgacagtgggaggctctaagtctccagtcccagctgcctttcactggccattaattgcaggcgaggtcagagggagctccttttacactcaggttgtcacagaggaggtgggccatgagaagttggtgggcttttgctgagtggagttgggggtggcattctagttggagtgattgcagggtagagactggttcatggggcggtgggcacaggggagtctaggtgaactcatgtgacttagatgattacacccagttgtatcagggtcagatgatagaaggccttgaatgccagactttgagaaatgggcttttgtctgataagctgcagggagcccttgaagagcttctgagtaggggagtgatgagaacagtgttttaggaaggttggtacaaccaggcatgctgggtgaggcaagggccctaatac

SEQ ID NO: 100382 - DNA, 1077 bp, Homo sapiens
cgcgcccagccagaaatattacagctttgaaatacaatgtcaagcttttattgacctgaagaaatgttcacaaataccaactgaaaataacaaagtacatagtgtgatcccaatgttattgtttaaagcatacatatacacatatatacataaaaggttaaaggaattatatcaaaacagtgttattaagtgggagtatcaaatcattttatttttatatcgttctgtttaaatttttctgtaataaacatgtattactttttgttcatttgaatttcatgctacataccaaattatttttactttttttattacacaagtaagaatgcatatttctttcataatcagaaaaaataaataaattgactccaaatctcaccacccaagaactcttacagttgacattttagtgagttgaggtatttacattattttcccacaaacgaggtttgtggaatttaaagagattttccttttacgcatctacaggcatcaggtttgtggcctccttttcttgtgacagtttcagataagcactttctcctatcacttacactcctgtgtcagagcagcgctggttggcacctgagggtgtcagctgtcaccttgggggtggtccctgcaagagctgcctccatcttcaacaaccagcctcactctggcccttcgctgcaggaagacaccatggaggagtctgggtggaagttggtgcacggcgacgtcttcaggcccccccagtaccccatgatcctcagctccctgctgggctcaggcattcagctgttctgtatgatcctcatcgtcatctgtgagtgtgcccagcggggccgggcatgggggcatggcttcctcttccaggtgcctcaaggagagaagggtgggcttccctccctggagaaagggaaccaagctcctggcaccaagtgggcatgtcagtatctctgggccagacaggccgtctatctcagcaacagccccagccccagcccaggactggtgattcacctcacagccatttacagagcccaccatgtctcctccatcaatgaggcaacacatcattgctgtgagcttggc

SEQ ID NO: 100383 - DNA, 1050 bp, Homo sapiens
tagttttattctgacaagattgggagcactttgtacagtgttgttttttcccttcttttcttcacataatgtgccacatgtaatctcttcattttgacctcttcatctcttcacgttctcagtccactccttcctgttcctcccctacttcctccctggatggtgagctcctctgggatgctgaggtgccttcttcactgggagtccagatcagggctggggtcagcctcaagagattctggccaggagccctgtggtgggggcagggagtgtgcttctgctgcacaagtcgcctctccttctgtggagcccagaaggtcccctcccccttgcgcagcccccatcccgggcatcagggcctcgtgggggcctcatggtgccatgtctacaggtgccctttcccaccatggtggctctgctgtgcatgtggttcgggatctccctgcccctcgtctacttgggctactacttcggcttccgaaagcagccatatgacaaccctgtgcgcaccaaccagattccccggcagatccccgagcagcggtggtacatgaaccgatttgtggggtgagtcctccagcagaggcaagagcaggggaacgtggaagagggtacgcccccctccgccaccagaagggtgcggcaaccagagttcctgccgcttcagccggctctaatagagtttatgaaagcttaacttcactccaagatcaaggtgaccaggttgtaggcagacttggtgtcatcctaggaaccaggacaaggaaggggaaggatggaagggtatagtgagacaggttaagaccatcacttggaccttgggcaagtcaccccacctctctgcaccccagttgcccatctataaaatgaggagaataatgcccaccctgcctacctctcaagagattataatagtacagaaatatgccagaagaattagcaccaccacactcgtgtaggtgctctctcttcatgccagcttgggaaggagcttggggcttcctggtggcctggtctctaacaatgtcaacctctcgttctgtggcagca

SEQ ID NO: 100384 - DNA, 1131 bp, Homo sapiens
gcatgtggcataaggcctagcgcttggtaagctgctcaagtggtggtggctgctctataattttgatttggataagaatcattattttctacaagctgctgagttcaggctggggtctacccagagcaggtcagtcaacccctggcccctccctaaggacagtgtggctcaccccctgctctggggaagaggggccagagccacatgccaggcccacgggccctgatggtgtcatgatgatgtgtccactcctgcccttgtgacaggttggtgtgccaggggaaggggagcagggtggtcaagccagctgaagccccactgtgtgtccacaggctatctgggagaatcagttctattacctctttggcttcctgttccttgttttcatcatcctggtggtatcctgttcacaaatcagcatcgtcatggtgtacttccagctgtgtgcagaggtgaggagagcagggccaggaggcgggggagggagaactggatccagcattgaacgggttgatgaggctctgcggagaggctgggtctgggctcttcatgtggcccctgcttctggctctgagctcttgggccagtacgttgctgtgcctctcccagcctccatgtattcagctgtaccctgggcctaatgagataccttccagcttagttgtgtggggtactcaccacagctagatgaaaggacagtagatttgccagtgccaagtccactccagtagtagtttcttcaacaggctgatgcacactgggtggcctgccctccctctgggaactggccattggcagagtgggtgaagccagggtttgggatgaacagtccctctgggctgggaccctggctcctccatgagtagctctgggtcttgggcgggttgcttaacttcatgccatccgttcctcctccacatgatggggtgagtgagaggacctaacttggagggctgctctcaggattaaatgagtggattcatctatagcacttagagtggtgtttgccagccaggcacggtagctcacgcctgtaatcccagcattttgagaggctgaggcgggcagatcacaaggtcagaagatcgagaccatcctggctaacatggtgaaaccccatcgctactaaaa

SEQ ID NO: 100385 - DNA, 1335 bp, Homo sapiens
gcctggcccctgaggctatgagcattagggcaatacacaggcctggtccagatgaagcagagctgtgcccatgaaccctgcctgccgcttgccacccactggagcacgccccttcccctggccaggcctcagtttccccatgatatcagtgagagtggggccccagttcgccatgcagcctggcactaagcatgcaccctgtcttctttctgctcgtggccgcagctggacatcgtggagttcatcccctctctcctctactttggctacacggccctcatggtcttgtccttctggctgctaacgggtaccatcggcttctatgcagcctacatgtttgttcgcaagatctatgctgctgtgaagatagactgattggagtggaccacggccaagcttgctccgtcctcggacaggaagccaccctgcgtgggggactgcaggcacgcaaaataaaataactcctgctcgtttggaatgtaactcctggcacagtgttcctggatcctggggctgcgtggggggcgggagggcctgtagataatcttgcgtttttcgtcatcttattccagttctgtgggggatgagtttttttgtgggttgctttttcttcagtgctaagaaagttccctccaacaggaactctctgacctgtttattcaggtgtatttctggtttggatttttttttccttctttgttttaacaaatggatccaggatggataaatccaccgagataagggttttggtcactgtctccacctcagttcctcagggctgttggccaccctatgactaactggaagaggacacgccagagcttcagtgaggtttccgagcctctccctgcccatcctcaccactgaggccacgacaaagcacagctccagctcggacagcaccctcagtgccagccagcctctgccagacctctctttccctcttctccccagcctcctccagggctgcccaaggcagggtttccagccaggcctcggggtcatcttttcaccaggagcaaacccaagtcttagttgctacaagaaaatcccctggaagtactgggggccaggttccccagacagcaggaattgcccctgttcagagcagccggagtttgctggaccacaaggaagaagagaagagacttgcagtgaactgtttttgtgccaagaaaccctggacctggggccaagtatttcccaagccaagcatccacttgtctgtgtctgggaagggatggccaaggccgctagggtccttacccctcaggatcactccccagccctttcctcaggaggtaccgctctccaaggtgtgctagcagtgggccc

SEQ ID NO: 100386 - DNA, 1113 bp, Homo sapiens
cccaccaatgcctagccatctcctttcccatgagttttgcccagaccaccatcagccctgttgcccgcccccaggtctacaggaacctccatagccgcttgtggacccaggtgggccacctgccaatgcacaggagagcccctaatccccaggaactctgccaaactggcctatctgggcatgtgagtgaggcaggggcaaggatgggatcccctcctgagccccagttactggaccccacagaatccaggtgctctgccagcccccctgcctctacctgttaggctgccaagctgtgggtgctggggagggggtcttcctggtcctggggcctgtctatccatacccagatctcacaccatttttttctttaaatgatggcttagaaacaaaaaataacaactgaagaaaaagattttttcttaaactcaacaagaaagactttcgtgttcagtttgcctctcttcgtctccagagagggagggtttgccctgtagactgccagcattctctcttcccctataccttaccctctttagcaaggcctagaatcttccaaaggggacagtccaaggctgctgaacagagagaccaggaagtccccagagcggggatagttaatattccattttatgctgtgttcttttagactaaccccaactctttcttacccttccaccaagtccgaacccctctaggtataagagctgagctgcccaccccctcctccccctgcttgcagagctgtctgtctccatttcattttaggggaaggggtggtagtggccatacccaggccccttcccatggaaggccttatcttctgttccctaggacctggggaggccttatcacaaaataatgtggagggtgcttttggcagggaagtacaaaaggaaccagagccagctgaaaaggcaggatggctgagagatggtagaaggaggagagcccttgattttggttaatacatagagacagggtctcactatgttgcccaggctggtcttgaactcctgggctcaagcgatctgcccaccttggcctcccaaagtgctaaaattataggtgtgagccactgtgcccatctgattttttttttttcttcaagac

SEQ ID NO: 100387 - DNA, 1057 bp, Homo sapiens
aactggctttaaacactgaaattgcatgtaactggaaaatgccagatgtagagcagtctttgggttaggcttgatccagtggctccaacatggctggcctcagcattcctatttctctctgctctgtcttgtgtagttgtgacttcatccacaggccctacaaagtagatttcccctttgtgtgggagtgagcagaatgctgcctggattccagacctgccattctcacacattgccagccagaaggaagcaaccctttctgggctctcaggagaggactcaccacagaagccccaataagcatcctgtttcattggccttgatgggattctgtgccatccccaaaccagttaccatatgccagtgacaacaagactgaaacaggagtggtttctcaaaggaaatttggggcactcttaagatgaagaattgatgctggttgtccaagaaaggacaaatgttcaccctagtcactgcccaaggtgtacagctggtgacagctaggacctgaccttacctatacttgtgcccaaccaccgggttcaggcagactgctgagaggcttacatagcttcacctgactttggtggtctctaatgaaggtcgttaccaccatcctgggtgccagcccttgtgctgagatcctcccatcaggggctcagactgaactggcttttctgtggtctggagccagtgtctatggccaagcagtgcaagtcacttgcagtccagccaagagcctatggggccgttaacaagtgcaggtgttttatgtacaaaggaagtgggctgacccttcatttttgaccttccacttgacaaatgttcactgtccaccccagtaggttaaaaccctagctaggaccctaaggaaatccaccttgctccctagggagtgtataccacagtataggtctgagggctcagatgagggagctgttgtatccatttgtcaggaaaaggctgaaagctttctggaagaggtggcaaggacttccacgcagaggtggagggggattggaggtactgacctccataggccacagtttgggagctg

SEQ ID NO: 100388 - DNA, 1119 bp, Homo sapiens
cagcctaagccagtactccttgtttgaggtaaaagccttaaaatttagctccctagctcttgattagaagcaatttggagtaagtgtgttttgatttaggcagggtagcttgggatacctttttaaaaacaccagatattaaaatgtctggcaaggttagaatcagactagatgatttgcttctaaaaattagtttcagtgagtcccagggactaattaaggtttattttaaaaagtgtctaccttggtacgcagccacctcctgcatgctgtgcatgttattgggacttgtattataggtgatggtatgtgagaatccagttgggactcgctgttgccatcctctttgttgtatctggttttcatcactagactcagcaacccttctcaccttaactgccaccttccctacactctcagtttacagaggccactgggcctctggctgcagaatacaaagtcccgggctgttagaggagtcctttcctctctgcctgccctttcctgtccctccctcgaattctctctccccgtaagtgatgctggaaaagtcataggactggcaaagcaactgtttaaaccctttgtaaccggggccttgcccccacctcctgtcttttctccttgccttccccactcctgtgtcctcccatctatcctgtctttcctttcctcctctcagtgtcctcagcacccacaaggaattttcctatcactgtgaactttgctggtacagaggaataatatctgccttcacctttttttttttggaccatagctagccagtcatttcttaaacctcccttcctaaaatctggggggtcggggggaaagaaaaaaaaagccttagtggcctggttgttcaaaggataagaatagctttatcctgcactcagtacccgaactcacttcagtatgcttactgaggccatgagaacctgaggggcatctgcccaggacaggagccatggcatatgacaaagaccaatgagggaccaggaaaaaaagtgatgtcccctttccctgccacctccagcctctgccagcaatgagctgtccccctcccaccctacacagtagctggtcagggctgagtacagtcctgggggtaaggggatg

SEQ ID NO: 100389 - DNA, 1895 bp, Homo sapiens
atgtggacttctcccacctactgggctttcttccactcaacctgcccccgtgtaacccacctggggccacaggaggcctggtcatgggctactcccaggctgaggcacagcccctgcttaccactttgcaagctcagcctcaagattccccaggagctgggggaccactgaactttgggcctctgcactccttgcctcctgtcttcacgtctggcctgagtagcaccaccctgcctcgtttccatcaagcattccagtagcccccacagaggccctcagctcagtttttggctctgttatggagccttagtacccaccccgtctgtgtcccccatgaaggcagctgagctttcagagctgggttcaaaaaaaaaaattccagtgtctgtatacaggagcacttggtttgggggttcaggctctaggatcgattccagaaggagccttgagccccaaccccgtgaaaagatctcataccgtaggacttcaggtattatttacttttatttttttgacctgaatcgggagccacacttggccctcttcctctccaaagcgccagaacctccttctctttggagaatggggaggcctcttggagacacagagggtttcaccttggatgacctctagagaaattgcccaagaagcccaccttctggtcccaacctgcagaccccacagcagtcagttggtcaggccctgctgtagaaggtcacttggctccattgcctgcttccaaccaatgggcaggagagaaggcctttatttctcgcccacccattcctcctgtaccagcacctccgttttcagtcagtgttgtccagcaacggtaccgtttacacagtcacctcagacacaccatttcacctcccttgccaagctgttagccttagagtgattgcagtgaacactgtttacacaccgtgaatccattcccatcagtccattccagttggcaccagcctgaaccatttggtacctggtgttaactggagtcctgtttacaaggtggagtcggggcttgctgacttctcttcatttgaggtcacatttttcccccgtggggaaataaactgactttggactgcttcagtctctgccatcttccatgactgcatttgttcctgcctgcctcggcggtatccacagaagacaggcaagaggattggagcagttttctcacaggtctgcaattctgtttttctccaagtacattatgaccccctcatccttctcttgaactggagaggggaagaaatgaaaggcatgcccacgtccgtcacctccccatcccctagtccccaccttgaacatcatgagctgttgttattagtcttggaagcagagtctgggttggtgtggatagcaaaggaggaagtctgagcccctcattggtcttcctcccacctgtcccttttccgggaagttgtggaattgttggaagaagagtttgcagaaggttaggaatgggtagatagctaagtcctaatctatgggtacattgttgtgtcccaaaccaaaattttccttatccacaatgtcccttctgtctcttccactttacagtggactcggccactgtgcataggcttctctgctctccatcaaatcacttccactttcctgtgcccccacccccgcctccagttttccgctagtatccggcaaggtttcttgcaacaaatgattagttcttttcttctgactcgtggggctccctgctgcagagagcacagcccttgcctggagcccaggaaccccatccttgcttcatctcagttcttcatgggcttcactcttcccactcacggaagggaggtagctcagggacctccactgtgggacccttgagacgcttccactctgattcagaaacacacttctacctcttt

SEQ ID NO: 100390 - DNA, 1032 bp, Homo sapiens
gatcgagaccacggtgaaaccccgtctctactaaaaatacaaaaaaaattagctgggcgcggtggcaggcgcctgtagtcccagctaccgggaggctgaggcaggagaatggtgtgaacccaggaggcagagcttgcagtgagccgagatcacaccactgcactccagcctgggcgacagagcgagactccgtctcaaaaaaaaagaaatgagatagattggcctgatgcacagtcatccaaccatccattcatctatccaacattattgagctcttgctctgtaccaggcacagtgctcggtgcaaggggcggagtagtgagccagacagatgggggtgctggtcctccttgggtttatggtcttaatagtgggtacagacagtaaacaagtaaatacatgaacaagatgaccacaaagcctcagttcctcatctggaaaacagttaataggaagggactaaaataggcaacagggtagcatggtagtcaggattgccctcttgacaattctgtggtcctcaggagtgcttagattctctgtgtgctcctataagttaagggaactccagtcaaggccatactcttaggctttcttttttttcttttttttttgagacagggtctcacttttgcccaagctggagtatagtggcgtgattataactaactgcagcctcaaactcctgggctcaagtgatcctcctgcctcagcctcctgagtagctaggatcacaggcatgtaccaccaccacacccgctaatttttgcatgtttcctagagacaggatctcttccctgtgttgtgcagggtgatctcaaattcctggcctcaagcagtccctccaccttagcctcccaaagtattgggattactggcatgagccactgcacccggccttcttagactttcttaatgatgatctggttgccagtgggcggctgcaggaaaggtcctgggtcaggaggcaggagccctgactcatcacatataatttactgtgtgatcttaggtgagttgctagacctcttt

SEQ ID NO: 100391 - DNA, 1102 bp, Homo sapiens
gtgtggagtttccagggctaggctcctctctcacatcagccaaattgatgtgacttgtttccttctggctgccattcccaactttccagaggctgaggtgcatgatttcaaattgaagggggagtagaatttgactttgaaggtaggggtaattccctccaatctaaacatgcacactcgagcacactctctgctcaattccaaggtgcatagtaattgctggtattacaaacaggtaattccacccttgcaaaggaggaggggacttaaacaatgaaagccagacgtcacaggcctttgaggtttatagtgaagcaggcacatatgccataatgacttgaaggctcaagtgggactagtttttagtgctacctacccctccccagcatgtgattcatgcaaaatgcagccaccttaatgcagatctttctagacaaatctacactcgtgatggggacgtgtttatcatattacatcgcagtgtttcttcaacaagaggaatggttcctgaacaggacgtagctcatgttaatgatgagcaaagctctctggggcatgaacccgctgatcccatcatcttgttcacggccagtctgttggatgaatggtcactgtaagcagcaggtgctaatgagctgagcaagcattctgtggcccacagctagtttgtgcagttggagccctccccagattctcgtggataatccccagacacccccttttctctcttcacatggaaaagcctcatgatcaaattttggcaccatctcttcaaagggaatccccctgttgtagcaggttgcatcgtggttggtaatctgtggtaagcttgggagtatgaatgtgggtctcttgtccccttttgagagtcagtgtggtaactcccatcctcttcctctggattagtatctggaatggagttgtgtcgttcttgcacatctccccttctattcaacaagagaaagaatcagactttaagatttcggctccccacttgggaatggctgcgaacccagtttaaaccagaactacctgggcctaggttggtccctgagaatcaacctgcattcagtgactagtttacctatctgaaataaagtta

SEQ ID NO: 100392 - DNA, 1044 bp, Homo sapiens
cctagagtcctcagttaatggaaaccattgatgttctgataatttcgcactcactatttttttttttttgagatggagtcttgctctcttgccaggctggagtgcagtggcacgatctcagctcactgcaacttctgcctcccgggttcaagcgattctcctgcctcagcctcctgattaactgggactacaggcgcaccaccacgcccagctaatttttgtatttttagtagagacagggtttcaccatgttggccaggatggtgtcaatctcttgacctcatgatgtgcctgccttggcctcccaaagtgctgggattataggcataagccactgcgcctggcctcgcactcactattacagtgtagacattgcccatccatctccctctggcttgcttgcctctgtctccttgccttctcagccagttgtctttccaagtccccacttccttgctttctgtggcttactaacctgctccaacaaggctcttcttcgccactgttagcattctcactgaggtcaccagtgacctccaaattggcaggggttatttcccagtctttctctcacctgacctcccactggcacttgaccctgcaagcttctccttcctgaacttccctgttccaagacaccacctgtccctgctacaatctaacctctcagcattttcctctttccactgtatcaggggctcctttctctccacccactgtttagatgttagtgtttctcctctttctgtttgcttactagctatgtgacctcagatgttatctagattctgtatgcttgggtttcttcataagtaacctggagatggttatattcctacctcaggattaaatgtgcaaatctatgtaaagtgatgagtgcagtacctagcactgtgtcaacatgcaataaatattagttgctattattaccattacttgctttgctataaatatctgttgactcctgtggcttttactcttctccgtgtacctcccaaatttatctgtggcccagactcagactcctccataattacaggcctg

SEQ ID NO: 100393 - DNA, 1180 bp, Homo sapiens
gccccctgagaagcgggtggcatactgctttgaggtggcagcccagcgaagcccagataagaagacgtgccccatgaaggtgggtcctgtgggttcgggggccctttcttcctgttccatgtcctctaggcccccaagactatgtcatggcaaaatgtggggaaaagcaccagaaggacttagaatagaaagatggagatttaagtcctgtttctggcatttgttagcgaagctgcatcaccttgggcagaagactttgcttctctgaaccttcatttctacctacaaaatagagatgccagtccctgctctgtctcactcctaaagtgtcatgagggccaggtgaaaaagtgcttgtaaactgcaaagtgccacatcagtaataataactaatattcatgtagcacttactatgtatgtcaggtaccacgctaagagctttacatgtatcaactcatttaatactcacactgttccatgaggaaaatacttataatatccccacttcatagagaggacaccgaggatggcacagagagggtcagtgtcttacccaggatcacacagcaaacaagtggtagagctgggattcaaccttaggtaatttggcaccattgtctacccacttaacttgaataccttcctgcatctcagcaggtaaatgagaggctgtcatatcttattaaaagaaatttatacatttctggcactttggaaataaacccccaagtatgtctttcggtgtatgtgctaaagtcttgggaaagtggttggaagaactatgaaatttgagaaaggagacctagctcacagccccaacagtgcccttactggctgtgtaaccttgggtaagtgtctgaccctcagtgggccttggtttccaccttgaaaatgaaggcattggattagccaatcttgaatgtctcttgaagctctagtccttggttcaaaatccaaggtctgcttctccccagaccctcatcagtgctgctgggtcagcaggatgtgacatgtgaacaggaaagactctcctgctggaatccagaattgaagccacggcactctgctcagcccctggcctaggaattgcagagtgacatttctcctaggccatcctgtgagagtgttttggcctgagtcacatcacccagcttcccccacctacacttccctggcccca

SEQ ID NO: 100394 - DNA, 1221 bp, Homo sapiens
gggaacatactaattcatgtgcggtcaaagcacttggcatttaatagggcaaaggtaaacagatgtagagaaatgagtctcatgcctgtaatcccagcactttgggaggccaaggtgggtggatcacttgagcctaagagatcaaggctgcagtgagccatgatggtacccctgcactccagcccaggttacagagcaagggcctgtctcagcaaaacaaaacaagcacaggccaaggagtgagatagccagcgctgatggtatctgcctcgtagtgcatgaagtgcatgtcatacactaagcagccagccagtgttggctgtcagtgttattactcacatgctttattttatttaagactttgagatagttcatgaagtgggtattattatcaatttccattttataggtgaggaaactgagcccagtgaagttaaataacttcccaaggtcattgagctgttgagtggacagctcaggtctgtttgtaaatctttaataaataacaacagctaagattcatttagtgtcttctatgtgccagacactgttctaagtcttcacaggtattgactcacttaatctttccctgagtctgtgggttgttactgccatctgtgctttacacttagagaaattgaagcagaaaggaataaggtcccttgcccaaggtcataaagcttgaagttgcagagcttggttttgaacccagaagtctgaatccaaagcaccagttactttatatatttatatttgaaatgggtcttgcttgtctcccaggctggagtacagtagcatgatcataactcactataacctcaaatccctgggctcaagcaatcctccccgctccgcctcccaagcagctgggagtgcaggcatgtgccaccatgcctgacgaatattttgttttgttttgtacaaacagggtcttgctatgttgcccaggctggtcttaaactcctggcctcaagtgatcctcccacctcagcctcccaaagtgctgggattacaagcatgagctgctgcgcccagtcccaaagcacctgttcttaatcacagtggattaaatagctgtgcctttaacagctgccagttcccttctgggacttgcctttggacctagctttggacctagttcatgtgccactgaggatcctcagtcatggcagatttaaatcttcctcattgttgatcccagatagcacactcccattctct

SEQ ID NO: 100395 - DNA, 1051 bp, Homo sapiens
ccaggaaaaaaagaaagaaaaaaaagccaccaactctaaaagcaactccaaaagcaaattccaaaaagctagaaaaagcacacaatcctagtaggaagagaaaggacaatggtgcatggggagtgttgttgaaacacttgtttattgccccatagctttgtttgagttcattgagttgtaagaattacatgagggtttgaagaagtttgtgccttacagccaagtttttgggaaaggaaaattagtagggaagatgaggtccctagagggagtttgagggagttgatggtcccttggcagctgcctgtcttccttcaacacatatttaagaagcacttcctgagtgtcaagggctggtttggatgctggggatataggccagaataaggacatgaacaaggcagggaatgaacaaggccagaataaggcagataaggtccctgccccaatggaactcatagtctaacaggggagatagtgaataaacttttacataggatagttccagagtgagatggtgcttagaaggatataaacaggtggtatgtgattggcagggctaagaccagaaggatgagaaggagccagttgtgtcagagttagaggaaaagtagttcacagcaggaagtcaggagcaaagaccctgaggcaggaataagcttggtatggtgaaggagcagaaagaaggcaatgtggtatggagtgagtgagagaatggtaggatgttgctcttatctgttgctgcataataaatcactacaaaacgtagtagcataacaacaagtttttttttttttttttttgagacggaatctcactctgtcaccaaggctggagtctcggctcactgccagctccacctcccgggttcatgccattctcctgcctcagcctcccaagtagctgggactacaggcgcccgccaccacgcccggctgatttttttgtatttttagtagagacggggtttcaccgtgttagccaggatggtctcgatctcttgcccttgtgatccacccgcctcggcctcccaaagtgctgggattacagg

SEQ ID NO: 100396 - DNA, 1050 bp, Homo sapiens
ggggcttgggagggcatgataggggcacctgcagacccctgctcccttccatagcgcagggactatgcctgtcttgttttcctccaggtcccaatacatagtaggcaatcaataaatgttttttaaatgttgaatgaatgattcaaatccagtatacatagtccctgtgagtgtgacctggccgttgcttctgtaagcagctgcatgtcccagtcctgccatgtaggtaaaagggcaaaggcttggtccagacaccccaccctggaatgaattactgcaccgcagattggaagccagtgtgacatataaaaggttggaatgctctcctgtaaagttttaattgttcgacaagcaaagagggttgtaaattccatgtggcgggacagtattgcatattgtgcctgttgccgccgccaccaaggttccttatcagcccgttggtatttcacaacctctcgtgtttcttgcgtgttgcaggggcccctccgcagggtctctggggcatggtgcaacaccatcctttttcccgtgggggtggcagccaggctctctgtgcgtcctctgacttccctcattccatctcctgtctagattttctccaaaggaacatccggtgcttgccctgccaggagccccagcccagttccccgtcctagaggaacacaggccactacagaagtacatggtatggtcagacgaaatggtgaagacgggagaggcccagattcatgcccaccttgtccggccctatgtgggcattcatctgcgcattggctctgactgggtaacttcccccttcctctctcactggctaacttggatgtgtccctgagcatggccctggcctgtagggatcggccccgcgtcccagccagagcagagatctctcacttgttctggttcgtgggattgtgtcccatcatcccactgcagcacatatcaaaatgtaactccagagtgcctgccagccaggtctcactttagcagcagctgtttttatcctcattttacagatggataaactgagagatcaagccagaccccaggtca

SEQ ID NO: 100397 - DNA, 1015 bp, Homo sapiens
ttctcatttctattttctgttcaaagaagctcagcaaataatctattaatagtaactacaacaaaaataataataagctttcactggcctgaaaataaagatccttcctctcctcagttctccttctgtccttagtggaattgacagaaaaaacccatagcctgaaggcaaatcctgcactctggattatgttgtcaaagtgaattcaaattcttgcttgaaacctggtttatttcagggttgagacctttcccttgaaataacattatttaagggcaagcaggtttggtttgtttttacatctaatcctttattgatcatcagcccaggatgccaagcataaccaggtaaacagtgagaatggaagaaacagaaggcatttcccagaaaccccattcctcaagtgcagtgactcagaacaatgcccacctgggggcagcaccccggggaggataccccacccctctgaaaaatccacctttgcaaaaaaattggcaacacattgatccatttgatattcatctcctccagtgtgggggatgttttcccctctctgacactgcacaagctggtttaggaggtcctgggcaggcactggcagaaggcaagaattatcttttcagtttttctcaatcctgctaacaatgcccaaagagaaagtctcagttcagtgctattgtgtcattaactcctctctactgcttgctaataatctgtccttgtaacagagtagacctcagagtcagacaatcttagttttctggaatttagtaacactattactaagtaaataaatgaattatttatttatttatttatttatttattgagacaggttctcactcttgcccaggatggagtacagtggcttgatcttggctcactgcagcctcaacctcccaggctcaagccattctttcacctcagcctcccaagcagctgggatcacaggcacgcaccactgcaccagctaacttttgtatttttagtacagatggggtttcgctgtgttgcc

SEQ ID NO: 100398 - DNA, 1040 bp, Homo sapiens
ctctcccatgaattactgtgtcctttcctcatgatggcatctggcgccatatggttaaagcctgcttgcttgtctgttttcctcagtggactcggagctttgtgattcacactcacattgcatccccaggacctaacataaagggtctgcttaatatgttctaagtggggttaatactttgtagaaacaagcaaaaaaaaaaaatttgttaaagctgaaattcatgtatctgaagaaactgtatcttcagtgttaccaagaagcctctagtgaagctgccccagtccctcaccagtgatggatgggcacagctgagcacagtgtattttttcccagagtttgtcccttttggctcagtcctgagctctttatctttcacaggctcccctgtgaggaattatgttctgagagaaaccgttcatgagatggattctactttgtttctcactcaggccatggagagtaagttgcttgttggaggaaaaaatatagtagatcatacgaatgaacagcagaaaatcctggagcagaaacgacaggaaattgcagagcaggtaacttttcattctttttcagggagaatgggtgaggtaaggtgtgtttatgctgcagagcaaacgtctcatattagactctcttcaaagagaatgagagcaaggtgtgtctgcctcatcctagctggagactctgatcctagcttggggaacccagcatagacacagtctctagggcaagctgatgaattttgtcatgttgctcagaaacgtcgagaaagagaaatccagcaacagatggaaagtcgagatgaggagaccttggaacttaaagagacatacagctcattgcagcaagaggtggacatcaagaccaaaaaactcaaaaaggtatgaaaggaatgaggccagatggagttgccttgagacttggggaaagggagaactctaccctttggacagacaccctcctcacctgcctctcccctcattccagctcttctccaagcttcaggcagtgaaggctgagatccatgacctccaaga

SEQ ID NO: 100399 - DNA, 1069 bp, Homo sapiens
ggcatgtgccaacacgctcagctaatttttgtatatttagtagagacggggtttcaccatgttggccaggctgctctcgaactcctgacctcaggtgatccacccgccttagcctcccaaagtgctgggattacaggcgtgagccaccgcactggccttttttttctttttttttttttttttgaggcaggatctcactgtgtcacccaagctggagtgctgtagcacagtcatagctcgctgtatcctcagactcctcggctcaagtgatcctcctgccttggcctcccaaagcactgggatgaccatgcccagctgagcacttgctgtgtgctgggcattgtacccagcacttgactgctttctctaattaagtttccccatcttctctatgcattcagtcctgttgcttaaaggtcaagtagtggggcaagtggctgaactaggatacacaacgtattaagttatagagtaatttacaccagaagtatatatatgatataaaatttgatgtaaaatatattgaaatgtaaactgtttttctctggttggtggaagcacactcaatgttttttttctttttgctcatctgtattttataactatcaatagggaacttgtattatttttatagtgaaagattttcacttgaaatatttttagatgtttctgagtctctcttggcagccagagccaaacagaagattacggttagttagctctttgggtgccattcttcctggctttgagttatttaaaagaaagaaagcaaaagcaaaaaattaggtggagttaggtgttgtaaaacggcatcacttctttcaggcaggctctttcttgataggccctgaataacaagcaatttgcacttctattcttggaggggccctcgattgcttgtactgcctgtgtccagttggaggctaacctagctggtgatggctgtgcttctgcaggcagaaaacattgtgctgttagagctggacatgcccagccggaccaccagagactatgagggtccagccattgcccccaaggtccaggctgcattggatgcggctctgcagga

SEQ ID NO: 100400 - DNA, 1059 bp, Homo sapiens
tttgacttttgcaggcctaaaagtggaaggaagtcgggatcctcctcctcttcctcaggaacccctgcatctcagctttatccacagtctcgggggctggttccaaagtaaagccagcttctcctctcccagggcggaaacagcatttgccttctgagagaagagactagcaaaaagctgcagagaggattcggcccaaactcagaactgttcccctgaggagaagcggtggcctctttgcagatcaaccaacttaatctggttgaacgtgctgttcctaatctggcactcagcccctctgggaaacatcttttaattagcatctcagaaatgcatgggtaaggtaaagtgcgatagttcaagtggaaagcaagagaatgaccagtgaccttgcttccttcccccttgccttcttctcccccttcccctgtgctccctttctctcctctctccttttctagcctgttctttacatggggctcccttcttgttgaacaatagggcagaatcaggagtcaccttagcaggaccacatctttggagcctcgggataaaatgacagtgaggttgaaaagtgaaaaccctagaacttgaataggtgcctgttcttgtagggagaaatgagaaatcgcatttggatccaggccccaggtgggcaccatcagcagtcttgcttccatgcacctcagtaagaagtggatctgcctttgggacctgctcagtgaggaaatctcttccaatttctgcttctgaatgattcaatgttgggagcaatagaaataacattccctttgccttctctgagtgtttagggaaatagcttctttaaaacctcaaaaccatgaccatcctgtcaaagacctaagtctgtaagctggtgccatgtccatacaccatgtcactttactcttcatttgtcaccatcttttcccatgcacgcatactctgaacatccttgtgtgggcccatcctctgcatccagagcatgctctgcagtgggcctgttttgtggaagaaaggaggctgtctctgccttctctgatgggactggagttgagg

SEQ ID NO: 100401 - DNA, 1402 bp, Homo sapiens
tccaggctggaagcattcccatgtgggtgtctgagtccatgagccaagcctgaggggacagtgagtctccaggtctgccacactggtgcaccttgctggcacggtgcctcaggaaggtggcgactcaggtgggccttgagttatattttaactcagctgctcagttcccagggcacatttctggatcagaacccatgggaaacaggaggtactaagtgcaatgtcttagcattctgcaaaatggagatctgttgtccagcggcttatctcctttttagtaacccttctttctgaacccagggcccttttcagccttccctcatattttcttgagatcaaactttacttctttcttatttactaagaatttgcctgtttgaataagaacaaaacgctaaggtgggtagcctaagctgattttctgctggttacacgtgtctctcacaccacatttcctcaaagctaatctgaattctgtaggctaaaaatattcatgtagcaaatctgagaattgaaaactgcagataaccggccgggtatggtgactcatgcctgtaatcctagcactttgggaggccgaggtgggtggaccacctgaggttaggacttcaagaccagcctggccaacatggtgaaaccccatctgtactaaaaatacaaaaatttgcctggtgtggtggtgcatgcctctagtcctagctactcgggaggctgaggcacgagaatcacttgaacctgggaggcggaggttgcagtgagtcgagataacactactgcattccagcctgggtgacagagtgagactccccctcaaaaaaaaaaaaaaaaaaaaaaaaaacagaaagaaagaaaaagaaaactgcagataaccctatacattaatactggtatctcgaggtgactcttctgaccaagggtggttaagtgacacatagaacttttctaagagaagacagacaagttgacaggcatgccttgtactcagctgtgttcatgtggtggtctgtggaaagaaaagaagactcatttggaaatgaagctgtccctttccaagcagtctctggtgcttttcttctctcaaaatggatccgataaatatttgaatagagcagattgtagaatgtcgtgctgtcaccagaaagctgctgttttgggttctgcattgagccaaatatgtagaggacctaccaagcccactgagggactaggttttcatgtctctagtcatacctagaatgttctgagccgtctgagggccttcatgccggcagcagctagcaaagccagaaagcaagtctaacaggatctaagatgaccatcaggagaaggagtttgagactgtgtatgcaacccccaatagacccccttttactctgatctggagaatgtatctggcttcata

SEQ ID NO: 100402 - DNA, 4264 bp, Homo sapiens
aagcaccgaaggggttaagggtggccgggggagcccagccaccgccccttcccagcatcgcctcccagaatcccgcaggcccccagccagttctcgcacctcgcgagactccacccagccccttccccgaacagcgacccgtccccgttcctagctgaggtcggtgctaggcggaggacgcgagagggagagcggaagggggccgccgggcacgccgggaagtgtggtccacgcgcttcacgcggccatattcttccggagcgggggaggccagagaggccgttgggactacgactcccaggcgccctttcggtttgtttttgttcaaaaaaaaaaaaccccacactccccctcctcactcttcacacacactcacacacacccacggcagacacgcacgcacccgggcgccgaagggaaagccgcgtctcgccctcccgccccgccgtcggtcctgtctcagtccctcagcagagcgggaaagcggaggccggagccgtgacctctgaccccgtggttatgcggagccgccgcattccttagcgatcgcggggcagccgccgctgccgccgtgggcgactgacgcagcgcgggcgcgtggagccgccgccgcccctcccccaccgccgctctcgcgccagccggtccccgcgtgcccgccccttctccccggccgcacccgagacctcgcgcgccgccgctgccacgcgccccccccaccgccgccgccgccccagccccgcgccaccgccccagcccgcccagcccggaggtcccgcgtggagctgccgccgccgccggggagaaggatgaaggacaaacagaagaagaagaaggagcgcacgtgggccgaggccgcgcgcctggtgaggcggacagccgaggggggctccgtggggcccggggtggggggggctcgccgcgcacccccccactggggggggaggggcaaggccctgcccaccgcgggagggggcggggccatcttcctttaagaacgggacagccccgcaaggcgaggggtggggagcgctccgccgggatgggatgtggcgcctttttccgctcgccctcgcgccccccccgccccgcgcagctaaattccggcggaggggcgagctggcaggccggctcctcccactctgggcagcggggtcccgcgtcccctcccccactatttggcagcgtctgggggtctggggcagcttcgttcattcacccgggggagttgggtttccgggaagggtcggaagctcctccctcgcttcctggtgggtaatggggtggtgcctttgactccgggggtggaaaagcgaccccacattcaaggacgccaatggcatgttgagctttcccaatctaaaccaggtgcgtggagggaagcaagtgcttactcccagcttgaaccctgagcagcggttctctaactttagtgtcctgtgggcgacacctgggaggcggttaggaacgctactcctagggcccttcgtaagacctgctgagcctcagggtctgggatagagcctgggaatctgcgctttcaccagcttcccaggtgattcaaacgcagtggctcacggaccccactttgagaaacgcagactgggctgtttgccttcagaagctggactggaaattggtattttgaggagaactgaatccactttgcaaagaatgtatgttggacaaagacaaagtatctctgttgggagacgttgttcactgaggatttagcaagggagagcgtaacttgagtgtttgaagccgtctcgttcaaccgatgggggttgtgaattttgtgttcagagcgtcagaggacttgcaggtgaaatagcttccttttggattactcccacaaagctcagacactttgagacatattcgggtaattatctgctgataccagtagtaacaggttatactaagatgtcagttcctaagatctgtcacacagcgaggttgtggtgcggatagcataagtgtctcttgacactgtagtttatatgtaatggttgtaattcagttttaatgatgagtgaagctcagacttaattttctctcttattttgaagtgagttttctgcttcaaaggtgttgtgcaaaaaaaaaaaaaatagactgtattgggggggttgacacaaacctgaagtacacctttttctttctcgaagtctgtaaaagttacagatttataaaaactgaaggaatttgggctacagaattttcattggtgcttgctatcctcttccctagtcatttgttgcccagggaacaaaaatagcaattgtttgtatgctgaagttttgtgcttcagtttattttggcctggcatgtgaagtttgaagattttgaggttccgaaatattttttttctgattgagtcaaaattggaagcttgggctagttttcaggatcttgtagaaatttcaggatttctctaacggttctgcacctggaaacaaatataggcctgatggggagtgggagagagctctcgttctcctcctcgacaatgagttttgtgtgttcattgacattctccttggcgttcctgttatgcgggtgtttatgaccctgggcacccaaggaaatttgcttgccagagttttacttgttagaggtaggtgaaagtacttttaagtcttgtgttatttatgtcttgacagaattatgaaatctgtttgtctcaaagttctgttggctcttactagttgactttaggaatttggggtccactgttaagtctctttagattctcgaatttaccgtggtctgaacttcaacatcgaggttgctatttctgttttatcattgactcaacttcaagccaggttatcagggtaagttattcctctttttcttctaaggctcttcattaaaaatagtaatatgaataggaattactttgtttgtttgtttttcgtttgtttgccaccacacccggctaattttttatttttagtaaagatggggtttttccatgctggtcaggctggtctcgaactcgtgaccttaggttatccgcccaccttggcctcccaaagtgctgggattacaggcgtgagccaccgcgcccagcctatgagtaggaattactttgtggtgctgttatacatgtgaaaaaggatttgcgagactttgggagtctgaggtggaataatcacttgaggctaggaattcgagatgagcctgggcaacatagacccggtctctacaacaacagcaacaaaatgagctgggcatggtggtacacacctgtggtcctagctactcaggaggctgaggatagcttaggccgaggagttggaggctgcagtgcccaatgattgattgtaccactgcactccagcctgggtgatagagggagaccctgactctaaaaaaataatgaggctgggcgctgtggctcacgcctgtaatcccagcactttgggacgccgaggtgggtggatcacagggtcaggagttctagaccagcttggccaacaaggtaaaacccagtctctactaaaaatacaaaaattagccgggtgtggtggtgcacgcctgtaatcccagctactgagggggctgagacaggagaatcacttgaacttgggaggtggaggttgcagagagccaaggccatgccactgtccagcctgggtgacagagcaagactcgtctcaaaaaaaaaaaaaaaagaaaaaaagaaaaaggacttgttgagaatgtgatatgcaatttgagtatcttgtgtgtgttttttgttttagaattttccatttctttgaatgggactggatggtaggtgagggggaactttttaagagtcccaggccgggcacggtggctcacgcctgtaatcccagctctttgggaggccgaggcagacggatcacctgaggccagaagttcgagaccagcctggccaacatggtgaaaccccgtctctactaaaaatacaaaaattagccaggcatggtgatggtgcatgcctgtaacctcagctactcgggaggctgaggcaggagaatcacttgaactcgggaggtggaggttgcagtgaacccagatcacaccactgcactccagcggcgacagtgagactctgtctcaaaaacaaaacaaaagaaaaaaccagtcctcttaatgtttaaaaaaagttgctgtaacactgtactggagaatttgtgagagcgtacactggactgagagaaacttgactaggagggaacgtaggacagttgattagaacacctgaacacttctctttgggcaggtg

SEQ ID NO: 100403 - DNA, 1629 bp, Homo sapiens
gaacgcgggaggcggagcttgcagtgagccgagatcgagctactgcactccatccagcctgggcgacagagcaagactctgtctcaaaaacaaacaaacaaaacaacaacaacaaaaaaacctttcgtagaggaaagaagattcttaagaatttcagtatagtgtaccccaggagattgatttttgcagatgttaattatgctgttgaaaaatagtctttctttcacacattttgtagtattgtcttttctaggtgtaagaagtagaccttatgtggttgagtggatataaatcctccaacttgttataaacagtttgtttgggagaaatagccaaggggatttccctttaaatcgaggacgctaaatggattctccctggcttcgagaaactctttgttgtatgctttatcttttactttgattcatgactgaccagttcttacatcaaacatttttttcccctttgaagtaagagaagagatacttaaaaaaaaaaatgtagtctagaaagagactaggaatagaacactgctgacttgttcttataccaagagctggaggcataaacagttttaataaaaaagaatactttgtatcttttgatgtaacttccctttagagattctgtttcccctgtcttaaattctcaggctatttctgattgctgtttaaataattggtagttactatttgagtcatgcttcttaaaaaaaaaagatataaaaattcgccagctcagctttcatttaattagtatcaaagaaatgttatctgtggcagtgaacattagtagcttgttccagggtttattgtaggtttgttcaagtcagtactgcccatcttggcacttaggttcttggaatacagaggtggataaggtttgcccctcagggcttatggtcttctggggatgaagaaggtccagacgcaggaacagaattttactacagtcatgatacgtgttatcatagttgtataaatcataaacagatatcccagttgctgcctcttgtctagtcatagtttctcctttcactctcaactgtcctggtttggaagataattgtatgtgttatgaaacaatgggaacattgaaaagagacatttacctctgcctggcagagatcagggaaggcttcctggaggaaggtgctttctgagctgaatcttgaagggtaactaggagttaggccaatcacagagggcataagcaggagctggtgacaacacatagcaggagagaaagagtcagagtgggtgagagggagtgtgtgtatttgcaacgtgtgggaattaggtatatctacaaattattggaacataaagtttgtagagtgtcactgtggatgggtagagaggcagagaccagattgtgagggttccatatgccaggccagtgagcacctactctgtgccagacattgtaggcattacttacattgtctctaatctgtccaacaactcgagaggaagacatcagtatccttcaaaagagaacctaggttcaggttgggttgtaattgccccagtttagaatgtaaaaatttgaatctaactctagatcctgttctttaccggtgggccagtggactttggaagcttcagcttttgcagtatgtgattaagg

SEQ ID NO: 100404 - DNA, 2336 bp, Homo sapiens
gaccctcctgcctcagtctcagctgagactataggtgtgcaccaccgtgcctggcctgttgaaggattttagagctgaaagtgatgagggcaggtttgctttgctgggttgacctcagtctataacatgtaagttctaccagagcagggatttggtcttgtttactgtgaatccctagaattgtgtctggcacaaggtacgtgttccatgtgtttgttgaatgaaggatgacaacagagtcagaatggatttgaggaaagcaggactggatggagggataaatattaagaggctgttgtgttgggtcaggtaagagactggttttgggacttggcggacagatgagcgagaaagatgacacctgcgtttctgaattaggtgattatacaggctgtcaatcaaggtagggaatacaggaagaagagtgggtctggagaagaggtgaattagagttgccaattagatgaattaagagtagagctgaattagagtagataatgaaggggtatagtcagtacacaactgaatatttgaatctgaaatttgggggagaagtcagagctagaggtagagattaggtagttatcagaatttaggtagtagctgaaactgagatgataatgttacccatggagaatggaaaatctgaaaagagaagcaaagaataggaccatgggaaataggggttttattttagtaccttctccaaaccttgactttggtgctgaggtcttatgttcttccatagagagtaccttccgcagcagacctatcagacgagatcgggcacattcagggtggtatggctgtagacagcagcatcgtatcagacttctttatgttttgcttgtgacagcagtacttggctatggcagttaaatggactgtaagatgttagcttgatttggagtaccctgagtagctgcacaggtagacaaagtacaaagatattgacagcttttttcttcctttagaagaataacatatctaaaacaactcttaaagcaagagagctgcagttgcacactaagaaaatactgcaatactgccatgacttggttataggtgatgctaacataaatgggatattctgtttctcattgcaccagtcatgcagaatcatagcatcatgtgccagatggcagaacgtactgtggcagttaacaccacaaattaacaacacagtggcagaaagcaccgtttaaaaatatgggtacttggccaggcgtggtggctcacttctataatcccagcactttaggaggctgaggcgggcagatcacctgaggtcaggagttcgagactagctctagtctctactaaaatacaaaaattagtgtgtgtgtgtatatatatatactaatcaaacttccttgggaaagaaaatgtgaatgcatttctgtgtcatacatttcttgtgcagcactatatattctgtggtttagcagtattaacagcatcaagctgaacagtaaccagtgttgctaaggtctcgcatactataccatgtatgctgagaagatatgcatccttagaattgagaattagaacatttcagttaattgcagtaacttttcagtaactagatatatgtgtaatttgatttctgaagtaattttaactgtggaaaaactaagttgtcaccagcggtacctcatagcataactttagcccatgatatatggatggatggatataaatggaaattgcacactgaaattaggacgtttatatttcttcaggtattagaaaactactcggatgctccaatgacaccaaaacagattctgcaggtcatagaggcagaaggactaaaggaaatgaggtttgtattgttcttgttgcttaacatgagggtttcataggatatgtgtctttctgtagttgtagtgatatgagtaagtacacctgtgtatgtatttgtgcttctgtgtctggtagtgagatggaactatccatttcccaaattgtgtgtcgtctcagtggagggtggcagtgggtgaacatccatttgttttcatttagaggtgcagtggctttccccatctccttgttcttccttaaatcttggcatagagcttgttttttgtgtaaggagtcagggcacattttctcttgtgctgttttggaagtttcagacctgatagcctctattgtgcctaacgctacccttttctctatgccgtatcactgaagttctttcttttagaataaaagaacagtggtctcatcaacataaaaaaccactgacttttttccccttactaattgcagtcatatatgatgtgaatttactaaattttgaggtgacctttattttccaaatttatggtgta

SEQ ID NO: 100405 - DNA, 3667 bp, Homo sapiens
aaaaaaaaagctgggggtagtggcccatgcctgtaatcccagcactttgggaggccaaggcaggcagatcacttaggtcaggagttcgagaccagcctggccaacatggcaaaaccccgtctctactaacaatacaaagattagccggcatggtgacgcatgcctgtagcctgtagttccagcttgggaggcggaggctggagaatcgcttgaactcaggagacggaggttgcagtgagccgagattgcaccactgcactccagcctggacaacagaataagactgcatctcaaaaaacaaaacaaaacaaaaaacaaagaaagtacttaaatgaggaaagaggagagcactacacagtccttgcctgggactcagagcaaacttcatgtttttgctagtcaaacttagctgctttaattgaccttttagggtcaaaaggccttcactttccagttgtcagttcaaacgttctcaagttgatgttttgtggggagggaagattgagattgtctacatcacatttatttgacttgtacttatccactgtgtagtgttataattgtgctttatttttgtttttatgggctatttcccatcatgctgctgtctgcactgctgttggaccactttgcctatagaaggtaaatgagtccctttgggacatatggaattgagaaccttaacttgtttctgcttcttgttcttagaggaattatgaagcagtcatgatggctcatgatgagtgagcagctctgtaatttgtagacagaggtataatatgtaggagtcacagaagagctgtgccagcatgctgttccccttgtagcagagatgctagcacacccacttgatactccagattttgcatagggtttcttttagagattggttcttggtgaaaaattttttagcatccagtgtgttccaaggcaaaataagtaatagttttttaatggtttttttagactcagaatttatttttaacactgcataaattagggcttctagttctgaaaaatgcaaagaggcttacttaagctatttatatattttttaacatgctggggagagggaagagagggtgcacaggtgactcctagcactaatatgctagtgccaaactcagttaatattaataatggtcatttgttgatatttttggtagcttttctatttaaagattcagtaagtagcatcctttgcactgaattgtcacgttttgtaacctgctgttgtggcagggaccatgaaacaacttagtatgccattgtttcagtttattttttaagcattactgggaactaaatccacttgacttactttttgcatttaggtttaaataattgttcctgggtagatacagaataaaactcaatctccccacttccagcagagaaaaaacaaatgaaatactgttctttttgtgtacttactagaaaatgtttaactggaaaaaaagttctgcttgttttattggcacagcaccattgattctgtgattctttgtcatagtattctgtggcagtttctgagtatgatatgtagattgaaatatagaggctaggaaacttttaatagtaaaattttactaaaaatttattaacttattaaaatataacttgaaaaaattgtgaggtttttctaaatttcttggaaatttgatttatattgtcaaaaagcactgaagaagtgttagttatggatttcgggtatcacataatgtttattccagagttttctgagtgtgatttatgtgaatttcatttggttattcttttactattttcacagtgaaattgtcatgagattttttcttctgtatttcttgcttagcttcttctcatttaagaatgagttggagggattaggtctttaagtaggcagatggattgtataaccctcatccattcttttgtggttttacagtgggacttcccctctcgcatgcctcaatgctatgctacattccaattcaagaggaggagaggggttgttttataaactgcctggccgaatcagccttttcacgctcaaggtaagtgatatgaactctcttttggtgcagtgattcttggacttttaatgtgcataaaaatcacctggtaggtctggaataggggccatgaatttgcatttctcatatgcagtcaggtgacactgatgtttttcttttttttagacatagtctcgctgtgtcacccaggctggagtgcaatggggcgagatctcggctcactgcaatctctgcctcccatgttcaagtgattctcccacctcaacctcccaagtagctgggactacaggcacatgccaccatgctcggctaatttttttattttttttaatagagacggggtttcaccatgttggccaggctggtctcgaaatcctgacctcaggtgatccacctacctcggcctcccaaagtgctgggattacaggcatgagccaccgcacctggccagatgctgttggttctaaatggcactttgaggtgttctaatatgaatcagatattagaaattatttagtcatagcagctcttgtttgtgtgttcatcttttcttgtctatatctttgtagattgtacaaaactgaagcataactatggggataattgcagatgtgcctttttttttttttttttttttttattctgagatggagtctcactctgttgcccaggctggagtgcagtggtgcgatctcagctcattgcaccctccacctcccaggttcaagcaattcttctgcctcagcctcctgagtagctaagagtgcactaccatgcccaggtaatttttgtatttttagtagagacggggtttcaccatgttggccaggctcgtcttgaactcctgaccttgtgatccgtccgccttagcctcccaaagtgctgggattacaggcgtgagccactgcacctggccacagatgtgccttaattaggattttgttgtagtaatgatgtgaaggataaattactggtcagctaatgtaagacctactctatggaaaataactgaaatgtgaacatatttgtggaaattaagtgacagtaattataaagtaagagtacttaaatcaggtagagttcataataaagcttaaatagggccgaaatgaacaggctaattatttttccaccatttgtgatatatatggtaatcatttagaccgggggtctgcaaagtttttctgtaaaggaccagaaaatcaatgtttttttgttttgtggatcatactgtctttgtcttaaccactcaggtctgccattgtagtaggaaagcagccatacccaaatgaatgggcatggctgtgttccaaaaaaaaaaaaaatttatttacaaatgtttgttttacttacgaaaacaggctgcaggccagatttgatttggggctgtactttgtcgacccctgatttagacataagatgacttgtcgacattggagaaactgaaaatttgatgctgaccctttcgttcttccatagtgggttataaattttagcagtcagtacaaactttttcctttaagttttgttttcttgatggactgtattcaaaataaatacctgaacaaataccaactatataacatgaagccataaaacttggtctttatatataaataaagtttatcttggggtcagatgtctgtgctgtt

SEQ ID NO: 100406 - DNA, 2022 bp, Homo sapiens
ggattacaggcgtgagccactgcacccggccagttgttggttttcttttctgtgccagattgagtgatatatggtggtactaagagcactggaataggagtcaaggactgaggtacagcatagcacctcatgtattacttggtatctccacttgtctctaacactgaagaggtataattggttgtttaaaaactgtgggtgtaaaacgctagtatcccatgaaatggaactgcagaatataagtggatgactctgaaactgcttttgaaacaagcatgagggctcagtttctccatctctcgtgggctccaccatcactgtctgacatcctgatctcctaaggcatctttcctccatcccagagctctgttgaaaatctcttgggctaaaaaccagtacagaccttctgatactcacgttctagcctttttagattgttgtgtgtgaagagtaagtcagctgtggatatttttctttcctattttgtgaggcatttggtatttactggaggctgcctgttttgttgcaaaccttgttccactgtgtactataggaggtctgctcagaaagcctagttagtagagcagtaccatttgctttggtcaattgtagcagcagtctgttttttttttttttttttttttttttgagacagagtcttgctgtgttgctcaggctggagtgcagtggtgtgatctttgctcactgcaacctccgcctcctgggttcaagcgattctcctgccttggcctcccaagtgggattgcaggtgtgtgccaccatgcccggctaattctgtatttttaatagagatggggtttcacccccaggctggtcttaaactcctaacctcaagtgatccacttgcttcggcctcccaaagtgctaggattacaggtgtgagccaccgtgcccggccagcaatctggttttaaaggaggctttgacccctcatttggtaaaaggttccttctttgactaattcccaaaggacatctcgatctgtcttcaaaagaaggggtattccgttgtcagtattcctagctagctctgggagaagagagaacttgattgttttcagggccctggtcagagtctggttttatgcccaagggatgaactgccttttgtccttctacctcctgaagttcagagccctgtgaaaatgaagtggtaaaggtcaagtagcagtagtttgaaaagcaccagcactgggacgattttgtggtagcctagcagagtgggcaggatgcttacttcagaggtgctaaagatgtatttttttttggaacaagaaggttataaatgtttctattaagtttgattttaaagcatgagggttctgggaaaatgagaagattgtacatactctaggcttccttgggactgcatttgaaaaaaaaaaaacttttctttgggtcagccagtatgaaaactgcatttgatctcaatccttcagatcaggcttttggggagagttagttgaagaatttgtttagtctaagaaagttgcttctagcttagctaaatctggaagaaaaaatggaacctgatgtttgagtgctaactgtattccagacagacgttatactccttatattggtccttttgaagcataaatatgtttccaagtcctataataatgaggaaattgcctgtgagagtttaagtaaattgtacaaagtaacacttttggttcagagatttgtttttaatacagagaggacaggttaggaactttgaagcttcagctaaatgagtcagttctcaaatgtttgagaagcatgctcaaggatctggaggaatagcttaattaatttgtacatcatgagaggagtagggagcaaaaatatgtataatttcttctgaatgatgctgtcttttttgatgcagtggtgctaaatgggctttgcttgtatgatacttcttaaatgcattagctaattattttgttttagtcttcttttttgaaatacagatgactctttgagctggttttctttggaaagttatctgtcctga

SEQ ID NO: 100407 - DNA, 1020 bp, Homo sapiens
gtctagcaactcatgtgtctcaggtctgggaaatgattttacagtttttccagctggtgcgtaactagctgtttgttctgatactgtcagtatttaactttatgttagaaacatttcataatgcaaatgaaaaatttaagccaggtgcagtggctcatgcactttgtgaggctgaggtgggaggaacacttgaggtcaggagttcaaaaccagcctggccaacatggtgaaaccccttctactaaaaaaacaaaaaaacaaaaattaactgggcatggttgtgcacccccataatcccagttactcaggaggctgaggtacgagaatcactggaactgggagacaggtttcagtgagccgagactgagacagagcaagaccctgtctcaaaatataaataaaatacataaaaaatttaatattatgtatataatatccagcccaggcttttctatttgtcatgccctgtttctttcacatcatagccttactcagatgcctgctgatccttgattgaggtgtgatgcttgagagtcaggctcttaaatactactggcgaattcagtgcattgtggttttgtgacttcacttgtctcttacagaagtggggaagtggtttttacttcgatgcatggttctgaagtagagatgtctatctcctgatgcacactttaaataatccccatgttttccactccatactccatccttgtctggtttaagctcttagcctgtctgcagttcaggggatgaatctgcttggttcttttcagcatctccctctgcaacgcttagatctcatcttcctttgctttgctaactattctctttgcttctccatttgtttctctgtcattgatgacttccaagttatatccccatcctggatattccttttgaacgtcagactcatatattcagttacctcctcagtatctctattcggatatctaatggcatctcaaaattaacatgtgcaaaaccaacctgttccacccttgtgttggctgtataaattag

SEQ ID NO: 100408 - DNA, 1026 bp, Homo sapiens
ttgccatgtttaaatatggaagctcaagcgtttgtacagagaaagtggaaaatgcccttggcttttatgccaaaccccaatccctctgtccccacctgccaccctggcctgttgcccctgttcttcccagtagctacaaccactatcattaatttaacgtgcatcctcctattcatatggaggtatgtggtatgtttgtttatataagtgtattttattttctttaatgtttaatagtgtaccatatcaatatagctacattttatttatccagtcccctgctatgaatatgtgcgtttttcactgttttctaatccctgttataaacactgcagcaacacttatccttaatctccatgtacaaacgtgtgagaatttctctaagggactattcccttaccttttcatattgtatgcttgggtaaaatggaagtgacttggaggctctttctgtgggggttagtgaaaagatttcattacattttctttgcattttgtaattatgatgagaaaaatataaaacttataaatcttttttaaaagttttgagaaacatgctttgttacgatcatgacatcaagttttatgcttaaaaagtctgtaattccttgtgtttaatgatgaactcttcaaattcctgatacagatctatagtcccttattaacaattctgaaatccaaaatattatgagaactgaatttttttccccttgactgatttagtagtaaaacctgacctgtgtaaactcattttgtgtcaaaactctgatgtagattgacaggtctaggttagcttatttgtttcacttggtctttgtctacattttatttttttaaaaattaatgtgtttgattatgggttgctggtggtgctgatacacaatatatgcatatattaacattctaaaattcaagaaattctaaataaaaacacatctagacccaaagatttcaggtaagggattgtggacctgtggtcaccattagctagaaagtttcagctgtgagtggcaacttacaagaatt

SEQ ID NO: 100409 - DNA, 1004 bp, Homo sapiens
tttgttataaattatatttttgttttcttttttcttcaaccctggcaaatggatatattttctttttttttttttttgagacagagtttcgctcttgttgcccaggctggagtgcagtggcaccatgtcagctcactgcaacctccgtctcccattcaggcaattctcctgcctcagcctcctgagtggccgggattacaggcgtgcgctaccacgccgggctaatttttgtatttttactagagtcagggtttcaccatgttggccaggttggtcttgaactcctgacctcagatgatccacccacctcggcctcccgaaatgctggcattacaggcatgagcccccacacccggctgatggataaattttctaattgatgatgttaattggtgatgttagtatcacttgatttttccttttttttttttttaatgtgatctcaaatgtcacaatgtggccaaaatcttttactaggtctgagtctcttggatctttaatgtaaataattatgctatctggaaattatgacatgcttttctaatcccttcttgtttctattatgcattgaaaggaattctagtatactgttgaatggttggtgttttcttagtttttcacagccttcaagtcagccttctcctaagagatagtacttattttttgctcaggaaagatataaggaaaggcataactgatattttgcttttttttttacttcagaatctaatcttgggcagtttaaactttatcaatttaaatgttagctctcctttgctcagatttgccacattcgtagtgtcttgtattttttaaaacatctgacctgtgggagaacattttattttggtttacttattacagatggtttattttttttcaacattagcttcttttctagttaccttgccaaactagtatacgttatgcattttagaaacacttatttgtattaatagatgaacgtgagtaaaaagtatacagcaagtcttctttgtactgtt

SEQ ID NO: 100410 - DNA, 1062 bp, Homo sapiens
attttaaaacccagcttaagcaacacatccttttggatgtgttacttccctgatcgttattcacctccatgccgtctttcgctcaactcattgaagttaggtgcccctcttctgggctgccacggctctccatgttcacctatgtactgtactttgtattgtaatcagtttaattgacccccctacttatttgagctccttgagagcagggccttgattcctgctccttagcactccaccctccccagaactaacatggtatagcttataggaggcaccctataaatgtttaatgaatgtttgaatgcaaaagtgtatctaactttcttaatgatatatttatgaaaagaacttgctgagaaaaaggtcagttagaaagggttaggaacttgtcagtattctaaatccctctttttcaaaagcatacacatttaggaatgactgccttgctttaagaatttgtagggttttgttcacctgagttgtaccttgctgtcacagaaggatgccctgcagtggtctcgccatccagctacagtggagggagaggagccagaggacacggctgatgtggagagctgtgggtctaatgaagccagcactgtgagtggtgaaaacgatggtaaggaccctttaatggatgggtgagggagccacagcaggcactagggactaacctttattttcctctcttccagtatctcttgatgaaacatcttcgaacgcatcctgttctacagaatctcagagtcgacctctttccaatcccagggacagctacagagcttcctcacaggtaaggaagaggtagagcctagcctgggaggatgaatgatgacaggtataaggcaagatccctccttctcctgtagtgagctgtgaacatgttcagagagtgaagaatagaagtctggtctccagctgttagtagcatttaacagggggccgcaggaaaagtgaacagtaggtttgagcagagtaagttttttctctttctttaccttggctgagtgattttgttcattctttttttttttttttttttttttttttgagatggag

SEQ ID NO: 100411 - DNA, 1121 bp, Homo sapiens
tttttgtagcttggaatgatgcttggcacagtgaccagcacgtagctcagtaacattaaccagtgctcttgtcagcattatttgacagatctggttgaagacgaacttcattttacaagagcgtgagtagagatagtgtcgccagggaatgcttttgtggctctgcagttgacttgggctctcttttgttctctcttggaacgcaggcgaacaaacaaaagaaaaagactggggtgatgctgcctcgagttgtcctgactcctctgaaggtaaacggggcccacgtggaatctgcatcaggtatgtgtaaactcatggttgtgatgctttttcctcaggtcctggggacctggcctccctctgtcagcagtttctgacctaatagtgcgatactaggagagctgtcgggccacaggcaagagccctgccaatggatgaggcctgccataggttctagtgctgggctctgctgtgtgccttcctctttgtctcccagggcagtcgtgaggatccaacggaggatttgattatgccagtgctttgtaaaaggtgtagtgctatacaaataaagatggcagtttggcacctgtaaggtgatattttaaagccagaccatgaagtggtggtttctctcagcctaaggctgggagatggaagcatcccagtattgctggcagcatctcagggagagctgggagaaatgagcttgtctgagagccatgggcgcggcttggtgatacttttgaccagtggaatgctgtgccttcagggttctcgggctgccacgccgatggcgagagcggcagcccgtccagcagcagcagcggctctctggccctgggcagcgctgctattcgtggccaggccgaggtcacccaggaccctgccccgctcctgagaggcttccggaagccagccacaggtgagtggcgtggcacttatttctctgcctgtaaagggggcccctgcaggcctagtgagaagatgatgtcttctattccaattcctttaccagtttatttttacttcttgggtggccctctattttttgtttatttttactttgtaatttgcttatttcatttgtagctctctgctaaactgtgagaactcctttcagg

SEQ ID NO: 100412 - DNA, 1532 bp, Homo sapiens
tcatccctctccagcccattcacagaaggcttctgcagatttttctatagtatactaactagatttacttttagataattctcatgatttctccagttgagctttgtggagcctgttctccagctttggagggaagctcagaacctgccccttgcctgattttctgtgggaagtgtccttttcaggctgtgacacagcacggtacagagttttgtctgaggagatgcaaccccaagtgttctcctgggtttgatggcaatgacagtaacctggaaagaatatacaggttaggatggactggacaattgagcagattgtgtgcagataactcctgggtagcttgggtgctgtcaccaaagttttcccatcagttggcatttgttttttcttttaaaaagctgaaatctataccttgcttcaaaaatcataggtcaaatgaagcgcaacagaggggaagaaatagattttgagacacctgggtccattcttgtcaacaccaacctccgtgccctgatcaactctcggaccttccatgccttaccatcacacttccagcagcagctcctcttcctcctgcctgaagtagacagacaggtgcacatgggcagcctcccctttgcctctctctgggtgggcttctgttctcttttaagtttatttattaggatttttttcccccttgatccttctaggtggggacggatggcctgttgcgtctcagcagcagtgcactaaataacgagttttttacccatgcggctcagagctggcgggagcgcctggctgatggtatgtagacttggtcatctcggacggcttgcgacgcacctgtcgtgtggtgttgcatgtctcctggtatttaaaacccaagctcgctcttctcaaagggttatttagtataagacaggctttcctcattactaataaatgtggtgggtattaatatgccacacagctctgaagaaataacagggtgtttaggtttagactttcactatattgtatgtatgtactcattcatcatctcctttttatcattaaaactataaacacctattccagtaatcatggcatggtctggaagggtggaggaaagtacactgtggagttgagaagctccaccatgctctgtctttttaggcattgtcacttggagtgattgttagcttctattaatttaattttgtggggaaagtgttgagagggctctaagaacacccctaggtttgatgatttgctagcaggactcagcatatagttatatgtacagggctgcggtttattacagcagaagaatacaaagtaaaatcagcagatggagaggcacatggggtggggtccaggggaaaccatgtgttggcttccaaggtcctctctcagtggtgtcacacaggacacatttaattcccccagtaacaagttatgataacatgtatgaaatgtctactagggaaacctgttaaagactcggtgcccagggtttttatcaagggctgatcatgtaggaagccactgcttggcacatacccagc

SEQ ID NO: 100413 - DNA, 1231 bp, Homo sapiens
cttggtctcactttaaggaagagtgaatttcccttatagtagatgtgttagctctgtccctataagagcatgatgtgagagagcctttagaagagacgtgttgttttaaaactgggagattcagctgtccataagacagacattaatatcccgaatgcacttactagaagaggtttatttctccctaggtgaatttactcatgagatgcaagtcaggatacgacaggaaatggagaaggaaaagaaggtggaacaatggaaagaaaagttctttgaagactactatggacagaagtaaggcagttggagctatgagtcctggtctggggttttgaggggatagaggtagatggtctcaaaatagcatatacttatgtgttggacaagaatgtggagattgcagtgacacttgggtcatttatcttaatgccattcatagtgaagctaacagaagtttttccatggttagattgtgcaccacacagatttattttgttctgagatatctgtgtttctgggtccatattattcatagaaataagagacatgtccactctggcctgaaactgatggctgtgattttgatttgcaggctgggtttgaccaaagaagagtcattgcagcagaacgtgggccaggaggaggctgaaatcaaaagtggcttgtgtgtcccaggagaatcagtgcgtatacagcgtggtccagccacccgacagcgagatgggcattttaagaaacgctctcggccagatctccgaaccagagccagaaggaatctgtacaaaaaacaggagtcagaacaagcaggggttgctaaggatgcaaaatctgtggcctcagatgttcccctctacaaggatggggaggctaagactgacccagcagggctgagcagtccccatctgccaggcacatcctctgcagcacccgacctggagggtcccgaattcccagttgagtctgtggcttctcggatccaggctgagccagacaacttggcacgtgcctctgcatctccagacagaattcctagcctgcctcaggaaactgtggatcaggaacccaaggatcagaagaggaaatcctttgagcaggcggcctctgcatcctttcccgaaaagaagccccggcttgaagatcgtcagtcctttcgtaacacaattgaaagtgttcacaccgaaaagccacagcccactaaagaggagcccaaagtcccgcccatccgggtagg

SEQ ID NO: 100414 - DNA, 4272 bp, Homo sapiens
ccattttactatgatgatttcattgttttaaggaaattatttgattctgtatgccatgacccttaagctactagaatcctagttttgctttacagtccctaggtcagatcacccagtcagttaaaactattttctaattctttttttgcagattcaactttcacgtatcaaaccaccctgggtggttaaaggtcagcccacttaccagatatgcccccggatcatccccaccacggagtcctcctgccggggttggactggcgccaggaccctcgcagacattaaagcccgtgctctgcaggtccgaggggcgagaggtcaccactgccatagagaggcggccaccactgccatcggaggggggggtggcccgggtggaggtggcggcggggccaccgatgagggaggtggcagaggcagcagcagtggtgatggtggtgaggcctgtggccaccctgagcccaggggaggcccgagcacccctggaaagtgtacgtcagatctacagcgaacacaactactgccgccttatcctctaaatggggagcatacccaggccggaactgccatgtccagagctaggagagaggacctgccttctctgagaaaggaggaaagctgcctactacagagggctacagttggactcacagatgggctaggagatgcctcccaactccccgttgctcccactggggaccagccatgccaggccttgcccctactgtcctcccaaacctcagtagctgagagattagtggagcagcctcagttgcatccggatgttagaactgaatgtgagtctggcaccacttcctgggaaagtgatgatgaggagcaaggacccaccgttcctgcagacaatggtcccattctgtctctagtgggagatgatacattagagaaaggaactggccaagctcttgacagtcatcccactatgaaggatcctgtaaatgtgacccccagttccacacctgaatcctcaccgactgattgcctgcagaacagagcatttgatgacgaattagggcttggtggctcatgccctcctatgagggaaagtgatactagacaagaaaacttgaaaaccaaggctctcgtttctaacagttctttgcattggatacccatcccatcgaatgatgaggtagtgaaacagcccaaaccagaatccagagaacacataccatctgttgagccccaggttggagaggagtgggagaaagctgctcccacccctcctgcattgcctggggatttgacagctgaggagggtctagatcctcttgacagccttacttcactctggactgtgccatctcgaggaggcagtgacagcaatggcagttactgtcaacaggtggacattgaaaagctgaaaatcaacggagactctgaagcactgagtcctcacggtgagtccacggatacagcctctgactttgaaggtcacctcacggaggacagcagtgaggctgacactagagaagctgcagtgacaaagggatcttcggtggacaaggatgagaaacccaattggaaccaatctgccccactgtccaaggtgaatggtgacatgcgtctggttacaaggacagatgggatggttgctcctcagagctgggtgtctcgagtatgtgcggtccgccaaaagatcccagattccctactgctggccagtactgagtaccagccaagagccgtgtgcctgtccatgcctgggtcctcagtggaggccactaacccacttgtgatgcagttgctgcagggtagcttgcccctagagaaggttcttccaccagcccacgatgacagcatgtcagaatccccacaagtaccacttacaaaagaccagagccatggctcgctacgcatgggatctttacatggtcttggaaaaaacagtggcatggttgatggaagcagccccagttctttaagggctttgaaggagcctcttctgccagatagctgtgaaacaggcactggtcttgccaggattgaggccacccaggctcctggagcaccccaaaagaattgcaaggcagtcccaagttttgactccctccatccagtgacaaatcccattacatcctctaggaaactggaagaaatggattccaaagagcagttctcttcctttagttgtgaagatcagaaggaagtccgtgctatgtcacaggacagtaattcaaatgctgctccaggaaagagcccaggagatcttactacctcgagaacacctcgtttctcatctccaaatgtgatctcctttggtccagagcagacaggtcgggccctgggtgatcagagcaatgttacaggccaagggaagaagctttttggctctgggaatgtggctgcaacccttcagcgccccaggcctgcggacccgatgcctcttcctgctgagatccctccagtttttcccagtgggaagttgggaccaagcacaaactccatgtctggtggggtacagactccaagggaagactgggctccaaagccacatgcctttgttggcagcgtcaagaatgagaagacttttgtggggggtcctcttaaggcaaatgccgagaacaggaaagctactgggcatagtcccctggaactggtgggtcacttggaagggatgccctttgtcatggacttgcccttctggaaattaccccgagagccagggaaggggctcagtgagcctctggagccttcttctctcccctcccaactcagcatcaagcaggcattttatgggaagctttctaaactccaactgagttccaccagctttaattattcctctagctctcccacctttcccaaaggccttgctggaagtgtggtgcagctgagccacaaagcaaactttggtgcgagccacagtgcatcactttccttgcaaatgttcactgacagcagcacggtggaaagcatctcgctccagtgtgcgtgcagcctgaaagccatgatcatgtgccaaggctgcggtgcgttctgtcacgatgactgtattggaccctcaaagctctgtgtattgtgccttgtggtgagataataaattatggccatgggaaacattgtatatttagtgtgtgtattttgataatgattgatcttaaatctgtatacagaatatcattgatataatactctttaggcaggagcactcttgccttcccccaaaatttacactgctaaagccctctgtcacttggcgacccttctggtcttgctggaggggtttcctgggtataacccattgggctgcccaaggccagccagcctgagctctcctgcaagacagagcctgatgtggcacggagtggggttgcggggggtggggggactgcctgactcccagagggacttgaaactgaagcaagaaggttgcattctccaccaagggagttaacctacctgaactaagtagaaatgccagtcttccactaccccctccctgccatcttttcttctgctactttggggagttgatggccaggaaagaagccagcacagggttaaagtaactcctggcattgcccaccagggggctggtgcacctgctgacctcagggtcacagttgagtcatttgccagttgacggagcaagtttgaccttggttctgttgctgaagcaaatttggaacttttctgtctcagtgtgatccactaacccacaggatcatttggaaccttgaatagctctgcttggacaatggggttggggaatagggttgtctttcctatgaaaatgccatctgtagaccttgtgagtcagccgtccagatgtttgcaggtgaattcctctgcttgacatcctccctgtcactttggaccctatgggagtgggcatctccacgcacctgtgtatgtgaaagtcattttacatttcaaagcagtgtgtgtttcttatttttatatttttaactctttattcttggatgtataaagtgaactttttggcttctgtaagtatgctctatgcacctctaatgttttatcatgtatttatatgttgtacacagtactggctgattctgtaaatggatgtattgtacagagaacatgaacgtctcttcctaattttacatcttcagcatcattgcattaaagtggtgtaatctccttctctacatctgttgtcagagccactgagtgctgtgctgctcgacgtgagggtgaaatgattgacttgtgacctgccaggttgcccgatgccctgttgggtcaccggctggacctgctgcagcctgcagagccacagtcagc

SEQ ID NO: 100415 - DNA, 1030 bp, Homo sapiens
atggctgcttgctgccatatgtgacaaatcaccaccaccagtgttaagtgcttctggattcatgggtgagttccctgggcagcccccaggaaggccttccagatctggctccagggtcaccacctgtcacagcaatacctgggaccatgctctcctgggactgtgaggctccttttgacgtacttttgacatcaggcaggtttgggaagaaacaaagccatgcctgctcctgcctctctcccaacatgtttccagcaagtagatgcccctgtgtgtgttttcccttgccttgtttcctgccttatatcttgtatttcgacttattacagagttgagggttcttgcttaatttagatcaagtataaaatttgtatgacttcaagtctcattttatctgaaaggtttttttctcatttaatctgatgtggcattttcgtcatctgaagcatgagtgacaagttgggaatgatgtggtgatttagaatgcagtattggccaagtccaagttgtcaacttaagcgtctgtttaccaaagaccgggaacaggggcccaaacatgtccagtcctcttcttccctctgctggaacctttggggacactcaagggtacagtttgacactgatctggtccatgaggctgcccagagaaagcactgcttctgtatgtctcttgtggtattggaacaataaacccgtacaacctgcagttgtggtctcagtcatctgtggctgcctcgctggtgtgggaaggtcagctggagtgctgagctggaagggaaggagtagacgccagctctcctcaccttggctctggagctactcttcttatacttggagctcttcttttgggaggttagtccaaaaggaatgacttggcagcttcactggtctttagccattcatgacttggcggacttcaccacatagactgcagtcagcgttctactgagagcaatgagaatgtttccccttgggagtgcgagtcacaaactgtgacatccctctgcagcaactcatccaaacagcttca

SEQ ID NO: 100416 - DNA, 1077 bp, Homo sapiens
ccccagtccctgtgtgttctgcaagacttgctcttgaggaggaagatgcacctcactaagctcatctgcttagcaaagccacaaacaaaaacctctcactttttacctacgtttccacctaaaaatacaacaaaaaacctataccacgtagaactcagattggctgaaaaacactttccacctggtagatggcccatatgcctcaattatgtggtccatttaggagcaggagtcagaagagagacctcttattggctgctggtgggtaactgcatggacagaggaaaagggaaggcaggactttgctgcagagctgtgggatgaatgtagttcttccctgggcagcctgggagtgggaaggtcagaatgactcatgttgccttcaggatcaagccatccaggatttagggacaacccaagaggtctttagtcctctggcataatttagacatgttttggaagagcatgagttccatatctgagatgagatttaagactttcagtgcagatagtacaagccatttcttcagggttcctctgggggcagctccttcatgaggtcccacctccggggaggggcacagggctccagatagtaagcacttaaggcaaacagtggatggcaccaacttttaaaggtgactctattaatggcttcacctctaaattatatttttacagatatgcacctatgcaacttaacgtggctcttctaagcaggtgaggacttcctcctcaatgctctctataaaaattatttgtgttctatatagtgagttttaccagtaaatgtggcttaatattttaattcttagaatgtgtcttctctacgtgatgtgactaaattctgttttgtttgtggaatgactagcacaggccgactccctctctccctcacttaacaaaagaccaatgagctgttaatcgagctgttatctccatggtattacttgctaaatgcactgatttcataagtatgtggaatccttttccttttgaatctgtatatcatatataagactgaatctacttaataaacactgaacaacaaaccgaatgctctgcttccactgtgtc

SEQ ID NO: 100417 - DNA, 1019 bp, Homo sapiens
aggattagatctaaagatcagcataagctacagtttgaagtcatgtttttctgagttcaagctgttggaactgaccaccctccagcctgccttagtactgcggcaagagcgtaggttcaatgtgttttcaagagaaaggaaagaatatgttgttaaagtccattgggcctcccaggcccctccaggacaatggatttcatcatgtcgaccccacctcttgggtgggctcctcctttccagtgaaactacacctgaagccctagagatggcagaatcaggagcaagtttctgcatggaaacaggattccatttagctggctcagtcagggaacttgttttgcttttgttttaaaagatgcagcttcaaccccttccccctactcccgacttggagggcaccaaagagctggttctgatgaactaagctcactgctgtctcaccctcaccagagggactgccttctcccaaaaggagctcccaaagcccttgtcccacagccatttaaaaatcttctgaagggcctcagggcacaaagtgatcatttgggatcctaagttaaaaaggaaatgcaagagtaggatactccaattccagagtctttgcaggaggctaatcccacaagaagggtagcatcagagaagtgggcattggtcttagtggtggatcatcaggtagacaagtgatagtgtgtgtaacccatctgaaattcattttaccgtcaccactcttacaaaggacagtttattcccaaggacagtgctgacggggagggggacaggcagggagttaggagggttttcgaggatttcaaacaggtggaacccatccatccctattcccaagggccacttacaactctaagggtggttacaggattaactaccagttcattttcaaaatgctgctttgaactcagagggttgatacttttaatttgtaattttttgtaaaactttttacaaaatagtaaagtatttcaccagaataccagtttcaatccgtccatggtctgattttt

SEQ ID NO: 100418 - DNA, 1042 bp, Homo sapiens
gtagggggagggagccccttccccagtctttctcactcctgtctgccaagaaatgcaaacggttcatgtctagcttgggtactgcctctgggaggagaagtgacacgttaagtaactgataccaggaattctagggtggcgattgtctctgccaggttttaacattaagattttcacaaataattgcctggggtaacatttttgcaaaagatcttactgattactttgtagtattgttcacacacaaaaataaatatttacacgaattcaaatgttgagtagtactgagcaggtggggccagatgtgtggatggctggggtgtgggagaggccttgggcactggaggttgtgctgtgctaagggtgagtctcaggtgtcctggccctgaccagaggcctggggattggtcagatggaaggcagaggtggtgtggctggatggggtattggaggccacttgagagataacgaccacccccaacctctaggggccggaagtaagcacggggtgggcaccctacctttcagagttctggacctgaggcaggatggggcatcctcactggtgccccccccatccctccttggggggagtctgccacagtgccgggaggcagtggccacagctgcaacaggcaattggctgcagaaaagctggtttgggaaggggtgcctgttctgggagcgagtggctctccgtggccatcctaggatccactcggccctggctcccctggggcctctctgctctgagggaggaaaggcaacagagggcttctgccagctctgggcaggggcgggcagcagagagctgctgtcatggctacggagtgttgcacggagaggccctgggggcctgctgaggtctgggcgagtccctggtttagcagcactggtaggtattgcactgagcaagaggaagtgcctatcaatcaatcaatcagggaggaaggaaaccaggccagctttttctttttgccctttttcacactccagggattatgggtttcttccaggaccggcccctccggaagggctggtc

SEQ ID NO: 100419 - DNA, 1031 bp, Homo sapiens
tctaccacctccaccacccccacgcccaccccctccagcaccagcaccagcaggcccgtgcccaccgctcagctcagccccacggagatcagcgccgtgcggcagctcatcgcgggctaccgggagtctgctgccttcctgctgcgctctgcagatgaactggaaaacctcatcctacagcagaactgaccccaccggcacctggagcgcactgccctagggaaggaggctgtcccagcctggacctggcttcctgcctcaccagttggtacattttgtttttgaaagaggtgggatccaaaagagctgtttctagccacactccaagcacctgagactttgggcacaaggacacttttttttttttttttttttttttttggaatctcaccacacgggtgctctgacctgcttggaagaggccaacggggcagctctggaagggttgggggctcccctgacaaggcgctggggctgcagctctgtttagaatcaccttcgtggaccctgatgttagaatcccacccccagataattacctttcaagtcttaggtgagcagaattgcatatttattgagaaaagcaaagtggaccctttcttcctctccccttagtaatttatttttctgaaaatggattcttttgtgtttgtacagattgctagtctgtgtctgtctgatcagaaggatgtatccccatacctaacattccatatcactacactgatgtgggctggggccagtaggggcaggacaggtgccaggctggctgttcctctgcatgcctggtgcaccctgtggccgctagcccttggccaggccatcctgttgcagatcccagtgctgccacagggacaccaccaggcacctccctaggcaacgccaagcaggaggacctcacccacacccatggcaaagcaaaacaaaagaggcaccccgaccccattctacagaagccccagtccatggtcacctgtattctacctcacactccagcgtgggctttttccaggatgtgccctgagcctgtt

SEQ ID NO: 100420 - DNA, 1047 bp, Homo sapiens
agtcggtcctccctgcggcagcccagggagggaggtggtagcattgctgtccccattgcacagatgaagggagcagaagaggggagtgacttgctcagggcctcgcagctatggctctcgtggcagcagggcatgcgtgccaccctggtccccaagctcaccgcctgtaggagacccagcaagggcttgagcagctgcttggcccaaccctctgcctcttgccctccttttagtcccccccctacagctctgggagctacgattccatcaagaccgaggtcagcggctgccctgaggacctgacagtgggccgggccccgacggcagatgatgacgacgatgaccacgatgaccatgaggacaatgacaagatgaacgactctgaaggcatggaccctgagcgtcttaaggccttcaacgtgagcaccggccggaaacaggtggggtgggatgggggcaaggccagggccagcccttcccatggcccgtgtctccacagatgtttgtgcgtctctttgtggacgagaacctggaccgcatggtgcccatctccaagcagcccaaggagaagatccaggccatcatcgagtcctgcagccggcagttccctgagttccaggagcgggcccgcaagcgcatccgcacgtacctcaagtcctgccgtcgcatgaagaagaacggcatggagatggtgagtcccccctgcctggcccacactttccctcggtgccactactgacctcctgccacactcccaggatgcccgggccccttcacccagggtcttcccaggagccctggaagcaagtaccataatccctggtttgcaaatgagggaactaaggcccagaaagatcacacagctccatagactgaggcgctggagcccaaaccccaccctgtgccacccacccctggggcagggtctctgcacaagcccagggcccccacgggccccatgctagctccatccccgttctgcctgcagaccagacccacgccaccccatctgacctcggccatggcagaaaacatcctggcagctgc

SEQ ID NO: 100421 - DNA, 1058 bp, Homo sapiens
cctggtgaagctctggaatgggagatggcttggagtgtgcccccaagccaggcccccttctccgagcctgtgaagtggagctgacggcccctgccttggtagaggtggtaggtggatatgcatccccacaacccatccccctcccccagaacagcatctgctggggataacagcaagtggccactttcggcacagccaggtacgaggcctcccactgcctggtttgtctgcgtgcctgtccccattttataggtcgtgcgaaaaaagggcgagggcccagggatgtgggcagtggaactcctcctttgactaggctgatggacggtggtaagggtgggcacagtacgtacccctaccagtgggcatcccccctgcttcctggggcctcccccacacttccacaagctgcctccgggccactaaggtttcctgtagtagtgcctcttctccaacctgggcccgggggccagaggtgccttcctggagcttacacctctggacaggctcttctccctctctgggcctgttttctcttctgcagagagagtggagtaggtgctactgcctgcctcatttggaatgtctcgtggggacattctgtaccatgggctcagtgctgagttgttgctatgtgtctagcacaggtggctgggagcaggttctggccagagcaggctttgcctgggtccaagggacaggcatagctgctgttccatgaagggggtgagttgtgttcagcagccattgccactgtggccacagggtacatggggggcccagggaagtgagatgagagcaggaacgccaccagcagctcctatcttagttttttctccatctgtctgccctggccctggctcagggtttggctgaggagtggcgtgggaatgtggcttgcctggggccacacggccagttatggtagccagcgggggccctcggcatcctgcccctatccaagtctgtatgtggacgaagagacaggcaccaggccagtgaccctagggcaccaacccctgcgggcctggtcccagggagagaggcctggcgggggccgt

SEQ ID NO: 100422 - DNA, 1194 bp, Homo sapiens
atcgcttgaacctgggaggtggaggttgcagtaagccaagatcgccccattgcactccagcctgggcaggaagagtgaaactccatctcaaaaaaaaaaaaaaaaaaaattagccaagcgtcgtggtgtgcgctgctggggagatcgcttcagcccaggaggcagcagttgcagtgagccctaatggcaccgctgtactctagcctgggcaacagagcaagaccctaaaaaaaaaaaaaaaaagtaaaccatgtaactgagtcgccaatattttaaaatctgtttacataatggtgcagatttccagtttcttctaacagcttggaacacttggccatacgaggtcctagcacctggtgccttacgggtcttacccgcccaaccacttccctggccagaccagggtggcatctgagtgcagttaggggaggttctgccccggcactagtgcctgtcgatccccagccaggcagccgggggcacagccccgaggcaaaggtcttggtagctggagagtctgggcccccgtgccgggcatctgacctggtagaggctccaggagcaccctgagcagcgtgtctctggagctcacagtggcggagggcaagtccatcttctcgggaaaacctgattgggaggtgggtggtgggatgatgggatgtcacttctgggcctatgtagggtgtggcactgcagccagccttgggcctggtgcctgtgatgaaggcagtgaccacttgctcactgtgtgccaggcacgatgcccactgaggagcagcccctcattccagaggaggaatctaaggccctccaaggtcaagcaagtggcctgtgagggtggtgtcggtatgtgaagtcgcacctgcaaggtgggtgaaggatgggccccctgcagctcatgggagcgtgggtaaccagccagtatgggtgtcatccctgtcccccgtggaggctcctggacctcaggtgcaggggcttctctggtgacagggtctgtcctggtggggcagatggccctcacgatgaccctgggccaggggaagggagcatgaggatccctggcagggccgggcagcaagctggggttggaggcgtgagtgcctccttcctagggacagtggagaaaagtgccagcctgaagtggcagtgtggaaccagaccttgaaggctggctgccatctgctcagctggagg

SEQ ID NO: 100423 - DNA, 1034 bp, Homo sapiens
cagcttggacacctctctacgggccaggaaccccagggtctctgcagagagaaatgatttcagttttaggggaagatctaggtgtgtgacgtctaattcattagccaaggacggctactgagccttggaaaaggctagtgcagacaggtgtgcaatacacgctgcgtctcagcggctccgtaggaaagaagaaggtgaaatatctcagctctgataacacggtatcaattatttgttgaaatggtactattttggatatattgggttaaataaagtagattattaaaattgatttcacctgtttctttattactttttaaaatgtgggtactagggcactcaaatccctcatgcggctcccactctgtttctgtcggacagtgctgctcccgactgtgagggcctaaattggcacctgcctaagcaaagagtgaccagagtttcagcaggaacgcccactgcccgggcactgaggggcacacgcagaggaggcgcatgctgtgggggtagaggaactggcgccccggggctgcaaatcagggggcaagtgtggcacccagatggggggcatgggctccctgctccgtggctggggccgggccaggctgtgtgaaccacagggacagagctgggcgctcaggagggcagctgtgcaggcagctggggcctgagggccacgtggagaatgcaggtgccccgtgtggccccatcacccggatggtagggtcctagtgtcccccatttgacccctgcacccctcctgcctttctggaggaagagctgggcagcctgccctgagcctggtgctccttggaactacgcatcgtgtaaacacagcctgggcgctggcctttgtcaaagcaggcagggggccagtcctggggaggtgcacgcctcaaattcagagcagggtcagcacccccagaccacagcccatagccctactgtccacgcctccctggccatggtgggccgtggctccagcagtctcccaccccctcctcccccgtcgccctgttgtgtgtgaattattg

SEQ ID NO: 100424 - DNA, 1029 bp, Homo sapiens
cccaatatgtggcatcctgtaggcaggtcctgggtgctgtgccatggatctggccggcccttccccgaagtatggtcttgagctagccgatcccccaactctgggccacagcttctctctgtgacatggcctgggggctgtggcccctcatcctggcatgcccccaggagctcttagtgagaagaccaaggcttcctacctcctggcccctgctgcccttgggtggggccctccaccacccagaaatgcaaactgggcagcagggcgggtctctggggagcaggtgtgtttcctgagtgcccagggctcggtatttacagcagcagtgctgttggcctcttctccttggcccggccccctcccctgtgtgcctcctccctggcctccaagaggtctgcagggaagtgtgggggcacacagagctcagatcttgctcagttccctccttgccaggcagccttgggcgggtgccaaccccttgctgggctgggggtgatcatcttggcccaccttgccaggcggttgaggaccagatgtggacagcacaggcccattgggggccaggctgggactggatgtgggcggtcttcctcacctcccccagattctctgagccctgcgcaccaccccgttggtccagtcttgcctcctcagccagcctggtctcccttggtcccctctgccatggaggcctgtgggaccctgactgcagcttacctcacagccaccctcagcggcatccccacccctgctctcagctcccaaccaccgcccgggttgtgcttcttcgtaaagggagccgggctagggggtccttggtgtcaaccagacccaggcactcacagcttgtcctgagtccctgtccctccctccccacccacatgtgccaggccctgtccagggaccccaagttcccaagaccctgcttctcaatctggcaaatgccagacccatccaggtgcccacactgatgggcagctaagcaggcagcgaggagtcagtgctgccatccaaggagaaggtgccagg

SEQ ID NO: 100425 - DNA, 1930 bp, Homo sapiens
ttggggctgaacagcacatccgtctgtacttacgccgccacctgtgggatgatctgtttgatgcagtctcctccccaagtaccataagcaccctgagagccaggcctccagcacccagcacagggcctggcaccacgcaggtgctggggtgctgtttgttgaatgaatgagtggatgaaaatgaacgaaggcatgcacggaggcaggtgagccagtgcgcctcctgcaggccggggctggcccaggttcctgacccggcaggcggggccactccttccgtttcccctggatgtgcttcagcaggcctctcactctgccccttcctgagcggaaaatgtgaggcccgtctggcctccagaagggatgcgtgggggcagggagcggacattactcacctcctgggcagacaggaagccagcgccaggggagagcaggggtctgctcgctgggcctgcatccgccttctgcagggtgggcagtcgggggattgctgagcaagagtcgtgtggagccctggctggggcaggtcagggcctggtgtgtgcgcctctcagatgaggccgctcctccaacctgggcctcgggacacacgggctcccgcactgtgcaggcctgagtctggacaaaggcactgagggccctttggctcttccaggttcttggccactttagtcacaccagcgttggccttgtgacacacaggggtgatgagccctgtccccacctccctggaggagtctggggtttggttgaagccaaacaggcaccagtgtgggacccctgcaggctgtcagcttgctgagggcaggagccacatctttgtagaaatgtcccttatttctccccttatttcagaagtattacaattattgtagaaaaataaaggagaaggccaggtgcggtggctcacgcctgtaagcccagcattttgggaggctgaggcgggtggatcacctgaggtcaggagtttgagaccagcctgaccaacatagaaaaaccctgtctctactaaaaatacaaaattagctgggtgtggtggcacatgcctgtaatcccagctactccggaggctgaggcaggagaattgcttgaacccgggaggcggaggttacagtaagccgagaccacaccatttgcactccagcctgagtaacaagagcaaaactccatctaaaaaaaagaaaaaaaagaaaaaaaaatagaaaaataaaggaggaaaaaagaaaatgaaaaataatgatgtctggggccctatttttctcagacttttctatgtatctaagtaaccagagcctcattttcttttcaatgaggcagtattggcgccttttttctcacatagtcattggcctccctgacactgatgtgggccagccacagttcaaagcttgtctagtcagtccagtgactggggtcccattcctgagcccgctgtgtgcccagcctgaccctgctgtgtgcccagcctgaccctgtgagcccagagctatacatgtcgctgttccacagggcaggaaacatcgtctccgaggggaagtaacttgcccagaccacagggactgggtctctccagagccagcgttttggccactcctgtggaaggacactcaagtccctgtttttctttctttctttctttcttttttttttttttttttttgagatggagtcccgctctgttgcccaggctggagtgcaaaatggtgtaatctcggctcactgcaacctccgccttccaggttcaagcaattgtcctgcctcagcctcccgagtagctgggattacaggcgtgcaccaccacgcctggctaatttttgtatttttagtagagacagtgtttcaccatgttggtcaggctggtctgaaactcctgacctcatgatctgcccgcctcggcctcccaaaatgcagggattacaggcgtgagcca

SEQ ID NO: 100426 - DNA, 1072 bp, Homo sapiens
ctctgtgaaacgggtcagccttaaagagtaaataaggggtaggagccttgctgtttgggtcaaagttcatctccatggcagaacctgcgcgcctgcctcccgaaggcctgaatccggctttgtttgggaggagacccagtctggaggcagctggaggtgtctgggccaggggctggggagcacagggagtggctgcaggaggagtggggtgcgtggctgccggcaaagaaaaggcttttgtgcttgatgcctcgtgaggtcggtgcgaccccctcgtgctgccagcctcccaggccagtgccgccttccagcgttcccacgggggtggggaccggcgggggcagccacgtgctctggggggctctggggctgggacaagcgcagcagctgacctcccgcctcaactgagccgattgaggccacgcccaaggaacactgagggcggtgcctgcagagcccagctggggccacaggctgtggtcccccacaagaagggtctgggacagttgttcagaaacccagagcagtggggctgaagggaccatggtccccctactcattcccaagcagatctcatgctgttattcctcatgaccaccctttgagagcgtgatctctcttggagacacgtcctggggaggtctggtgatttgggggctgtcaggatcaggtagctgacagtggcatttctgtggggtccatggggttccctcagcacctgctgcccagaggctggctggcctggccatgaggatgaggctgagagatgcagggaggctggggggtctgtaggtccccaagagcccagtgcggggtcagcctggggtagtcagacaccaccttcccctcctgatggacaccagagctgggacagggaggatgctgttgaccacagggccgtgggcctcactgtcccctccgagacactcatggagttgtgggccaccccgctggctggctgagaccctgggcagggcacaggccttgggaaggcccaggcagctggcctggcctctgctgcctcttctgggcctgtgggcctgttggtgtctgtccagagcagtgggtttcc

SEQ ID NO: 100427 - DNA, 1132 bp, Homo sapiens
tccacccgcggacaggagccatgtgaataagccaggaatgcttttgactacaggcccccaaacccagttgactatagcaaaacatgaagttattttactcctaaaacaagaagaatggaggagccgccgctggtgccatttgcaatgttgggttggtgtctctgtgatgttattgaggcttttcctcatggttgcaagttgcctgctattgctccaaccttgtccacattcgaggcattgtgttgatgtctcattgctgcaaaagggtcacgtggttcccagttgtaagggaggctgggaaagaaagaatttcatgtttctaccctctgtggttgaaaaagataagggagaatgttgattcagggcataatatcaagaaaactggttcacagtctctgccacagcctgggcaccatcaactaaactttgacaatcactttgggtgttaagatgccgaaggcttgggcagagaaaaagaatggaaaagaaaggaaacggggaaagtggggaggaagaagagaggagagggaggtaggcaggggagcaggaacagcaattgttgggggccttctgtgtgctgggtacccccagacacagaactcagttcctcagcacacagggaaactgaggctcggctttagagagcttaagtaatttgtttgtgtgtgtgtgtgtgttgtgtgtttttttttttttttttttttttttttttcccgagattatctcactctgtggcccaggctggagtgcagtggcatgatctcagctcactgcaagctccacctcctgggttcaaatgattctcctgtctcagcctcccaagtagctaggattacaggcatgtgccaccacacccagctaatttttgtatttttagtagagaccaggtttcaccatgttggtcagactggtcttgaactcctgacctcaggtgatccacctgccttggcctcccaaagtgctgggattataggcatgagccactgcgcctagccagtaatttgtctgaagtcacagaattagtaagaaagagagccctagtctctccaatcttaatgctgttatttctcaagggaaggggtggggaaagagaaaggaaaaagaaagcaacagtcagggtagggacaagctg

SEQ ID NO: 100428 - DNA, 1078 bp, Homo sapiens
tatcaattttttcttcaaatcgcttctgcatttgagtcttaaaaaggctaactccactccatcccccatgttttcttttagtatttttatgttttcattttttttttgatagactatttttgagaacagttttaactttacagaaaaattgggaagatagtacagagtatccacattgcccactcctcgacacacagtttcccgtattatcaatgtcttatattaaggtgatacatttgttaccactaatgaaccacactgatacattattgtaagtaaagtctacagtttatttagattcctttagcttttacctaatttccttttctgttccaagatttcatccaggatacaacatttaattttcattgtaacatttaattccatttaattgtcatgtccctttagtcttctttgggctttgacagtttctcagactttccttgtttttgataaccttgacagtttcgaagagtactagttgtgtattttgtaggatttagaaatttgacatttttctctatataaaaccggggttatgggttattaggaggaagaccacagacatggagtgtcattttcatcacatcctgttaagggtccataatatcaacatgatttaggactgttgccattggccttgatcacacctggttgagatattggttgtcaggtttctctcctgtcaagtgacttttccctctttccacactgtgcacttgggaaggaaggcaccgtgtgcagcccacacctgaagagtggggagtcatgttctgccttttttagggtgaattatcaacgtaaattatttagattgcttatgcataggagatttgtttctcctcccccacttattaatttattcagccatttatagaagtcgagactcatagctgtttattttatgctttgatgatcattcaatacttcttcattttgttgtacaaattgttctagctttggccattggagctttttcagttgtttcctgtgctcttttgccatacctcattggtgtttggggtttttgtttgttcgtttcttgttttttagtgcttctttgctttctggcactgta

SEQ ID NO: 100429 - DNA, 1060 bp, Homo sapiens
cctgcgctgccggtctccagccctgggtgcggccgtcctgtgcactggtctccttgacaaccccagcatgcgtgctccgagggggtggtggctccttggccagatccatggtgatgtagcaggacacgtgcaggtggcatcttggcccgtgttacccagtttgaggacttcagctgggtggcttgaacctgcagagctgcgtattcctttcaagaggcagggcggccagccctcctgtccccacactgtgcccagaccctagaggctgtgtgacgtaggctttgctctgagcggtagaactgtttgctagaactgtgtctcccacgtcttctcatctgagcgtgcctgttctgggatggttgcatctccaaaaacttcacatcatcacaaataattccagtggggaaaatgggcttgggttgggtttccaacgcacaaaggcaaagtagtttgagctgcaggagtgtcggtaatgagggtgttgcttttgttgttggttatagaatcccagcaccactgtgcagcctctgcattaggtctcctctcactgccactgaagagcaatctgtggcctttctttcctgtagccatcctcactgtctccggcacctggcttcgtaaacactgttatcaccgtgctcatctgtgcccatgaagaatgaagcacaaaaccgcacaaacagccggaagcacagccccctggttttgtttcatacagaatggcactaaatccaggtcaccactagaaccagtagtggtcagtgtcgtgcaagttgcgatctctcactaacaaatcagatatttgatctggttaaaaatcctaactgtatcttcacttgcgtcaatggaaggaggggagttaagactatgggttaggtgctttaacgaggattcagtcattccacaaatatttatggagctctgttctgtgagccaggctctgaggatttacagaaacagcagtacccctagattttctttcttttctttttttttttttttttttttttgaggcagagtctcactctgccacccaggctggagtgcagtggcccaatct

SEQ ID NO: 100430 - DNA, 1036 bp, Homo sapiens
ctatgtagctaggactacaggcacacaccaccacgtctggctaatttattttattatttgtaaagacgagatctccctgtgttgcccaggctggtctcgaactcctggggcctgtgtcccctcctggggctcaagggatcctcctgccttggcctcccaaagtgctggaattacaggcatgagccagcacgcccggcctcattgttttttaacgtgtgaaatctctaaatagaacactggcatttaataaaaaaaaaatatttttgacaccatgcagtccacatctctgggccagatgtgggtgagccacagagtctgcgacctctgacctgtcccttctcctccaaggtggcttcctcttccacgggctctgttaaatgctccatgtgggcaacaggcccgcagcacagactgaaagggctttccttttgttctttctgccagaaaacgagcctccatctccactggtctctgggattattgattacaacatgcccctcacctccacctacctgaagcagatgaagcttcgagtgatgaattcccaggagcaggtaaggcggccgtctcccctcaccccacctggaggcgtcctgacttgcctggcggtggttgattctttccaagacttggggccacagcttgtgtaaacacacgggaaatcaaagaggcccttatctggttatctgggttgtccaggcggagaggcgggaggcaagaatgtgtttctcgtgagagggtctcctgtgcagacagccctgcaggtcttcagggagaaaactttccccttgggtgggctcgtgggaggagggggaggaggggacgtggaagggagggagccgcagccctggcccctggagttgttctttctctgctctgccctttatcgctggcctcttgccaccttcccccagggaggcaagagagagtagccgcctgcctgtggcctctgtcactcttggggcccagaggactaggggatagtccttggagggtggacctggggcctcctggccgtccaagcctccccagctgg

SEQ ID NO: 100431 - DNA, 1023 bp, Homo sapiens
catatgcctgccgcgtgccccacttcccgctgcccagcctggagctggcacatgactggcactgagccagctgagctgcacacagagctggaatttcagcagcagggccaaggctgagctgagcaggccagggccctcctgccgtgggtgtgaggccgaaggggctggcacacctccctcctcccctacgtgcctcctctccttttccccttctcctccccatctgtcacccttctcatgccacccttttccttttttgggggcagggggtggtgcctggatgcctttgtgcccctcttcatctgctcccattttcctcgacccatacctagctcttcagccccactctgcagacacgaggcccccacccatccatgcctgtggaaggagcccccaaggaaacccctgctgatggctgcagaggggcacagcctggcatcacggggtacgcatcaagctcctggctgaggactttttggatctatctctgtgttttgccaacgctgaatcctcagactgcctgacagtctctagggcacagggcccctctggatttttccaggcctaggagggtactataggagttaggactggcagggcggtggcagactttttcagtgcactaaatgaggcgtgttatttggtagggaaaagagctttctggcatctactgctgtccacccgtggatcagatagggcaggcaatgagctttctgaaactggaggtattcgagctggagttagatggccatgtgcaatggataatgcagggattcccatttcgagtaggaagtccctgtctcacttagcttctcagtgtgacctgaggtgcagaggatctcggaggtctctccagcaccagggtttgaggaaggctccagctggttctacagagtttcctgaactcacacagagggctagtcctttttccaaggggccttcctgcttttctgatttctgcacccttctgggttggaacaagcccttttgcttcctttttccctcccagggtgctggtaggtc

SEQ ID NO: 100432 - DNA, 1037 bp, Homo sapiens
caggtgatcggagctgttcccccgggaccccagcccaggcccacagtgaaaggttactgctaattggcgagctcctgatggggccgcatctatttagcactcccccctccccagagacttccaggatggtcttggcacagcgtgtgattcaagagctccccgcccgagtctggcacaatctgtctgaaattgtgaacatggagcctcttggttttttaatttgtattttcgttgtcgccgttctctgcccattgttgctggtagatttcatagctgcagccaccctgactctggcgtccccctccagggagccccctcggtaggctccctcccctccccaccccaagacccactgtcggaggcattgcccgtcctgaccccttgccccggcctcagggcccagttctcaccccgccatcattcctgacactaacacagcttgtccaccctgtcgcagggggcagatggcctgtcggagccagagggcatctctctgaagcgggtcgctgtggtggaagatttctttgacatcatctactcgatgcatgtggagagctcagcggagccaggcaaagcccccaagcacgctgggcagaagaaaacctaccgagcggtgagatttctgtctctttgcctccactggcagccccaggccttggcaggaggccacgggctccgcacatgttgggcttggggggcggggcagggagctgaggcgtgatgaaacggcctttggggatctaggggggcacagggcaagggcacggcagccagagatggctcacagggcgaggggagggaatctgtggtctgagcacaaaggaaaagcaggttgaagggggtgagagggagggaaggagagggatgagggcaggaggcgccctcctcttccccgtttctgcttcacttgctcccacccgacaccacccccagccccttgcagcctgttctggggctggggtgctggggacagataataatcagaggagcaaatgccttcatggcatggcatttactgcatgccaggcctgtcctga

SEQ ID NO: 100433 - DNA, 1052 bp, Homo sapiens
cgggttcacaccattcttctgcctcagcctcccgagtagccgggactacaggctcccgccaccatgcccggctaattttttgtatttttagtagagacagggtttcaccatgttagccaggatggtctcgatctcctgacctcatgatccacccgccttggcctcccaaagtgctgggattacaggcgtgagccaccgcgcccagccaaaaccagctatattcattcttaaggttcattttgtttattttcaccaatgtgaacctctggttagaagtgtattataactgtacatcccaaatccatatctttgctgagtaaaaaattttttaaaagtctaactgacctatcataatatttgtcccatcccaaccctgtcatggcagtatatgaagagccctgtaatgctgggcatttacgggtcaatagtgaacaagttagtcattgatcagcccgtacagatggcctgagatgtcggagggggtgggatactccccaaaagaggtaaaattgattcctgagagaggttaagagcagaaaagtcatggaactttacagctcatctcataaatgaagctcggggaggttgaagggtttgcccataatctcacagcgaggaagctggaccagcaagtggcttctcctgtacacacagagagagagagatatgtgctatctgagacgtcccactgaaatgggttctgaccaggaaggaagccactggcaagagggccttgttggggccagtgaggtcacctcccagggttaccacttagggacactgcccgctagctgtggggctcgggaccccacatcccagatgccctttgccccccatctgctctctgctcttgaatgggctgctggtgaagagacactgctgttcggccatcatggtgtgtcgagaaagctactgggtgaaaccaagacctgtctgtgccagaacgtgttgtgagcgagcgtcacctcccagtgtggcctgtattctacttggactacagagtccaaggtctgaagccatctgtgccatccaccagccactgtacctcaggc

SEQ ID NO: 100434 - DNA, 1565 bp, Homo sapiens
aacttattaccagcaagtgacttcgaagctctaatggagatgacagaactgcaatccattagcaactggacctcacttcaccatcaggggcaggggtccatttaattggctcatgtggggagacaggcaagattcagtccgattcaggagctccctgaggtcgccccggcaggagcctgtctaatggcctggtaagacatgccgatccccctcttaggtctgcagcctgggaattagcatgctgagcattcagatccatctgaggaaaacgaggaagccagaaaggacctgccaagggatgccctgcttaagtatttattaactttgccagggaggacttaaaaatctgatgtcaggatgcagggcgttcctgctctttctatccataatccacattaagtctctgggcagatgtgttgaatttatactaatgttgcccaataagattcttttgttctcaccattaggaaaattggccttcatcggaaatgaaaatattaatatattaggccaggaagcacagagcatgtctatatttaatgagccaatacctgttttcctacagttacctccctggctcaatcatggagacattctgatcagcagttctcaaaatctgtcttgcatcagaatcatctgggggggcctgttaaaacccccagcacatcagatttggtaggtttaaggtggaacctgaaaatgtgcatttctaacaagttcccaggtgatgccaatgctgctggtctaaggaccattgctgtaatattttgaaatatcagatgtatttaagtagacatttggtgattttgtcaatgacttgccacctagcttttcatttagaacccaaatgggctggtgttaagggagctggtgatgtccaagaatgtagctccataaatgtgtaggttttttttgtttttgtttttgttttagagatgggtcttgctgtgttgcccaggctagactcaaacccctgggctcaagtggtcttcccatctcagcatcctgagtagctgagactacaggcatgcgccaccatgcccagcttctccataaatttttaaaactattgccatgtctgattctgttggcctggctctggcaggctgtttgggggttggatggttcgaaaggatggtgtgtgttaccatggcaatgttcttctccatgcaggaaggccccagaggttgatcctacacaagtgactgtgtgtttttcgtggttcttcccatggggtgatacagggttccattccattactcctgctaggtgtttccaggaagctgggataggcaggagactccaagtcccttcttgatccagcctatagataaagtgaacttcctttgtcaattcactgtccagtttgcttagggcaatggattagatgaagctaatttgggtaccaggcagaagggggatggcaggggcttcccaagtctacagggaaggtgctttctgcttcctttattagcagctcttcccttgcagcactgtctggatccttagctagggaaggcctgcctcccctgcagcatttagcatgaaggttattacctccatgg

SEQ ID NO: 100435 - DNA, 1821 bp, Homo sapiens
aggaggctgagaaaggagaatcacttgaacctaggaggcggaggttgtggtgagctgagatcgcgccattgcactccagcctgagtaacgagcaaaactccatcccctcgccaaaaaaaggaaaaaaaagctgggcgcactggctcacgcctgtaatcccagcactttgggaggccaaggccggcaggtcatgaggtcaggtgttcaagaccagcctggccagcatggtgaaaccccgtctctactaaaaatacaaaaattagccgggcatggtggtgcctgcctgtaatcccagctactgggaggctgaggcaggagaatcgcctgaaccaaggaggcggaggttgcagtgagccaagatcatgccactgcattccagcctgggcgacagagcaagactctgtctccaaaaaaaaaaaaaaagaaaagaaagaaaaaaaaagaattacaacctaagtgtcttgtaaacaggctcttcctagctccaaaatctggacacaagaataatggcaatccaaatatcctgctctagcccgcccttcttacagacaatggaactgagactcagcacgctagaataacggcacatgcctctccctgcacctccagcccctgggacagcggagaatgcagctgcattctggatatagtttaaaggtggagccaacagaacttgctgatggatgggatgtgggctgtgagaaccagtgagcagtcaaggatgccttcagggtgtttggcctaagcaagggagatggagaagcctgctgggggaggaagtttggtggtggtggccagggctgtgggcgggtcgggggaagggggtctaaatgcttgctggatgagtggatggatgtgtcgccctggctctccagggggccctagacacacacttgctttcagtccagtcggctgtccggcagcagaggagaggcccatgctggagatgtcaacgtgacatcgcacacgtgtgagtggccccaaggtggacgaagttcaaggactggggcttggggttgtcaacattaggaggtcctgtccaaagttcatgtttttcttctttcatgaaatgtcccattttttaaaaatttttattctttagagacagggtcatgctctgtcacccaggctggagtgtagtggcactattataactcactgcagcctcaaactcctgggctcaagcaatcctcctgcttcagcctcctgggtagctgggactacaggcaggcaccaccatgcccagccccaacttttaagtatcagcaacaaactcaaattgtaataaacctctgtaggttcccccagatacatccatagaccccacttggcctgagacctcctgcttaggacctgtggtgtgggtctggagtcacactgcctagatctgaacctggctgtcaattcccagctgtgtgcttttaggcaggtgacttagcctcagtttcctgatctgtaaaataggaataataatagtactcaccttttcgtgtcatagtatgggttctctgagagtcgtgatgaaaagctatttgtgatggattttactagtgaccaaggctgttgatagcaaaggggaacagtgcactggattttgagttcaccctggggtgggatctatctctgccattgacaagccgtgtgacctggggctggttttagacctctgagaaagtggtttgttgctcttggagttgggagctggccaggatgcctgctgaggcctctgagccgccactgaccaccctccctccctgcctctctccttccagcctcgcccacctgccacctcccacccctttaccctgcagccaaaatgat

SEQ ID NO: 100436 - DNA, 1071 bp, Homo sapiens
gtttatttttcaccatttgatttggcccccatgccttgagagtgtctccgcccacttctgaaataactaccagaaaaatgcaaattcagcaggtgatgcctggagaatctctgagatcatacttaagtgtgcaaaaggcaattaagtgtggaagcccaaggcagtcagttactagggaatcttgaatgagcatctgttgtatgcctgccagtgagatgtggtctggtttaggggcttagaggtctagctttgcaatttgtcaggcaaatgtaggttcaatcctgactccatcccacctgtctttgggcaacttgcttctcctctcagtgcctaagtttcctcatctgtaaaacggtattgacaatagtacctactggtacatcaggagtgtttaatacacattggctattattgtccttgttggcaaagtgttacaggaaattgaaggcaagagacatgttgggttgggggttgggggaaggtcagggaaggattcctggggagagagaggacatttgaatgaaaccacccagttgtgggcacccagttgtgggcagaggggacagtgtgtgtccaggcacagaggcacgattgccccagagctcatgggaggagaagcagccagggaggctggaatgtcaggtttgtgctgggacctctgggaggaggagacatggctggagctgcttccaggggcctcaaatccaggcatgagttttgggatggcatttgacaggcagtacagagccacagaaggattgttgagcttgcagtcctgcccagcatgtccccacctgcaacttgggtgcttccttggggcaggcttcccaaacctcctttcttactgagggacagcctaggacagtgtttaagaatgagaaagccaggcatggtggctcatgcctgtaatccctgaactatgggagtctgaggtgggagaatgacttgagcccaggagttcaagaccagcctgggcaacatggtgaaaacctgtctgtacaaaaaaatacaaaaattagctgggcatggtggcttgtgcctgtagtccagctacttgggaggctgaggtgg

SEQ ID NO: 100437 - DNA, 1035 bp, Homo sapiens
gtaataacattcctacctcaagtgctccgagcagtgccgggaacaaagagagctcccagtaactctgggcaatttgtcattgactctgcccttgaggagaaagggctgaatgtttatcgagttcctactgtgtgttagactctgacctgaagagaatccaattcaagaaatatctgctgagtacctactatgtgccagcatctaggctgggctttggggatacctggatgcaagacctgaggcaggggtgtggggatagaaggaaaaggaaagggaagggaggtgaggtatgaggtcctactacgtgccaggctgtttgctgagcactgggagtccagagaggaaagcagtggcccctgccttcatgatagggaaggacagaaatccagaacccgatgattatgacccagggtagtcccgtgggggatgcctgggggccagggaaggcttcctggaggaggtgatctggaatcttgggcattgcggccacactacagctctcttctacaacagccccatcatgtgatctggcctcagtttacacatctggagatacgggacacactatccaaggaggaatatactttttccatctgcaatcggctcaccttcccttgcactggttctcggcggcccctccgctgcccctgctccggtccaggctgcagtggctcttgctttggcctgctggctccctctctccatccagcagccagagcgatcttccgaaacgtaaatcacacatcatcagttcctagcctaaaacccttcaggggctccccaggggctcttaggacaaagaccagactccataccacagcctgcaaggcccggccaggcccagcaccgctgaccctctggccccaccagtcagaggaaagggccacagccaggccagatcctccacctgctggtgcagctggaatcctccgttacggctgtcaggggatgagtggtgtggggtggtggggcggccgtgtacccagccggctgtgtgatctcagcatacagtccctttccagaaccgtgagtcag

SEQ ID NO: 100438 - DNA, 1047 bp, Homo sapiens
cccctcccggctgggacccgacacaagctcctgggaggcctctgcttgggtggatgactcatcgttttctcggcatccccgggctgaggaaatgttcaaggagacatggggcccttccttcagcaggccaggccctgactggatgctggcgagtcgagaaaaacacaatcgggcctccggccttgtctgaggacagccctcaggggtgtttccgagagcccctggcttccacagccttgcacagtcctcaagcaccctgcaaggctgtgttatgaccccattctacaggttagcaaaccaaggcacaggctctgctgggcccccagctaagcaaccactgggtgcctcagtttcttcgtctgtaaaatgggtgtgatgattgcccctcccctgcaggttgttgggaaaaactaaaggcaagaatccatgtgaaatgtttaactcgtgggattgtcattgtcatgaggatgtgaagaggggtctccccgggcaacaggggctcttgactgggcagagccactgtagggacatccagaaggcggtatggccaaggacagtcctgcatttggatcccaactctggcaacagctgtgtggttctgggcaaatggcttgcctgctttgatccctgaccccttctgtataagggggtgataaaacccgtaccccaaggggtagctgggaagatggcataaaaccaagcctgcccggtgggccacagcataggggctgctgctccatcttggggtctctcagagcaaagatcccaaagccaggcagctgtgaagctcccaagggtggctccgaggctctctgtggggtgatagggaagcctgggctgaggggagagaagaagggaggcagctcagagggctcaggctgggaggctccatggaggatggatgttctctggaggttgaggttgagacaggagcaggctaggggtgaaaggctttatgttgattcgaggcccctgcaggtcagcagagcagtgggggtctggagccaggggctgggtccaggttctgccgcttactgctgtgcagtc

SEQ ID NO: 100439 - DNA, 1037 bp, Homo sapiens
tctagcctggtccaagcctggagaggtggctgcctctccccggggccccctgtgtctaccctgttccctgcccacataaccccttcttcccacaaacagccagaggaaaccttggaaaccccaagtcaggttctctccctcctctgtccagaaccctccaagactcctgtctcactcaaagcaagagccaaggccttcccagtagcctgcagagccctgcgcgatctggccctggctgcccactgctctcaattccctctcgcctcgttcatttggcctcagccacactggcctgtttgctattctccaaacacgccaaatacagtcctgccccaggccccttgcactggccttcctctagcttggaatactctttcttcagatctctgcatggccagctcttctccctcttcaggtctttggtcaaatgtcacctgctcagagagggcctccttgatcacccagtgaggcccaccttagatcccttggaccatctcccatctctcttttctacttgatttttcctctggggcccttatccctgcctgacattatgtgtatttcactactttctgtgcttaggatctgtctcctccaaggccatgagcactagcagggcggactgcgtctgtgtttttttgctgccgtgtccccaggacccagaccagcccctgcccttaaggggctccccactgggcagggtggttcagcagatgtctcagagccgggttctgagaactgcctagttctacacagaggccctgagcagccccagggcgcagacccaccctcccacgggacagggcctgagaagtccttgggaaagtgacatttcacctggaccttgaagtccaaaaagaacttttcagcaagagcagagcatagggaagctcattccggggggtgggactggttttggcggggtcagcgtgggcgttgtacgacggatcccagggccaattttcttagagaagcatgtttggaagaacattctagatggagtggagatgagtaaatggccaagtcagcttgagaac

SEQ ID NO: 100440 - DNA, 1049 bp, Homo sapiens
ctgaggggtggggacaccgtgcacccttcttccctgggtaggagctggtaggaaaaccctctgctttatggcccctgcaggctgctttgtcgtccctgcacgtctgggaggctggaaggcccatctgggacctcagaaatgctgctgggaggattggggggtggggagcctgtggctgggggtgtctggggaccaagtggagggcctcaggcatacctgggcttcttcaagccagatcttagctcagaggttgtgcgactgaatcctgaacatgtgtgtgctcacgggctagaacacgcatgtgcgtgcatgtgtgtgtgtgtaaaagtgcaactgtgtgggtgtgagtgtgctgttcctatctatgtgcaggctggaaatgcttgtgtgtgtgtgcgtggagtgtgtgcagggcacaggtggagaggctcctctgcgtgtttgtcggcatctatgtgagcacctgggctgtgggccttggcagctgcgggtgtgactgcgtgtgcttgcactcatgtgagatctggattggactcaccctgtctgtctgccagtgtggtgctgttgggatgtcctccatcatcaccaagtcacctgagctgctgccctggcccctgccatccccggagtctcagcagctggctgaagccaagaggtggccataagaggtggtgccatacccccgtccccatgactgcagccaaggcatctccttgttccagcttcccactgccaccccctacccgcctcttgctatggtcctataacaaagcccaaagccaagcatggggcgggaaggtcctgggagaaaaggctctgaacttgaagtgagggggccagggcctatggggtcctaactcaactgtttaattcccacatgaccacgggcaagtagcctgcctggcctctctcagtctcagtttccttttctggaaaatgggctctaaaactccacttcttggcaaactggaaaaggctctgctgtcatttgaggatggtggctaaggaatgtgcttgaggccaccctgctcactcatgtcaaagccagg

SEQ ID NO: 100441 - DNA, 1035 bp, Homo sapiens
tgagggggccgcgagggagggaggcgggagccggggagcagatccggaggcgcctccccccgcgcccaggggacggggctgcaggccgcggggagtgggagccgcgagcgcggagggcgggcggcccatctgcgaggagcgctgataaccgcgctgcggccgccagcagcccatctgcgccgctgccgcctccggccggaccgggaacagggggccgggcagaggggcgcgccgggaccgggctccccgagggggaagctggggcagtgacccagcccgcgcaaggctgggaccctcccagcctaaatcagcactctcgctcaaacccggcgagtctgggtcattgtcccctcccccgatcgagtccaggacccctcccccagcccaaatcagtgccactttcccagatggggagtatgggtcagccctccccaccctgccaggtcggtcccctcctcggttctcccatcttgggtcactgccccccgccggagggcggtttttctgaggtcagtgacccacgagatggttggctgggtcttgccccctaccctaggtcagtgccctctgccatcagggcttcccgggtcggtgccccaccccacccccccatcctggttacacctccctgaagagctggaagccttggcccaaccttcttagtctgaggcaggagccctgagtccaccctctcctggagttggggggtgaccccccagacctggcagctggctcactggctttctgtgtggctcgacttctccctagggagtgggcatctggagcagtcgtccactctttatccacacagctgtagaggctgagcaccccctccccctatccaggccacatgcagaaactgggtgctgggcctggaccccaggtcctgccggcccagctgctggcttcagatgctccttgagacccacgctgacccgctctgcctgcccctggcagcgcgaccgtccccagtctccaccctggctctcagaccaataatgagccctccccaagggaccacctgcctgggaggca

SEQ ID NO: 100442 - DNA, 1064 bp, Homo sapiens
agccttcctgtgcccaggccccttctcgcaggcctccttgtcccacccccaccctcaccccaatagctgcaagagagacctggctgggaaaatgcttctgtgttgtccaaagggccctgggatgctgattcatggctcacaggagctgcctgttaaatatgtggagcttggctatagcctgtgcctgtctctttaaggaggccttgggcctccttgctcagccaacattccctaaggaactgggcaggcctggtggctcctctggcataggcctactgacttcaacttgttaaggcagcctgaggcggggcccacaggtccttgggtgggggagggaggaccaggggctcagaggagccctcccttatccaagatcctagtctttggaagggagggaaattggatcccagaccaggtagctggacccgaaagcctgggcttgtggcacttgggaggtcctgagttaggatgaccagctgtccagcttgcctgagactgaggggtataaactgtgatggtcccaggcaaactgggattccatcaagagcgaagtcatccccatgcctgggcaggcagtcttctctgctgaccgagctctgtggggtgcagaattcctgggttccagaggctgccccacctgagacatggctgtatgaccttcgacagggctcctcatatctctgagctttcatttcttctgctgtaacatgagggtgtggtcactgccctgcccctttcaggccaatgggagatgctgggaggtaatggctgccagagtaacttcatccttcgtttgaatctctgtgccctggggcaaatgtcttttgagcctctggatagcccaatgtggggaagagggttcactgattcactcagcacagggcccggcgcctgtgctcagtgcatattgaatgaatgcatgcgtggaaagttaaatgtgcatccatgcctcctctgtgaacagagctggagaaacagaagaataagaccatcttggctctcaaggggtcatctttagtgggagggggaaagaaaaggagtcagtgtccagagtggccctgttt

SEQ ID NO: 100443 - DNA, 1020 bp, Homo sapiens
ggcaggggcaccgcggcgccccggtggcactgcggctggaggtgggggttaaagcggagactctggtgctgtgtgactacagtgggggccctgccctctctgagcccccgcctccaggcctgtgtgtgtgtctccgttcgggttgaaaggagcccgggaaaaaggccccagaaggagtctggttttggacgtctgaccccacccctcccgcttagggcttctgatcccccagggtgatttcactggcccggggttgggagggcagggggccagggggcggagcccgcggagaggggcggaggggaggctccgagcgatttcaaatttccctcgtccccgcccccccgttccccccgcgcccgggcggggatctgagtggctgcggcgggggcacccccgggcgggggcggggcaagagccgggccggggctacaaggggagtcggcaccgccccctccccacccactcccgctgccccgtccggcccgcgccgcttcctcgcagcagctgctcccggctccgcggccgcagcccgcgtggacgctccgagcgccccccgacggacgggaccggctccctggcggtcgggcgagcgggcggcaacgctgcccggccggcagcgctggggttaagtggcccaagtaaacctagctcggcgatcggcgccggagattcgcgagcccagcgccctgcacggccgccagccggcctcccgccagccagccccgacccgcggctccgccgcccagccgcgccccagccagccctgcggcaggtgagcgccccggggccccggggaggctcggccgccagctgcttcgagggctgctaggggaggggacggcgggggctcccgaagctgccggggagagaccctctccagggacctcccgaggaggggctctcgccgggttggagacccggctgggtttgcggggtgaggaaacgtccacggaccctgcttggggtggaacggggacagcgggtgggacgcgggggacatacgtctgacggggaccg

SEQ ID NO: 100444 - DNA, 1050 bp, Homo sapiens
gggaagggagagagcaaacaaaggggtcaggagggaaaataatgcactggcttcctgagcccctgcagaggctgagcagggagagggggccagggccagaggggacagaggctggcggcagacgggccgggacaggcaggtcctaaatggcattgtttgaaggggccggctaattgcacagagcagtctgagcctgagaccccagccctggcctccccactctgtcctgggtgctggcgtctgagccttcgggacagcctgtccacatggaaccaagtcctgagcctccaagcttggtgagggggaggctatggggggcagcctgggtggggtacttgggcaagagcatcaccctaagaatgcatcctggggccttggcctgagaacacagagcccatggcgggggaacactgtccctctcatgtccctgcttccctttcaccccacccattctggcttctcccacaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggtggctgggcagtggggactggggtggtgtcaggcgctgacatagtgagcggtcactgcagacaactggaggctttggggagagtctctgacaacctccaccacaattccccgggagggaagagagctctagcaaggagggatgcagggtcgagcccttcacacctgcccgcagcccttggcctcccctttgggactctcatctcagctgggactctgagcgtgacacaagggtgatggttccctgtcctctgccagtcatgacaggggtggtctcagcatgggcccttggagagcccttctgcagtgggaccctctccccactcagagctgggctggggttgggagggggaggtctggagtgtgcttcctttccaccctgccctgagcagctccagccagctcacttgggatcccgccccagctgggttggaa

SEQ ID NO: 100445 - DNA, 1008 bp, Homo sapiens
gatgtaaccctgttgtgctatgagggaagtactgttattccaattttaaaatgagggaaatggactcaaagccacacagttggtgagtgaaggcaagtgcttaacactccagccagacctagctgctcgctgcttcagcttttgtgtttggcttatgctgggttttggtgtgaggtgtgaggcctgcacgaggaagccctgatgacatggtgcaggtttcatgccattgcttccggggcatctgtcgtggttggtctgtgtctgcacccatatgcagtgtgttgtgatgagtgacccggtctccctgccaggcacaggcgatcagtctttcatattgcaggtgccttgtttctttgacttgctgataccctggggtcttcatcatgttcatcatgtttccttataaaggacttgacaggcgatggcgacggggaagatggggatggctctgacaccccagtcatgccaaagctcttccgggaaaccaggactcgttcagaaagcccagctgtaagtagccacacctcgagccaaagcacttgtggccaacactctacatagcatacatagcatgctacatacatagcatagctccttaggggagcttttaagagaaagtgatgaaaaaatgttttgaaactagaaaatataagcaaggctcttggactattgttggagggttttcttttttctttttttttttctgagacggagtctcactgtgttgcccaggctggcgtgcaatggcgtgatcttagctcactgcaacaacctctgcctccttggtccaagtgattctcctgccacagcctcccaagtagctgggactacacgcacctaccaccacacccggccagtttttgtattttcagtagagatgaagttttaccatgttggccaggctggtctcgaactcttgacctcaggtgatccacccaccttggcctcctaaagtgctgggatttcaggtgtgagccactgcgcccggctggaaggttttctctatgt

SEQ ID NO: 100446 - DNA, 1792 bp, Homo sapiens
tccaggatgatcctgaatttctgattgcaagtgatctgcccgccttggcctcccaaagtgctgggatcacaggcatgagcgagccactgcgcttggccagatttttatttttcaatcccaattggcaggtgccatttcagctggccatgtctgtctgctgtgacaggcagagcaggacctgctgggaattgtcgggcatcctagctggccaccctaccacctctattccaagaactggggaattctggctggactcagtccagagtcccacctcatcacctgttcacttccagttgtcctgaagctggctaccaggtctccttggccacctgaaggcctaatccttctggccccgccagaccccaggcctccagtcacctaaggcccagtgagtgtcctctcttgcttctaggtccgaactcgaaataacaacagtgtctccagccgggagaggcacaggccttccccacgttccacccgaggccggcagggccgcaaccatgtggacgagtcccccgtggagttcccggctaccagggttggttccccagatgcccagacccctgcccgcagtctctaactgggagatatgcctcactcactgcactactggttgtggctggtagataatctgtgtccttttttcacactgcttttcaggttcttgctttttcttttctctcctgggtaagcttcccgtaagcctgttggcttctctcctggtctgatctcagatgacactctgttgggaatggaagctttccctgttgacttggttcttgctctaacttggaaacaaggtagaaaacactgacatccagaactgtcttctccctcatgtcttcttcacctgtcttgaggcaaccctagcgggtatggcaacatttcactctctgagagtccctcgtcattacccatcatttgtgcctttgtcatctttctgtctctgggacagttacaatgactttctccccccttaagggatacgtgttcctggaaaagtttcttcagcggtctctgttctctttaacttcagtctttcctctttctttttgcctaggagccatatgggggtgccgttggtctctggtcaccgacatcctttgctctggcccaaactatgtgtccttctgtccacagtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggtatggccgagaggggctcctgcccagggtgactgaggaccctgaacacggggaaaaaccagttacctgctactgttggtaacagagcgacaacagttgttagaagtttcgtaattgtaataattgacatgtttgaattctaagtatcttccatatgcaccacggacctttctttaccttaatcctctcccagacataagtcaaatgccagtatttaccacgtgaatactgtggtttttcccaacatgacatttatgtaaggactgcaactgcgtacgttatacatttcatgtacgcccgtgtgaagagaccaccaaacaggctttgtgtgagcaataaagctgtttatttcacctgagtgcaggtgggctgagtccaaaagagagtcagcgaagggagataggggtggggccattttctaagatttggg

SEQ ID NO: 100447 - DNA, 1930 bp, Homo sapiens
acaagaaatctagtgccgccttatataagatacagaggagatgagatagtgctggctggggcttctatatcttggtggtagagttaattctgatatgtctgccttttgagtgggaggtgaccactgacattccctagggggaagagatcctatttggtgcctgcatgaaaagatttaaccacaaccccccttccgaggcctctccctgcacaggcccctccttcctctgtcacataccacagcccaggacagctgtctggctatgaaagggcccagtgtgaaggggaatgtaggccctggctgggggaatccctgggtgtggcctggcgagcacctcctccccacccccccattcatcacagactctgcctttgcagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccaggtgggaatgagtccccatggcagcacccgctgcctctgctggtgggaccacttcttgggagagtcagccacccctgctgccccacaccccacccagctttctagcagctggtctcaactctgaatgttggaaaaataggagcaggcatacgaaggctgtgccagctctatctggcttccccggccactttcttgctgatggtcacgtgcatataatttgtattgaatctgacatctgtcttgaagtcaggatgcagtgttgactagcaccttttttattaaaggaaaaaatagttaagctatgctcatttgagaaaattggaaagtgttaaagaagaatatgccacctgctaacattttgaccagtaccatatttctcccattataagataactctggtttctagaaatccaggacttgtcttacaatccatagatttaaaggccaggcctagtggctcatgcctgtaatcgcagcactctgggaggctgaggcgagtggatcacttgaggcgatcacctggacaacatggtgaaaaatagaaaaattagcctggtgtgcttggcatgtgcctgtggtcccagctacccgggaggctgaggtgggagaattggcttgagcccaggaggcagaggttgcagtgcgccgagatcgcaccactgcattcaagcctgggtgacagagcaagaccttgtctcaaaaaagaaaacagtccatacatttaatgtaatgttttttctgttttgttttgttttcccctcaaaagtggttaataagtcgaaggtgcgtcgtgcaggcagtaggaaattagaatcaaggaaatacggtatttccttcctgtcttttgactgtgccctgttttctatgcactttcttctgatttctttgcatataaaatggtcactggaaaagaatcaaatttcttgaaaagtcaatctgaactccctccccactctcccctcacatcccaccctcacaaataccctccaggttaacgttgggttgcacatccttccagatttttctgaacactagttggattcctgctttcccctttattaatattaatactgtaagcactgtctgatgtcattttgtcactaaagggtccttaagatttttaatggctgtacaattttctttcctagggtcagagtcaaatttaaccatgtccattaagattttctgtgtagatggaatagaaatacaaatgggttttacaaaatcccatttatagaatgggagccatattatgtaaaattaaaaagtgctgggctcagtggctcacgcttataatcccagcattttgggatgcaaataaccatctcttggatttcccagcattttgggacgctgaggtgggcagattgcttgagctcaggagttccaagaccagcctgggcaacagg

SEQ ID NO: 100448 - DNA, 1096 bp, Homo sapiens
ttcttgaatccaggaggcggaggttgcagtgagccaagatccacgtcattgccctccagcctgggcaacaagaaaggaacaggtgaaattaatacaaatcatgatttttttagcgctaaatttccaagatgttagcattttaatatccagctattataaaaactgagatagtctacatttatagtgctggtttcaaaatttcacttattttatatattttacatattacatattttacagatctcaattttgatgctaaatttgcaatgaaaatacttgatctgtattaactatatacagattcttgactaaatacagatgtagatggttaaacacaaattaactaaattcataaaacgtgcatttgagaaagcagactcatatgtctaggctagtcttaatgagccagttagttgacttacttgtcagtgttttaattaaccttaaatgcagaattcatttcctcaacagtttcaagttctcagtagccaccccctatgcctactgcccagcatgtcagatatcacagacatgggtatgccaggcttttagctttgaatcgagctttgctctctgagctgagtcatttttacatcctagttgtagccatttaaaaccttgtaaacatgtgttaaggatcctgggtgcaaggggttttgaatgagctcctgttgtgagttgcccatcaaggggccatatacattcagtgtggaccccctgtcatgccccaattgcagctggtacccaggcatagcatggtcttgtcctgggcccgcattctctctggaccctcctaccaagccacggctgcagtctaattacctttcacagagaacaagactcgaagacgcacagctgacgactcagccacctctgactactgccccgcacccaagcgcctcaagacaaattgctataacaacggcaaagaccgaggggatgaagatcagagccgaggtgattgttgggtacctgggatcatgggacagatgggaggaggacgctgcagatcaggaattgatctgtacccggctccctgacctcatctcatgccttcttcttttctcaatagaacaaatggcttcagatgttgcca

SEQ ID NO: 100449 - DNA, 1101 bp, Homo sapiens
tcccccatctggctaggtagggatgcttgtttgtgggttttataaaggtcctatctacccagccagggatgcaactccatgctgacctggtgatatgaagggaaggcagggttgcctactggttaaaggacctggattctgaaattacagccatttgctgtttacagggtgtgggcatgggcaagtcctatcatgagacaacaagccaattggagtcaccacaaaatccttagtgtcccagtatttaaagcttctcaaggattgtcacaccagggaggtccccctgctcagcgttctgcctgacatcatcctactggggcagccccttgcccatcttgatgttccccatctgtgaagtagggatgccacctggaagcattgttgagtggtagaagctgtgaggcatggcctgaggtgcaaagagtccttggcaagctgctggcctggagggaaatcttaggaactgagagaccccaggctttagcagctggtgtcagggcctcaactgccaaaagccacaaccctgtttttcttacagatggctgtttgtcttgtggcaggaaaaaccccgtgtccttccaccctctctttgagggggggctctgtcagacatgccgggtaagtcctcctactactgccctggaccttcctccccttgcctcctctaactcccctctccttcccaacagcacctgtgtggagactcagtgaagcccactcatcccagctgccttgcactctgcctctggggcaggatgggggacagctgtcacagaggccaatggcacgcaggtcacagccagttgtccttttaaaggacaccaagccaccagcagtgtgttctgcagctgtatcctagggcctccaccagcaagccggcagggcctgcccttctctggtctccgatttcactggtgtttctctctggctgccaggatcgcttccttgagctgttttacatgtatgatgacgatggctatcagtcttactgcactgtgtgctgcgagggccgagagctgctgctttgcagcaacacgagctgctgccggtgagcactgggccctgtggggtggatgtgggtgggcccccaaggctcctacg

SEQ ID NO: 100450 - DNA, 2138 bp, Homo sapiens
cagtcttggtcattgagttttatttatttattttttcgagatggagtctccctttgtcacccaggttagagtgcaatggcgtgatctgtgctcactgcagcccccatctccgaggttcaagtgattctctcctcagcctcccaagtagctgggattacaggtgctcaccaccacgcccagctaatttttatatttttcgtagagacggggtttctccacgttggtcaggttggtctcgaattcctgacctcaagtgatctgcccaccttggcatcccaaaccgctgggattagagacatgaaccaccgtgcctgggcagtcttggtcattttaaaaggacatacatcttagctgttacactttattttttatgtgcagttatcttgaacttgattttcattccacatgcataagtataattggagataaactagttaacaactactgctacctctggttttggttcccttcttttcctcctatatggagtttacacagccaatatgtgtggtgcgtgtacagcctttgctggattgaacgcatgtgatacagtcatgaggaactgttcattttaccatagcagggagtggaggaaatgagctgctgtgtgctcagcatcatttatgcttctgtgtctctctggcccccacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatgtgagggcagtctgtaccttgcgggcctcatctcttcctgtctttttccccagtcctccacaccctgaaacccacatgtaggccccatccctgagaccccagaaaaaaggattgaaatcctgtgggaatcttaagcattaggttagggtcagaagtggagttggtgaccaagcaagattctatttttttctggagacagtctccctctggagtgcagtggcatgatctcagctcactgtaacctctgcctcccgggtttaagcgattctcttgcctcagcctcccaaagtgctgggattacaggcacctgccaccatgctgggctaatttttatatttctagtagagttggggtttctccatgttggccaagctggtctcgaactcctgacctcaggtaatccacccccgccgtcagccttcctgggattacaggtgtgagccacctcgtccagccccacgcaagattctagaagtgggtccagctctctttccctctgtccacaccctcatcctgactctgtctctctctttcagattgaagaatggggcccatttgacttggtgattggcggaagcccatgcaacgatctctcaaatgtgaatccagccaggaaaggcctgtatggtgagcatccttctctctggcagtccctggagagcctatgtcacctgaccactggcccaggtgcagcagcctgagaaggagccacttgcttctggccaagttactggcagcatcaggggcctgttggtgctgcctacgctccatagtaaatcctcagcccacaagggaaataccctagtaaatagtgccctgctgctgcctgtgtccctgctgtcattcaggtggacatagactggtaggcatcaccctgaactgtcaggaggccattgggaacctgctggtctcagggaataaggtgggttgggctggaggtttcaaatgaaccctgcgctgtcatcttttctgagcacagagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggaggtgagggaatctggggacctgattgtcacagacagccagggcagggaaagcgctgctggcagtgatgattggtgggtgttgccaacattgggaatgactttcccgttcttggtctggctagatccaatagtgagggattcagtgggttctcttagtacatggaaaatattttttttgagacagggtcttgctctgtcacccaggctgaagta

SEQ ID NO: 100451 - DNA, 1004 bp, Homo sapiens
tctgggtggtttttacttttttacttaatcttgcttgatcaggaactctggtgtcttcttggccccccacgtgatctcgttcatggtcacttttttgtttatctcattttctctgaggctggtccttcctgttaacgtcttggcatttgtgggaagcacaaaatgttcttgtctctccaactctgcttttcgctccctgccctgccattcctctcccgcgcctgccctctcccttccatctttcccaggtacttttctctcccagccctgccactcttctgccgcacctgcgctctcccctccatctttcccaggtacttttgagccttgactccccaggtcccttcattctgtgctcactccatgatgtcattttgttctccagttaaagaaagtacagacaataaccaccaagtcgaactcgatcaaacaggggaaaaaccaacttttccctgttgtcatgaatggcaaagaagatgttttgtggtgcactgagctcgaaaggtgagcaaggctgcacttggagagggaaactgtgtagatcaaaacacaaatgggcagacatgggcaggtgcttaccttcattcttgatggcctcactgccctttggtgttactggggcgaggagtaataataccttttcatagttcgcccttatttcctgacaaaaatggcggagggggtgtggtggtggtgaggaatctgagacatgaggtcattaggccacaccatctgtctgttggctgcactgccgtgacatctgcctgtcccaacatgctgggacactacgatgtgtgagaagccagtgaaagaaaaccccacagacatgccattcttgaagacttcagtttgctcattctataaatgattccttcttagccacagtttatcctctccttccctttctttgggctaagtttgtctgttttgatgcaaataaccatctcttggatttcagttctgttctgttctgttttctttcactcctctattgtttgttcatt

SEQ ID NO: 100452 - DNA, 1025 bp, Homo sapiens
cctatagaggaagcttttggtatatttgatgccatctgcctggagtcatctagcatggtccttcatccggcagctgggtttgaagagggaaggaaaactctggttgcctgagcctgtgatgactgaaaatctaggctgtttttgagtgaccttgttccttattaaggaaattgcttaacttctcccatcatagtgttttgaaaatggatacattgctggctggctgatttagtatgcatgcatttattctaggaaggtcctctgagcaccaactctatgccaagagtatggtgctaggcctgcacaaaacgggggactttcatttgtgagcaatttgtaagcaagtgttctgaattaagggctctgaatttaggtccttggggaccttactgatgggactgagggatggcgagggcagaaagagtgggacctggctggttgaggctgtcaacatcctggaggcacttctgacttgctgtcttttcactccggtacccccaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaa

SEQ ID NO: 100453 - DNA, 1026 bp, Homo sapiens
atataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaattttttttgtaactggagccacgacgtaacaaatatggggaaaaaactgtgccttgtttcaacagtttttgctaatttttaggctgaaagatgacggatgcctagagtttaccttatgtttaattaaaatcagtatttgtctataactgtctgatgtcccttttcttctgcaggtcagatggatgggacatgggggagggcctggctaacatgtcagggtgggagtttggaagtaggtgattcattcattcatgtattcaaacgcaatgtgaccccaagctgactggagcttacttacagtgtaatacactggttctgcaccattggctcacgcctgtaatcctagccagggtgggcggatcttttcagtccaggagttcgaaaccagccttgccaacatggcaaaaccccgtccgtacaaaaaaaaaaccaataatccaggctgggcacggtggctcatgcctgtaatctaagcactttgggaggccaaggcgggcaga

SEQ ID NO: 100454 - DNA, 1364 bp, Homo sapiens
ggtgagccggctagcgggcccggggggtgcggctgggggggcggccgcgtgggccaaggccgggcgtgcgcgggcaggccctacgggcagcgccagggccgttccacacggcggtgctgttcgagccgggtgggggaagggcggggccgtcacccggcgcgcgcgggctgggcctgggggcgcgcgctgcgctctgctcagggggcggggtctcgggccggaagtgggctgctgctacgcggggtgggggtttctgggccgccgctgaggtgtggtccctgcgctgcagcgactggaggtcccagggtggttgggccctgggagggtgtgggcgaggtgggccgtcctgggagctctggggacgcacattgtgggaggccgtgttgcctgagggccgagagatcgggtggtggagtcagacctgggttgggttccgtgcggtgtgaccttggacaggtgctttaaccgctgtggatctcagcttcctcatctgtaaaacggggacagtaatactacccacattaaactcttagcgcgatgtatggcagaaagtaagccagctcttggactccctcctttcttcagtgtgtgtttattgaatgcccactaggtgttgggcaccgtgctaaaccctggctgttttcccgggaacaaagatttgctctccaggaatccacattatgatgagcaggaggacagtataacgggatggtatcaacagtgctagttcagtccctacttcacagttgccctcggatgctgcagggcagagcttgacctctgccccattttggggatgaggatcctggggcccattgagggaggttatgctaggccgggcatccgcttctccgatggcatgtctctaacagtagtaatgataatagcagctctttgttagttgggcacttgttttgtgtcaagcactgttaagtgctccatgtggctttgtgtcttttaatactaacactgtctttaagagagattctcttcttccttttttttttttttttgagacagagttttattctgttgcccaggcgtgcagtggcaccatcgctcactgcaacctccgcctcccgggttcaagcgattctcgtgcctcagcctcccgagtagtcgggattacaggcgcgcgccaccaagcccggctaattgttgtattttttagtagagacgaggtttcgccatgttggccaggctgttgtcgaactcctgacctcaagtgatctgtccgcctcggcctccaaagtgttgggattacaggtgtgagccaccgcgcctggcaagagagattactttcattttacaaataaggggtctgagactctgagaggcggagtgtcttatgcagcccagcaagt

SEQ ID NO: 100455 - DNA, 2072 bp, Homo sapiens
tgggcagttcatttcaggtcatgtttgtatgtggaaatccagattctgtggctggaatcttagtgtctctcgtttggcctcatggggaagaaggtgaggcttaaaaagtcaatgtacctaggctgggcgcagtggctcacacctgtaatcccagaactttgggaggccaaggtgagtggatcacctgaggccagtagttcaagaccagcctggccaacatggtgaaaccccatctctactaaaaatacaaaaattagctgggtgtggtggtacacgcctgtaatcccagctactcgggaggctgaggcaggagaattacttgaacttgggaggttgcagttgagtcgaggtcgtgccactgcactccagcctgggcgacagagtgagactctgtctcaaaataaaataaaataaaataaaataaaattgagtgttcctacaggtttgcttttggtgactctctaggaaacacttgaccttacttgcatgcctaatgtaacacaggcccttctcttttcttcccatgctttagaagatggcagtgaacgtatactcaacgtcagtgaccagtgataacctaagtcgacatgacatgctggcctggatcaatgagtctctgcagttgaatctgacaaagatcgaacagttgtgctcaggtaagagaaatctgctggatcatttttctaggaaagcctgtaggtttttcaggaatgtgaaggcctgtatctgactgcaaagccacacacagaggttcagggtctttgttagggccaccctgtttcttcctctcagccctgcctttgcttctgcttccaaaggaacttttttttttttttttttttttgacagagtctcgctctgttgcccaggctggagtgcagtggcgcgatctcggctcacttcaagctccgcttcccgggttcacaccattctcctgcctcagtctcctgagtagctgggactacaggcgcctgccaccacgcctggctaatttttttgtattttttttagtggagatggggtttcaccgtgttagccaggatggtcttgatctcctgacctcatgatctgcctgcctcggtctcccaacgtgctgagattacaggtgtgagccaccacgcccggcctttttttttttttttttttttttttgagatggggtctggcgctattgcccaggctggagtgcagtggtgcagtcttggctcactgcaaccttcgcctcccgggttcaagcgattctcctactttagcctccaaagtacctgggactacaggcgtgcatcaccacacctggctaatttttttgtatttttagtggagacggggtttcaccatgaggtcgaactcgtgacctcaaatgatctgcctgcctcagcctcccaaagtgctgggattacaggcatgagccaccatgcctggttggaactatacttaaataaagagtgtgctctggcctgcaggtccaccatcttctgctctagagactgcattctgaggcctgaagctcagccccgacttcttggtgtctattattgtgcatccagattgcatgttttatttgaggacagtaattgtattaactactgtctgctgttctagttttatgttcatcagtggcatttcttattcccaagaagtacaagatcaaagtctagcaaatatcatttcagccacaattttatggaactactgtttaacaataatttggcaaagatgtaatgatttaaagtctcggtgtggtggctcacgcctataatcccagcactttgggaggctgaggcaggcagatcacctgaggtcaggagttcaagaccagcttggccgacatggtgaaaccccgtctctactaaaagtacaaaaaaattagccgggggtggtggcaggcgcctgtaatcccagctgctctggaggctgaggcaggagaaacgcttgagcccgggaggtggaggttacagtgagccaagatcgcaccactgcactccagcctgggtgataagagcgagactccgtctcaaaaaaatgaaaaataagtagtgatttaaaagaagaacaaaaacatggtctctttc

SEQ ID NO: 100456 - DNA, 1068 bp, Homo sapiens
gagatgtaaaaagcccagggagacagacgtcttagggaaaaaaatgttttttaatctagatcaaggatggatcttggaaattgcctcctgaagaggagggtatatctttgtgaaaaatcagaaaatgtcacttttgttattttcttttctgtattttaggcattcatttttgtttctagtggtcattttattgtcatgatgattaccaataaagaacaggagttttaaaattttgtagaaacactccttttctccttgttataggcttctgggttgcaagtatgttgtagaatatatggggtgaaaaccacagtcttgttacaggttttagaaattgacttcacatgaagttagtgaagcttttggtttttgtaggtctacttcacaattttaaaaattgtatttggtttaagtgggtctgggaagaagttcaccctgcttctttaattgtatttttctgttgccgttgttctttcaggggctgcgtattgtcagtttatggacatgctgttccctggctccattgccttgaagaaagtgaaattccaagctaagctagaacacgagtacatccagaacttcaaaatactacaagcaggttttaagagaatgggtgttgacaaagtaagtaaacgttatcttttattgtggttaatgttccttaatgatcgttactaaggaggtagatgctagcttatgactttggacattttcttttttttcttaatttatctagttaacttttctcagttaacacagaatttactgggagcagtttgcccctaccttcttgcccctattccccttgcttgtttctttcttcatcgtctgtgaagttagtaactgtttagaggagtcagcctgtaaatttgtacagtgatttttatttttaaaaaattcctgtgtaatctctagtagtctggaatctaactctcttaatctggatttacttctgtaaaagcatactgtatgtagaatagttccagtagagaagattctaggccaggcgtggtggctcacacccgtaatcccagcactttggaggctgaggtggagaagattctagaa

SEQ ID NO: 100457 - DNA, 1058 bp, Homo sapiens
gccttggcctcccaaagtgctgggtttacaggcatgagccactgtgcctggcctgtgcagtggatttcatgctttgtgataggcattgtggccatgcaagttatatagcggacctactctttatagcataatgcacttttgtatcacgtcttacgatgtgcttggatggatgtgtgtatgtgacttatatggtacttgttccttttttgtttctgattccttttcatacatttgagagagtggggaggggttgggaagtgtaggtactcttgaaggcaaactgcatgaaacttgctttataaatttaggggcttagccctaaggtctctaaaatatttttttctccttttggcagagctttataatgaattgatgcatggactagtttgatgcttgccaaaagcctcttttttggggctaaacagttgtttttctctgcagataattcctgtggacaaattagtaaaaggaaagtttcaggacaattttgaattcgttcagtggttcaagaagtttttcgatgcaaactatgatggaaaagactatgaccctgtggctgccagacaaggtcaagaaactgcagtggctccttcccttgttgctccagctctgaataaaccgaagaaacctctcacttctagcagtgcaggtaaaaaaacaaccccaaaacgtttccaaaaaatagcgttccagatattcattcagcgttcaactagaatttttttcagtagccataggcttagggatcttaagaaatataatcccaggcatgtggccagagtatggattttggcatcaggcagataacggtgtgtgtccttaggtgtctgtagccctgtgtaagcaacttcaactctgccccacagtttcctcctctataaaatgggaattttaatacttgccccagagggtttttgaaacttgaacaagttactgtatgcagttttgccaaagctctagaaatccatcaggctagctcatgtaagagagcattagtttgttccaaaacaagggcatttttacagagccctaggatgggaagttataccagagctgaa

SEQ ID NO: 100458 - DNA, 1274 bp, Homo sapiens
attgtggaataatattccattgcatgcctatacctcatttgattcagcagttcatggtcttttgcgttgtttcccactttatggcagataggaataatgctgctgtgaacgttcatatacggcttctgtgtggacctacaagttttgatttctctcagttacagacccaagagtatatactctgggagcagaattgctaattgctgtgccatgtgttaactctgtatttaaccttttgcagaactacctgttttccaaagtgcctcagctctttacattcccatcagcagggttcccgtttctctagatattgagtactttttattctttacctgtttagaatgggaaactacatagataaccccgtgcatttcatatttcagatgctgctaccagttgagtggagacgtgcattaagcatttagtctttgggataaacgtgctagagagagtcatccagaggaaatgcctattactgtgggtgacaggccttgtgattatagtttggggtgttaggaagatgagatattttcaaacctggcatgtaatatgcaaactttacaaaataattgctaagtaggtgaatcatcagtgatatatataccttgaggtttagcccattcttgattaattttacttgtagataggttggctcctttactccttttttcttgtctttgtctgcttttggctgtaaatactgagagacgtctataaatactagtcagtgtgatgcttttctctcctcactcttctaaactccttctaaaaggtaagcagagatgaagattttaaagcaattcatgggaagagcaggctctcctgctcttatggattccctccctcttccactccaaggagtctgaggtgaggagttaggagggacctaactttccagatggggagcagtgggcacctggcaacagccgagactgtgtgctcatgtctagcgtgaagtttgcctttgctctacgaagctggatttggtttgtagatgtgttaactaaatcttagctgttgtaaccaacatgaaacaacctgtttgtggatttggtcagagctgggttaaggtggatcatctctgtgcaccagaatgactgtacccctttcagatggtagtcctgttcaccgcagtggagaaaagacctcactgaaggacttattcccagcatgaaacatcatgacagaaattggtacttaactctgctgccaggatagaaaccactcagtaggcaaatgtgggagcgttgtcttgcatgcgggggctctctagc

SEQ ID NO: 100459 - DNA, 1001 bp, Homo sapiens
attgagccctttccagggtcctttctattgaccccctcatgcaatcagacctggacttgattgtccagtcccttggtaaggactcagtttatgattgtcagctaccttgctaggctgtaattgtctcaggcttccctagttttttctccttaatcctttttcagtccctgagaagcttctacatgtttcaaggggtagtctgctctttctgggagctgttaccgtcaaggttgctataaacaaatccatgttgtttatctgaggctgaagaaaattgacattaaactgatgtggtttttgtctgtgttggggtttgatcaaagaccacatctccttttgggttagaagtctgcctgatattttattgccatactaatgccaagcatctcaccctttttaatgtcttgtgcaggtcaacgtattgaaacttactgttgaagacttggagaaagagagggatttctacttcggaaagctacggaacattgaattgatttgccaggagaacgagggggaaaacgaccctgtattgcagaggattgtagacattctgtatgccacagatgtatgtgtttgacatgaggatattttctttccattttacatagaagggttggtgaactctgtgctgatgcttgttgtattccagtgttgcattcatcaaaagacttcatctttaacccctcaaagtcagccagagggcatctctgcccagctttagcttctgcctgaggtctgtgagcttttgaagaaggaataggacaaggaggtggctggcttgcccagcatctgtagtatgtggccactgataggtgatgagtgccacaaactgctcttagccagaagcaacccatgtcctcactccaccccacctcctattgcttggatccctcagcttcagttgctgcctccattttatcagggcccggggcatgcccggaaaagcaggcacatgctccctttttcacggcgtgcccacatatcacgtcatgtctgggtat

SEQ ID NO: 100460 - DNA, 1035 bp, Homo sapiens
gtcccaccaggcttggctagtttttttttttttcgagacattgtctcactgtgttacccaggctggtcttgaacttctgggctcaagccttggccttccaaagtgctaggattacaggcatgagccatcacacctggccttctttcttctttaaaaaacagttttattgaagtataactgacataataaactgcacatatttaaaatgtacctttgatgacatgggtgaaattaccaccataatgaagacaatgtaaatatgcatcactttcaaaagtttgagggtaaatttgactgtgctcagtttttgtctttggtgagatgcaattctactacccaagaaataaaatagcagtcacctggcctgtatagagccaggaagaaccattgtttttaagaggctgtaagtatgaggaaagtgaactcacagtagaaatggatctttcagtggctttcccctctcattttcctatttcaggaaggctttgtgatacctgatgaagggggcccacaggaggagcaagaagagtattaacagcctggaccagcagagcaacatcggaattcttcactccaaatcatgtgcttaactgtaaaatactcccttttgttatccttagaggactcactggtttcttttcataagcaaaaagtacctcttcttaaagtgcactttgcagacgtttcactccttttccaataagtttgagttaggagcttttaccttgtagcagagcagtattaacacctagttggttcacctggaaaacagagaggctgaccgtggggctcaccatgcggatgcgggtcacactgaatgctggagagatgttatgtaatatgctgaggtggcgacctcagtggagaaatgtaaagactgaattgaattttaagctaatgtgaaatcagagaatgttgtaataagtaaatgccttaagagtatttaaaatatgcttccacatttcaaaatataaaatgtaacatgacaagagattttgcgtttgacattgtgtctgggaaggaagggccagacct

SEQ ID NO: 100461 - DNA, 1079 bp, Homo sapiens
gctccccttgcccactggggactcctctttggctccttgaagtttgctgcttagagttggaagtgcagcaggcaggtgatcatgctgcaagttctttctggacctctggcaaagggagtggtcagtgaaggccatcgttaccttgggatctgccaggctggggtgttttcggtatctgctgttcacagctctccactgtaatccgaatactttgccagtgcactaatctctttggagataaaattcattagtgtgttactaaatgttaattttcttttgcggaaaatacagtaccgtgtctgaattaattattaatatttaaaatacttcattccttaactctccctcatttgctttgcccacagcctattcagttcctttgtttggcaggattctgcaaaatgtgtctcacccactactgagattgttcagcccctgatgtatttgtattgatttgtttctggtggtagcttgtcctgaaatgtgtgtagaaagcaagtattttatgataaaaatgttgtgtagtgcatgctctgtgtggaattcagaggaaaacccagattcagtgattaacaatgccaaaaaatgcaagtaactagccattgttcaaatgacagtggtgctatttctcttttgtggccttttagacttttgttgccctaaaattccattttattgggaacccattttccacctggtctttcttgacagggtttttttctactttaaacagtttctaaataaaattctgtatttcaagagtatcatgtcttctgaaatttgtcttgccctgggtatatgctgttaggttcaagtgatgggaaaccagtgcttctttcttcagtgaggactgatcttttcacatcctttactgatttttcagatgtgcttatttcttcttcttcttcttttttttttttttttttttgagatggagtcttggtctgtcgcccaggctggagtgcagtggcatgatctcggctcactgcaacctctgcctcccaggttcaaacagttctctgcctcagcctcccaagtagctgggattataggcacccaccaccacgcccggctaattt

SEQ ID NO: 100462 - DNA, 2168 bp, Homo sapiens
ctcccgagtagctgagattacaggcacgcaccaccgtgcctggctaatttttgtgtttttagtagaaacaggatttcaccatgttggccaggctggtctcaaactcctgaccttgtgatccacctgcctcggcctcccaaagtgctgggtttacaggcgtgaaccactgcacccggcctgaatcatggttttttgaaaccattggcatctgaacctgtagctctctctggtagtgttgtgtggttttaaatgtcatgtgagctgagttactgacctcaacctactgccagatgaaggtgtgatcctgtgataccaatcttgagggtcccttctagttttagcagtcagtgacttctcttgtttatttttgtttgaaaaagtaaaaggctctctttttggctatagagttgcatcttgaaatttttgacaaattacatagagctgaagaaggatacaagttttgatatcttaaaatcacagggttgaagcttgaaaggacagtattggcattgcagctaagtgggagtgtgaggaagcgccttctctagggcaggtaattgcatctgttaatgtggtccttgggcccctgagttgctgccttccaatcagaattcccttagcattagccagtgacgcctgaattaatctcaggtaggacttctaacttttttccaaaattatttttgtgcagaggtttatctagatttttcttctaaatgtcctcctccccacttgttttattattactgtttttttctctctttaatttttttttttttttaatagagacatggtctcactatgttgcctgggctgatctcagactcctgggctcaagtgatcctcctgcctcagcttcccaaagtgctgggattataggcgtgagccattgcgcctggctctgttactgtttttctaacctgagttacttaggatcatattttcattcttttttaaaaagatgggagttttctgaacttttccttaactaaaaagtggaatgcatcttaatattttcctttttttacttgtgtttctccccagggagggaaaaacatatttattgtgacagaatttagcatattttaggccacattaaaatactgataaatgtattaatcagtgaaaataggttatagtgaaaaatatataccatttgattaataaaaatgttattggaaaaatgcaagaactgctgtaagaattgctaacattgtgttggaaaataaatatactaagctaagaaacaatgggaaactgtcatatgtagggccaacagcctttttttttttaaacccttccaatttattaatatctagtctaataaaccctgatttataggacctctgcaccttttttgactttttattcatccattcttaatattctacactatgacaaaatccttaaaactccattattgatgaaatgggaacagacttttgtttttgtatgttggtgttctctgagtggtgaaggcccagggagaatgttttgtttggtggtcacttagcatttgaaaacatccacttccttgtgacttagctgggtatcttttaacatctggaagccacgtccctgattgaaatctctggagacaacttacctttcaccaacttgtctgccaaattgcaccatggaccaagattgcagtggctgcatcaagtctaggcctgccctgaagtctggatttgtaagtcccccatttcaaatggggcagaaggcagaggagcagaggagccactgtgcctttcgctgtcctggagccagttggccttctggttttggtgaaccctgcttttataagaggactccctggcatcttccagtttcccgctacttgttttatgtattattttatgtctgtgtttgtcctggagtgctgtaactcctttcactgtctgctgtaagttcaacttcttcaataaaagaaatgtttcaaattggatgaaaaatggttctgtgattatggtttgtgggacgggttctgatgcttcatttatgttcttcatacggaattctgtctcatttccctagttctaaatatgaccagcagacccagagttccatctcgacttcataaaggagctgtcttggactgggaacagctgccaatgtctttgttgagatgggagttggaaagtgttagcactttgccagactttgcc

SEQ ID NO: 100463 - DNA, 1030 bp, Homo sapiens
caccccaactgtcactgcgtgccttggagggaagaggggacatgccagtgtccttcttcctgttctgtaagttcccttttcctagcttcagtccaggttgtgccagatctttgagggaagtcagtggttcttaaagaggaaagagtgcctttcagtctccccaggaggttttgaaagcacacaaaggcagtttgactcccagctctgtctggaaggaggccgcagggctcatggcctgccccctggcatctatcttctacctggaaggaccattaagtgcttaagcaccttggctgtaactccagataaacaagatgggtccctcttttagcaaggcatgatttcttcaggctttccatttattccttgatccagcaacaaatataataataattactgttgtatcattgtgctgggtgttgtataaggagaatagaatggggttaagagcatgagttctggagccagattgctagggttagtatctggtgctaccacttaccagctgtgtgaccttgggcaagcaaccacgcctctctgtgccacattttcttccttatgtaggtagtcagggtgcataaggcacagagaacaatgcctggcatgaagtgccatcaccggcacatctcagtgcccacagaaaccctcaggggaccaatgtttgttgaagccaggacccagccctggggcaacaggctcatgcctgccatcccagagctctcaggctggagtgggagatagaagacagacagacaagagtgaaagcgagctgggcacggtggctcatgcctgtaatccctgcactttgggatcccagcgagctgaggtgggtggatcaagaggtcaagggttcgagaccagcctggccaacatggtgaaaccctgtccctactaaaaatacaaaaattagctgggcatggtggtgggtgcctgtagttccagctacttgggaggctgagccaggagaatttcttgaacccaggaggtggaggttgtagtgagccaagatcatgccaccacactccagcct

SEQ ID NO: 100464 - DNA, 1055 bp, Homo sapiens
tttccaccctccaagaacttatgactgtgacaaatccataaactcttctatttggtagtggattccaggccacatgtgagttctgggaactgttcagtggacagttcccaggttactctctttgcctgacttcatggagttttatgctacacatgcaagtgttagtgttcagtgaagactcataaggaccccctgcatatttctgaaattctttttccgctttgctcccttctctctagaatttgcttcacagtttctaactatttcagtctccctgaacattgatccctctctcttcagtgcaggggaggaccactgtgctgtgcttgagctctcccctcctgcttcacaggctcccgtctggcatgtaccttctggcagaaagcaggggtgattggggggctcactttgttttccttctctcacagctcacagtcttgtatgatctcttgtccagtatccgaaaacagttgtttcatatattttacccaatttgctggttattatttataaggctgaagggtaaacttgtttctgtctctttaccatggctggaagagaagggtttccgtagactctagaagttaatcccatcatagtgatgttagtatcttcctggctctgtcttctgtgtgttgtgttggagattctgcctttcagtctgtctattcagtgagggcaagtaatgcaggccaaacaatcccagaacattcattcataagtgactagtatgagactgggtgaagtgaaagttggttttccaaatgcatcgctcataagtctctggctttaggcctgttggaggtccattcctgcagaaggcagttctgcacagacttattgattaattgattcattataatatagttagcaaaactttacagtgtttctgttgtgggccatacactgcccttgctggtgaagcagcagcaaacactgagtcttcagtgattccttggttaaggaatgctctgtgggtcagactcttggggatccgagacagagaaggcacagtttctaccctccaagaacttacaactgtgacaaatccacga

SEQ ID NO: 100465 - DNA, 1068 bp, Homo sapiens
ttctgggcatatttcgtgtgtttataagcatgcctgtatgtattctgtctacactaaagttacatgtgttgatctgcactttgcttatttcaagtaacagtagattttggagaacaatccacattagtacatatagaactatcattctgtttaacagccgcacaatattccattgtatagataaaccataatttctgtgactacttgcctattgaaatatttaggctgcattgcatcttatgtcttcataaatagtactgctgagtaacctagtatatgtgagtcatttggtatatgtacaagtgtaacgttaggataaatatcaagagtaattttgagtctatgattttcatgtgctaaatttagaatttaacccttgcaaaaatatgactccactacctttttatcttggaatgctcccagagccagagaaacctcttgcctctggcttgggtttctgtacatgtgtctgttacttgtaggtagaatgaacatggtcgccctctgtgcattaagaatagattctacaagtccttggtgacctccatcttctctcttttttttttttttaatagaagacacgggcatatcataggctgaaggatgatgtcccggaagaggtaaaattaaggcgtttggaggaactcatcactatcttccgagaagaagcaacaaaagccaatcagacctctgtgggctgtacccagttggtgctagtggaaggggtgaggccatatgtgtgtgtgttatgttgttttttatgtttcagaacattagatctttgatttttttcctcattatgttgcctaggctggactcaaactgctgggctcaagtgattctcctgcctcagcctcccaagtaggtgggactacaggctgatgttttaaatcaaagtttttgtagttttcagtatacagattttgtccatgttttgttagatttacacctaagtatttcttttctttttttgagacggagtctcgctcttttgaccaggctggagtgcagtggcacagtctcggcccactgcaacctctgcttcccaggttcaagcgattctcttgc

SEQ ID NO: 100466 - DNA, 1104 bp, Homo sapiens
atatttttttgtttgtttgagacaggttctcactctattgcccaggctgagtgcagtggtgtgatcatggctcacggcagcctcagtctcctgggctcgagcagttctacctcagcctcctgagtagctgggaccacaggcatgtatcacttgcctaatttttaaattttttgtagagacagggtctccctatgttgccctggctggtctcaaactcctgggcttaagtaatcctcctgtctcagtctcccaaagtactgggattataggcatgaaccactgtgcccagcctaatatggtatttcttttgttctgaaggtctatcattaacttgggggtacatctggcaatttatgttatcttaagattgaagcaataggggacttagtggataaccagatgcctcagatatttctagagcatttgggaaggagaccttttgagacacgagaccccttgttgtctgtctaccatggattccccccaacctctcactgcagtctacctcgagacctatggctgccagatgaatgtgaatgacacagagatagcctggtccatcttacagaagagtggctacctgcggaccagtaacctccaagaggtacatgcatttcctatttcctttgtttcctggacctgggcaagattctgcatttgtgccagttcttaggtgtagtttcaggagcagggtgccccctggtgagagagagttcccttgggtgaagtgttcaccatgggactgagttgtacttttgttccagctgtttttgaaacttttatggtgatgtgcgccttcagacaaggagctaagttaagaattggctgtggagagggaagttggagagttactgtttaacgagtacagggttttagttgcagaagatgaaaaagttatggaaaatgcgtagttatgaaattgcagatgttcttaatgccacaggactgtacccttaaaaatggttaaaatgtccaggtgtgggtcaccatgcctgtaatcccaggactttgggaggccaaggcaggaggattgcttgaagacaggagtttgaggctgcagtgagctatggttatgctattgctcttcagcctgggcaagtgagc

SEQ ID NO: 100467 - DNA, 1022 bp, Homo sapiens
tctctggcactcctttgtgtggtcttgggcaagttgcctcagtttttttcaactgtaaaacagaggtcatattattaggagtaccttcttcatgggcttttgtgaggggtaaatagatgtatacacttgaagtgctcacagcagtgtcctgtccatagtgttcaataaatgctggtgatgtctgtcattcttttgcagactgtgggctgtttagtgccatgcaccctttacagtgtgtcctccaagtgcagaggtctctggggtggggaccattggcctctgtgtcttggctgtcgctgaggatgtgcagggcacacagcagtctctctagtaccatgtgtcccagtccagagaggcaggaggatggagctcggaaggatttcagctccaggctggctgctggaccgacttttcaacattttttaaaaagtgcctcagctcctcaggagaagctgtcttcagaagtggaagacccacctccctatctcatgatggatgaacttcttggaaggcagagaaaaggttggttttacttcgcttatccctttgggcttcctgccttgctcctctctgtcattcctggcatgattcttttattacagaactggcttggaaggttaacagtgtgggaaggctgtgggaatcattagactccaccaagtaatattaatatcaagaaactcgactggtcacggtggctcatgcctgtaatcccagcactttgggaggccaagatgggtggattgcttgagcccaggagttcaagaacagtctgggtaacatggtgaaacactgtctctacaaaaaataaaaaattagccaggtatgatagtgtgcacctgtagtcctagctactcaggaggctgaggtgggagaatcatttgatcaaaagctgattatcattcagctcttaacttttagttggaatttattggagtctggaaataagacctgctggtggggacgggggttgatcttggaatatagtttgaagctgccagaatgtgaaattcatattctta

SEQ ID NO: 100468 - DNA, 1105 bp, Homo sapiens
ggcataatcattgctcactgcagcctcgacctcctggattcaagcgatcctcccatctcagcctcctgaatagctgggactacaggtgcacaccaccacacccagctaaatttttgtgctttttgtggagatgggatttcgccatgttgcccaggctggtcttgaactactgagctcaggtgatctgcccaccatcggcctcccaaagtgctgggattacacgtgtgagccactgtgcccggcccctcattctttttaatggttatgtggtgtcccattattgggctggaggactacacatctgtagtcctatttactcctgaagctgaggttggaggattgtttgaggccaggaattcgaggccggagtgcactatgatgcacctgtgaacagccactgcactccagcttggacaacatagcaagaccccatgtctacaaattaaaaaaaaaaatcccatggatttgtttattcatgtaacatatatttactgagcccctgctctgtgccaggactagatgcaggcaccaaggatatagctatgaacaagactgagtagtgagtgtctgccagtcagggagttcacatcttgtttttagcagcccctattcatgaatattcaagttgtccctagcctcttgcaggatggacaatagcgctataagccttctgtgcacctgtgagcactcatctgaagggtggttcctggaagggttgctgttaggtcaaaagggtcacatgcttttgggattttgtataggttgtaacccctgtactactcaagggtgtggtaaggtgagattttatcccccaaagtgtggcaacccctgggctctgctggtcatccctgttatagggcctgccagagtctggggactatttatagttcagccttgctagaccagcaagaccttaaaggtcatcccttccagggcctgttggaatcccaagtcctcttcacaccatcctgggtggatgggtgggcagctggaacttgaatcctcaagttcaagttgagggttgacatatcagtgcccattatataggcaaagaaactgaggctcagagagaccttgcctcatgcaagtgatattacggggcctg

SEQ ID NO: 100469 - DNA, 1037 bp, Homo sapiens
agatcaggcttttatttatttatttaggatctcactctgttgcccagcctatagcacagaggtgtgattgcagctcactgcagcctcaactcctgggctcaagcgatcctcctatctcagcctctcaagtagctgggacgacggcatgtgctaccacacctgcctaattaaaaaaaattaatagaaacagggtctccctgtgttgtccaggctagtcttgaactcctgggctctagcagtcctcccaaagtgctggggttacaggcatgagccactgcgcctgatcctgttattgttttctttagtaaactggaagctgtttgagggcaggaaccacatgtagcttgtctctcagcccccaggtctggcactgagcccaacatacattagatcttggtgagtgtttggagactgatcagtggggtatatcttggaccctttctactttacctttcaccttttcaattgctgttgactttcctaaatgtttaagatgggacttgagaatcatgctgagcttgactgactcttgagcttttctgttctgagtcctcagaactctaaggccagctccctactggctcttcccaggaagatggccactgccaggtgtcctgcctttgatctggcttgatgcatcaccactgtcaaaagcgggatgtcattctggatgtagctaatttggggccaccctgtttcaacttagctgagtcatgctgtgccccagagatgctggagggacccctgtcccaggaagagggcatgaatggaactcctgttcagttctcccatggccgcaaagacctgttgttctgaccattgttctcaaggaaaagtttacttggctgtgcacacgcatagctttggaccatgtgactccccacaaacaaaacttggcttaatccagccctggcctgttccccggaccttgattaaaatgtcttgtgggcctctgtaggcaggttctggccctgacgagctgtgtgaccctggctgctgctggtggtggaggaaataatagtgataataatcaggat

SEQ ID NO: 100470 - DNA, 1031 bp, Homo sapiens
ctgccacccaagctggagtgcagtggcacaatctcagctcactgcagcctcgacctcctgggctcaagtgatcctcctacttcagcttccctagtagctgagaccacaggtgcctggctaatttttgtatttttagtagaggcggggttttcccatgttgcccaggctgatcctgaactcctgacctcaggtgacctgcccacctcagccttctaaggtgctgggattacaggcatgagccaccggacctaatcaaaaatgatttattattagtgttactagtgtcccaaacttccaagatttttctcagattccctttattctcccattgccttttccagcactgggctaggcaccaagggaagccttcagaaataattgtgtcttgatgtgactcccaagtgttggagtatctgcctaagtcttgtcctccttctgtacctgtgcaggcggccgggagaacaagatgcctattctcatttccaagatcttcaagggattggcagctgaccagacagaggccctttttgtgggggatgccatcctgtctgtgaatggggaagacttgtcctctgctacccatgatgaggcggtgcaggtcctcaagaagacaggcaaggaggtggtgctggagggtaagcactgacgttccagggttcagaggggctgggtggaggtgttccactgcttctctacctcccccaggcctcagaaggccccatcccagcactgggggctgggaggtgggcaggactgaaaacagaaacagaatttggggacctgcctgaagacagtgtggggtggtggagggagagttggcatagagccaagcagacctgatttgcattttctgtcttccagtcactagctgtgtagccctggacaagtcacttcatttccctgatccttagtttcctcatttgtaaaacagggatgtagctcctgcctttctgggttgttgcgactagggcaaaaatgtacatggcagagtgtgccagcacctgagtgacacagggagagaggggtgcgga

SEQ ID NO: 100471 - DNA, 1036 bp, Homo sapiens
gatggcgtccggcaggcgcgccccgcgcaccgggctgctggagctgcgcgccggggcgggctcgggggccggcggcgagcgatggcagcgggtgctgctgagtctggcggaggacgtgctgaccgtgagccccgccgacggcgaccctggtcccgagcccggcgctccgcgggagcaggagcccgcgcagctcaacggcgccgcggagccgggcgccgggcccccgcagctgccagaggcgctactgctccagcggcgccgcgtgacggtgcgcaaggccgacgccggtgggctgggcatcagcatcaaaggtgggcgcgggacaccgagggcgcggggtcgtggtgtctgggggcagccgagggcgcagggggctggcagcgcgcccaggacatggagctggaggcttcctgtctgggggtaaggggggtctgaggaaacaggtaacggagggcactgggcacaccaaggttggagggggtttcagtagttggtggccttagggggcacggaagacacaggtgtggataagattgtgggagcaccaaggacacgtgggtgggagttctgtgtggaggcgggggggtctgaggggtaaccagcatgaacatcaaggacaagaggggtcccccggaaagcagagtgtggagaaagggggttgaggccgggacaccagtgggacagggaggagggagtccctgagaagcaaccaaggtgggtgcagaggggaagcctggagtctgggaagcacaggggtggataggaggcctgggtgcaggcacaggctggggtcacaggcagaaggccagcaaggacctaggaatctaaggacccaggaaggctgcagggagccctgacagctggatttgggtctcctgatctgactatctccaccttgcacaggatagagctttcagcccccaggactgaccgctagtggggtgcagttagggtgcaaccagactgtgtttgaatccaggatcagctgtgtgaggttgcaaaagtcccgtcccgcctctgaatctgtttcctcaac

SEQ ID NO: 100472 - DNA, 1369 bp, Homo sapiens
cggcgggggcgtgcccggcgggcggggcggggccagccgggggcggggcggggcgcggcctaacggcggcggcggcggcggcgacggcgacagcagcggtggtggtgtctggttagctcggcggctgcagatctcgcggcgacgcctgcgagggacccgggccgcgggtcgaggcgggcggcgcctgcgagggacccgtgtcgcgggtagaggcgggcggcgcgcggcggcggcgctcggcgatggtaggcgtccctggagcggccgccttccagcgtaagtggggcgtgaatgcgggcggccgaggggggcgtgtgagggcctgcggctccgcaggcgcggtgattccgagtgccccgggcgcgaggccgggagtggaaactgaggcccgaagcggggcggcggatccaaggtcacgcagcggggcgggccttcccgggctcctgaggccaccccgtcgcttcctgcgccgcccgaagagctcggggctcacggtgtgagggaaattgtggggcccgcggcctcggaacttaggccgggccggcgtccatgggacttgccggcgggcaagaatcattttgttgtcccagcgctggggccacgaagtccggctcctggggaaatactacacccgcccgatgttgagggttggaggagatgagaatggcccctcggagggcctgtttgagcgcaggctcagtagttggctacctgggttcacatccaggcttccccatttaggtagtgaccttggctctcccggtgcctcagttcccccatctgcaaaatggggatgtggagcgggttccctccctcccccagggttcttgggttttgtgaggccagtaaaacgcttgacaccgaccgtggcacacacacaattgtgaaaactgtcattattgtaatcgtcctttattaatctgatccagtgtgcaccgcactcggaaaagtccgaaattaggctctagccgtgttaagattttgttttgttgtctgttagtcctgctccatgatctaattgttattcttacttccatttagccattccagtatttatctagtgttcctccttgatgtgtgagatccttgggggaggggtggcttctctgaataagaacaataaaattttaattgtttttcattattgtaattataatagccaacatttttttgagcaccagacattttgcattctattcacttaatatttattaaatcatatagtaagtttaaaaataccattccaggccctgggaatacaataaacaagatagaccgaactggggttttgagtttagttaggagagggagagacatagtaaatgaggaaacagataaacatgttttgcatgtttttttaattgtttaa

SEQ ID NO: 100473 - DNA, 1050 bp, Homo sapiens
caattttcagctgccatcctagatagtttaccaatattgatgagtctttcttaatggggggacatttctcggaggatttaagtataggttaagtcgatttaaggctttagggggagaagaaaacatttctcaattataaagtatacaactaggaagaaattcttatttctcatattctgtttatttagcactatccattcatttagcacatttacttgtattgacactaccatgcttatgaagccgtgatggctagggagtaatgagcttgttttgctagtgttatcttctataaatgttctaaattaagtagttggggaagtggttaatgacaaccaaatttgtaatctaggattgttaccctctaatcaattctttttaaatttcttcctgacatttatcttgttataataataactctctgacattattattataacaaaattgttgtatttgtgttttggggataaaaggcatattttagcatcctatagtttaaaatggtgtttgttttaatctgggtgataagatggaaatgctgacctgggcttgcctgatctacagctaacattgttctaataaactgcatggagtccaggtgttttactttaactgcagctgtaccatctgtgggagcaggtggacagattctgtgtcatcaggaaaatacagctggtgagactaaggagaagagctaattgattgcttttccagctctctccagtcatatatacctaagcatagcatttaccttggcacaggtgttgcctttggtctggatagtaacagcaaaattgaacaaaaaaagatgtaaatttgagctgcgtgtgtgtgtgtgtgtgtgtgtgtttcttggttggcattgagaaagataatttaagggttttttgtttgtttgtttaggttttatttttgtttttagttacttgaagatatttccagctcgttaacttctctgagagagttccttgtaaggctacttataaatagtagtatatatatatatagtttatggcagggaagatctgggaagtaagcaaaaagagcctt

SEQ ID NO: 100474 - DNA, 1001 bp, Homo sapiens
cggtgcgtgttccatgaaaataaagatggcgccaggcgcggtggctcacacctgtaatcccagcactttgggaggccgaggcgggcggatcatttgaggtcaggagtttgagatcagcttcacctacgtagtgaaaccccatctctactaaaatacaaaaattagccgggtgtggtggcaggcgcctgtaatcgcagctcctgtaatccaggccgtggcaggagaattgcttgaacctaggaggcggaggttgcagtgagccgagatcacgccattgcactccaacctgggcaacagagcaagactccgtctctaaataaataaacaaacaaacaaacaaggcttctagttgcagtaggagggacgaattgagagcaagggtttaaggactaaatgcagggtgcagtacagtgtcagtgtcagtgtgcagtgctcaggaaatatttgttgaaggggaagagtatgcttcttcagtccaaggtggaagcatgaaggaaactgtaagcacattgatctagaccacagtttcaggtacagaggggagcgttaactaaagctcagagcggggaaagcacagggtgcttacaaaatggcaaatgctgtcatttaggccagaatcctactcacactgctgctgtatatcctcttcatctgtgtttaggattttgaaatgcatttttgttggattattgccccactagaaaaaacagttcagatctgttgcagtttcacatttgaaactactttcattctggaatccttatccttagaccttcctaataatttctgtggtcacactggacctgatctcttcctgtgctaaacaaaagcacacaatcacaaaactgtgtaggcataaatgagaggcatatgggagtggtgtaaaaggaactggaagagtcttaatatgcctgggtgggcgagctaaactaatagctcccagcagtttttctgaatcagacattgtggagccaggagtctagcatttggaattccactgc

SEQ ID NO: 100475 - DNA, 1246 bp, Homo sapiens
gaagagggaacttaggaaggcattattgagaagttgacatttgagtttacagcagaaacgttgggcaaggggtagggaatgatctctgagatagcagcatacccgatctactagctctttttcaccaggctatttagagtttgacatttatgttacatttataacaaggtacatttcaagtgtagctttcctttttgctttaagcaactgagacatgtaagtcaatttcagttattttctgctaaactgtgtgtctctttgaatgttcactatcaaggtgaattatacaaggtgtgttagatccttttaacatttcagagcaaccaaaaccaagtttgaatgtctcatttaacactgtgagaggatgtatcttgtctgcatcttgtgtttcagttgtatttatcggtaaaataagccaggggagtattctgacttgcagtttaaaagctgacaggcctaggggaatgttccacaaaatagtatattttgtatatggcatggtattatagataaatgagctattgtgctgcctggcactgtcttctcccttgtgctgtcttctgctgtttctcaaggagtgattcctctctgtgttttggaaccgtgtttctcactgcctacagatgatgtccatttggcttatttcactgtcatctcatacacagctgtttcaaactgcatggaatcctcagagaactacacgccccttcctgaacaaacagtgcttcttcctgcattttcttcttaaacttttatcacttttccccccttacatatacttttgttttattctttcactaaaaaaaaaatgaggtttaattgacttacaataaactacacatatgtaaagtgtacagtttgctcaggtttggcaggtatacctgtgaaatgatcactgcaatcaagatagtcaacatatcattcactccataaagtatccttgtgcccattggtaatctctccctcccatgctccccctgccctgtctccaagcaaacactaatctgctttcagtcactatagattagtgtgcattttatagaattttatgtatatatgttttatatagatgaaatcatacaatatgcactcctttccttccatcctttcttcctttttaggtctggtttctttcatccagcataattattttaagatgtatgtatcagtagtttattccattttattgttgagtagtattctgttgtatggatatatcacatttgtttatttgcctgtggataga

SEQ ID NO: 100476 - DNA, 4768 bp, Homo sapiens
tgaggcgatctgcccacttcagcctcccaaggtgctgggattacaggtgtgatccaccactcctggcccaattgtgatttttgttgttgttgttgttgttgagacagggtcttcctctgtcaccagcctggagtgcagtggcatgatcttggctcactgtaacctctgcatcctgggttcaagccattctcctggctcagcctcccaagtagcttggattacaggcgcccaccaccacacccagctaatttttgtattttttagtagaggcggggtttcaccgtgttggctaggatggtcttgatctcctgaccttgtgatccacccaccttggcctcctaaagtgctgggattacaggcgtgagccattgcgcctggccaattgtggtcattttttattgctcctcaaattaccccatctttgttagtgggagcctcttcacattaactctctctgagtccttgggacataactccagaagtgattgatggcctgattgctttctgttatgacaagttttgtacattttctgccctatacctggagttgactattttcctgaagagctctgcttccttttattggaaaatgctatttaggatccataatctgagtgctagaagtgaaagacccaccttgttttcctttttaaataacagtatttatcacctcacatggtttgtatgggtcataattctgaggtgccttagttcgatggtagtggcttggtgtctgctgtcaagatggcttacttacattgtaggcaatttgataccggctattggcaagatgtctcagtctctccccatgtggaaggctcttaggactgcttgagtgtcttcacaacatggtagctggcttccttgagaacaagtgatccaagacagccagcagcatctttggattcattttcttgtcagcagtggggtgtagtgctctagctgtgaattcagacaacctgatgctgacactagctatgtggcattaacttgtttgaacattactttccttagctataactttgagacaataatacctaccttataggccctttaacataggacctttgtagcaatgcagggaactagaatagtctctgacacttagtgagtacacatgacaaacactgaacctgctggtgttactattattaccaccatcactggtatgaaatgaagccctaaaacctagtaattaagttgcccttgacagaaatagccttccttcctatttgtcaaaaattgccatgacagaaatattgtttacagattgcagatatatcccaagtatggtagaaggttaagggttagagaattataaccacacctgtttgactatatatatatatatgcaggggatctttcatgccgaatctgtattcatgtagattttagtataggatatgtgtcatgtaatgtgacccaggaagaagccaagacccccgccttcccctggccatctttttttgcttttgcttttgctttttttttgagacggagtctcgctctgtcaccaggctggagtgcagtggcatgatctcagctcactgcaacctccacctcccgggttcaagcaattctcctgcctcagcctcccgagtagctgggattacaggtgcgtaccaacacgcccagctaatttttgtgtttttagtagagacagggtttcaccatgttggccaggatggtcttgatctcttgagcttgtgatccgcttgcctcggcctccaaaagtgctgggattactggtgtgagccacagtgcctggcctttctttttcttttcttttttaaagatggggtctcactgtgttgcccaggctgatctcaaacgcctgagctcaagcgacctgaccaccttggcctcccaaaattgcccaggctgatctcaaacgcctgagctcaagcgacctgaccaccttggcctcccaaagtgttgggattacaggtgtgagtcactgcacctggctaccaccacccacaatcttttaactttttattttaaaatgtagattcacaggaagttataatgaaaaatgtacagggaggtccgttggacccttcactcaatttgccccagtggtaccattttgtgtaactatagtatggtatcagttgtcaaccttcgatttttatttagcagaaattgactgagcagctattatatgctagctctttgaggtataaaggattaaactctgaccttatgggtttctgtcatctctctggattttcattgttattgttcttaaaatattttttattttggcgactcattgttgacacttatattagcagttattttaatgttaaatattatgttatttctgacatttatatttgctctgttttaaaacaattttgcattgtgtccccatcttccatttataatctttacagcatcagaaccatgttgcctgcattgtcttattttaatcacgtgccagttttgcagtgctaccaagtctggatctgagaggcagcttgtgtgaatcatttacatacatttctgtttatattccccaaattaatttgcaactttatatttttcatccaattatatgttcaaaacatatttttaataattgattttaagaaggaatttgttatattaggatttaaaaactggctcaaaaaacagaagctattaaacaatagcagaaaccagacagtatataggactttaaatggtaattgctaaacatttgaatgttcccaaaaatgtgagtctgtgtgtctctgtgtgtctctacgtgttattccactagggatttgcacagataggttttgcacaatatccttgctgttattgtcagccataaacaaattacacgtatttaacaagttaatgtcagattggccaggagccactgggaggtgtgtacttagtgacatcagctggcaaagagccctggtaacagggagggttggaagggtagtggagagagaggaagcaggagggagggagaaaaagagagagactgactgtatctggggattctggcaaggtgaagagctggtctgtttggcaggaccttcccatctgggatccatctgtgtttccctggaatgggacaggcagctctagtcagtgagaaatcgcagatgtgagagagctgacacatgtccagctaatgaaaggaggaggaaggctggtctccgattgagctttgaagattaggaggagaaaaagaggagctttggaatatctatttcaaataaatttggtgtatttaagaatctggattgtttataatttgggcatttggggtaagtacattttaatatagttttgggggttaaagtgcacaattctctgcctttcaaagctttttacttctttcaaattacgatgatatgaatgtttcttggtatttgatacaagagttcagcctttctactcagttttattttaatgcttcattttatttatgtttctatttttctgttgccaaccttatatttgaatgtcatgcttttttgaatgcaaggtttacttaataattagatgtagtatatgaattctacagctagaaaagtagtcccacaaatatttctgtaaggttttccacgttggattgttctgtgatgtttagagggaatttttttcccctttagtatgcataatacaaataggccatattaaaaagatggctcataaaacgctcttttctattgtcagattttatttcagtatatgcaggcaaattataactaaaagaggttgaagcaaaactaacagcatctcttcgttttagatatatctaacagtttttcatttacattttgctcctatgctgttttcttctgttttcttgctacatataaaataaataacatcaatgaatctgacttgaattgtgagtttggggtagttttgtgatgcaataaattcatgtgcatataactacgtactgtgttctgtagtcctggttagtttgtgatgcctattttagatttttgctatttcttatatataagaaatagagatgggtctcactgtgttgcccagactagtctcttaaacttctaggctcaagtgatccttctgcctcagcttcccaaagtgttgggattgcaggcatgagccactgcacctggccactttttactgtttccatacattgtattcatgtttttgaggccttcgaatctaggcttcctttccatgttctatggaaagaacatgagtttgggagttacacaaactgtgtacccattatttactagttctgtaatctcaagcaagccactgttctctttgaatctctattttgtgtaattcctgactgatgttgttattggggaaatttgtctggcacatagaaagcatacaagttggtttcaagagttctagatgttcactttttttgctgcgatagattcctaaaccccttgcatttttaacttcagctcctgggcaagaatgggtctggcctgtagttctagttttcagggcgcccttcctcttgctgtactcgtctcagattgtctgcatctattctaaatgttctatgctatatttgccaaactataccagaacagaagaactttgaaaaagtcaacaagcaggagtgaggtactgaattgtactgctttgtgacgacactgttgaaattgttccccccactccgcgacctcccgctggaaaattgtttttcccccgtgtattacaagtcacgcaaaaattctaccatttctcaaatagaaactttaaaaaatatttttattccttaaagttcttcagcctttatttatattaattgggt

SEQ ID NO: 100477 - DNA, 1203 bp, Homo sapiens
gtggggttttgccatgttgcccaggcttgtctcaaactcctgacctcaagcaatagagccacctcgacctcccaaagtggtgggattgcaggcatgagccaccacgctgacttgaaggagacttttaaaatggaacttttcccaagttttcttttcttttcttttctttttgagacggagtctcgctctgtcacccaggctggagtgcagcggcgcgatctcgactgactgcaagctccacctccccggttcatgctattctcctgcctcagcctccagagtagctgggactacaggcacccgccaccacacccggctaattttttgtatttttagtagagacggtgtttcaccgtgttagccaggatggtctcgatctcctgacctcatgatctgcccgccttggcctcccaaagtgctgggattgtaggtgtgagccactgcgcccggctccaagttttcttttataccaaattgactaaaatgattttgtaaaaatttgggggcatctcttttgataggtgcattgttcaacaagcatctttgggacttttctgaatacttgagaggatatagtgtttatactgaattcacatggtactccttcagtgagaaaacactttccattgtagcctaggagacatgagtggggagaaaaggacttaatgcttttctgtaggatagggcctactatagagggcctgaaaaggggatttcatatgactatgtccatgctaggaatactttggatgctagagtttcaggaaacataataaataagaaaaaatatgcattttaggatgtgaagattcactcactgtaaataaagttgggtgattaaaagtcttgctaggaccagacatttcaggagagtattgcttgctactgaggttataaccaagatacatttgagttgaatactggagaaaatcatgattctttctgaagattatggaagcatcatgagaatcttactactaggaggaaattctcctaaattggcttccagtaatgacccaagcatattttcatagcgagggtccttgttggactggaggcacataatgcaataatgccaataaactggagatgaggataatgacatttaagtggctttgcgggaacatcaaaaaatacatttgagtgaacgaatgtatttaatacacaactggaaaaattcagttggatccgaaagattggttg

SEQ ID NO: 100478 - DNA, 1092 bp, Homo sapiens
ggaggcggaagttgcagggagctgagatcatgccactgtactccagcttgggcaacagagcaagactcagtctcaaaaaaaaaaaaagtacaaaagtagtaagtcctgaaaattagcaccaactgtaggaatcagagaaccttcctaaaggaggtcgcgtttgatcagaatttagaaggacaggaaggatttggacttctcatgtttggaaggagcatagtggcaggatggaaaggttccctttcttctagagccttaaattaaactttattaaatgcataattacatagtattcatttctaccatgttttgaagtatgtctagctgttgctgtctttccaaatccaagatcagttgtttacttctgagatacttacctttatgcatgcatagccgtcttttatatgtgtgatttatataccaggaagctgtgatttaaaagattgctaccatgatggactctgtggattgtttaattttccctccaagttcaagtcagtaaataaaggaattagtggtggttgtatcttgcagaaaaacaacatattataactggtgtttgtattttcactggctgatggactttccaaacagcatttgacttttgagaactatatgatgacacagattgatactggggaatttaaaatgcatatggatttaattttcctaaagcatgccaaaacctgaaaaagcaactctttgtgttttgtttaaagcaacagctcgtggaaatcctgttatcgttcaatcctcagcagtttgttatagatgcctggcaaggtgggatgcagttctgtatatgtatacatattatctgcagttgtctctcgtagctggagctctgcagtaaatggagtgtgtacagtagtctccccttagtcgaagtttcgctttccagggtttcagttacctgtggtacagtacgctaagacattctgagagagagaccacattcacataacttttattacagtatattgttataattgttataatgttttattcttgttaatctcttactgtgcctactttgtaaattaaactttttttttttttttttaatttgagacggagcttcactcttgttgc

SEQ ID NO: 100479 - DNA, 1335 bp, Homo sapiens
accataagctgatttaaccttcacctctaagcctcagttttctcagctgtaaaatgggaataaaaatgagttctaaggatttaattagaaagaaattagcatgatacttcctgcatcagcactcaataagatttctctttccatgtgatttttcccagtcccccaaaaacattgaagtcacaataactaaaagatttacttaaaatgggagtcttggatatttttactgtctcacttgagactgacagggaacccagttccctaactaattctaagtcatgggagaagggtgcgtgtagagaatgctgtagagaatgcggcagtctttaaaaactcaaacctgttgctgtgtggcaagctgttaacatttagggaccttgcaccacttactctgctggaagagctgggggatgggctgctttgagggtgacagatgtgtcctctgctgccggcgggcgcgtgcctgctctgtccctctgctcccagcaccaggtgcagccattgttctggctggtctctcttcatccggcctcgtctgttactctgctctttctagctcattgtttctgtaggaaattagcattaaaaacccatctgaaacccccatgtccctcaactgcaggtgactgttattggccccagctgccacccttgcgcttgattacttccatatgggtctatgcaaagaagtagtagccatttattgatttccaccacaaccccaacctctattactcaaactataataccctgaaatctattagacccccagtaggctgtatagctcagttggcgctacaactgtgatgaacattttacaagcaaaactaattacacccttttccccacccccatcacctcctccctaaatattaaatgtagaaacaccagagtgtcataagtggaatagtaaatcttttaaatgtctggaaatgaatctgtttctgagtagtaaagcttttagactttggatgggattttatggaaaattttagtcactgctttaatatttcatgccacacccataatattcaagcaaatcgtggcccagtgcccctagggtgggggtagggcacacaaaaattttcatcacttgctttttggtttgttaaatttaatccagtgggcagtatgttaggaaaggggcctagtttaaaaggataatatgttttgtgggagaaaacaacatgcagtcattgttaaatgctttaattttgcattattttgttgtttgttctctgtgtttacacaaataattgttctagtttactcattagaataaataccacaatgagaaggtcgatgttttagacttctttcttccttcatcagtaa

SEQ ID NO: 100480 - DNA, 2276 bp, Homo sapiens
aacatggagaaaccccgtctctactaaaaatacagaattagccaggcgtggtggcacatgcctgtaatcccagctactcgggtggctgaggcaggagaatggcttgaacccgggaggcagaggttgcagtgagccgagattgtgccattgcactccagcctgggaaacgagtgaaactccatctcaaaaaaacaaacaaacaaaaactcttataaaaagttgttttctttttaagcagggaagcctgacttcattggcattttgagatggaggcttctgggcaaaagaagaatttcatgggggtattttgagatgagtatgatcaatctagtcaagagatggggaaggtctaagctttgtctcttgtaggtggaatggagaagggcaaagggtttgaattttggttgtgtggtgtgaagaatgattggtcttaaaacagatttaaaatgaaaagattaaactgatcaatgttttttatgcttttaaaaaatgtggctgataaagcgtttttgtgcttttaaagggagcctggatgaataggctttggtactgtatgtattgtattaaacatttggagtggcaaaataatttctaaaatatttctagcaacttcattttcattttatctgcaggatgaaaaagtaaatttggggattgttgattaaattagcaaaccatatggttgtttgcgcagactgactgctatgcgaggtagctgtgttatttttctttcaggatatgctgttgtatctgatgccagtgttctgaaacacttattttctagtcaacagtaggtgaagcaattatttctagtcattatggtttttcttgatgccttaattaatgtcacaatttgtgaatgctttaccctgctgtttaaaattagtttaatattttaaaagattaaatcttcacatttatgtaatgcttcccaacctcttttcacatcatagcatacatagaaagtattaagttctgattggctgtcccaggctgaggaaatcattatctcagtaaactgataatcattcttcataactctctggcgttggtccctggcacacagcttgggaagttctgtcttaatagaaaagatatagaaacctttctgtactgtattgcagttagttaagaggaattaggaaagagttatagagtctttcttaatagggttttttttttcctttttcgctagaagcctaaatctcaccaaattatcgggtgttatactaggaactatggttataagagtgaagagctcaaggaactcacagacagacaggcacagaaacaaatcacctgtggcacaatatgacaaatgacatcacagaggtgtttatttttatttttattttttgagacagagtctcagtctgtcgcccaggctggagtgcagtggcgcgatctcagctcactgcaagctccacctcccgggttcacaccactctcctgcctcagcctcccgagtagctgggactacaggcgccagccaccacgcctggctaatttttttttttttaatgtatttttagtagagacggggtttcaccatgttagccaggatggcctcgatctcctgatctcgtgatccgcccaccttggcctcccaaagtgttgggattacaggcgtgagccaccgcgcctggcctaagaggtgtttataagaagctgtaagagtccaaatgtgggaggttttatttctgtcaaggtgcacttgagtctaccagggaggacttggagttagaccttaaagtaggagtttctaaagtgccagagacagggaaagcagggcattgcaggtggagagcacaacctgttttataggctttctgcctccttaatatctagcagaggtctcatcttaatataaaagtagatactggaacttaggagtttgctctgatggcagacatggatacttgccctgccagagtgcccatctaccttccatttatgttgtttggattcagtctccactatactatagccttatatttgcatggtgcttttaattttcaaagctttttatccaaataacagcccctcagggataggaaataaaagccagctggtagtgtttttatttttatagaggagaaaactgagacatcaccatcatatcagcatttcatttcccagataagaaggtctttttttcatctcttgattgcaaagggtgctgcccaacaggaataacctctcccaattttctgggcacagcccagagtgctgactgaggcagccaccaggagggcgccagcaaggcagacagcatg

SEQ ID NO: 100481 - DNA, 1021 bp, Homo sapiens
tgaattgagagggtgctgattgtgtcactgaaatgtttgccaaagaaattgtttttctagctgattttgttctgcctccatctttcagtctatttggaaaacacagtagagtacctggttatctttcagagtgtcattgttaaataatcatttcagtaagcagtgatggctgttgatcattttagacttgtgcctatactaagtatttatccatttttctaatatacctggatttttaaaaatattgatggataaaaactttctggattgttgattttgaggaggtataccaagaagagaagggtgatcttggtgtggagccaacatctttgaaatcttggcttatttgttcttactccttaaggcaccccattgccactccttaagcccatgtatttgacagtggggctttttgtcagaagcctctctgattgtcatttggggacttaaatgggctcctacataacagcttctatgcttcaattttctaacttgtccagggtgtgcttcagctgtagactgtgtatttacgttcatatatttgtgaagaaagacaggaactatatagtagaatgtgaagtctctctgaactgtaatcaatgtgttttattaaattcttggtcacaatgtgcaaacttcattgagtcctacaataattaattctttttgcattatttattttgctatagtatggtctctggagctcagcagagctgccatttcttagccatatgacttgggacataatttttgacttctctgagccttagcttctggttaaataaagtggtattggagatggtaccttctactgtcttagtgtcatttaaataagaaaatattttagcaccattctttgcgtgtaataaatattttgttatttctaaatgaatatatgaagatggagagtaatggtagctattactattatagttatttcctgacttgtatttatccttcccagcaagaaagtcttgtcctactcaaatcttgggtaaatatgaaacttgcttcattatca

SEQ ID NO: 100482 - DNA, 1943 bp, Homo sapiens
acaaatgatgcatttcaggccttgtgatgtgaacagaaatttttttatattcttcattacgcagcagctgatagcagcatcacaatttgataggggccaggcacggtggttcatgcctataattcagcactttgggaggcccaggtgggcagatcacttgggtccagcaattcgagaccagcctgtgcagtgtggcaataccctgtctctacaaaatacacaaaaaattagccaggcgtggtggtatgtgcctgtagtcccaggctacctaggaggccaaggtgggagaatcaccctgagcccaagaggttgagactgcagtgagcagagatcacaccactgtattccagcctgggtaatggaatgagcccctgtcttttatttatttatttatttttaaaaaggcagactccatttgggtaggatgtatgtgcagtatacagataacattgctgtttgtttttgaatgaaaatgtttcctgaagccatagcatgagtattggaatgagtatatatgtctgccctcccttcccctcccttgccctcccctccccgtcctgtccatccatcccgtccctccttctttccttctttctttcctgtcttgagacagagtttcactctgtcacccaggctggagtgcagtggcgtgatctcggtgcactgaaacctccacctcccatgttcaagtgattctcctgcctcagcctcctgctgggattacaggcacacgccaccacacctggctaatttttgtatttttagtagagatggggtttcaccatgttgatcaggtgggtctcaaactcatgatcttgtgatccacctgccttggcctcccaaagtgctggaatgacaggcatgagccaccaggcccagccatgtctgtcattttctttgttaacctaatttctaaagattactcatcttttaaacttctttgaaacaagttgtttcatacctgtgatttgtactgtaactcaaggttttttgttttttgttctttgtgtgtgtgtgtgtgtgtgtctgtgtgtttgtcgtctttgttgttgttttgttttgtttgaatcctggggaaccagaggtgttagcctatgttttaaaactcacatttggcaatggtatcaacagctgtcacactgaataattgtcatgtcattataagggtttctgttgctcactaatctgtaggtataaatctggattttaaccacatgtgattggtaaaaattagttcttgtgagagattctatgctgtgtaggccatctgttccctattctcaaacccagaatgaaaagttagccttagaatttgcaaatcagtgaactaagaggtatgttataataggaagatgggctgactgaagtctctggagctaagctgggacctgtatgtgggcactgctggcagaaacataagtgtgtgtggataaactcttcattagtggaaaggaatcttagttttcggctgattttcagtggtgggcatgaccccaaacagaatctgagatgatgtaataatcatctgtgatttgattgtacttataagattcagctaaatcttcccttttttgtcccagtctacttgagatgtaccttccttgaacccttattgcccagctacatcatgaactccttgaaggttggaatatcagcttcaagtttgtgtcccaaacacttagtacagtgcttgggtcatgttagccttttgatgatgttgatcaaatgaatcagcagccgggcgcggtggctcacgcctgtaatctcagcactttgggaggctgaggtgggtggatcgtctgaggtcaggcgagaccagcctggccaacatggtgagaccccatctctactaaaaatacaaaattagctgggtgtggtggcacattcctgtaatcccagctacttgggaggctgaggcaggataatcacttgaacctgggagg

SEQ ID NO: 100483 - DNA, 1018 bp, Homo sapiens
tcaggagcctgaggcaggagaatcacttgaacccaggaggtggatgttgcagtgaacgaagatcgcaccactgcactccagcctggatgacagagcaagacagtctaaaaaaaaaaaaagaggaaagacagcactaccttttattaaacaacttctttctttccccatattcccttctagttttttcttatacatgtgcatactctttccattttattttcgtgagtatacattatatccagctctttccttttacattatatcaagaccttttctgtgttgctatatatttatctgtcattatttcagtggagaagtagacccagaatgtgcattgtttttattaatatcacatgccattgtttccattagattgtgttaccatctaactatcctttgtacaagaacactattgtatcgatttgaaaaatcaactgaaaaatcagttgttttagtagtcattactacaaagttgtaggtacatgataattgaccttttcccagggccaaaggccaagtcccaagccataaccttgcctggatttcattttctttatctgggtagactgagtatatgactttatagtttaaagttctttgactaatcgttaaccttatttggggagatgaaatgatttttatgaaccagtaatttgaatataatgtatgatgaagttttggggctttttttccctttaaattaaataatttagtaaaattttaaaaaattatcttgtttccaaaaacggataattacatataattgaaaatgaattatttgttgaattggatatatttaagttcttaagtcaacttgtttggatttagatggtgacccaagtctaccagcactgcatttagtaaccatttcattagacagatgctgtctacagggtgtgctgttatattatgcattcatcctcagtacttgactgtcctctgggaggccaagtgtctcaaaatcctgtaagcactttcctgtaccccttctcataccaaccatgccacactgtgaact

SEQ ID NO: 100484 - DNA, 1101 bp, Homo sapiens
ttgccatgttgtccaggctggtcttgaactcctgacctcaggtgatccacttgcctcagcctcccaaagtgctgggattacaggcgtgagccaccatgctggccagattaagtgacttttttttttctttttttttttttgagacagagtctcactctgtcgcccaggctggaatacagtgatgcgatcttggctcactgcaagctccacctcccaggttcacaccattctcctacctcagcctcccaagtaggtgggactacaggcgcctggctaatttttttggtatttttagtagagacggggtttcaccatgtgtttgccaggatggtctcaatctcctgacctcctgaactgcccgtctcggcctcccaaagtgctgagattacaggcgtgagccaccgcgcccggccttaagtgacatttttaagagtttaagatttttccctcagcccatcaggtaagctctagtcagcttctttagctggcttcttagtagaagtaatagcaataataatatagatgatggtggtcatgatggcaattataaccataatatattttgtaaaatggtgtgcagtttagaacaggattactagcatcatttcctgattacagaacaggttggagacagaggcagacttaattgcttattttatagagcttgagccactgttttggtgtgtttaagcatttactatataccaaaacatgatatcctttaaactaccagtgggattttgacagggtaacttagatgccttttatcatattaccaagttgctgagattgtaacccagggcatttggtctaatttgggagcatgtttccattcatctctgcagctcagatggagaagggctggggtttagggcttctgacctcaaaccttgttttttttctgtcatgcttgcagggtattttaaataccctgtcctgttgttccctcaacccaaactacctgttaaaattttggttttgaaaatgaggtccctatagctagatcatgctgcctgtgtgtgaagaaagactaacatgttaggaatgcgtggcattcaagtaggtgtctaataattcttctggagaaaagcaaatttagtc

SEQ ID NO: 100485 - DNA, 1117 bp, Homo sapiens
cagctacttgggaggctgaggtgggaggatctcttgaacccaggaggttcaggctgcagtgagcctaggttatgtgactgctcttccagcttggacgatgctgtctcatctttttttacaaaaaaaaaaaaaaaatctgcaatccttttttcctgtgcacaaacagcttccagaaaatagttaaaagaaaccatcaaaccctaaggtaattttttttaagtacctgttggcccaaacagagggcttaattagcggcaactcttagaaaccagattgcgttaaacacatctagctttgtttttttttcttggcccccacaaaggctatgcgcatgccccaggaatatacttcttctttgattgggcacaataagattgttttcttcaaatatttgagagtggtaggaccccagaagaactcttaccaactgatggtgagtgccaagatcttctcatttatctggcagtggcatattccatctctgcagcaaggtaaagccctgggtgctagaagttccttcacagaacctaggtgtcagccagtcatggatattgtcctgtggcttcccataaagaaagctaaatctttgcttcgtgctactcctgagcatgcagttttgatttttgtggttctccatctcaaaacaaaagctgatgggctgactgggcctttctttgcgctgggggaatattaaaaactcggtttttcaaatattaaggtacatggagccaggtggaacccaggctcttttaaagattgatgagggcaggtgcagtggctctcgcttgtaatccgagcactttgggaggccgaggcaggcagatcacttgagaccagaagtttgagaccagcctggccaacatggtgaaaccccatctctactaaaaagaaaataaaaatttgccgggtgtggtggcaggcatctgttaattccagctacttgggaggctgaggcaggagaatcacttgaacccgggaggcagaagttgcagtgagccgagatcacaccattgcactccagcctgggcaacaagagtgaaactccctctcaaaaaaaaaagtactgatgaatagctgggcatggtggctcacacctataattccagtgctttgggag

SEQ ID NO: 100486 - DNA, 1718 bp, Homo sapiens
tgccaccacgcctggctaatttttgtattttcactagagacggggttttgccatgttggccaggctggtctcgagctcctgacatcaggtgatctgcctgcctccgcctcccaaagtgctggtattacaggcatgagccaacacgcccaaccttctgactggtttttaatacaagatagctagatttttatatctgcttctgcattaatcatgtaatctctgtaaaaagctaccattcactcatgaaagagtaaaaaggataaatgacctcttcttgctacgattatgaaaattgttttgacctttccccttctgtccacacatatcccaaagggtctccagggcccccaacggtcccaggaccatattttgagaactgctgagtagatcatggcattcaagccaaggtaagtttatgttttattgtaagagcaataggaagccattagaagagttcaggtctgtgggaagatctgttttaggttttaaatcagcactttggatactacgtgatgaatggactgaaggggttaaaagcagaagcagaaagaatagttaggaggcagatgaagcagtccaggtgagagatgacagtggctaaattctagcaatagagatgggagacatgacatactgtgacatatttaagagctggactgtcagaatttactgctatatttctttcttttctttttttttgagacggagtctcactctgttgcccaggctggagtgcagtggcgcaacctcggctcactgcaacctctgcctcctgggttggagcaattctcttgcctcagcctcccgagtagctgggactacaggcgtctgccaccacacctgtctaatttttatgtttttagtagagacagggtttcactgtgttagccggaatggtctcgatctcttgacctcgtgatcctcctgcctcggcctcccaaagtgctgggattacaggtgtgagccaccgagcccggcctactgctagatttcctctagaaggttctgtgttccgcagacatttagcacagatgtatcaaatgctggaacccaagagacctggctttttgaatcgtaggaaagccattaactagctgtgtgagaaattgatagcgtttttccctgtctcccgaaaaaaaagtgaggtttatttttggccaagaagactaaagttagctgattctccatcagtctcagattctctgagttctctgactttggctgcgtatgtgtggcccaggcagtaatgtgacacacctttaagtggttgggattcagtcgattttgattgtggtaggggtggcttccatacaaaggcaagatgctaatcaaatttaatttaagtcttttctgttcatgtgagaaatactaagctggtggagacctgaaacagatggtgtgcagttggagtagataactatattattctaaataaatatttgctggagctgggaagcaacaatccatatttcattttttccctatttacattttcaggtcagctgtgttgctactgtttttaacttgcattaaggttatcaacagacttggcaattacaatatatctttaaatgttgaaataattagcattggaagagaccctcagcacgtagtgctgtaatgattcttaatgcatttctggtggatagctgtctaataatatcttacacttgaaaaaattttttttttgagtcggagtctcactttgttgcccaggc

SEQ ID NO: 100487 - DNA, 1046 bp, Homo sapiens
ttcctacagggacttactataatcctgtgaccccaggcagagggttaaaatgcctactttggaacataccctttcccatcatctgagcaactgctgaatttgtcaccttgtaaaccacttggatagatctcactccatgaagggcattcatgccacccagcttccatcaaaaatgccactttacattgtgcttggtgattttgcagctattaattcttggatcattccatacattatctctgagtttccatggataaattgttgatagtatacctattttccacagaaaacagatgttaatattaacttggtcaaggtcacatacctagttaatagtatgtccagaatttgacaccaggatttctatcttctaatcatcattcctgttaattaagcaccttctgtataccttgcagtgatttaggcatcatctttaatcattacatgtttcctgacaggtaggtcttactgtcactcattttacatatgttgaaaatgaggcctagaaaggtgaaatgaattggtgaaattcacttgcattgtaacagaatgagaattcacacggaatctctcagtcttcatacctgtgctttttctgcttcattcacttgaaacatgaagaaacactagtgttgtaggttttgggtggtgaaatgaaaagtatcaatctgtaaacagttctctagtggctgggtttggcccactatcaaagcttttggttggtaagagcacagagttcagcgttctgcatttgggctgctctaacttttttattctgccaagtgctgactgttaaaactcatctcactgctaagccttcctcaagtctttggcacccttgctatagagccaggtggtctgaagaaaagctccctctaggttgttgcacactgtacacaacacattacagtgcgagacaactgtcagttccttcctttccttctcccctacccttccagaaagctgggccccagatggaagagctggaaatgtgtcaactgttctctgaagggcattgagaaaatactgtcaggaagaaaaggcaa

SEQ ID NO: 100488 - DNA, 1062 bp, Homo sapiens
gtcacccagcctggagtatgatggtgcgaacacagctcacttcagccttgaccttccaggtttaagcagttctcttgctgcatcctcctgagtagttgggactacatgtgcatgccgccatgcccagctaatttttttattttggtagagatgggatctctctatcttgttcaggctgctttcaaactcctagcctcaagcagtctgcctgtctcggcttcccaaagtgctgggattataagcatgatgtttaattgtagattttatgtcagtgcttatcaaagaaacaatcgataatgtttacttgttatttaaggtggtgatttaattccaataagcaactttggattttttttaaaactgctctcaacaggcccactggtgtccaaccaagttaatgcaaggttttgtaatttaatatattcagtgcttagtgcattgtttccaaaccaaggagagtagagaggtagcaagtttaattttcaaaacaatgatttctaaaattacaagttacgtggcctaaataaatactatcaaaataaacagtatcaaagggattgcattgttcagctcctcgtgcatataaacttgcttaagaatttgcaaggtacacataatttttctttctttctatactgcacgtggtgaacctgtggcataaaggagtgattttctgacttcgacacctgggtggggttttattctcagtgtttataagggaagtactgccagttcccaatgtttctaattgaatttacctccaataaaagcattctgtgctcctttgtgtatgttaacccctttatatgggataaaaagatgaatcacagcactaatccttgaagctgcagctctccgagtgtaaatctagggaccctgaagattctccaggatcctttctggagatccagaaggtgaaaactattttcataatataacagtagactaaatgcaaaagtagagagaatacaactggcttctagtatgctagatattaaagagactttctattatgctagatattaaagagacttgcaaaatgataaaacagtgctgctcttc

SEQ ID NO: 100489 - DNA, 2023 bp, Homo sapiens
ctttttggctagcatttggggttttgtcaatttatttctgctttaaaacagtcactaattatggtgcctgctaaattaaccctcagtgaagggatggctacttgcatgtattaaaactctcctttcacttgctcatctgtcccttgggattaagcctttgcttatgagcccagcctgcattgcttttaaatttggtgagaaaaatataatttctactttatgttttttttaataaaaatgggaaaagtaaattctgtatatgaaagagatcgagttctgagcttttaaagatgtatagggttttaaaatgtgatttgttcctattgcaggttttctaagtatgagagacagaaaaatacctacttaatgaattatctttttacattttacatcactcccagtgctccttttcaaactcccatgtttcagaataatcacagtttccagaattctgttgcagcttttatacagagctggaaggaaggttgagtagtgctatcagagatgagttggggtccagaagagagaaaccagggcttggaatgactcccacataggcagtagtaattctctcactgactaaagtcttcagaagcgtatgttttaaaattattatgttcaacaaccctttattgagctttgactgtatactaggctgcaaaggtaaataaggtacaatctcttccttaagcatatttacatctggttggggcaagagacaattgaaccagtaattcaagtgcagtataagagatatcattgactcacagaagaagcatttgaaaatcagactgccaaggagagaaaggcttttatcttgtatcatctgctttgtgaaagccctttgaggtgctgagccttcttgtgtagggcctaacactggaaaaactgcctcttcctttcaaggccaacctgcccctgctgcagcgggaactgctgcactgcgctcgggcggccaagcagaccccatcccagtacctggctcagcacgaacaccttctgctcaacacaagcattgcatcgcctgctgactcgtcagagttgctcatggaggtgcacggaaatgggaagaggcccagtccagagaggtgagcagatgagctttgctgtccttgccttcctggaaccgcactggtcctcccctttgcttataaaagagagagaatttgattgctgtggttgtaatgtctcaaactttttttgagacaaggcctggctctgtcgcccagactggagcgcagtggtgcaatctttgctccctgcagcctccatctcctgggctcaagcgatcctctcacctcagcctcctgagtatctgggattacaggcacgtgccaccatgaccagctaatgtttgtttgtttgtttgtttgtttgtttgtttgtttgtttttggagagatgaggttttaccatgttgcccaggctggtctcaaacttgtgagctcaagagatctgcccgcctcaacctcccaaagtgctgggattatatggatgtgagccaccatgcccagcccaatgtctcagactttctgtggttatttttgctttattccaatacctagctgcataatacatctaaaatctatgggagtagcttccagacatgagtatttttcgggaactcttcagatgcctgcacacccggtaagaaactctactctagagaatttatgggtcgactgttccagaagcctcaggagtacagttctgccttttccttgatgctgtttgtagaaagaattggaaaaaaaaaaaaaagaaaagaaaagaaaaaacaaaaaaaaagaaatacaatctgccaaatgccttttatgtcaaacgcatttttttctgatctgagaagttttgaaaaagtatagcaattaattattaatatttgccaatgactcacctttactgagattaaaattaatatgaatttattttagaaaactccctatgagtggctatcaaaatattctatgggttatcaaagaaggcaatatcaacaatagtggataggctttaatgacattttttta

SEQ ID NO: 100490 - DNA, 1032 bp, Homo sapiens
aacccgtaactcagaaaaacggtgtcatctccttagtctctcctttgctttataagggttaatgtttctgtctggttatggatggatttgacctcttttttcatgctggtataagtcagcaatttacatgaggtgcctggcccttgaagacaattcagctcatgcctcatgtcacacctttccttagaggcttcctgtttatgccagcatgtagcaaaatacctaatacatagtaggttctcaggaaatgtctgcatgaacacttgttgacaggatcagatacgcacttctgcttcttctacaggagagaagagaatagttttgatagagacacaattgctcctgagcctcctgccaagagagtatgtaccatcagccctgctcctcggcacagtcctgctctcactgtgcccctcatgaatcccgggggccaattccatcctacccctccacctcttcagcattacaccttagaggatattgcaacttctcacctgtatcgggaacccaacaagatgctagagcatcgagaagttcgtgatagacaccacagtcttggtaagcaaccgaagcagcatggtaaattcagactggattcttggatttctttccaactcaatgataaagtcaaataatatgattgctttttcccactgattggataaaacaatattatacatagactattagaatcatagttgatcttatttgatatcaatctcatttgataccttgttgctatgatatgatagaagtacagctaggtgtggtgactggtgtctgtaatcccagctcttagagaggctgaggtggaaggatcacttgaagccagtctgggcaacatagtgagatcccatctctacaaaaaattttaaaaactagccaggcttggtggcatgcgcctgtggtcccagctactagggaggctgaggagggaggatcagttgagtccaggaagtcaaaactacattgagccatgatcttgccactgcattcagcctgggtgacagagtgagacctgtctaaaaaaga

SEQ ID NO: 100491 - DNA, 1028 bp, Homo sapiens
agagattgctttttagcccacatactcatgtttcgtagttttagaacacaggtcagtaacaaacttctaggtaattcaaccccccaaaattgtttatattccaaaattattttgcactctgaaagatagcagccttcctcatctcatcaaaattcataatttctgttagaaatgtgtgtgtgccttattttatggttcagccacagcaaatttacagtgctgcagaccctagggatacaacaaatgctgctgcaacatgaaatagtagactgttggccagaaggccatgcatctgaggttttgtccaaacactggaagccctggtagttattgtcctctttaggtatgtcagcctcaacaccaatgtccttcctagctgatggagaaacagacagcaataaaggttttaaatgtaaacttgatattcctaaatctgtactttaaggaacctgaattcctcatattgcgttggcctgatttacagtgttggttgtttgaatgttcttatctcatctctgcctggccccctctgtgactcaggcgctgaattgcattatggaaatggtagagaaaacaaggcgctctatggcagttctgcggcgctgtcaggaatcagatcgtgaagaactcaactactggaaaagacggtacaatgaaaacacagagctgaggaaaacggggaccgagttggtctccaggcagcacagccctgggagtgcagattctctcagcaatggtaaggggagagtctacgggaaacccaaaataaatgtcagcctttagagcccaccaatctgtcacagaaggcgttttctacttgactttaaagaaaggtggtactcaattgtggatttagggaaactcaggtgattatgaaaagtaaatgagaaaatatatgaagcccctggcatgttttggtgggtggcgcaggaagggggtttttttgttttggatagacaggatctcactgtgttgcccaggctggccttggactcctggcctcaagcaatcctcctgcctcaccctcc

SEQ ID NO: 100492 - DNA, 1070 bp, Homo sapiens
agcttgcagtgagccgagatcgcgccattgcactctagcctgggtgacagagcaagactccatctcaaaaaaacaaacaaaaaactccaaaaacagacaaagctaatcttctggtctccctcactttctgaacatttgcagatccctgtgcgactttcggacagggagaaaggcttttggagacgtagctaaagtttacacccaagccatacctcattcatcagtgagtccacatgtgtgcaggtgagaagcatagagtacagagggagctgcagtcgtgagccagtggttgctgagccaagatacagctcttgctggagtcattcaggtcttgctggagtcatttaaacatggctatgcatgaccactactcacctttctcaccttttgcatcaaggattagctctggggagcatgttttctgatttgcctgagacagtccagtttatacctgtgtcctgttaatagttattactagcatttccctcattctcaacaatgaaggcaatctggatgataagttatattgtcattctaggtttggtttctgacagcactatcaacctgatttagatagtatattttagtgtcatttatatgtttatctcatgtttattacttgtccattttagtatagtatgacagtataattcatatcctaaataaatgtactatgcaaaatgtgaaccaaaatgactccaaaaagtgccactggtctgattacatgaggagcttgggcacggttggcttcatcaagaaagtcttactgtgaaattagttctttttgtttgtttgtttgttcgtttttgtttgtttgttttgaaatggagtcttgctctgttgtccaggctggaatgcagtgcacattcttggctcattgcaacctcctgggttcaagccattctcttgcctcatcctcctgagtagctgggattacaggcacctgccaccatgcctggctacgttttgtatttttagtagagatggggtttcaccatgttggccaggctgggctcgaactcctgaccttgtatgatccacccaccttggcctcccaaagtgctgggatt

SEQ ID NO: 100493 - DNA, 1044 bp, Homo sapiens
ggtggcgcacacctgtactcccagctacctctcgggaggctgaggtaggagaatcacttgaacccgggaggcagaggttgcagtgagccaagatcgcaccactgcactccagcctgggtgacagagtgagactccgtctcaaaaaaaaaaaaaaaaaaaaatctgtgtgcatttatgttttatacatttatattttagggggtactgtaccttaaaaaccgatgtttataggggaaaaaattaggacataataggtaagtaaaaagaagaaagtgaagatcacttttaatctcactactttgaaatactgttaatttgttcatttgatgggggtgtgtgttttaaaactaaatatttactgtactattttataatctggtttttagcccttatatgagaatttttttatactaaatgaaatatatgtttgagtctaagtggtgaatgagaaatctgatcaaaaataaaactgctgatcatagacagcttctgaccctatgctttttatgtctcttctgcagattctcagagagagttcaacagcaggccaggtacaggatacgtacctgtggagttttggaaaaaaacaggtatgtgtctgactgcttgtaggtcatacatactcactaatttgtgggagcagagaacagataactgggtgaatggttggtaactgggtcctttggttgtataataacttgctcctcatagagctctaggctcctgcctctcctgctctggcttgtcctgcatgtctcctgatacctgtcttgttaatttgcaggtcaggagtttggaatagctccctccagtccctttcacactcttccactgggtcacgctgaggcaataagtacctgttgacatgtcctgtttctgggcttgcaacagagttcattttgcctgatctcttcactggtggctacagtatactgtgttcacactactgccacatttgtgcccaaattctgctctgggcacagctctgtaatccccctgtgctttctttcaccttctctgtgcctaccatagtgaagactgttc

SEQ ID NO: 100494 - DNA, 4323 bp, Homo sapiens
cctgccctaggctggtgctgtgtaaggtattttcacacacacatctcatttcactgttcctgtcatcttgcagggaagtagttttcttgttttacagatgaaggaaactcagaaaggcagtgtgtatttctcatagttaaacagcagtagagggcggagttgaccacaggtgtatgtagttccaaagctggggttctctacatacagccccttgctttactgtgcagggaatgaatggcaagcctgcccctcaatcccagcaaccactaactgatgcctgtgtcttgcagaactgctggaactgtggccgcaaagccagcgagacatgcagtggctgcaatatcgcgcgatactgtggctctttctgccagcacaaggactgggagcggcaccaccgcctctgtggtcagaacctgcatggccagagcccccacggccagggccggccgctgcttcctgtaggcaggggctcctctgccaggtccgccgactgcagcgtgcccagcccagccctcgacaagacctcggcaaccacatcgcgttcctcaacacctgcttctgtgacagctatcgacaccaacggactctgagccccggactctgcttaccctgatggctgctcagcaccacagagtgcttgggctgagggactgactgttggaacccgtgcatgtagctgccgggtcatcagcaagaaatgaattggaggcaggaagagtccaagcctgaataataacaccccacagcctctctgtgcacttgctgtctgcggagccagtgtgccattctctgcacatgggcagccagcctgagctgcctcctccatggctttcctggtttgttcctctctccactgaagctgacttagccggccccttttcagtgtagaccaccagctcccctccccatctccttgagtcagcagactgtccaatgtgctcagccaggctggaggcggcaggcggcaggcagcaggctgtggaggaggcccctcggtcagggagcggcctgcctcacccctgaatagctccttcggccccatctccatcctcagcagatgacactgattggcctcacggggacttgggtaagcaacaggcggcattcaggactcttctcaaccctgctgttcagacttgataagatctcagagtccacaggaaagaagtcactgttgcaataaaagcacccgtagtagcaaaaacataaaacaaataaaacttcccccacatcacagatgattttggacaagattttccaaccttgctggctactttagtttgggacctgttttttttctcatttgattttgcttgtgcagaaaatagtttccagcacatggattgatctgagagagaatgaggctcagttgtggatagtctgttttctctgagcatgttggccaactagtatcgtcaaattattgagtggatcatctcttggaaatgcagaacttctgccaccacttggctatttgcacagtcatcttgttctgtgtccttttatctctcagaccacacacatctggaacgctgtgggcatcttctgcccatgggctccatttggcacctgctgagccacagttgtcctgctggatgtgctgtgcaggttggtaggacttgcccccactgtcaaggcctggtctcatctgaaaagccctcctggacctcaaagaattcttcagacctcatagttacaggtcattatatctactatgttgatttatcatcaggcacacaacttctgtttccttctcttgtgttatctgatagcgtccctccttgagctcatcagaaaggttttatgaaatgtgaaccattttgggaaaagctgatcaatttttcttcctagcttcccattttcaaatgggacatcactcatatccctttcagaatgttaggaactgcctcccacattcttccctgtctttttgggttttgttttttgttgttgtggtggttttttaacacaaagtctcactctgttgcccaggctggagtgcagtggcatgatcttggctcactgcaacctctgccttccaggttcaagcaattctcctgcctcagcctcccgagtagctgagattacaggcgcccaccaccacgcccagctaatttttgtatttttagtagagacagggtttcaccatgttggccaggctgatctcgaactcctgacctcaggtgacctgccttggcctcccaaagtgcagggattacaagcgtgagccaccatgcccggcctgtctttttggttttgatgggagtctgaggaccccgacccctcctgctctccatctttgagcctctggcatcctctcacacccagaaatcagttggagtaagtttaattggccctgctccagctggcctttgaagcacaagtttaaatctccaccttctgtgcactgaccagagtctaaaataaaagttgtcagtaccataaaggaaaagggatccacacaggtagccttctccttggatacaggtacatcttactgtaagaatttcaagtcctggctgggcgcagtggctcactcctgtaatcccagcactttgagagaccgaggcaggcagatcacttgaggtcaggaattcaagaccaacctggccaacatggtgaaaccctgtctctaataaaaaaaaaatagaaaaatcagccgggtgtggtggcacacacctgtaatcctagctactcaggaggctgaggcaagagaatctcttgaacctgtgagccagaggttgcagtgagccgagattccaccactgcactccagcctgggcaacagagcaaaactctgtctcaaaaaaaaaaaaaaaaaggcaaaattaaagaatttcaagtccctaatttactctaaccaagcattttcagtcttacaaagaaatctagtgcacgacacctttaaaatgcctagatttccattgcctaaagtaaggtgtgaccagtgaaacaacagcagagaatcatgttcctttgctgtggaacacataagccccacagttttccagtcagcctaatacatgggtatcccccgaccccatctgcctccttaagccacagtccttggtggggaactctaagggggacggagtcagtaccccggacagggccacatttgcatgagacatggctgtctcacaggtcacagagccattacaacagcttactagtttttcatggatttgttggattaacaccttaagcaggttttttattgttattttgtttgtttgtttgttttgagacgggagtttctctcttgtctcccaggctggagtgcaatcgcgcaatctcggctcacggtaacctctgcctcccaggttcaagcgagtctcctgcctcagccttctgagtagctgggattacaggcatgcgccaccacgcccaactaattttgtatttttagtagagacggggtttctccttgttggtcaggctggtctcaaaccccggacctcaggtgatccccccaccttggcctcccaaagtgccaggattacaggcatgagccactgtgtccggtcttgagcaggtttttaaaatctccagtggccataaaactagccagggtagctcatgcttttactggttggaataaggagccaaaaccaacaaaataatatttattagggctcgatgcccatttctgtggctaaggcttaggtttggtgtgcagagcctggcctgctcttgtgggctgtggttgctgtgacagtttcgttttctgaatctttgtaatgctcttccaccctgctcgtgctgcccagaggctgatctgcaaacctgggcagtattccacactgaagctcagtttgcaaaccttctgctgtgttaattctggtcagtttcacacagaagtcacgagggcctctgcccaggaccttctattcacatttcaagaatccctttctgaaattctccaactctctggtcaggaggaggagcaccattggggcggggtaggcagctagaggcgcaggagcgaatccaggttccttgcgtggttcccagcctctgctgacagcacctcagctaccaggtggggagtggaaattcagcctgcttagaggactgacctctacagttcatatttgcagtgacataaaaggcaaagaggagctggcatggtggtacagaaggtatcagtcaagcgcaggctcttcagaaacctagaaactaaaaagagatgcaacatgtgactggccatcagccagacatgtctagggtgagaccagtgctcagcaccacccgccaaggaacactgatgagttgtgggacattatggtcggccaagtgaggaatgattgcagggaccagaga

SEQ ID NO: 100495 - DNA, 1014 bp, Homo sapiens
cctaggcagtccacttcgggaggtgggggcactccacactggggggccctgcagctccagggctggtgctctagcagatccgctcaggcacggttgggtgaccgtggggtcaccgattgcgtagattatttctagggcagtgctgggttagaaatgtctgtctggaaacaggacacatcttgccaccacaagtccacacctggccttggctgctgcccgctctctgcagcgtggatttcctttgcccatttgggccagaaggtcaccaggagttcatcactgcttagtgtcaacttgacatcttcagcttccagacagaaaacccatgctttactttgtacagccctgtcccagagttagtaagcctcggcttgtcacctgcttgcaaagggtatagacatcattctgggtagttctagaggatatcgcaacaagtgcgtttgaaggttcagcacagctggaattgtacggtagtgagctcttcaaaatgaaaacagaatgaccggatggccatctgtcctggaaactgtagaattgaataaatcactgaaaatagaacacttcttggaggctttcttcagaactgaactagaaacaaggtttccaggctcccaggtcagtagaccaaaccaacttccttagatttttttttttaagctgtttgcagaaaactgggtggtagcgtgtctgaaccaaacggaagaatagccagcggagcatggactgttccagcacgggccagatggccagctgtcgagagcagccctgcccagattgcggtgggggctgtgccagcggctccgcagggcccttccaactctggagtgtctgtagttcttgtgaaaccaaaacgttgactacctgcctctttcctcgggcatcgacgtgctcatttccaaagatgatggtgcaggtgaccttttccatcgtgagctaagagaaggttaggaggcctgaggggcgggccttgtgtcccctcctccccctccacagcccctgaggtggagcttccct

SEQ ID NO: 100496 - DNA, 1024 bp, Homo sapiens
cctttttattgactactttaagtagaacaaactaaatacatatttaacagttttggttcatttatacagtacattaaataagttatgcacagagttaggtaacaaaaattcctatcagagtaaaatgacaaagcacagaaaaaccagattctaatgcattctgtgggtggtgtcacattcatcatccccctttaaaaaccacgcgtggaggcttcgttttctatttatttacattattggctttcttttgtgagcggagcctttgtagcctcgtcaggaagttggaaagccacgttaaggggactgaaggcctcttggcgcagcagccctttcaatcattcgcctaatgcttattgctgcttctctgccgactccaaggtagggatggggctgtccccaacagacaccagcgcacatgccctatttggtataagcatcactgagtgtacactgggcagccgtaggctcgaccagatggggtctgtgagggaagctccacctcaggggctgtggagggggaggaggggacacaaggcccgcccctcaggcctcctaaccttctcttagctcacgatggaaaaggtcacctgcaccatcatctttggaaatgagcacgtcgatgcccgaggaaagaggcaggtagtcaacgttttggtttcacaagaactacagacactccagagttggaagggccctgcggagccgctggcacagcccccaccgcaatctgggcagggctgctctcgacagctggccatctggcccgtgctggaacagtccatgctccgctggctattcttccgtttggttcagacacgctaccacccagttttctgcaaacagcttaaaaaaaaaaatctaaggaagttggtttggtctactgacctgggagcctggaaaccttgtttctagttcagttctgaagaaagcctccaagaagtgttctattttcagtgatttattcaattctacagtttccaggacagatggccatccggtcattctgttttcattttgaagagct

SEQ ID NO: 100497 - DNA, 1018 bp, Homo sapiens
cacccagcctagctgtggctgggactcactggctatgacagtgctgaaggtggtagccccatcagggaaggggccatgaggtccagagaggccaggcacttcgctgggcagatgccccctgtgagttggcctcacacctccggggagggaggccagtcccggacaaggagggatccagaccctccctgcccatcaggtctcagtaccctcctgcctgtgccaggtttgcgtgcccctgctcttggcactgccaccgctgctctgatgggcaagaggcaggggacccactcaagagatcagtgcccgggctgggagatgctgaccgtccctccttggcccacaggagtacgagagggcctccaaagtggaccagtttgtgacgcgcttcctgctgcgggagacggtgagccagctgcaagcccttcagagctcgctggagggggcgtcagataccctggaggcccaggcccatggctggcggtatgtaagggtgctgtcaacctgtggggctagtgcacaagcgcccattgtacccccattccaaatccccacagtcccagcatcctggagcctgcattttcgggcggggaagccatggcagggtagccatggcggggtgaaatgagactggctttggggctaggcctcggagtcccaggaggcttgtcttccccacccaggcttatcccgtcctggggccccagtcctcggccctgtgagcctcacttcctctaggtcagatgcagagagcgtggaggcgcagagcaggctctgcggcagccggcgggcaggacgccgagccctgaggagtgtcagccggtcatccacctggtcccccggctcttctgacacaggtgcgcctggggtggggtgggaggcctggccgaggcaggcaccgcatccccccttcccccagggcccgctccttcactgcccctcacttcattctgagcacctgcgggacctgagaggcccctgcctgaccctgcacgggccccacacacagggcgcagctcag

SEQ ID NO: 100498 - DNA, 1056 bp, Homo sapiens
taatcaacctctctggacctgttttctcatctgcaaaatggggtcaattatggttcctgtaaattgttacaaaggttaaatgaggcctggcatggtggctaatgcctgtagtctcagtactttgggaggccgaggcgggtggatcacctgaggtcaggagttcgagtccagcctgggcaacatagtgaaaccccgtctctactaaaaatacaaacattagccaggtgtggtggcacaggcctgtaaacctagctattcaagaggctgaggcaggagaattgcttgaagctgggaggcagaggttgcggtgagccaagatcatgccgcttcactccagcctgggtgatacagtgagactctgtctcagaaaaacaaaagactaaatgaaattcttcttgcagtagtgcttggctctgagtgggtgcttctgtctgttctctggttgaaagcaacagaaactaatcatctcaaatacccaaaaaggaattttttgggaagatttcatggagatagaaaccctggcctgtctgagaatgaaaagacccagcctcttctctgtccctgtctcctagctcataagcctggcccaggaggtcccatccgatggctgagctgaggcaggtcatggcaggagatgaagtctctgatggatggggcttctggagtctcctcggagagggcaggcacctggactgcagctccccaggactcccaccctgatgcgtgtgtgtgtgtgtggtaggggttaggcaattctcaggacatctgtgactcctgggtgtacaagtgggcaggccctttattgtattacacttgacgatagatggctggtaggtctggcatcgagagcttacgtgccagaccctgggctgagtcctatgcaggaattaactcctgggacgttcttgcagctccatgtgctgagtttcatctttcctgtttgatagatgaggaaatggaagctccaggaactgacggttgttgaggagcctcagaatcccatgctgggccatgcagggcctagcatttgggcagcctccctgcctctctgccacc

SEQ ID NO: 100499 - DNA, 1041 bp, Homo sapiens
aaacagaataaaacagacaaaaatccctgccttcgttctcactggtcacagtgatgtatgaagggcagctctattgttatgatggtttacagatgaggaaacaggcccagagaggtcaaggggcacagctacaaagtgggagccaggatttgaacccaagcccctagctctataaccctgagtcaagactgtggaggatcccacagcacagcagatgcccactgcctcacagtggatcccccaccatcagccactccactcaccagcttggtggcatccatggcagcgagcactgcacggttcagcgattccaatgcagccagcaccggccggtagacacccaggtgctctgagaagtagtctgcaggcagaagaggtgctcaagggttcctggacccccacccatctacccaccctgggattctggccccctggaattcctcagcagccaagcaggccttatatcctgagcccagcccaacctgtcccatcaggagaccagcaacagtcccttgccacacgtaccctggggcccaggggccacaggagaaaagagctcccatgggcctactcaccacacagtttttctgtttctaaattgctgcagggaaaagagaaggcgcccttcagacctgggcctggtaaactgggactaatggggccaatgccccacatcccaccccaccaactcccagcttagcctaacaaggccacttctgctccaccccagattaagttgctcctgtggacagagtccttgcagggttggagaatgggttctactgcccccaccaatcactctaagggcaaagattcagacccattcttggctaccaagaggatctcaggccaggggaagatggatgtggacacaggccagtgagaagtggtcagagctgcgaaggggaagccaggtgcaaggcaatgaagtccagggacggcatggggtatttagttgtaggttagggagggtttcctagaggaagagctgcctaagtgaggccctgaaggacaaggaactgggtggggagtctggccagg

SEQ ID NO: 100500 - DNA, 1181 bp, Homo sapiens
tatgtccctttgtcctctaggttttccgcagagcagacaagaatggtgagtgtggcttcccctgggtcccacagtggggcagggtgggaggcatccaggaggcccagggagagttgggaggttgggtgggaagtcaagagttgagacaaatcttgggggcccaaaacaggagaatcaatcaaggcacttcccagaggaagtgctgttctcagccaagtttggcaggatggagagtggagagaatgtggtttggccacggactggagataggggctgactttcacacagcaccctggcatggtgatgggcacttcctgtacgtggccctctgttgtcctcacaaccaccagctagattggaattcaccctatttcataaaggagcagagggccagagaggtgaagcaagttgcctaaggtcacacagcctttaattgataggctcgaacttgggtctttgcagcatttaatcccaggctccttgtgtgaggcacttggaagagtgaggtaatggagatgaggcctttttggagattttactcaggtttttagagggctcagtaacttgtcatgtgaccaaccatctggaccagggaggtcttggaggacacaactaaacccacgccttgggcaaggataaagctgggtccagtgccaaaggagtcggctcctcctgccttgggtcctgggcagtctcagaccctggtctgggagaaacttggaagctaaagcaggagccctaggggacccatccagcaacaggctgctccccctagatgacttggagcagcccactgtgccctgtgtggcccgtggagggtctgagcttcgcagtcagcctggggctcctttcatctgggtcttcacgccctcttgtgtttcatcctcctagagacggggtcctgtccccactctttgccccttctccttgggtctcttcaaattgatggggattgtttgtcccaacccattgatcaggacacatgctctcacttggaccagggagttctgtctggggaggttcagatcctcccccgggtcagctccccgcacccatctgctcagagacctcacacatcattcaggccaaatcccatgtctttgtcccacataagtactcccagcctctgcttacatgcccctgtgatggggagctcattcccttctgagccagcctgctgc

SEQ ID NO: 100501 - DNA, 2658 bp, Homo sapiens
ataaattcccagcaccaggcctggagttgtgttgaacattttacatggaatcgttcccggtagccattattaccttgggattcaatgggtagagtgatttcattatacagatgtggaacttgaaactcaggcgtgaggtaggttttgagtgggtaggaggttgggaggacaggagtgactaggcaggtgtgagccctgccttgtgagctgttggagtgagtgaccccctagaagtcaaaggtcatgtggtccttgactctgccaaccctggcctacgtgacgtgtcaggaccttcgtagcattgcagaccctgcagagcagatggttatggtgatcaaagcccctcctgagacccagctccaagccgtggactcttcggaggtgagatctgggaactccgggcccaactgggctgggctgggctgggctggtggtcacctgggcctcagtttaccctgcctgctgcttccacccagaactttcagatctcccttaagagcaaacaaggcccgatcgatgttttcctgtgccctgaggagaccgtaggtgggatcagccctgggaagaccccatcccaggaggtcacttctgaggaggagaacagggccactgactctgccaccatagtgtcaccaccaccatcatctcccccctcatccctcaccacagatcccagccagtctctactcagcctggagcaaggtgggtgatgggtaggtgggtggggtggggcagggcccctcttctggggggtgggcaggcacgacagcccctgccttcctccctgctggggcatccccggcctgtgatgctccccgtctccccagaaccgctgttgtcccggatgggcagcctgcgggctcccgtggacgaggaccgcctgtccccgctggtggcggccgactcgctcctggagcatgtgcgggaggacttctccggcctcctccctgaggagttcatcagcctttccccaccccacgaggccctcgactaccacttcggcctcgaggagggcgagggcatcagagacctcttcgactgtgactttggggacctcacccccctggatttctgacagggcttggagggaccagggtttccagagatgctcaccttgtctctgcagccctggagccccctgtccctggccgtcctcccagcctgtttggaaacatttaatttatacccctctcctctgtctccagaagcttctagctctggggtctggctaccgctaggaggctgagcaagccaggaagggaaggagtctgtgtggtgtgtatgtgcatgcagcctacacccacacgtgtgtaccgggggtgaatgtgtgtgagcatgtgtgtgtgcatgtaccggggaatgaaggtgaacatacacctctgtgtgtgcactgcagacacgccccagtgtgtccacatgtgtgtgcatgagtccatgtgtgcgcgtgggggggctctaactgcactttcggcccttttgctctgggggtcccacaaggcccagggcagtgcctgctcccagaatctggtgctctgaccaggccaggtggggaggctttggctggctgggcgtgtaggacggtgagagcacttctgtcttaaaggttttttctgattgaagctttaatggagcgttatttatttatcgaggcctctttggtgagcctggggaatcagcaaaggggaggaggggtgtggggttgataccccaactccctctacccttgagcaagggcaggggtccctgagctgttcttctgccccatactgaaggaactgaggcctgggtgatttatttattgggaaagtgagggagggagacagactgactgacagccatgggtggtcagatggtggggtgggccctctccagggggccagttcagggccccagctgccccccaggatggatatgagatgggagaggtgagtgggggaccttcactgatgtgggcaggaggggtggtgaaggcctcccccagcccagaccctgtggtccctcctgcagtgtctgaagcgcctgcctccccactgctctgccccaccctccaatctgcactttgatttgcttcctaacagctctgttccctcctgctttggttttaataaatattttgatgacgtttgggccgggttttgggactctgttgggaacatttcggggcgggagaggccaaggttgctggggaaatgcccattctccacttcccttctccctgtccgtgcccgatttgatttgagcctcataactcgaagaaaggtcagcttcctcgctgttttggtcctaactcaaaagcagatccagtaaaggtttttgttgtagaaagccaagaatgctattcagtgctgcccgaagtgcagagtaatgagtggcctctcctttccccagccccagaggccactctgctcagtttgctgtcttccttccagacgtttctggacattagtaaacatgtaacaaatacagtgggctggttctgtgtcaggtatttaacagttctggggacacgggtgttacctcctttcatggtgctctcagggtctgaaagaggagatctgcataaatgagaaaatcgggaaaggcgttctggaatgggtggtgcttaagctgagcgctgtaaaataagtaggagttaaccagaggaagaaaacaccaagc

SEQ ID NO: 100502 - DNA, 1067 bp, Homo sapiens
tgtggttttttgggtggaggggggtggtttgagacagggtgttgctctgtcgcccaggctggagtatggaggcacaaatacagctcactgcagcctcaacctcctgggctcaagctccgtacctgtagctaggactacaagtacatgccaccatgtctggctaatgtctttgattttgtgtagaggcagagtctcactgtgttgcccaggctggtctcaaactcctgaggctcaagcaatcctctggcctcagccccccaaagtgctgggattataggtataagccaccaagcccagcctttttttttttttcatttgacagcatgtcttggaaatgcatgtgtgtgtgcatgtgtaatatttcgtggcatgtcagtcccatcatttgtttatcccgccctggttgagggacatgtaggtgtttatattcgggccagacttcaagcccatgacactctgatttggagcccagctgaggagccagacccagacagaagcaagggcttgcctaggcctcacagaacagaggcaacagcagactctgtcctgaggcccagggctcctggccagaggggccaatcgctgttaaccctaccctccctggtgcctccccacaggggcagccacaccacagtgggcgtcggcggacggcttgaggggttgacccaggacctccgacagctgcaggagagcgagcagcagctggaccacctgatgaatatctgtactacgcagctgcgcctgctctccgaggacactgacagccagcgatatccttggattggccgtagggtgtggaaggcaggcttagcaggcaggggctccacccaagtgggactagagaggcttggatttaagagagagctctgattttggttgcaagtcctggctcagcattttctcactgttgtgacactggataaattgcttaacctcttggcctcagttttatctataaaaggggaataataatatccaattctgaaattgtacagattaaaaaagaaaagtggctaggtgcggtggttcatgcctgtaatcctagtgcttcaagaggctgaggtggg

SEQ ID NO: 100503 - DNA, 1014 bp, Homo sapiens
gtgattcagacacctctgagggtgagatagatacatctgcagaaatgtgtagggagagacagaatgtggcaaaaggttgggtttgaggcagttcagagggagaagaggtgacacctcctagctgatgcgtaaggtttctgcccacagaggtagagggagcaggcgtgaagtggggagggtgggagggatgcaagggcagtctagatttctgggaaaacgtgactcgggttcctctagagaagcagtggcagatgagagtacaaaggcaatggggagctggaggaaggccttaagcaggggcggcggcatggtaaggtttgtaggaggactggctgcagcagaggcagggagaccagtgtggagtctgctcagcagcccactgggaaggtggtgatcgccgtggtgatgagcagttcttggtagctgcatgtgaggagggtgacaggtcaggaactctagctcaggaaaccctgtggatggtggaggggaagatcagtctggttttggtccgggtacttttgagcagcctgtgagacctccaggacagtcccaatcctggagtgtctgaactaagccagagtgcttagagcttgggttcttcctcagaccgtcttgggtacaaatcctgactctaccacttcctgggcctccctgggctttagttgccttatctggaaaatggggccatttttatacagccagtccgttgaatggaatgaactaatggatgcaaggaacttgatgagcaccagctgctaccatgcgtatagattagtcaaaaaccagagagaaggtgatttagccaagggacctatgtaatcagtggcttagctgggcatggtggctgactagtcccagcacgactacagtgaaggctgagatgggagaattgcttgagcctaggagtttgagaccagtctgggcaacatagggagaccccatctctacgagaaatagaaaagttagctggtcttggagggatgcgcctgtggtcccagctgtttggaaggctga

SEQ ID NO: 100504 - DNA, 1272 bp, Homo sapiens
gccgccgccgcctgtcacccgggccgcgcgggccgtgagcgtcatggccttggccggggcccctgcgggcggcccatgcgcgccggcgctggaggccctgctcggggccggcgcgctgcggctgctcgactcctcgcagatcgtcatcatctccgccgcgcaggacgccagcgccccgccggctcccaccggccccgcggcgcccgccgccggcccctgcgaccctgacctgctgctcttcgccacaccgcaggcgccccggcccacacccagtgcgccgcggcccgcgctcggccgcccgccggtacggaccccagggacgccgcgccgacagcgccgcctgtgccccccgcgcagacccgggagggcgccgtgtttggcctggaggcggcagggggcgggggaggggttgactgaggcgcccaggctgggcggtgcagagccggggttgggcctccgggccccgccctggggtgcggggtgacctcgggccggtccctgtttgctgctctgtgctctgcgcctcagcttcctcaccggagcctccccagcgtcggactcagtgataataatagcccacgtgtattcaactggcgtttactgcatgccaggcctttgggcgacttcaagccagctaaaactcacaaccccgctgtgagctgtgttgtcactgtgcccatctgacggaggaggaactgaggcccagagagggaaagtgacttgcccctggtcacacggctgcaggtggtggggctgggatttgaactgaggcctgctggcttcagctcagaatttgcatctcggtagtgagcacagctgctaggggaagtgaaggcggggcggaggaaagtcctggggcctaaccgttggtgagccattgaggagaccctccttcctgcctcgatgctgactgccaggtgcaggcctggccggccaggcctctggggacagccctcctggctgggaggccttctctgcaggggcggggcagctggaccagctgctgatcccctccctctgcctgtccttccatctgccaccctccaccctcccaggccctggttgccatggaacctcattaatcaggcaggccgacccctgagtctctgtagaaggactaggtgggctgggcctctgggagctggagaggaggcccccagtgccaggagagaaaatgtctcagggagatcctttaataaagccctccctgatcgctgagctcaagacgaattcagactggagggcccagaagaggcggctgaattccagtgg

SEQ ID NO: 100505 - DNA, 1024 bp, Homo sapiens
aggtggaggttgcagtgagccgagatccagtaagcccactctctctagcctagccgacagagccagattctgtctcagaaaaaaaaaaaaaaaattagtacagaaatcaatgaaattgcaaacaggaaatcaatagagaaaaggacctaaaccaaaagttgattctttgaagagataattaaaataaataaacccctagccaggctctctaagaaaaaaagagaaatgaaacaaattattaatatcaaaaacaaaagagggacatcactattgatcaccagtaattcccatcattccctctttgcagatcaacatgtacctgttgtcacgcgtcctgtttgccctgagccgcctggctgtagagaagggctacatccctgaacccaggtgggacccgttcccgctgctcactgcggtggtgtgggggctggtgctgtggctctttgagtatcaccgatccaccctgcagccctcgctgcagtcctccatgacctacctctatgaggacagcaatgtatggcacgacatctcagacttcctcgtctataacaagagccgtccctccaattaatgcagccctgaggtgtctggctgtggctcaagatttggccccatgcagaccctcccaaaggatactgccttctcaagatcataggcctcagactccaactggtgttatcccagggttccgtttgctgaagtaaaaacactgattttaaaatcccagtgggtacctttgtatggtggcacaagtggccgaatcaggctgaggaatctacggcttggttccagctgtgcagctgacttctgtgagactggggccagccacactactctctaggcctcaggggtcaaggagctcagaggagggccctgaggtctctttccggtgggtatgttcattcttcaactgttcttatgtcacagagggctccttgctggtgggcagtgggttgtaaatactttttaaaaaacactaagttccttatctcagatgctgttctactggagaagttctagattc

SEQ ID NO: 100506 - DNA, 1069 bp, Homo sapiens
aactgcgcgggaggcgacggcggggcggtctggaacagccgcggccagggaggcggcttggcggcgcgcggggcccgggacgggggtgcggtcgcagctgcgggcaggagggcctcggcggcctgaccacgaagaacttctgcggagcggactgtatgcctcgtgctaggacgtagtctcaaaatcagaccacagcagcagaggcgccacctgtgtgcacagcctggactcagagcttagggacccaagccagcaaacacctggcgcctgcagtgcgcaccgtggccggtgcagttttacaaattaaactgacaccgtgggtgctggcgcggtgtgcccggccgggacgcggtgttcccagacccaggccagcaaacgctgggtgccgacagactgttccgtgctctgcaagaacctgggatggggttggtgctcaggctcaaaactgtgggctttggagacagcaaacactgagcacctccatgtgtgcatctgctgggcgtcggggaggaagggcagccttagcgactcggggccatggcgcagaatagatattgtgggaaatacagaccaagaatggtcttggaggagtgggatgagatgagtatacagatagggtgcaaactcgaagtactggactggcgggatgaagctgaagctttgagtcctgcagcttcctaggagatctcagccactccctgcactttttaattttttgagacggagtctcactctgtcgcccaggctggagtgcagtggcgcgatctcggctcactgcaacctccccctcccaggtttgagcgattctcgtgcctccgcctcctgagtagctgggactataggcgtgcaccaccacacccggctaatttccttttttttttttttttttgagacagagtcttgctctgttgcccaggctggagtgcagtggagcgatctcggctcactgcaacctccgcttcccggggttcacgccattcttctgcttcttctgcctcagcctcgagagcagctgagactacaggcatccgccaccacgcccggctaatttttttttttttttgtattt

SEQ ID NO: 100507 - DNA, 1076 bp, Homo sapiens
tctcgaactcctgacctcaagtgatccacctgccttggcctcccaaagtgctgggattactggcgtgaactactgtgccaggccagaagtcctcatttaaatgggcttgaacaattaggaaatgttctgtcacagtatgagatggtcagaggagggcggctccagggtttgttgatgagcagctcagtaacgtgacccggaacccagggtctttccatctctggtctgcctgcctcagcgaaggggcttgtcgccgtggtgtcagaatgtggcaagtggcatctggatgttctttctgggccttccttgtggctgtgagctcctgggctgaggcctcgtccccgttcctgcaggagggcactgacaagcttgtcttccacagccacaccggtgagaagcccttccagtgcattgcatgtggccgtgcctttgcccagaagtctaatgttaagaaacacatgcagacccacaaggtgtggcctccaggacacagtggtggcaccgtgtctcgaaactctgtgaccgtacaggtcatggccctgaaccccagcaggcaggaggacgaggaaagcacaggtgggtggaagtagggaacgccatgcttcccacacctctcttctgccgcttcacaggttttattgctagctgtgtgaccttgggcaaaccccatgacctctctgggcttcaatctacctttatctataaaatgtggcataagatgaaaggaaggatgacaaacatacaacatgtgtggcattactctaatactgtacccatggcagacatcactattcaatcacctacccattttttgctgagcctggatctcacctcagaatctttttttttttttaacttatgagttatttctggaattttccatttaatattttcagaccatgattgactttgggtaattgaaatcatggaaagcaaaactgcaagtaaggggagactactataaaataaaaatttatgatcccctactgttaaaataaatgaatgaataaataaataggggataaaagaaagccctttctttttttttttatttttactttaagttctgggataca

SEQ ID NO: 100508 - DNA, 1026 bp, Homo sapiens
cgcctggctaatttttgtattgttagtagagatgggctttcaccatgttgggaaggctgatctcgaacttctgacctcaagtgatccgtccgccttgacctcccaaggttctgggattacaggtgtgagccatcgcacccggccagatgattacaattagaagaggggactggggaggcattaggagtacaactaggatggtgtttagaatttttaacaaccatggagaggtctacagtgtctgaggggaaggccagagaggggaggctcgaggcagcagctgtttctcactcagaaaggaagcatttctgtatttgagcctgggaatggccgtaccagtgcacagcagctgagtgtgagtgcagcaccttaagcacagagtctgacccaaagcgagtagcaggtgccgggtgaacacagaggagcacggagtaggggttctgtgcatccttcctgaatgggccggctccttgtcctgacttccctggctttctccacagggttgggccagcccctgccgggtgcgccacagccccaggccttgtccacagctggtgaggaagagggggacaagccggagtccaagcaggtggtcctcatcgacagctcctacctgtgccaattctgccccagcaaattcagcacctacttccagctcaagtctcacatgacccagcataagaatgagcaggtaggtggatggtggcagcaggggcccacaccacaccagtcgaaacctttcactggtgctagggtcttgaatgctgcctagaaaggggtaggaaccagtgagtcagaccttccacggctctattccccccgggttagattccgagcaggggattgatgaagtaaggttacccttggggcaaatcacagaaaactttgactctcctccagacctgagacagctgactccacccagcgtaaggactctgtgtctttccagctctggtctctgtcatctcagggtgtggccttgacctctcctgatggctcaccttgtactcctgtcctgggatggtg

SEQ ID NO: 100509 - DNA, 1041 bp, Homo sapiens
ggtctcaaactcctggcctcgagcgattctcccgtattagcctcccaaagtgttgggattacagccactgtgctcagcccttggctggcttttaaagcagagagtcatcatatctgtttggaattttgaaagagcactctagcagcagcttaaaggaagaagtgtagactgaccaggaagggactggaggcaagaatcccatcaggggcaaggatagtgcctttcagacctgggtttgagctgcagcttcatcatttccttgctgggtacctggggcaggttactctgtacctcagattcctcctccacaaatcagggtactagtatctgcctgattggatgaaaatatgttacgcatgccaagctcctaggacaatgcctgccatatggtaagtgaccgataaatgcttgccattatcattattacaaggagacttgcaattcttcaggtgagaataaagggcctagtgtagaagcatgggaaactggaagagaaataatacatgtctgagacttttctgaaggagaatcaaaagagacttggtgatttgttgtaattgtgggagtgggcaggacgaaggagagaggggagtggaggatgattccccagttcatagcttgggcagctggttggatggtgatggcagtaatgaagttgggaaacaggagaaggagcgtgtacttgataattgtatagtcctggtaggtttggaaaaccgctcagcatcccctgaaactgtgaggtccatgaagtaagatgtgatggtcacattcatcactgtgtccccaccacctagcacagtgctttgcacatggttaatggtcagcatttgttaaatgaaaaaaacaatcttgtgggtaagttctgttattcccattgtacaagagaggaaaatgaggctcacgacgggacgaactcaactcaaagaccagttctgttgactgtgggcatcttgtgttgtttactcccatgatgactaagggtgtcatcatgaccatcaccatgttcattaaacactcagttcattaaacacccacctg

SEQ ID NO: 100510 - DNA, 1017 bp, Homo sapiens
ggtacatttctgtgaatttatggatgcaaatcagttcatttacaggttaatttaggtttagctgagaatgtctgatggatgcatagaggccagaagctcacaagagatatatcttcattaagttctgctcattgctggagtgagggtggttttctcatgtttaataaagtctctctcaaacatgagcatatgtgaagacactgtaataagtttatagtcttatgagacaaagaacgtggctctttggttctctggaatcaagatctcaggttgaaaagcacagtgtcttaatggcgcatgtgccagcagtatctcttatcccagaggcccagggatagaaaactcgaaatccacccagggaagtgagcagtgggaatttccctcagtgacgcttaagtttcttgtttggaaaaatggttggctagattgagtttggtttacttcctaagacagatggagtaccagaggccctatgtgttggctatccaaacacactggttcctttaattcaaatgacaaatccttattttgccccatttggcagggagattagatatttttaattgcctgccagagtaggtttataatgtgatttgtaactcaagatagattttgtttggaagtttaactaaacgtgaagacctgtgagcaggactgttttgcttggagaaaccttgagttgtccagagttgggtttgagtgtggagcgaggtcttggagagcatcctatgaagatgtgtgcgagccagccatctccgaggcgtaaagccaggacctaatttgtttacagtggtccagagccttgacatgaagccagagcccaccaggaggaggggcagagctcttggggccttgaggaatttcttatgaaaacttagtcttcttgctcagaattattttgggttgtgccactgtctttaagagtgtgagagagaggatattagaaaacaactttagttggtcattttgcagatggatgattatatttagaaggggaaaatctgagcatagcaatgg

SEQ ID NO: 100511 - DNA, 1030 bp, Homo sapiens
tttctttctttctttctttttttatttttttgagacaagagtctcattctgtcacccaggctggagtgcagcggtgcgatcttggctcactgcaagctccacctcctgggttcatgccattctcctgcctcagcctcctgagtagctacaggtgcccaccaccacgccgggctaattttttgtatttttagtagagatggggtttcactgtgttagccaggatggtctcaatctcctgaccttgtaatccacccgcctcagcctcccaaagtgctgagattataggcatgagccaccgcgcccggcccagttaagtaattttcatcatgcttaaaaacattgtatttcaaagaaaaattttttttttttcaaaaaaagtatccccaggaaatgaaaacatttcccccatctttgggaaataccatgtactttacaaacttgatcatgtttgatcttttcagcaactccatgtgtgagtggtattatcctattttagagatgagaaagtcgaggttcagattatatgagtcactgggcagatctagctctgtgacttggggatcctgaggtgggctgtatcacagtagattttctggtgtgtttgatattccataggatctcagctctgtcgcccaggttggagtgcagtggtgtgatcatggctcactgtagcctggacatcctgggctcaagtgatcctcccacctcggcctcctgagtagctagaactataggcatgtaccaccaaacttggctaatattttattttatttttcagacagagtctcactctgttgcccaggctggagtgaaggggcacgatctaggctcattgcaacctccgcctcccagattcaagcacttctcctgtctcagcctcccaagtatctgggatcataggcgtgtgccaccacagctggctaatttttgtttagccatagggtgaagccaatagggttgcacgatattggttaggctggtctcgaactcctgacctcaggtgattcactcggcttcccgaagtgctggg

SEQ ID NO: 100512 - DNA, 1094 bp, Homo sapiens
ctacccttttgttgttctgctggggaaaccaaggtctagagacttagcccaaggccacctggctctgctttctagaggtctggctagggctgggaacttgacctgaatccctcccactcaggactctgatcaacccatagtccctagtcttttcaggttgaagaaaccttttctaatttcaaaaaatatcaagaatgggtgtatgataatagttgtacttttaatacccgttaattgagaagatcagatattaattcccttcaaccgatattcactatatacccaccgtctttcttccctaggattgtgtctgcgtaaatggtagatggtcacatggtagttgtttttattattgtgtgatatattcatcatttagtgcacaggcagggcacagttgggcacattcacagagcgctggagtgaccactgtgaaccctatgagctcacagtccataggttgggaactgattgacacattataccaggagacttgagagaacagcaggtctgaaactctgggcttttcctgaaaccatgagctgtcttcacacttgagatggaaatctccacactctggaaataaaaagccaacaggctacccagagtgctcagtgctgctctctcaacagctatacactagggcatttgtgataaaagaagaggtatttggctggaaacaagctttaagtttctagcattagttggtaaatggtgcatgggtctaaggggagtataaaataatggccttgaacttgggaatctgtgtttgcagaacctctcatctcaaagcactgagcttctctgacaagaaccattgttcttatttcagaggtaagaggcagagaggccaagcccacacaaagggtctctgaaaaagagccagctccttccaggtttaggagcttggacccctgcttggcatcctagggtggagctgtttggttttatcaggtgatggtgggaaaaggaaaaaaggttgttaagttccacccagtttggcaaatattttgagtgtttactgtgagagactcaatttgaagggatggtgtgggtcatagttcttaccctccaggaactccctgtctggtgagggc

SEQ ID NO: 100513 - DNA, 1060 bp, Homo sapiens
gaattagaagaactagaacaggaggaactagacaagaatttgctggaaatcagtggacccgaaacagtccctctaccaaatgttccctctatagccctaccatcaaaacccggtgagtgcttctagagtcatggcacaccgtgaggtcatgtggcaggtgatcttgtggtcggttggctttggtttgtggtcggttggctttggtttgtggtcggttggctttggtctgtgtcctgagcttgcccaagattgagaaccagacaggatccattgtagtggccacagaggccatgtcacctggctttttctggtttctctctggaacagtgtttcttaatcttgacgctgtggacatggccagatacctctctgggccgagagatggagggtgggggcggggttgtccggtgcactgtggatgttcagcaccatccctggcctctgctagatgccagtagcaaccgccatgagttatgtcaaccaaaaatgtcttcagacatggccaaatgtcccttggtaggggttgggaggatcacccccagttgagagcctcttttctagaatgattttcctatttcactaaagaagagaaagttccaggcactgtgagaaggtgtgagagcgtgagtccaggacagctctttccctgcccctctagtatcctgtgctgcgcaccctgcaaaagccccggcccctagagacagcccctgggggaaggaaacagctttgactcctttagagacctgattctataaaaccttcatttcctcccttcatttcttcccttcccccatcccctcgcacaatatttcacccccaggtagaagtaatccacacagaacttctagaaaaagcgaggcaatttgatgtggcatgagagagaaccctgggggcagtgcatgaccagctgtggtcacctccctctcccatgtataaagagggaacggcctcctcaagtagagtcagctgcctagagtcctgtgtaggcagaggccgtccagcaagcctcctggagctgtgtggccatgagtcaagccacttgaggtggagttgggggttg

SEQ ID NO: 100514 - DNA, 1353 bp, Homo sapiens
agggtgggtgctgccaaactgtgcttggttttccagagttgtatgttgcagcttttaggcaccaaggagcagtctccctacagcctggagaggagtctggccacagggcagggctgtttgacagacaccatggagcacaggcagccctcatttccggccagaacatgttgaacgcaccagtcatcctaaatagccttttctgtcttcacacagccaagaagaaagaagaggaggacgacgacatgaaggaattggagaactgggctggatccatgtaatggggtccagcgctggctgggcccagacagactgtggtggcctgcgcagcgagcaggcgtgtgcgtgtgtggggcaggcaggatgtggtgcaggcaggttccatcgctttcgactctcactccaaagcagtagggccgcgttgctgctcactctctgcatagcatggtctgcacctgggagatgggcggggggaggggggcgggcggggtgggaagtgcctgctgtttataatgttgaatttctgtaaaataaactgtatttgcaaatccaacattgagcttctggactacgctgactccactgctgaatcctcaatggaaagggtcgactggttgcagttgaaatgacctgaaatgtagcctctgtccttgtaagtcagttgacttgccgcacatctctttgtgtacttgtacggtactggcagaaaagtcatttttcaaaagccataggcttttccttgcccttagctgtaataatgcatctgattttgatttcctccagagctgtgtttctgtccatcacctgtgtattggccctgtgtttaccactctggcccactcctcacccccttgctcccctggtcttctggagtttgtgacattgatttgaaatggatggtgttctcttgagagcaagtgagattgttagaattaagttccaactatacagttttctaacatagctataaggtccttgttgctgtttgtgataactgatagataactcattggaaacgtgcatacatttatattcagatgaaattatggtttgcactgtctattaaatatctcgattaattttcatactttgctgttgtgtttaatctatcatttgcctcgggagctgaccctttccagaccagcaaggtgtacagtggagtctggaaacatggaagacttaaccatgacatgtgtcaacagtttgaaccaaagagcagagcttgtctcaccagaagtctgttcaagtcctagattggccctcaccttgcctggggactctctgggtacagttcagggtgagttggttcttgggtacttcagggtcttccctatttcttctctgccagtgtccatg

SEQ ID NO: 100515 - DNA, 1740 bp, Homo sapiens
tttagatgatcacaatgctaaatgtcactcctttgaacttagtcttcatagtttcattgctcatttatctaggtcatccactcaaaactttaaggatgaggagaaacagcttctcccatcagaaatctaggcaagaggcgctcactggctcccaaccagcgggagggtcgtcgtgtgcctgcgcctgggttgggggagccttcgcgcctaggcctttccctcaatttttcctctttccccctcgccccgcactggggcttcctggtcggcgcttgcacagggaactcagtgctgagattgtctcaagccccaggaaaaatggtggaaaattcactgtcaccattgccagaaagaccgatttatggccttctgcttctcttaagctcccaatttggcttcatactttacctcgtgtaggcttctattcctgaatcttggctaaactccttaggtttaacctattggcctcaaaaatattggacagttgcattacctctctacttccttattactatagtaattggctatgtgctcttgtttgtaccccattcactcgactccattcgtacaatcacagataactatgctaaaaatcaacagcagaagaaatactaagaggaggccattccagcattaagagctatttctatttagtgaagtaaaccaaattttctttcttgtagccaaagacctttacaccaaaaactgaaatgtacctggccatactaatgagaggtgaagctggctgggcttctgggtcgggtggggacttggagaacttttctgcactgacggggagtgtctgcagcttcattcctgaagtcagcgagaccaccagccgaccggaaagaagaaacaactcccgatgtgccacctttatgaactataacactcactgtgaaggtctgcggcttcactcctaaagtcagcgagatcacaaacccacgggaaggaagaaactctggacacatctgaacatctgaaggaacaaactccagacataccgtctttaagaactgtaaccctcaccgcgaaggtccgcggcttcattcttaaagtcagcgagaccaagaacccgctggagggaataaattccggacacactaacaccaagcatttatttatttataagtttttgccatcgtaattttgaccataaattaattcaaccatctctcttattaatagaggagatgtaaaaattgtaaattgatcttctcttagattatgttcaatgaatattgtaagtgttctcatgtattgttaatgaacagaataaaatacagcattaccattaaaaaaaaaataagtctaggcaagaaccatttcaagccatgctggcaacagagtcaccagactgcagttaaggtagagacacgatgttctttgtagttctttgtagagagaaggactaagatctgggtcatggagagatgatcactcaacagggaatgcgggaagctagagtaaaatttggctggcagaccaagtcgtgagaggaaaaagagaccaaatgaggctttgaaagataaataaacaggccgggcgtggtggctcacacctgtaatcccagcgttttgggaggccgaggtgggcagatcgcctgaggtcaggagttcgagaccagcttggccaacagggtgaaaccccgcctctactaaaaatacaaaaaaattagccaggtgtggtggcaggcgcctgtaatcccagctactcaggaggctgaggcaggagaatcac

SEQ ID NO: 100516 - DNA, 3669 bp, Homo sapiens
tgcagactccaggtctcagacacaactcaaattccctggggttttggctcaaggaagctttgagactgtaaacggtgggatccaccctttagtttgtgtgtggtgtgttcctcctcccagaccttgcaggttctctgtgtttagatttatcgatcctagtttgatgggggttagggggagtagctcaagtcatctgccttcaaacaaatattactcctattttcagataaggcccagagtggttaaagtgaactaaaattaactttggcaaatgttccagtttttcaatgtgatccggttggagggagtgtctaaaaatcaggcaagggagtttctgggccaggtcttgaggagtctcttgatgttcacattagttctttggagtctggtacgtctgtggtgcctggccaggattctggatttacgagtcctatgtgggagctgaaaggggtcttaccatctggtccaactttttcatatctgcctttccccgcttccctgttaactgaaccttggaaaggggaagtaagttgtctgaattcagactgccttagtgtcagagtgagaactaaaatttccagtcttcttcctcctaatccagtaatatttttatttctcccataccttgccacttcttaaaagggcacgaaaccacttattcaggtcttaaggtcaggaatcctgagtaattggaaatcccaaggaagttttatagtccccacccctttctgtgccttatggttagtattaagaggaggccaggtttaagcacaggtgtactagttctcgtaagtcaccacttcggttttatgtgtttatggcttatatactcttccataaccattatctgatttaatttctaatccatttctgtgaggtagtttgcagagcttggtttatgtctctttttttactgtgagggaatggagacacagcatagcacttgccttagatgacagaatgagtaagtagtgaggacaagacacctctctggagcagaggatttgatttgacatcataaactgagccactcattgtggctctctgagcctcagtttccttatctgtaaactcatagggttgttgtggggattgttaagaaaatggctatgaaagtgctttatagtggtagtaataatagctaaatttattaagtacttaacgtgtaccaccagtcaatggactgaggactttatggactatattactaattcttagagcaacctatgaattaagtactattattatccctgttttatagaagaaacaggcttagagaggttacattacctgcctcagggtcatgtaactggtaagtggccatggcagtattcagactgcagacagtataaccttaaagctggcatgctttttttaaaaaaaaaattgtggtaaaatatatataacataaaatttaccatttaaccgtttcaaagtgtacatttatgtgacattaaatacattcgcatggttatgcaaccatcatcactgtccattatcttccccaactgaaattctgtacccattaaactaactcccccttccctcctccctccagcccctgaaaactatcgttctactttctgtgaatttgactactctaggaacctcatgtaagtggaatcatgcaatatttgtccttttgtgcctgcaaagctggcacacttagtgtcttctttagtctcagagtgcattgtaaatgcaaaattattagtcctcacctgcagcagagatgtggcatgcagctccagggcaggaacccaggcctctctgagtaagacctacttttctcccccttaggttgatgttctgtatcactgaagcctgttttgaatctctgctggccccccagtatctgcagaagagaccttataccctgttttttttggagacggagtctcactccgtcgcccaggctggattgcggtggcacgatcttggctccctgcaacctcaacctcctgggttcaagggatctcttgcctcagcctcccgagtagctgggactacaggcatgcaccatcacgcctgggtaatttttgtatttttagtacagatagggtttcaccacgttggccaggctggcttcgaactcctgaacctcaggtgatcctcctgtcttggccttccaaagtgctgggattacaggcatgagccaccacgccaggctattacacccttaaaatagaaccgagataactccccaccctcaccttgtttgcacctgcccttctgacagtccagggtttggggatattgggctgcagttatcaggaataacagtgcagtgacagcagcttggatcaaaactactcagaatgattaagtagatcacctttatgaaatgttccctctttcttccccctttttccatagaggcacacaggagggattagcttttgggttcttggaggatgtttatggatactcactgcttgcagttggttaagatggagttagatgctgcatatagcctttcaaaatgccctttgaccgttttctgtgttggtccatttaggggagtgggctcttcatgtttatgaagatggttggaatattgtcctgataacaactgggggttgggagaggcagtgtctcagagatggttaatagggtaacaaacacatgatcatgtgtctggtcatgtcacactctccttaaaaatctgatggccccaacattgcctgcatattaaagttcaaacaaatatgacccatgaggtcagtgtgttgaatttattgaatagaatcttgtagttgagggaccttacagtcatttagaccagccacctggctgacatttgagttggttacttgttgagattgtctttctttggatacctcatttttggaaagtttttcattcactgaagaattaatgagcctctgttagacctggtgctacgcttagggatttgggtttgtatagcgtagtgggaaagataggcaaggaaacaggcagtgtgagaagtgttgtcacagggacagacaccaggagagcacagaaaaatgatgcctaacccagcattggaaggtcagggaaggctttttaggaggagaagttggttaagcctagccctcaagagaacagacataagccaggaaaagaagagatctggggagtcagggaagaggcagagataagactgttctaggtagaaggaacagtaagttcagaaatggtgataataggttaagaccatcccgaaagtacgtactgttactattcccattctgtagttgaaggaaacgggccaagagagctaaacaaatttctcaggattcttgggtggagcataatgcttgaggtgggtggatatggccagacaggagactttcaaggtaggcagagcagaggccaagtcaggaaagggccttcttgcctgtgttgaggagtttggacttcatccggaggtgagggggccatgattcaatgtgcattttggaaggatatctctggctgcctgttcaggagcggactggagagctagaacactgtgggcagagagaccagttaggaggttggcaagaggtgatggtgtttcaaatgaaggttgtgggagagcgtgtgcaagagtgtgtgcagaaaaaagatggaattgctgggcgtggtggctcacgtttgtagtcctagcactttgggaggctgaggtgggtggatcacctgagg

SEQ ID NO: 100517 - DNA, 4259 bp, Homo sapiens
gagaagaaggagcacgtaagggagggggtagggtttcttatgcagggtctccttacatatgctttcacttacctctggttatggattctagttctttgtgtcaggtctgaaagggagagagtgagagtatggcacaactggtcatgttcctggctaaactggatgatgcaaacattagtttaggaagagaggagatattcaatcctagacatccgggtgtggcacagcctggaaactgcttacgttaagccaagaaaagtttacattttatccaggctacatcctttggcactggtcttttcgtgtactagtgtattcctaagtccctctctaagccgaagccacttctctgcttactctctgctaggcactgggaaaacaaagataagtaaaacgtatcctaaggagctcatgatccagaagggcagaagtctcagtagcttggatacagcggtggcctggggagagggtggatggggcagggcagggtaggacaggatggagagggacccggaagggtttctattagggataggagtcaggagaccccactgtgtgctccagtctttttctcgggtggcacgtgtctaggtttattcatctgaataatgactagatgacccataaggtcccttctagcaattacattttatgattctaggtggtggtttagataatatatctctaggagaggtatttctttcttcttctcccccttcttagtttggcattggtgaggggatatagtaggggtggagatagcaaggttttcacttgagtgtcttggtcttattcaattttggcttcatgtctatatagctggaagggagaaaatgacagccgtaatgttaacctgcttgtcctacaacttccccctgggtactgtaaggaaattgtgctcagggtgcagctcacagacccttaggaatagagacagagtgcagtggaataaataggaagtcttgtcactagcctgagcatcgtttggtcagtgtgtgggctggactaaggtcctttctttttatagccctgtttcctcataaaatcatctgggggggtccctgaaattctataaaggcccaaagagtgggggtggggaggtagggacagaaaaagggttggaggtccctgtctctctcacttctcccctctcttcgaacgaataagtagaagcaggtatctggccaagtattaatgttggtcatcttttgtttccacagccttgccttatttcctcagtgttagtgtcttctgtcatttcataatggctttcatggtaatcaatgtcctgtacctcctgggaggaaggaaggaaagatgggatattgtccctgggctctagtctccatctccagaagagccatttaagacatccactgccccctgttctctattctggggttggggtagggggttgtggctgaatacttgggtttcttagagggtacatacttgagtttcctagggagtgctctactaactaaagtgcaaatctggctatcttcccaacacaccaatgagtttgactggggaaaatagcagtcagtgggcttttgttgcttgccaaacccatgttaattgtaattatctaatattctgtgggatctctgtcttcctgtctgtgaaacaagggaattggactagataatcttgagtgatatttctacctttttacagttttgtggaagtggcttgagaatttatctctggaaggagaaagggctttgctaaagtattgagagtatctcagagggttaaattctgggttcacaaaagatacctttcagtatataaacagatggatattgctttttagagtggacagattgctgaaaaattgcttgtgagatgaatttatcaaattgtatgctgagttccattataaacttggagctgtagcctcatgggacaaacttggagtccaagactataaaaaaattacattaaaatatgtagcaaactgtttaaaatcacataataaaggaaaaataaaaaacattttaagattttcacacaatggtaataatggaaaaacactagaccagaaacttgcatttcctaagagctttagcttatggagtagatgcctctactgaggttacctggcccttgaagtgccatctgtagagactgaatagctctgttatttgtcaaggtaagactcattgctttattccaagtaaatattctcttttagaatgccaggtttggaagcttaatgttattggccagattttcttcattccagaggcatttatctggtatttagctgtctcctgtttattttattaaggattttaataagcttagttaacggtactgcttacatggtgtctcttgatctatttgtctagtttcctttgaaattctttgtgttagtgaaagcaagcccagcagtagatttaaaagggtcatttccataacttcatttatctagatttgggtttttttggtaagagatatgaccacactatactgagaaatcgaatgttgtttcctttttttttgagacggagtctcgctctgttgctcaggctggagtgcagtggcatgatctccgctcactgcaagctctgcctcccgggttcatgccattctcctgcctcagcctcctgagtagctgggactgcaggtgcccaccaccacgcccggctaatttttttgtatttttagtagagacggggtttcacagtgttcgccaggatggtctcgatctcctgacctggtgatctgcccacctcggcctctcaaagtgctgggattacaggcgtgagcagccgcgcctgaccacgtcgtttcctttttacctgaagcattaatttaaggctttggaattttgtttttgcggatacctgtaaggtggtactgaggaatggtgctgctgccaaagtaataatgagggctgtgcgtgaatcagttgagcacaagaataacttctcttcagactttaaagattcaccctaattgattcttacaccaattaaaatcaacccttactaaaattagggttcagaggaagttacttagttgccgtggcatgattatttatgcttgggagtcccaacagccttccatccctaatctcaaccattcgttccaggaatttggagtacctcctatatgttcttcttatggaaaacataaaaaccaacaagacataattcctgtccacaaattactttcagtcttgagaggaagacagataagtaaagcaaatccagcctgccgccctggctcatatatttggattgagggttcaaacggaaaataacataattggtggctgtatcagtagacaaggagaccagtttgataatctgacttccagtgtgtagactttatttttttggcattcccttctctcccttctgttttttacagatatttatcctctgttgctaaggtgtccaacacccagtgtgtaaagtcaagaatattagagtaggggacaacatttcctttcaggtttaggtgtccagatatctgcatctggacacccacacagttctctggctggcttcaggaagatttggtattgtctcgcttcttatgtagaaatgaagaaaattaagtttcatgttgaattattttaagttttattatgctctattttgaaataaaatagctctattttgtatgcaggtggaattatctgaggtgtggtttctggcatttgatcagtctgtgatttgataattgtgtttatattgtagttcgtgaagcccattgccactgccagccgcctttgaacactttgcagcaaggagccctagtaaatggaaatggtgggcacattgaggctctcctggttttgaagggctcttccctctttcctacccttcagagagaaatattacttgggatgctgtgttgtgctcccgatttcttccaacaatttagcattgcctgtggggtctggaataataaggccatgtaaactggagatgtcatcttctctctctttgaagttccattttctcatctgtgaagtggggttaacactccatatcttgccttcctcacaatggtattgtgaggagcaaattagaacgttgtaaaatcacatgagacaatttatatgtgaagaatccatcagtcatttgtcagtggtaataggtaagtggcagaattttccttaagaggggagatcgatctctttgtagggagcagggagagtgatctcagctggtctctgggattgggaaaaagtgtgatgaaagcatctggacaggggcaatgatggagcaaaagactggagg

SEQ ID NO: 100518 - DNA, 1515 bp, Homo sapiens
atggttagtgatgagaaaattgctgttgttctgtgttgttgtaaatacttggcattgtctatctttttcatttgaagccattctggttagtagttatagatatgaattttaagaaccatactatgaattctcacatagcaagtaccataaaggggtacaatgattgggaagttcagaaggggaagagattgcttcctttgtacatggaggaggggcagagggggagttcccaaggaacatttgtggaccagtgagtatttgtgctggactttgtaggataaggataatgaccatctgttgtccaggaccattttaatttctaatattctgtctggttgtacttacagattatgaaataccaatcaatattgccatgtctgtaccttatctcccatactatgcagaagcaacacccagttatcttttctcaaccgatgtgcttcccttccccccttttccagaaagaatggtcacaggtgattaggctgcagagatggagaacattctgtgcaatgggaacaacttgagtagaggcacagatgaatgactagaccgagtagtatccatattcctgctaatgagcaggtggtggaagtgtcccacactttggagatgggtgataccttctcatagcctctcagagcagaacaaggtcatgtcgttatgaagccaatttgtatttaaactggataaaaggatgagaatgagctctttgcttatacttacatcatttcaagaaagaaattaatccagtaaacagtcatacctgaagtatatcaaaagagagtttttcttcttaaaatggttggggagggaatactaaaacctaaagaacttagtctctcagagctcatctattagttgtatatttgctcagggaaaaattgccatttctttgtcagcttttatcctgccggtggaccctagctgggtgtttattttgtgtagttttaccaaatcactttgaaggttggcatgaacattgatcatgtcttagagcctttcctctttgttctgtcagcaaatattagaaaatgtaccttaaattacctggttggggaaaatagggtggccctgcctccttccagagagcagcattttcatgttaaacattagtcagcttctgatcctgtgtcaggtcgcggggtgtttgtcaagatagacagggtgctagagatgccactagggacattcactagagaatttctaggccccctctcgaggagactagtcgagtagttgatttaaaaatctgatgggctgggtgcagtggctcatggcctgtaatcctgacactttgggaggctgaggcaggcagatcatgaggtcaggagatcgagaccatcctgacggagtagtgaaaccccgtctctactaaaaatagcaaaattagctgggcgtggtggcgcgtgcctgtaatcccagctactggggaggctgaagcaggagaatcacttgaaccagggagttggaggttgtaatgagccaagatcgtgccactgcgctccagcctgg

SEQ ID NO: 100519 - DNA, 1043 bp, Homo sapiens
tcaaggagcatatagtcaatcagggactgcaagaccatatgctatttcagacaaggtcattgtgggactatgggatccttaatctcccttaagagtttcctgcctccctgtcatcctgtcttgctgttttctgtgccatgctattcactgttgcctggtaccttttcctacaaaccatttttgttgtattctccctgctgtaagtctagtatggaagttttggtaaataaaagttcttccagcaataaacttttctttggattgagttactatttcaagggcagctactcttttttttctcttgtgtttggcaaaggtgttattgcttttatggagatgctgaaggaatctggggaacatagaataatgatggaatgaagcatggggaatgccatcctgcatcaggggagaacatatatttagcgttgtactgttcactcccaacggcatctgactgtaatgggggtaattttgctcttttgcaaagacaaggaacttttagttgtgatgttcagggagcagaattttaaaggtattccatttaggggaaccaagctgctgaactttcatcctcattgggaagtccttggggcactcttaaatcctttctgttccagatctgttcagtcttatcctctagatcagaggtcacatactggtagccccttgggctgtatctggcctgtgtacatattttgtttggcctgcagtagtggtgtcattgttttttaaattgagacagggtcttgctctgttacccaggctggagtgcagtggcacaatcatagctcactgcagcctcaaactcttaggcttaagctatcctcacgcctcagtctcctgagtagctggaatgacagagacatgccactacacccaagtgttttttaaatttttttgtagagatgagttattactttgttacccaggctggtctcacactcctggctcaagcagttctgctaccttggcctccgaaagtgttgggattatgtgtgagccattgcacctagcctctatttttattttgagtggaataaaag

SEQ ID NO: 100520 - DNA, 1120 bp, Homo sapiens
tgaaggtgactggtttctcatgaaaaaggaggaagatttttgagaaagtagcagaggctagagcctgacgctgaccatgagcaatttttccatttataagagtgggggtaggcctgtcttctccttgagtcctctaccagggatttgttttgttttgttttggtgtgtgtgtggtttttttttgttttgttttgtttttgagacggagtctcgctctgtcacccaagctggagtcagtggcatgatctcagctcactgcaacctctgcctcccgggttcaagtaattctcctgtctcagtctcccaactagctgggactacaggtgcgcgccaccatgcctggctaattttgtatttttagtagagacagagtttcaccaatttggccaggctgatctcgaactcctgaccttgtgatctgcccgcttcagcctcccaaagtgccaggattataggtgtgagccaccacgccccagcctctaccagggttgttatattgtgactccttgtacactggctagtccatgctttagaagcttgtaaactgaagcaaagagacatggcttggatctttgggcaactctttggagcttcggccaaatttggcagaagctttgagtttacaacttcatgttcttcatttctctacttttttccacattctgcttccttattgactggcttctttagacagcatatttgttctcaagtttgtcaaagccacaccatttcctgttgtttctttgatactcaagcccagtgtcagttgccgtttatcaccagagtatagcactttttttgggaaacacttggtcaattcatttttgctacctgcttgccaccaaggtccagcccagctctagaaggaactctaatattgaagagactttacctagttaaggtgctggtgaatcccctgcgactaagtgaattatcttcattttactgggaacttttggtgcccttattggctgataaatctgtctcggcctatcttaggacttcatatggacagcaaactagtcaaggctcagtggatcatgtccttgtcaagttggcattttttgcaatccctattatatatttgtaaggtagagtggaagtgagtctgatgtgtcat

SEQ ID NO: 100521 - DNA, 1041 bp, Homo sapiens
cctctgaatgttactgtttatgacccaaggtgagtttgaacctgagttcactgctattggaaggtgatccccatacttagcacaagaaagccaaagctactgcatgtgttccaaatcagaatctctggggtcaggcatagaaactgatgtttttaatgaattccttgagtccttctgttgtgtagccaggttgggaaacacttatctagagaaagaactagaagtaaaaagatatgcattatcttctgataccaccttggacaagtttcttttctggacatcagctttctccactgaaatattaaaaacctatactcataaaggaccctttcagttctaaaatttcatgctgctttatgatgagtttagtctgggatctttttctacctcatagtgtccgttctctgggtctgcctggggcggggcattttagggcatttggccagaggccagcgaggcagcccaggccctgaccttctgccagaagcactgacacagctcctaattagaaatggatcaatatgggcctgtagccaggcctggggagcctgggaggaggctggagcagtgctcctaggtagggagaatgattaccgtgaaatggatctggttacacttgtcaatacaacagttctgctggtgtagcccacctcccctggggaccagcaggcagggctaccctgaacaaacggggaaatggttaacttgtatccctatttgatgtgttttcctcacctttataaactcttacctaatgtgatgctaggtacatcgtataggccccctcttcagatggaaaaatcacttattgaatacctactaagtgttaaatactgagcctcattgtgtttatttctccttgcaacctactggcataggaaggaaaggaaactgaagctcagaaaagtcaaaatgaagtgacttggctgcccattgtcatatagcataatctctattgtactatgctattaatacatttctgagcatttgcaacaccgattccaatctgatgaactgttttctaccagggccctctcttac

SEQ ID NO: 100522 - DNA, 1820 bp, Homo sapiens
gatgtgtccaggaattactggtaaaggggtgggcattagagcagtacctaacgtgtagcaaaacagatggactgctctgagcccttatcctttgccagatttaaggttgtagtagtagccattggatggcagtaatgcaggtgcagcaggtagggaggagaagattgatttattagcaagtaccaactgaaacttatttctagacttctgtgggggagaagggaggaagcctgaagagcagcagtcctctgtcctctgggccagacctgcagaggtgttgtggttcttggcattggtttgaaagttcgtctggcccaggcaaataaccttgcttctctcatggcaaaatcttctgcttcacacagcctgcccctcctttctgtgttcttttacagaaagaaattaatggaatctgttcaaaatacccctgaaatgaaattacatttttaactctaattaccctaattaaaacttgacagccgtaatcctggaatggaagatatgctaagtaccccttgcctgtgacaagctcacttacccagatggaatgttgttctgttctgggtttagaagaaaatttcttttggtgtttgttttgttttttccattagcaatttagtcttccaccccacaaatgccccaaggtaggatagctgtacttgtggactacaggtttgcccaggacccctaatctcaatagaggttcctttgcatccggagatggagctcctaatgatccttactacatacctttgagttttttcttcagttgaggttgaactgcagcctttccctcagtgaaatcacctgccttggggaaccaaggatctgtacttgttagaaggctgtcttctggtctagggctaaatacggattgggggtcagtttagggctagtatttaggatacagtttgagcccagggacaaggaggtctaaaaataggatccctcggccgggcgcagtggctcacgcctgtaatcccaccacttcaggaggtcgaggcgggtggatcacttgaggtcaggagttcaagagcagcctggccaagttggtgaaaccctgtctttactaaaaatattttaaaaattagccaggcctggtggtgggcacctgtaatcccggctactcgggagactaaggcaggagaattgcttgaacccgagaggtggaggttgcagtgagtcgagatcatgcatcttgcactccagcctgggcgacacagcgagactctgtctcaaaagaaaaaaaaaaaggatccttctgctcttcacatagctccagttcctttaactcagcacaggtgagagcaacctagtgagatgcctggtcttggcctctgctttaagtggttacctggccagacccgaaaacatgatgggatgggaggtaggggcaagcccataaagcagactgaaggattctttgatgctgtgggtcgtctcacatttctgctagaaccgaagatccccatgttctagtaatctactcagcttagaagcctgttcagtaggcagacactgggtgctctgttaggtactgcaagggacacagagttgagtaagacacagtccctgctcttgagaaacttagaattctgggggagtggggaggtagtggtgggtgagggacaaccatacacatacaaattatgtaagacagagcaagctttattcggtagataggaagcttggccgggcgcggtggctcacgcctgtaatcccagcactttgggaggccgaggcgggcggatcacgaggtcaggagatcgagaccatcccggctaaaacggtgaaaccccgtctctactaaaaatacaaaa

SEQ ID NO: 100523 - DNA, 2485 bp, Homo sapiens
agtgaagccttatggtcagcactgatcatatgctggagtatcacaagagccccacagtcagtctatggtataatagggccagaaccagtctccttattcccaatcaggccacctctcacctcactcagacttaatacagtatagaataactttggaggggacctcagtgtggaggctggaactgcaaatttcaagcttacatatcagtttttgaataggtattcaaaaaccaatgacaggctgggtgtggtggctcacgcctgtaatcccagcactttgggagtccaaggcgggcggatcacctgagattatcaggagttcgagaccagcctggccaacatggtctgagtgaggtgagaggtggcctgattgggaataaggagactggttctggccctgccactgacttccctctgtgactttggacagattcccctccctgctctggtcttacctccctttttataaaatggttgagcccttccaactctggtctcatcaggggcatgaaagccattttctacacagtctcagttgcacagagcagtgtctggtcggagctttggtgtgttggttactgattataaagctttagattctcacttccagctcaagagggggaaggggaaccatccaactgtctcattagcatggagaaaagaaaacagtaattactcgtgcctcccttgataattcctgcagggttggatcttctagggaaggaggaggggaaaactagagatagcttcagctgagaaaggagaaatgctgttagctgcccagaaaatgcagaggcaagaatgattgtcttgcacatctgttgtattctgtggacgttcctccaggcagcttggagactgcctagattgagtttcatctatttatggcatgcattatgttctcatacgtgaacatgggttgggctcaagacccctaatgtcacctgtcattaagaaaccagctgtcctctagggcctactttttgatacactgggcatcctgacacctgtctttgtttgggagtatgggagggttttactgacccattttgtgtcctggctgcattttttattatgttgtgaggtcattttttttacccccacagcaacacagccagtagttttattatgcctgggcataggcaaccatacagtagagccagtcacaagagtcaaggtcaggtatccttgtgaggggaggagtctgggagaactgcaagaccatggggtttagtaaaggctgggataagcaagccttacagaagggttgaggcagttttgaggctgaggggttagggggagctggaacccaactgtcaaatagattggcaagttggcttgtgggacaagggctatttgccctgtgcctttgccctgtgccagtcttttactccctgtgtgtggtcggttgtgagccctgaagtgctgactctagcagaaatgcgttggaggctgccttcaggggagccctgcctgagggagcctggagccattaggctgagattatctcccgtggctgctcactggtgccttggttgccaccccagaggcctagagaacgcagcttccctttctcttcctctctcctgaggaagataacccttcagcaacacgtctctctctctctctcttttttttttttaagacaatctcagtctgttgcccaggctggagtgcagtagtgcaaacacagctcactgcatcctccgctgcccgggttcaagtttttctgcctcagcctctggagtagctgggactacaggcatgcaccaccacaccacacccagctaatttttgtatttttagtagagacggagtttagccgtgttagctaggctggtgtcgaactcctgacctcaggtgatccgcccacctcagcttcccaaagtgctgggataacaggcgtgagccacctcacctggcccaacacctttcggtcagtcttcctgcaggccctggagcttgcttattctaaacaacaagagttctgtagggacatgctattttaaaaaaaaaaaaaaaaattgttttacaaatgtaggagattatttcctctgttaaaatcgtcttcggtccccagggaatgctccctttctcttgtcccagaccgtttgcttgattccccaccctttgatgtccacacccaggcttcccataattttcactcttcattcacttcctggctcctttccctagcttccagcagtagattcctggttgttttttttttttttttttttttgtggggggtggggataaggaaggtttttcaacaaagctttcatgatggggagctactggagaaaggtccagaggatgtcagtaaccccttagccacaaggaacgatatactcccaaggcttgttagcctggagtaatgctggtagaggaggaagctgtgacaagaggaagaacctgcttgtcttctgacctctgcaggcttcagcttaaacctggcagaggttgggctggggcagggcaatagt

SEQ ID NO: 100524 - DNA, 1924 bp, Homo sapiens
ttgagatggattctcactcttgtcacccaggctgtagtgcagtggcacgatctcgctcactggaacctccgcctcccaggttcaagcgattctcctgcttcagcctcccaagtagctggggttacaggcgcccaccaccatgcctggctaatttttttttttttttttttttgtatttttagtagagacagggtttcaccatgttggccgggctcgtcttgaactcctgacttcaggtgatccatccccctcggcctcccaaagtgctgagattacaggcatgagccaccgcgccaggcgtgccttatttttctttatggcacttagcactacttgaaattatatactgtaaataattgacctgtcttttgctaggatgcaaaatgtgtgagggcaggaattttgaatgcctgctgcctgttctgagcagcacccctaatggacttctctctctattgtaggtgagccctattcccagaggcaggtggtgctgaccctgtaacccaaaggaggaaacagctggctaagctcatcattgttactggtgagtgaggttgcctgggaaagctctgggcaagcttgggccaacatggagggtaactcgtttggggattgtttttacctttagtacagataacttacaagtgattatcttcctactccatgtctaaaagattggatgttgcacaggtaaccttctgaactgggagggttgagactgctctcctagaattgccacaagaatgtctgagatcatttgccatgaataaggcagagcaggtctgcttccttcttgcttctgctagctgctttctgctgggatgtggcaggtggggggctatcctgggacctggcggctatacctgtcctctcacaagctctttaacatgacctcacagcccttagagacttgttttttgagatggagtttcgctcttgttgcccagactgcagtgcaatggcacgatctcggctcaatgcaacctccgcctcccgggttcaagcaattctcctgcctcagcctcctgagtagctaggattacaggcatgcaccgccatgcctggctaattttgtattttttagtagagacggggtttctccacgttggtcagactggtctcgaactcccgacctcaggtgatctgcctgcctcggccttccaaagtgttgggattacaagcgtgagccaccgcgcccggccccgtagagactttcttagctttagtttttactgtgatctgccaagctcataggtcagctccagaaaatcctgtagtttcttccattctgcaaaatgtcgtatgaataatggtgagagtggagtgattagggttttatgaagtggatgtcaggggaagctgacagatggtgagaaggaaggaaaatcaacgcattaagaacttactatgttactgatctcaatctagacaaaatccctttttgtgtgttggggggggttttatttttgtttttgggagacaggtctcactgtgttgcccaggctggtctcaaactcctgggctcgtgtgattcaagtggtcctcctgcctcagcctcccgagtagctggaattacagatgtgtaccaccacagcctgctctgaaacctcattttatagatgaggaaattgaggctcaggaactgaaataatttgcccagggtttacacctgggaatctataaagttgatgttagaacccaggtcagtctgaccataaataccattgttcttccagacctgaccttccttgggctgttaatctccctctctaattctgatttttcttataaagttcaagaaggcctacttacttagggattcagaaaggagattcagttgaggggctgaacagggcaggtaggagttaggggtccctctgagcagtggtatttctagtgagggggactactagactgaaagata

SEQ ID NO: 100525 - DNA, 1051 bp, Homo sapiens
tctgttcttctgtctgcctgagagtgcacagagggttttgacccctaccttccctcctactctgaatatccaggctcttgctgccacttctttttgccttgttaatctaaagttctacagcttctggcctttccctggcctgggtgccaagcttggatcttatatgcttcctgtaacaactgccctgtgaaaaagctccactattaacttttaaaatatgaatgattccacgtaaataagtgtgtaatatatacatttatatatgataagctacccatataatagcttatttatctaacagcctcatttttccagagtccaactgaaaaacaagagggaagtaaagcattgtcatccttaagtatttgcacagtgctaatttattcttatttttatgtgttgttgtaacaagtttagcatttggtttctaaaaccccataagattaaaagaagaatatcaaaaaagggagaagagctgctatattaataccatctaggggtgagagctgaaagctgactgaaaggggaggggtgaaagaagaagttaaaacaacagtctgggccgggtgcggtggctcacgcctgtaatcccagcactttgggaggccgagtcaggtggatcacaaggtcaggagatcgagaccatcctggctaacacggtgaaaccccgtctctactgaaaaatacaaaaaattagccaggtgtggtggcgggtgtctgtagtcccagctacttgggaggctgaggcagaagaatggtgtgaacccgggaggcagagcttgcagtgagctgagattgcgccactctactccagcctgggcgacagagcgagactccatctcaaaaaaaaaaaaaaaaaaaaaaaaaaaaaaaaaaacagtctggaggccacttaatttaggagcagcacctccacaaacatcggtgtccctcagtaagatgagggtggggctgggtaatttctgtggtagttttgggttcctctcgaaggctagagttatcagaaaatgttaattatttatagtatctactatatattatcaggcactat

SEQ ID NO: 100526 - DNA, 1012 bp, Homo sapiens
ccaggcacagtttcaagtgtttgaggtgtagcagtgaataaaatagttttctctctgtagtttacgttctagtagaggaaagcagataaatgaataaatctgaagaaaaatagcagggtaagggaatagggagacactggattattaaagaaggcctctcagaaaataaaatttgtgcagaaatatgcaagaactggagtagtgagctatgtgtatctttgggggaataactttctaggcatagagcgtgcttcttgattctaaggaacgaaaggaggccagtgtggctacagatggagtaaacgaagggggagataggaatatggagaagtcacaagggtagacagggaccagatcatggagagctttattctgagttaaataggaagacattggagagttttgaatagaggaatgacataatctgacatccattaaaaaaaaaaaaattcccctgcctaattgtaccagctgggatctctagtacagcgttgaatagaattgataagagcagacagccttccttactttgttcccaattttaggaggaaagtattccatctttcaggctaaggaagttcccttttattcctagtttattgagaggtttcattatggatgactgttggattttgttgattttatggtctttgttctttattctacattgacattacattaattgattttcagatattaaatcaacttcacattcctagaataaatcccacatggttgtagtgtataatcctttttatatggagttagatttgatttgctggggaatattgttctgtagttttcttaggtctttatctgcttttggcattagggtggcctcatggaatgaattgatgtgttccctcctcctctgatttctgaaagagtttgtaaaggattggtattatttcttctttaattgtttgatagaattcatcagtgaagccacatgggcctgggcttgtctttgttggaagagtttaaaattactaattcaaatgtcttacttgtt

SEQ ID NO: 100527 - DNA, 3669 bp, Homo sapiens
gcctgtcacccagcatttggaaaataaatgtcaaagagaagatcataatggcctagaaggttggaaactgagtagctagcaagtgtgagagagggaccatgagacataggacccagattgtgctctatcacccactcattgggtgttcccagtcaagctatttctctttgcatcctccatatccccatctgtaaaaatgagttaggcattgtattctccaagtgcctcttcagggctttctgaaatttcattggccccttttttctggctcttgtgtttgtactctagcttttgcctttggtactgaggatttcatttatgagaaggctttttaaccagccaggctttgtctagccctagagtatttagaatgctcctgaaactatgatttcaggccattcaatttgcatctagaaatgccttggttcacctgatcctactccctcatttaacattgagagataatgcaacagagaagaaagactacaggcttgacaaatgacccccaattcagattcctgccagtactagcttaatctttctgaaccatatcaccatcatttaaaagtgcaataatgggctgggcgcggtggctcatgcctgtaatcccagcactttgggaggccaaggaggaaggatcacgaggtcaagagattgagaccgtcctggccaacgtggtgaaaccccgtctctactaaaaatacaaaaattagttgggcatggtggcgtgtgccagtaatcctagctacttgggaggctgaggcaggagaatcgcttgaacccaggaggcggaggttgcagtgagcagagatcccaccactgcactccagcctgggcgacagagtgagaccccatctcaaaaaaaaaaaagtgcaataatgataatagattcagcacacagagaattatttagaagaggaaagaaaaaactgaggcccaagaggtgaagtcacctgttcaggttcaggttcacacccgaatccagatctcttgtgtctcattccagagtttttttcccctctagagccaaggtcagttgtgcccatatggatatggtagcaaagattggaactgaaagcatgtcagcttttttaacatctccgccaacagccctctcaattcccctgtggcacgtgtcaataacacagcccgtacttgttttagaaacaagcgctccataagcactcctgtttgatttgctttggctggtacaggatccagatgctcttagaatagcacaacagactctccaaatcagcctattcccattccgagccactcacagctctgatctgctgctggctggggttcatccccgagtcttccctacctatcatgtgaatcacgttcagacttttgctagtttgtcctttccctcttgagtagaagtaacatttattgtgtgcatactgtgtgccaggtattgtgacaggtactttaaatagattatctcccttaatctttataactcattaagctattaatagctccaaaggggaaagctgaggctcagtgaagtgaatgaatttactgaagccacatatctagtctctgaaagagctagagtttgaactgagtcctgaccccattgactaagctgtaaggtaagctgtttcctgagtatcatactgcctccctgtcctctggccacggcccttccaggagggtagagtgtttgggagtacccaagaataggcgtttggtgccctgagtgtaataggaatgtcttccatgccttcagtgtattttcctgagagtttctgcactctgtgcctcaaaccaacttctctagaactcagatatagagcccagagatccaagcactgagttagaagctatgtttccatcgtgatcatggaacagagtccctagtgaaaagtatatttgtccttttcaaagttgaatagagagagtatttcaagcaataacccctacttgtatgaccaactccaaagtacagggaaggaaagggaaagggtctgtactcctcaaccgtgataagtctcctccagggacctggcaggagtggagacatgcacacacaaaagattttaggactaagattgttctgataggttctcaaatctgtactcaacagtttgcaaagcagtttaccttcaagaaaccgtactgtgaagaaactgaaggaatctgcctttatgtgacagagccaggggctagagtccaaatctttagtcttgataatgccagtgaggctaagtcttccctgagagggttttctctctggcgttgggcgtacccagtctccacttgcaaaaggagcaggcccttagtctctgtctttttctcagccttcctctgccctcttgtccccctcctcactcattcatactcaattgctagggacttatttcaaccccttatagggtgttatttttaggcacagggtgataggagatattttttgtttctgtattttccccaggatcaattgccataaaatcatggaattttaggatatcagagtgggaagggaccttaattgacaatcatcaagtttacatagtaaccctttttttaaaacatgtaacatccagaacagagcttctggctgggtgcagtggctcatgcctgtaattgccagcactttgggaggctgaggcgggtggatcatttgaggtgaggagtttgagaccagcctggccaacatggtgaaaccctgtctctactaaaatacaaaaattagctaggcatggtggcatgggtctgtaatcccagctattcaggaggctgagatgggaggattgcttgagcgcgggattgccatcccggcgggtggaggttgcagtgaggggagatcaagccactgcagtccagcctgggcaacagagcgagatgccgtctcaaaaaacaaacataaacaaaaacaaccaaacagagctgctttggctgaagcagcagcaagaggcctagtagctcagcctccccactacccttaccaaacaaagacgatccccgctcccgccgaggcagctgccttaaacttccagggttcccaggatcacagttcgtaaaacgacactgacctgaaccaactctcccattttatcattgttaaattgaagcccagcaaaggagagtaatgtgccaaggtcacagagtgaattagtggcaggtgccctgactctctgcctggtgtcctttttactaccctgagctgtatgtcattatgtcatttcgttaagtgaccacttctaacacttgactggcatcctgtgcctgggtgtcaggcttctcttgcctcatgacatctggttcctgtgaggtaggcaggcttgtgaatgtgtgtacctcgtcagggcataattttcatacatagagtgagcatgtgtcaggttttgtttaactgattaatgtggaaaccagcagaagtagaatagctgagaaatcagatttagattgttaatgaaagaaggattgctgaaataaaattgttttggttagtaccctaatgaaaatataacctttggaaatattttatctgcgtattaaaggtatataccttcttagttttttacacattaacctcttactgcagagttttaaaacatttgggccctaatcgtttgtgaagaataacaaaattccatttcccaagagtgtcagatgacttagttcatagtaaacaatgtgtctaacatgactttt

SEQ ID NO: 100528 - DNA, 1866 bp, Homo sapiens
gcactttacagatgggcaaactgaggtccagagtccctgaattgtacatgtcagaaccaggattgaatctagaagtcttgggctcctgacaccaaacaggtgctcttaacttgcagaatgtaggttcctttgattcagttcggttcaaacaattcttgaatataacccatgtgccagagactttgctatgcaagagagcctctagttaggctcaaaccgtcttggtctagtgccttacttaagaacagggacttgtattatttacttctctgtccccaggcaggaccttgatccaaaaatgctttgctgttgtttttggccttaatctgccagaaactagagggagcagatggccacagcaatgtgggttatgaggatgtgatatcaggcagggttgaaggatgaattgagagccctgcacccaactacttctgtgtctgtgcctaggcccttgtcagggtagtctctatctgagagtgtagctggtcagcctggtcccatttctcatttccagtcacctccccctcttgccatcccatataatggggttagtctcctggacagatctcatacagaggctgctgggatctgctgtccaaatgaccctttggacctatttcccagccatgttccaagatgatggtgaggagtctagccccacagccagtatgctatctctattcagataactcccagctcacaggcctcccaccaggctctcacccactctgatgttttcactcctgactcctaagaagcagattggcaatttagtgtgagtctgtcagacagcctagagagtaatcaatactgagagaaatggacatatttcctgtttattcaaaatcctgatgaaaattttaaggagcactatttgggaagggatgactgggaaccttgcaagaacaaacagcttaaaattcatgaacagaaatagcaacgtttattcatgatgtttcaaatgcccctaatattcacatctttatatattacagacccctttcatacgtgttactgcttttgaaccttagagcaactctgtgagggaagcagtgtaaggattactattcccacttgacagttgaggaaactaaggcccaggaagctttaaagagagttagggaccatctgatagtcatggtggcagagcccaaaacagaaccaagatttggaaaatgagtactcctgggtttgaaatctggtgctcgccactttctagttgtgtgacctttggcaagttacttggcctctctgagctcagtttccttctctgtaatacgaggataacaatgtctactccttatggttgtgtatggatttaatgatataattaatggaaaatgctagcacagtacagaacatgtgttaggagcttagtaactgcaggtatcctatctcataggatagcgttttcagtatattgcactctgagtctttgaaatttgatactttttttttgtttttgagacagagtctcgctctgttgcccaggctggagtgcagtggcgtgatctccgctcactgcaagctccgccccctgggttcatgccattctcctgcctcagcctccccagtagctggggctacaggcgcctgccaccacacctggctaattttttttgttgttgttgttgtttagtagagacgggttttcaccgtgtttgccaggatggtctccatctcctgacctcgtgatccaggtgccttggcctcccaaagtgctgggattacaggcgtgagccactgcgcccagcctgatactttcactacagtaaaatggactacatataataaattctcattaaccagagtatcatttaaatgcctcactaggttaagagaactggataagaagggaagcagggt

SEQ ID NO: 100529 - DNA, 1023 bp, Homo sapiens
agtaggcccacagtccccacagtccagctcctactaagaactaagctctgacaccagtaatataaaaaagatcctgagaggggtttgaagagaatgtgtaagtttctgctcctctgtcaccgtctccatcacaaaattgagggggtaggaatgttctgctggatttctatccagacagtggcagaggaagttggctttggcatttagtggggctatccttgcattttactaagccctctagttaagatcaaatcaagtttaaaaagaaactttttttttttttcactctgttggccaggctgatctcgaactcctgacctcaggtgatccgcctgcctcggcctcccaaagtgctgggattacaggtgtgagccaccacatccagcccaaaaatatcacctttaaatttgcaagtttatatggtagattgttcaaagcacatctgatcacaacacaatcccgtgacatagaggttcttttccatgtatcatatgaggacgttaaggttcagaaaagagatggtgacttgtccagggtttgacggcaaattagtgatagacccttttcacaagtgcctagtgcaaggccaacatttagtagatgttcaataattttttttttttttttttttttttttttttttgagacaaggcctcgctgtgtcacccaggctatagtgcaatggcacagtcatggctcactgcaggtccaaccttctgggctcaagcagtcctcccacctcagcctcccaagtaactgggactataaacatgtaccaccatgcccggctaatttttaattgtttttagagacaggctcccactatattgcccagactggtcttgaactcctgagctcaagcagtcctcctgctttggcctcccaaagtattaggattacaggcgtgagccaccatgcctagccaagaaatatttattaattgaaaattttagtacattctcagggattaacttatggtctcctaactctttgcccagtattctttccattaagatagcttgg

SEQ ID NO: 100530 - DNA, 1075 bp, Homo sapiens
ctggcctttgctgctgtccttatacatactacccactacagaaagcccagattcagtagtctctgggctgcagactcaagcttttgttgcctttgctccctgtagtatactgaacaatgatgccagtgacccccagcttctcactctgccttctcctttattttctttctcatcagtgtcttacatctccttctattctgctgatggatgaggaatttgagctcatctcacaaacatcagctacacggttcactgttaaggagttgttgtatcatgtaccttgggaaaccatttactgaaaaacgcccacctaggattctttcacctgttcactagcagaaatttcactggttgctagtatagtgctggaggctgggattgcaaagattaataaaatagtctctgccttcaaggagttcagaatttaatggagggagacagatgtgtaaatacaaaagtgcagcagatgttgcagtagaggtcagcagagagtatctgggtccagaggagtgagtggctggatctgcctacggggtgggatacaaaagctttcccgaagagttttctacagggacgtcacatcagtgggtttgtactcagaaaactcctggccccagccaccactgccagatcagaaattggttgcaggctgggcatggtggctcaagcctgtaatcccagcacttcgggaggctgaggcaggtggatcacttgaggtcaggcgttcgagaccagcctgaccaatgtggtgaaactttgtctctactaaaaatacaaaaattagccaggcgtgatggtgtatgcctggcatcccagctacttggggggctgaggcacaagaatcgcttgaacctgggaggtggaggttgcagtgagctgaggtcacactccagcctgggtgacagaatgagactgtctcaaaaaaaaaaaaaagaaagaaagaaagaaattggttccagttgtactttattgatgaagcggtctccctcttaaccttactcaatgttgagtatgatattttgagctatctgttaaatgggggcaatagtaataccattttcatttagaaaattcc

SEQ ID NO: 100531 - DNA, 1077 bp, Homo sapiens
ccttgctattatattgattgttaaaataataaacttgttaatatctttgacatcattaaagtcactgttattaatgtagaaagtagcagtatgtcttattgcatatattacctccagttaatggatccatgggcactattggtgcttccatcacatgtctagcaatgtgcccaaaaatctctatgttgcttgaggagaggagactaatacatgagacaaaaagggtttggcacaagatgggatgctctgctcaggggttggattggtggttcagatgctcagaagctatagggacttacaagtgcctccttactgagcactgggctgcgtacaacatcagaacgggtgatggctcactcttcagtgtccacaaagccctttctgatctgatctcggctaggcactctagtatcatcggcatcatttcttgttacatcctagactctgggcaaaccacaatacatcatattattcattaaatgtgggatctctgtcaaacttctgtaactttccttatgctatttcctcttaaatgtactctcttacctgtgtgtgggttaacttcaactcatccttcaggacaagattggaacttactgttgactcttcttgtctgagtcgtctccctttctttctgtcccttaggtaattgacatgcctccaagttcctagttgctcctgtcatagacctcatcaagatgaaacataggttctggttttcttgaggttttcaccactgactggactataaattcttccaggggggagattgtactttattaacctctgtagttttatacagtgtctggcagtaataggtgaacaataaatgattttttgataaatgagtaaatctttttagcatgttattcctctacctaggaacctacagtaacttcatggcactcaaaactttgtagactcaaaagctagtaaacacagtagactatacatcttcacatgtacatgaaaacagtaatgaggatttgattttccctactaattcacctctactctccctaccccaccacctgcccaatatggtaatacatggtgctgcgaggttgccatgaaagt

SEQ ID NO: 100532 - DNA, 1008 bp, Homo sapiens
ctatggcagccctgccaggcctgagtaatggccatagcctggagcagggttttccttgagctccatcggggtttccagtaattggaacatggcaccttccaacttgtaatggatggcaaaacaagaggggcatttgtcactgcctgacttccctgtgggaaagaggctcataagtcacagctgacaaaccctttgatgacttttaaacttcatttacagaacagaatagctataatcaaccaacagcaagcagtgactaatcttgccacattatcagtgtgaggagccaactcttaaggcataggaatggggcgggggccatccccaaagctcacagcaagtgctgattggctcttggacttgagagtatgccttcagctaggccctgtgagtttatgctcaaaggatcagtgttaggaggtagaggaagaaactgacctccaggcagatacagggcatgcccagttttgaagccattctgggccaagattatgagaccagctctggtctcgcacatattcatcctacctctgtcatttcctggcttgagcaagaccagacaccaagctttggtttcatcgtatgtgaaatggtcacaacatgtatcatcactatctcatagcagaaggcttagtgcagttcctgggatgtaagtactccacaagtattgatgatggttatcatgatcacatgtttgggcctggagtaccttttgtggtcacatggtttaaaacctaggtcatatggcatgtcagcaaagccaagaccattcttcctgtggatgggggctcagtgggagcaatctagtggaatgggaataacacaggctttagaatcagacaagcccttgggtctttcggtccaaagcatgcaacttaatgtgactgtagacaaattaagctgtttctgagtctcagttgtatctgtagagtgcagatgatactacatatctcattagattgtgatcaggattacaagagattatgcctgtaaagctttcaactcagt

SEQ ID NO: 100533 - DNA, 1033 bp, Homo sapiens
ggcatcaacctgtaccaatgagcagaagactgggccgggaactgccaaggcttaacttgaggcttttcctactgaaattgagcttctctcctttcccctttcctcttggagcctatgcccagccgtaaactgtacgggaaaaatttgtacagccctttggggtaaaagacctggccagaatatagagagcaaagggtaggtgcagtctcatctctaagccaaacagaacaaaatttgaacgagttagtattaatatgggtaactaaaaaataaatttattaaaaataattctcaggtgaatgtgctgactttctgtggtatctaaattggctttagctctgggaagcaaaatgataaagttgaaagaaatagactttagtgacagactgacctgtgttcgaatgctcattactagtaagttaatgaacttgtcaatcagtttctggtaaaatatgagtaatcatgacattaacttgtgggatcttgggattattcagtattgtataccacccttagccacagcgagtgcctggtgaggctttgtgttagtccattcttgcactgttataaagaaatacctgagactgggtaatttataatgaaaagtttaattggttcacagttctgcaggccgtacaggcttctgcttcttgggaggcctcaggaaatttacaatcatagtggaaggcgacggggaagtagacacgtcttcatatggccagggcaggaggaaaagagacagtgggaggtgctacacacgtctaaacaccagatctcacgagcagtcactcactatcatgagagcagcaccaagggggaaatgcatgatttcagtcaccatgatccagtcacctcccaccaggccccacctccagcactggggattacaattagacatgagatttgggcggggacacaaattcaaaccattatcgggcttagctagcatacccttttcaaaatggttggtagcaattcagacaggtctgtgtctggatcagactaagcagttttcttttcttttctttttttt

SEQ ID NO: 100534 - DNA, 3162 bp, Homo sapiens
tttttagtagagacggggtttcgccatgttggccaggctggtttcgaactcctgaccttaggtgatgcacccgtctcggcctccaaagtgctgggattacagttgtgagccaccatgcccggcccctgcaattttcatcatatggtggtggtctagagtaaacatcacttgcaaataccatgtgaccatggttctacattgaagatcttcaaatttagatcctgaatgggataacatttgagatgagcattaaaggagtagactcaaaagaattagagtcaagcagatcagggggtcagatcccagccctgccattcactaacattgtggtctctctgaatgtgagatttctcccttgtaaaatgttgtggttctgcatatcatgtgagtaacaaatgagggaatgtatgtaaagcacctggcatgaggtcagcagccaatatgtggcaactcttggtaatatgacaagaaaacaagatgcaggaacaggtaggctggatgctataagggttaaggaaggtaagaggcaattcatttatccaggatatgggccgtgggcagtccttgagcccagcccagggacccagcttcaccgaggctctttttcttcaggtgggcaccatgtccttgaagcttcaggcaagcaatgtaaccaacaagaatgaccccaagtccatcaactctcgagtcttcattggaaacctcaacacagctctggtgaagaaatcagatgtggagaccatcttctctaagtatggccgtgtggccggctgttctgtgcacaagggctatgcctttgttcagtactccaatgagcgccatgcccgggcagctgtgctgggagagaatgggcgggtgctggccgggcagaccctgggtaagcctctcttcactatattctcctagtattctctagaatagctgctatcactatccagttctcaacccccttctctctttctctcaccgctaccactgctctgagattttataaatttataagctatgtttaagttttaaatagttataaaattaatccctatagggaagaattttagaagcctctggaaaacacttctgacctgtctctgctttctcagagcttcttagtgacaggctttacagttccagttaaaatgcagattctccagagaaagagaacagagtggcctagaacagcctgttacaccgggtacagatgacttaggttagaaccctttctgagagcgagcaggagggcctgagagcacaaggacagtgtgaatacgcttggttttggtgtcatgtccatgtgatatgactatgctagtggtctctcttgaagtatgtacagtgttcatgcatgtgcatttactcctgtgtatatgtgtatgtttgaaaaggggtatctgtatgtgttttttcctgaacaagaagtatatggattgactgaacatgtggagatatgtggacacaacccttgtatgtatagatgtagtgtgtgtgtgtgtgtgtgtgtgtgtgtgtgagagagagaacatatttgaatgtgtcagcagatatacatatattcatttaccaggtatttattgagaccttttcatgtagtaaggactattctaggcatgaaggtgtttggtagaacatccatgtgaatgtgcattggctcatttgcatgtgggtagttgtctatactgagtgtacttgagaatacacgttacctgtgtgtgagtttcttacctggatatgtgaatgtatgtgtgagtgtggctctgtgtatgcgttcccatgtacctgatgtgttacgcatttacatgagtgtatttgagaatgcatataggaatattcgacgtgtgtgtgtggtggggcgggggggaggacatgtttatgagcatgcctggatggatctgaaagtgtatggacatataaacaggcatatccatgtgatacctggatatgaatctaatgtttgaagattagatgtatgaagacctttgttggcaccatcagtgagcagaatccatgtgtataccgtgtaagcacatgaattgctgtgcgtgtgcatgaggttgatgtgtgtgggcacactgtcatgttagcattccaactctgccttctccctccacacagacatcaacatggctggagagcctaagcctgacagacccaaggggctaaagagagcagcatctgccatatacaggtggggctgtctgactgtctgtctgtctggtgggatgactctctctttccacagagggagtaaatgctggtgtgacagtgtgctgaatctagaacttggggaggtgtctggagatgagggcctgtggaaagtgggctgagtggccgtccctaagctccagccctctcccctttgtttccccagtggctacatctttgactatgattactaccgggacgacttctacgacaggtgagcaggggaggggcgtgcccaggcatgaaacagccaagctggaagggtcttgagagattgttggtgcagcccactgagttctccaaatgagaaccaaaacccagaggtttgcctggggttgctccaccagtcggtagcagagctgagactggggtcctgtgctgcaggtgctcaggccagagctcctaccaccatacaacactgtctgccatgctaactgccctttttccttcttgtccttgggtgaggctcaaggagaccgtacagccaagagctatgtaagtgtggctagttggaatacacaacagggtacagcgctggttgcagggagtttgagcccttccctctgtgaggtgcccaagcagctggtaggagccccagagctcagtctaagcttcttgggtttatatttagagacaagaggccagcagccatttggaagtctaattagtccctggcgggctgtggtctaccctgcactcccaagccctacccagactccagcccagaggctgtgggctcccactacaacagcactagccacattcttgagtagaaatcatggtagatactaactcaaatctctcctcctccctgcttctctccctctgtccagcttagcccaccccaggcagcccaagaagaacagtgcctctctgagcatgagtcgtccgcccccatccccaccccgcccctgtgagtcgtttcaggagacagtgtggtgtagtggaaagtgtcttagcctg

SEQ ID NO: 100535 - DNA, 1214 bp, Homo sapiens
gctagtgtcaagcctccagccccctaggtgacagccctgtcccccctccactcccagtaaagagcagtgagctgcaggccatcaagacggagctgacacagatcaagtccaatatcgatgccctgctgagccgcttggagcagatcgctgcggagcaaaaggccaatccaggtcagcctctgaggattctcacccacctccatgaccagggcacagggcagagcatggggaaatagtacatgggagagaggagctagggtggccctgcagatcctggaccacctgcactcaccatgctgaggccagcttccgctaaggtgctgccctagacagctaccccaggctgagttttattctcccctcctccaccccttcccctcaagatggcaagaagaagggtgatggaggtggcgccggcggcggcggcggtggtggtggcagcggtggcggtggcagtggtggtggcggtggcggtggcagcagccggccaccagccccccaagagaacacaacttctgaggcaggcctgccccagggggaagcacggacccgagacgacggcgatgaggaagggctcctgacacacagcgaggaagagctggtgagggcctggccaggggcacgactgggactcgactgtgctcctactctcaggaggccaacaggggaatgggcagcctgagctggttgcccccactgtgaacttcctgttctctccttcccaggggttctggtcctgggggaaagagggaagaatgagcagggggcacttgcctatctcagacaccatcagaagtcccactgaggcctagggcagacctcccccaaatgcgggcacattctggcctccggtttccacatgagttggagaatgggagattcggacataagggagcacacacggcctgcagagcttcagagcagggctggggtggcttgtggaggccacagccaggaggtgggtttttctaaaagccattgctgcttaagcatgaagcaaaagctgtctcataagggggtgagctccccgcctgttactagaactattcaggctgaggccggcaggccatttgacaaggagcttatgttgagtgggagggtggaccaaactctgagtctgtgggatatgggttgtacacttgctgctcatttacttaatgagcgctcattgagcaccaagacccagatcatactctctaacttcacataacctt

SEQ ID NO: 100536 - DNA, 2905 bp, Homo sapiens
ttttgaggctgggtgtggtggcctacacctgtaatcccagcagtttgggaggccatagtgggaggatcacttgagtccagtagtttgagaccagcctgggcaacatagggagacccctccatctctaccaaaaaaaaaaaattagcagggcacagtggggagtgcctgtagtcctagctacttgctaggcttaggtgggaggattgcttgagcctgggagattgaaggtgcagtgagccatgatcacgccactgcactccagtctgggcgacagagtgtgagaccctgtctcataaataaataaattttgggaaaccaagtagtatagcaccagtcctagagtttatcctatgctactgaatatattttaagttcattaagtttaaaggtgctggaatttggttcctttaggaaaaaacaataataatggagatatttttgttttctttcatagtggttctatagatggtaataaccaacttgtaatcaaaggaagattccaacagaaacagatagaaaatgtcttgagaagatatatcagtaagtgtataattcatttcattagatcaccctgaaatgttctcatgaggctgcagtgttagaggaagagccatttgattgcagtgagctgggaaaagctggccttaaaaagatcagagacaaaatgatagtgaaagggaggtggctcttgcctactaactaggggtatagatagaaaaggatttggatttttaaagaaagcccagctgattgaagctgctggttgattgtagggctgaaggccaagtcagagaaacttgcctgtgattcaggcctggccttggcccccttttgttcctagttatttaaaattggcatgtctgtcaacatgtttgagtggctctcctctagacagaaacgagaataagcaagctggcaggcttccttgcatcctggggcattgagtatcagcccatgtttagtgccggaagcgccacagcagacagcttgtgttttcttacccctcgaatagctgcgcttccctggtctgggtgcccagctaaattctcagcctgggcttgtggagttctttgtagatgtatttaagaaggcagaaacttctctacctcactgcagccaccaggtaattctgtgtgttgctttatttgcagaggaatatgtcacttgtcacacatgccgatcaccggacacaatcctgcagaaggacacacgactctatttcctacagtgcgaaacttgtcattctagatgttctgttgccagtatcaaaaccggcttccaggctgtcacgggcaagcgagcacagctccgtgccaaagctaactaatttgctaatcactgattttgcaaagcttgttgtggagatgtggctggacaggtttgccatcagagtggatataccgttgtattaaaaacaagataaaaaagctgccaagatttttggcgagtggttggtctgaagtccttgcaagacgctgatgctcaagctgttgacatactcattgcctactttaacacctgtcagagaaacgtgatatggggtaaggaggtgcttttttaaaatcgttcatagacttctgtaaaatgcaagataaattaaagttattataacagtgattctttcaatttggtttgtccttcagttttcttttctataaatgtgcttggtgaaatcagcaagaaaccaaccatataaaacagtgtgtgccgggctctgactgagaaactgaacaatggcaggcgcttcatctgggcagccatttttcttctctgcttctcttgagatacatagttaaagtagacacggcctcccacgcgagtgtggtgggaccttgagacttaggaggattgcctgttttcagtgtccagggaatgactccatagatttgaattcttttccgtatgtggggatggttgctactacctcaccgccaagtcctcccccagctgttaccacatgagggaatacaaggtgctaggtaccctccttcctcgttggccactaagaggtcttagaaacatagcctgtaaatgtgtcttgtaactggcacactaaaaaagatcctagttgagcatctctcttggtgaggaagcgatgtgtgtgcggttcaggaaactcctccaagaggaggaggagtccaaacagggatgccagaggaagctttccgttttcctagccaacttgtgttctgggtttgaaaaagacccaccacaaatgctttttctattttctgatttaaaagtcgcttttgaatatgaccatgagaaaccaagaaatgctgcttgtgtggtgctctgcttcctgaggatttggctggaaggggattctccgctggcacatgggagaaggccatcttctgtgtcggtgctgtgatctgccttgttctcacttgctgaggataagggcatacacgctgctcctcgctttcttgttgcccgacttcgtactaagcagctcaggagcagtcactcagacccaaatgtcttgactgtgttgtttttaatcactgtgacccttaaagtacaggccaagtgttgtcaaacaccttggctaaaacagtggagggtgatgggtaaagcagtagagggccctcaacccacacactggctgaaactgccaccaactgccacgatgaacccaactgctgtttatgcccccattttcctttttttgtatctacacccacacgattcccaatgttggatatttctacatgaataaagcaaggatcagtgcctcttatgtaattaacgctccattgcttttgtgtatgtatgtgtgtttgggttattctttacttagcgggaccctttaggagaaggaatgatactcttcagtttggtgacaggttgacaaatagactggtgatttcaacccgtttttaacttcattcttgaagcagat

SEQ ID NO: 100537 - DNA, 1860 bp, Homo sapiens
ttttcttaaagtcagacttttttttcctaaattggtaacaggctgttgaagaaatacagctagtaagttgatgagtggcactggagaaaccattgaaaccaggatctgtgatgaaataggtacttacctgtcttcagggctcaccttttgaaggcactgagcaagtcattcccattcaggaaggccaagatctcatggaccccatgccaatgagtttgactactatctggaagcctaatgtccctttaaaaataagtaatgtagagtaggtcatgataatgatgactaatgcatattgagcacctcttttgtgccaagtgcttttttgggtgccatctcaattaatcttcacaatagttctatgaagtagaaagtaatattcctatcttcacgttcggaaacaggttcagtaaagtgaagttgtagttggtcacatagctagttagtggcacagtcaagatagatacaatcaggtctatctgtccctgcagcttgatcacctaacaggcttgacacctgtgcgtcactggcagtacagagataattaaggtgttctcttcctactctctttaaactgttgggatttgctacacttggtgtggggttaaggggtaatttacttgaccgtggtggatacgtaggctctgttgtagaagaattgtgggttttgttgttttgttttgtttttttgagatggagtctcgctctgtcacccaggctggagtgcagtggcacagtctcggctcactgcaagcctgcttcccgggttcatgccattctcctgcctcagcctcctgagtagctgggactacaggcgcccgccaccacgcccagctaattttttgtatttttagtagacgaggtttcaccgtgttagccaggatggtctcgatttcctgaccttgtgatccgcctgccttggtctcccaaagtgctgggattacaggcgtgagccaccgcacccagcatgttttaaatataaatttgttaccatcgttatttgtaacttgcacaaactaatgagggagcaaaagctagcattgttttttctattgttagaataatctagaggttttgttagaggtgggataaactattataacaagttgtggccagtaaacttatggtcaatgggttaaatgggttttcgagaaaattccatttattttgacagtgaatgaaaaagaatttctacatcaagcattgcaatcactgtagcctggagattaagggttacaatctgtggaggaggaaatttaaccctgcttgactgaattttgttgtttcactttatgatttataattttgaatgaatgataatatctagcctagagctttgctttctcaaaagtgcctgtcaacagtttcctatcagtttatcattaagtaccattgacagtttgtggcttgtgattcaactatcctttttttttcttcaaacagctttattgagataacagcttacaaatttaaagtgtataatccaggagagtcccactcggacgtccgtctctctcgcaagacagagctattctttctcttttgcctattaaacctccacccttggaccccccccccccaaaaaaataaatatatataaataatatatacaatccaatggggtttttttttttttttgagatggagttgtgctctgtcgcccaggctggagtgcagtggcgtggatcttggctcactgcaacctctgcctcccaggttcaagcaattctcctgtctcagcctccccagtagctgggactataggcgcccaccaccacgcctggctaatttttttgtatttgtagtagagacggggttccaccatattggtcaggctggtctcgaacacctgacctcagg

SEQ ID NO: 100538 - DNA, 5307 bp, Homo sapiens
ccctcagcttcctgaatagctgggtttacaggcacccgccaccacgctgggctatttttgtatttttggtagagaggggtttcaccatgttggccaggctggtctcaaactcttgaccttaggtgatccgcctgccttggcctcccaaagtgctgggatgacaggtgtgagccactgcgcctggctggcagattggtcttgatagccacatgtggcactaagactacacaactggatttgggatcccgaatctgagctttatttactcccagctattccaacttttctgctggtaagatttctgaaatgactgtagccattgtcccaggtcaggatgtaggcacacacaaaatagatattaatgaatgagtaaggttgacagcacagttcaggatagggagctggataagctggtagaaggaaggagaaatcagaaagctggaaactgagactggccttttctgctcttctgggatgtttatgactcatttctaggttttaatatgccctgtttacatccatgcctctggcaactaatcttggggtcaagctttactttgtttccattccattccatcacttgatcctaattccccatggcttctgcctttccctctttgataatgtcatctattggagtgatgcccaaagaccacgccacagactggtgccaggctgactgtcatataataaaaaataaatatttgttctttacgttcttggctcacaactgctaaaatccttggaatctccgaagtgataacagggtctttggtacgctaatgagatttctgaaatgactgtagccattgtcccagttcaggatgtaggcacacacaaaatagatactaattaatgagtaagggatcccttatctggggatctctagatagctttaggatgggggctggtcaccagaaggacaaagctatgattttagagggttggaactttcagtggtccccctgccacctccagagagggaaggtgtggagattgagctcagtcaccagtggttaataatgtaatcagttggccaggtgcagtggctcacacctataatcccagcactttgggaggcccgggccggtggatcacctgaggtcaggagtttgagaccagcctggccaatatggtaaaaccccgtttctaccaaaaatacaaaaattagctaggtgtggtggcgtgcgcctctagtcccagctactcaggaggctgaggtagaagaaccacttgaacccgagaggcggaggttgcagtgagccgagatcatgccactgcactccagcctgagttacagagtgatactcagtctcaaaataataataataagaagtaaataatgtaatcaattggtcatacctttgtaatgaaacccctagacatgggttcggagagctaacatgctggtgagcacagcaaggtgctaggagggtgatgtccctggtgtggcagctccacgcctgccctccttgccacccctcagctcccacccccataacttgtcctatgcattgcttatgtttggctgtttgtgagttgtatcctttataataaattggcagtagtaagtactttcctgagttctatgagtcgttttggcaaattattgactcttgatggcgaatgtgggaacttccgagtttatagccatgttggacagaagcaggcagcatgggaacccaatacgtggtgactggcatctgaagtgaaggcagtcttgaggaactgagcccttaaacctgtgaaatctgatgataactctggatagtgtgtgtctgaaataaactggaggacacctaactggcattggagggttggtgtggaaaaacacatatttggtgtcacccggaaaaatctttcccaatgactatatcaaaatcacttagaaacttctttaaagtactcctgaaccctgttcctgctgaagatcatcaatccgatttaaacttttaaattttctcaagtgattcttttttttttttttctttgagacagagtttccctcttgttgcccaggctggagtgcggtggcacgatctcaactcactgcaacctctgcttcctgggttcaagcgattcctctcaagtagctgggattacaggtgcctgccaccacatccagctaatttttgtatctttagtaggtgtggggttttaccatgttggccaggctggtcttgaactcctgacctcagggatccacctgcctcgacgtcccaaagtgctgggattacaggtgtgagccaagacgcctggcctctgccgtgattctgacagtagcctggtttggaaataaggacaataattataagatcctaaggctgaagaataaagagatgaatgagggggaaagatcccacaagtgtcttgaagaattcacagttcaaatggcagagtctctgtgagccagtttggtccatttctgacaggcgtttcttatctgtaacttcaattttgaatatgtgatttttttccctgccaaaataatgtcagcccacgtcatttttaaaaaagaacaggctgggtgtggtggctcatgcctgtaatcccagcattttgggaggccagggcgggaggatctcttgaggccaggagtttgagactagcctgagcaacaaagcaagacctcctcatctcaacagaaaatgtaataaaataaataaaaaagaatagtcccagtatcaaatgttcagactcatctcactttcttaggatcttaagattgaaagtgatgttcaagaaccaactgaaccagaggatgaccttgacattatgcttggcaataaaaagaagaaaaagaagaatgttaagttcccagatgaggatgaaatactagagaaagatgaaggtaatgctgaggactcagcagcacatttagaggttactcaagcctttggccctggtctccttgatgggggtggagggtgcttttaaaatttttttcttgccccttatttctactgactgataatggaagcgaaaggaaacagtgtttggcttgataatggcagttaaagaatttgttaactgtgattacattaaaaacatactgattcaggcttgggaaaattactataaccggattttttttttttttttgagacggagtctcactcttgtcgcccaggctgaagtgcaatgacacgatcttggctcaccacaatctctgcctaccgggttcaagcgattctcccgcctcagcctcccgagtagctgggattacaggcattcgccaccactctcggctaattttgtatttttagtagagatgggagtttctccatgttggtcaggcaggtctcgaactcccaacctcaggtgatccgtccgcctcggcctcccaaagtgctgggattacaggtgtgagccacagcgcccggccccgattttttaattaaaaaaattttttaaactcgtgtttacagttttattagtttctaaatgctatagggtctttagagaacttttgtcagtagatgagttttatggatgttgatgtttcttaagtgctcaaaacagttggactttttcctctaattattccaatgcattattttatctttgatttgttaaattaagaaacatttcagtatgttatcaactcctaattagagaggtctctattaagggccttttttgaaagtcataacatccctgtttctaaggaaaagggttgtgagctttggtttctttatgcttaaggctgttgtgaatgcagctgtggaagggaagacagatgtctttgaaactcttcatttctctagacccaccccacttttgtattgtagtagggcccacccctcattcttaaaatcttttttatctgtagctctagaagatgaagacaacaaaaaagatgatggtatctcattcagtaatcagacaggccctgcttgggcaggctcagaaagagactacacatacgaggaggtaagacaaaatctgttgtgaaaaggggctaagctattcactagtgctcaaagaagagcaagataaatcttattggaacggccgttgaagtaatgactgatggtggaacagatgcagagaggtcacacagccagtgcacagcaattcctggtgcgcacccgtggggcagcctgcccagagtgcagcagtcattgtagtactactcactgtccccacctgaatttgtggactgctgagggcatgcagccctctaggaattaggagggcagtggtgaattagctaatttagggccagggtagtctggagtttgctagtttgggctttcctgaatcttacttttccatgtatcatgtactttgccatagaaacaacagaatgagtggttgttcattcatttcactttggacaaggagttgctgagcatctataatgaaccaaatgctggttggggatgaacctctgccctcaaggagctcccagacttgtagtaatgcatgtgtatatttaatcagaagtgaagtatttgctgttaagcaacatgactcaaaggggaactttatacccctgcagttactaagcgtattcatgaataccactttatttttatagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactgtaagttggttaatggagtaccttcatcccaaatgccagattctcattgcagttttaagaatgttaaatgtccttattgtcgactttattatagatggaaagaacacacaggtgtaggggttgagggagttcaccgttcaagcctgtcattttcttcaattcataagtctcagggctgttttattttattaaagataacggtcttgctttgtcgcccaggctggaatgcagtggagtggtcatggctcactgcagcctcaatctcctgggcttcagcagttctcctgcttcagcctcctaagtagctgagactacaggtgcacaccaccatgcccgaccaatttaaaaaaatttttttttttttttgtagaaacgtgggtcttgctgtgttgcccaggagggcttgttttattagtgcattcagaggtgagagaaatcaactcatgctgacccactgaggatggatcctaactagatgtagtgaagagtgaggaggctcaatgtagttctcaggagccttgggagcccagggagtggaaaggctcatcagttgctctaggataggcctgccaagcaagcagtgagctcagggaaagtgcctgaatttgggtgcct

SEQ ID NO: 100539 - DNA, 1805 bp, Homo sapiens
agatttaaagttggagagttggaaattgtgttagagctctgactttgtcttgggaacagtgaagagtgatatggtcagattactaaataaatattctcaacatggtcccctaaccagatttttcctatagatctttgagatgacctaccattttgtttttcagaaccataacttttgtggccgggcgcggtggctcacgcctgtaatcccagcactttgggaggctgaggcaggcggatcatgaagtcaggagagcgagaccatcctggctaacgtggtgaaaccctgtctctacttaaaaaaatacaaaaaatttgctgggcatggtggcacatgcatgtagtcctagctactcaggaggctgaggcaggagaaccgcttgaacccaggaggcagaggttgcagtgagctgagattgcgccactgccctccagccttggcgacagagcaagactccatctcaaaaaaaaaaaaaagaaccataagttttgtgattgtggagggactaattaatagtcagtcttttctggtgacttgattaattgctgaactatgtttgtgtaactcataatttgatgctttgccttttagttgttaataattatgccttggtctttttagatgcttctgatgatctagatgacttgaacttctttaatcaaaagaaaaagaagaaaaaaactaaaaagatatttgatattgatgaagctgaagaaggtgtaaaggtagtattgctttcttgttgaaggtaaaatttgacctcttgcaaggttgctaatggctgatgtttccctctctttgactcatctcttactagctttgcttttgttattagcacttaattgccactggtagcgtcattttcttgggagtgtgtctgactaggtatcttaaagggattgtggttcaaggaatttaaatttaggtcttacatattgtattgtgtgccattaagatgatcacaaatgtcccttgtccttaactatactgagatttttggctgtggagaactatttctatgagtgagaaatccttctgagcaaatattcctttggtttcttaaacttttggtaacatattgaatatatacaaattgatatgtgtacctctaagcagcaaagaatgaaccacagtggtggttggtagctgatgacaatgtggcctgtaggcaaaccagagcactcaggctagttttatggagttctctgatcttgtggatacttgagaccctgtgagtcttattactgaattgatttctaatacaaatatctcaaaattcttttggacagggagtaagtaacaggtgggcaggaaggtgaataggagggagggtaggtggatggatgaaaggggaaggagctgaagatctgttttcctccctagagttaccattttaaagaccctgcctaggaatcactttagcagaatccacatgtctatttataaaacccaagataatagcagtacacacactcactcacatagagcgcgcacacacacaacagcaaacatacaccaaatatcttgtgccctctactcaaaattttctttgataagtagtttatttgctcaaactcaagtgaataaagtacatcccacatgtagcaggaaatgtatacagtaattcattgggttttagaaataatgtcataattttatgacagttaattcagtaaataagtatgagtgattacagcaagtcaagcttttgaagtattgtgtggtaattgctagagtactgaaatgagtaagatatttttcctgtttgcagagatattttggttcaaggataatttagaatcctt

SEQ ID NO: 100540 - DNA, 1102 bp, Homo sapiens
ctccatcctgggcaacagtgagaccctgtttcaaagaaaaaacaatacaaaaaaatttacaccccgcttaggtattgttttcctatatctgtaaagtgaggggcatagcataggttgttgccaaagtcccttccctaaattccatgattcattcaaatgtccaaatttgctcatgaaagtgaaagtgaagtatctgtgatactttacaaattgaaagatgtgtacatgtttcagttcacctgatgtttaatagtaacaagaaggttgggtggacaatttattttattttttggtaaactcccctttggtgttttaatgtatcacatactcttttaagagtatgccttttgaggataaagcatatttggaatgtgagcatcattaaaaacaatcatttggtccctttttgttttttgtcttttaaacagatgatttttgatcctactatgagcaagaagaaaaagaagaagaagaagccttttatgttagatgaggaaggggatacccaaacagaggaaacccagccttcagaaacaaaagaagtggagccagagccaactgaggacaaggatttggaagctgatgaagaggacactaggaaaaaaggtgcgtggttgatgtgagagagttactgttgtcatagaagccctggttctatgagcgttttggcttttggatatgcagcgacctctcagcctgacaaggctgttccagtgaagtcaaggccatcagtagtctgtatgcagtggacctttttagatttctgataggcttgttgcagggatgtttccatttaattcacaagttgcaaagatgaaaccttgctgttccagagctggttttccagttgaacccatcaggtctcttctctgactttttaatggtagttgtatttgagtgtgggcagaaagaaatggtactaagataggcagttttgtgtcttagcaagtctgaaaatgtatatgagagattaaaattatagcctaaagtatttggggttagacaccagctttagttacttacccctgtgctgtaacatagacataatttgactgttagagagaaatgtttctataaacattgtatgtgtctgttgaatata

SEQ ID NO: 100541 - DNA, 2556 bp, Homo sapiens
tcctatcacacagagatggcaacacttagcatttgttctggtcacctttggaaggaacttttagatcaatgtcttgcttctctgtgggttcttttgtgactcacacctgcttctgggtatagtatgactataaagttgatttcttgggtaaggtatgatctatgagaggaagcttctaatttgatgagcatcagggtaattttagctggtataccttttctttgccctctccaatcaaacgtgagaagttgaaaatagaaaatttatgcttttgaaggctttgttgtgaacctaaaatataactcaagtgatctgtagttttccatatgtgcactgtcaacagctatttgcttttcaaatccaaactagtttcataaaagaaaaccaatttggagtgtagtcagcttataatttggaagctagacatgaaagtcttaaaaagccattttagtcaagactaacatggcctcatttttggggaggtctgctttgggtgctgcttcgggatccctggtccttatttgtaaactgtacttcgcaggatggtatgaataaaataaggcaatgagtatgtatgttaagtatccagacagtaattgagagagatgttaattatttcagtttatgattcctggatgtttattatcctttacaaggctacaaccaaactgtttagctgtagaccataaggtttttcaggggataagaaggcacttgtgaggctgtcttctggtgatatcaggatccttgccatcttcagtctgtcttgatgaataatggttaaaaggcaattaatattctagggaacttgatgcttgaaaaaatgcaataaatggatggtaatcccttccagaaccaaatttatagtgtctagagttttgtctgtccttttgccaagtctccctatttctagaatgaagatgaaatgtagctacttccctgtattattgcagtactccttgcagtgggggactctttcctctttgctcttctatcttggtagggacacttctttaagttggccagataatgttcttcagactgactgcatttcagatttaattatttatacagttggatccttgttaagggagaaaagactaactttgaaaatgctatgcaaataccatacttctctactgggcaaggacagtaactgtattaccttattacagactgtagcttggtttcagtctagttccattaatgatcttgggacataaataagtttatgttataatcaattttgggaagcttttgagagttttatatgtttgggaaattagagcacctgaattgatgaaatttcagtgataggaatcaagagaaaaccatgctttatgaatggtaaagtattatataaattacaattgctaatatttatcgagtacttacgtaccaggcactatggcaagtgttttacatttacatacttctttaaccctcccagtaaccttgtgtggtttgttgtcattctgctacttgtctccattttacacatgagccgtggaataacacaggtacaagccagagtcagaatttaaatctagtcagatgggctccagacttgtgcttttaaacactttactattaacgctgtccacagcagatcactgggcaaaatgctgaatttaagcatggtattaatagaatatggagagagattggtaaggggttcaggaaaaaaatacttgggatttgaatcaggttctatttgacttcaaagaccctgcactttctttttttttttcgagaccgagtcttgctctgtcacccaggctggagggcagtggcacgatctcggctcactgcaagctccactgcccatgttcacaccattctcctgcctcagcctcccgagtagctaggactacaggcacccgccaccttctgctaattttttgtatttttagtagagacggggttttaccatgttagccaggatggtcttgatctcctgacctcatgatccgcccgcctcggcctcccaaagtactgggattacaggcgtgagccaccgcacccagcctcctgcgctttctactctatcaggtgtctgccctgtatgttgtttaaactattatgtctagataacttttctttcttcaagtgatcagtgcaagcagatagtctacaaattataaattagtttttcacctactctatagtggacatttagataagaataagagaattttggggcaaggcatggtcctcacacctgtaatcctaacactgggaggctgaagctggtggatcatttgagcccaggagttcaagaccagcttggggagcatggtgaaaccccatcaatactaaaaatacaaaaaatagctgggtgtggtggtgcactcctgtaattccagctactcaggaaattgaggtgggaggatggtgtgagtctgggaggtcaaggttggattcagctgagatcatgccactgcactccaacctgggcagcagagccagaccctgtttcatttaaaaaaaaaaaaaaaaaagaacctttaatgttaaacaaaaagcagagtgaaatgttgtatagaggtttctctt

SEQ ID NO: 100542 - DNA, 1350 bp, Homo sapiens
ggcgcctctagctccaactcagaatttctcaaacaccatgacgcccgggggtcatgtgggaaactaaagctccagcgggttcatatgactcagtgtctaacccactaccctaacccaggaggaagggaccccaattcactctacaagcagcgcaaaagaatgctccaaaaggctgaggcaatatcaacaaccgaatgttcttccggctgcagctcgctcagacgccgcgcacaggtcgctgggcggctacagcgcaagcgcaaccctcttataaatggactacaagtcccggcatgcctggcgacgcggcgtcgcctggtaactcgcgccacacgaagcgcgctaggttggctcttctgcgcgcctgcgccttggcgagctctgcgcaggcgcatttccaacgcttggaggagagggcggggtgtcgtttcctttcgctgatgcaagagcctagtgcggtggtgggagaggtatcggcaggggcagcgctgccgccggggcctggggctgacccgtctgacttcccgtccgtgccgagcccactcgagccgcagccatgtctggggacgaggtgaggatctgagcccggcgtaagggctaaggattgaggcgagaagcctaacccactccagtgtgggagaacgggcctgcggcctagcagccggccgccgccatgtgaggcagccgcgcctaggcggcccggagcggcagagccggcgaggactccggagccgcaggcttggccgcagcccgctttcctcagggcggcagcgctgaggcggacctcctgccgtggttggcgtttccggaatggagagcacacgttgagtcgtcctcccggaaggggctcgaatgcccggttaataaccccgaacgagactggggctggcgatccctgcattcctttctgctgggcactgccgccccagctcgcctcactgggtgccgggggtgccaggggtgccgcgaggagcctctcttggcttggtataacgccctcgttaaaactttctaggctatcttgtcggggccggtatcccgcccttgtttgccttcctagcattgttttttaaaaagacgagggggtgatggggttagaacgagagaaaaagattctgcagcctcaggaagtgactgaccttcccggaaagtttccgggcgagcccctgagcttcccttaacagagggctaccggcgacgtgagcgggaagtgcgggctgtgaaactggctggatctttttttaccgtggtacttggatctcagtgaatttcctcaaatccctttccctcagatttatcctagttgatataacgtctaacgacttaaaatgaagttgatgttaagtactc

SEQ ID NO: 100543 - DNA, 1041 bp, Homo sapiens
tagaaaagtgtttgacctgatttgcagagcaaggggaaataactggagggcgttgagaagatttctctgagaagatacatgttagaaatggctgctgcatggaggatgggttgtggtagggagactgggaagaagcgacagggtcacggactagagcagcggcagtgagaatagagaagctgggagttgttcggaggcagagtcactaggcctggtggtggcttccctgtaggagggcgttggggactcctccctcacgcgggtctgggtgattggggggcctgtgggatcagtcacagagatgggaacccagaaagaggaatggctttagggggtaaagatgaggaatttgcatgagcacaggtgtggcatctctgaggcttgtcctgtcccctcttgtttaggcatccgaggcatctctgaggagaccacgactggggtccacaacctctacaagatgatggccaatgggatcctcaaggtgcctgccatcaatgtcaatgactccgtcaccaaggtgagccgaggggcagtgacagctcccgctacagtggctgcagctcaggacgaggcctctgaagaagagtgcccaggaaggctgagattagggacatgaagccctcatttgagggggcaaaagcggttatagacaggctaatgagtgcgtttaaaaggggtgtcagagctgggtgttaggagctttatggctttgggaagaagagctttcaagttaagcaaggtctttgaccgggcaatctctcctagtaactgatgcctaggaaggctccacactggcagagaaagattagagagaagctctttgagccgatcggggtgaagggcttgtgggggcattgggtgctggaggggttcagcccaggccgggatgcttggtgggcccatgatgcctgggctcttcagaatactctgaggccaagttgtcctggccccagggccttgcctgcccctattgtctccttaccccctttcctttcagagcaagtttgacaacctctatggctgccgggagtccctcataga

SEQ ID NO: 100544 - DNA, 1036 bp, Homo sapiens
gtcggtgagtcccaggacctgcagccggttgcggccgcccggcacccgcccggggcttgttcgtggcgggggctgcagggccgactcggggctctctggaccccctggaatcgcagcctcggcgcgtttctggccgcgcgaagccagctggaagttggagttctcgcgcggccatgagcgggccgttccgggtggccgtggactacaagtcccagcatgccccgcgacgccggggccgccgcgcggtctgcgagccgcaaactggcggcgtgctccgcgggagagcacacctggccacggcctgggacggctggcacctgccggaccctgctcggggggcctgcgcccggcctcctaggcctggaccggaccctgtccagctgggcggccccgacgagcgtccacccctctctgggcctcctacagggacggcgagggcaccccggagggtgtatgaggagaggcctggaaagcgagccccaggccggctccgatcctcctctcccctgggactttgggccagttacccaacctgtggggtcccccacccctccagcaggggcagccttgcagaaatctcgaagaaaatttggagtggtttgaaaaatcctgctgtcccaccgattgaagtgtaatacagggatagttaacgtttacttagtgtttcctgtgggatcggcactgccttctagctttattctagtctcatggctctatagggaaactgttctcattttatgatgagaatcctgaggcagaggtaacttgccctcagtcttacagctggtggtgatggagcaagattggaacgcaggccatctagatctctgagcgcaccctttcaccactgtgtgcaagcgaatacacgcggaacaatcctagtgaattttcagcaaaaaccagttcagtttggctggtagcttttcaagtaactttgacactattggaccgggtgtggtggctcacccctgtagtcccagcactttgagaggccgaggtgggcgaatcacttgaggtcaagagttcgagaccagcc

SEQ ID NO: 100545 - DNA, 1036 bp, Homo sapiens
aaaaaaaaagcctggaggtgctgggagccgctcgcgcccatctcacctggagctgaggaaaactgggatttaactgatttaccaccgcagccagctcttcaagccaggggcgggccggacggctggcgcgcaaggcctgctggggcttgtagtctagaccacttccgcgctcaggcgcctgcgctttagctgctaactcgctctagtagctgtggtcggggctcgggaccggctgccatcttagtctagggactgaggagtcgccgccgccccgagtcccggtaaacccccgtgggcgaactcggggcagttctcgggagagggagggagtccggatgagaatgttcggggagaacaagggtagaggagtgggacgcgcggttcgggaccccagagccgcggctgctccttcttccagagccggtgtctgtcgggggcgcggggagctcgggctactggcccgggccgggcggtgggggtgggctgtctggacgttcggagggatcagtgtctggcacaggcttccggaggccttcgcctcgcgggctccaagttgtgaaagggctgggccacgacgggcgtgggtaccgtccggcccctcgcccctcagccccgcctggggccactctccagcggttcggcctacgcgcggggcccggcggcggggccggcgcgggcgacgtggccctgtgaggggcggcggccgggtcccccgccacccagctggccttctcgagacttttccgagcccccagtcgctagaagggcccagcacagcggctgcctccccttctctctcccactcgcctcctccttccattgtccccccggcgtggtggtcccggctccggcgccctccccgacgtccgccaccgtcgtggcggcgccgacttttgcagacgtggagctgtcactgcccttcctccggagagtgcccttttctttagcagagaaaagaaaaaagtagccgttgaacgtattctaagggtcgaagcatgatgacatgacttttaagtggagaactcaagttttccaa

SEQ ID NO: 100546 - DNA, 1031 bp, Homo sapiens
cagaagtctagttgagaaatgacaaagcctgaccttggagagaggttgtggggatgatcaaaggattggatttagctttttactagtgcaatattgttgccatatttctagatgaggatttttttttagagctaatctgggtaaagggctccttttctgtcaaaagaacccattagcaagtctgaataatattgccaggttatatatgttatgtatagtatgagagtgaattgttcattagcatctttgagaaattagaaagaactatgtcaggtgtaatttggaagagaacttgaagtttgttattgttactatttttgagatggagtcttgctcggccatgcaggctggagtgcagtgatgtgatctcggctcactgcaacctccacctcccgggttcaagcgattcgtgtgcctcagcctcccaagtagctgcctcccaagtagctggaattagaggtgcatgccaccaagcctggctaatttagaacttggagtttggactgaaatttatgcctctaaaaagtattgatctaggcttgttgggagtgtttttctctcagcctgtagaaacttgctcattgagttttagagttgggagaagttacagagattatctagtccataatggcaaatatattttggtttattggccagctctaattggaagctgccagaagcactgtgtttggaaggattctggttgtaggtgctctgagaaattgtattatggttgatcaatgatgtctcctgtggacagttacctagtaggtagtagacatgtgccaaatatatgctattcttagataagtccaatctcttagttttctgttttgttgttgtttgtttgttttaaaggttaaataatttacctgaaactagttaagagtaagaactagaactagaactgggttttgcaactctgggactggtattctctggtttacaaagatcaatgtgcactactgaagagcttctggtattagactagaaaaagaaaagggagatttttagcctatgcgtcttgactg

SEQ ID NO: 100547 - DNA, 1017 bp, Homo sapiens
tcttgttgcctaagtctctgttttgggttttggacattggtttcctttataagaattaagacaaaagtatgtaaggtttttttttttgtatttatagtacttagccaaattctgggctcataataagcactcagtaaaggcatgttgacttttatggctgtaaatgatactggctttgagtcaatataaattagttagggggttcacagaattgaattgcagcattctctggttgggaggttggctttcagctaaaaacgttaagttggaaactatcctcacaactagaagcagttaaccagaagctgttcctgcctctatcctcctccagtctagcagtgtactgtccttgaaaaactgctgccagctcagcttttttgcttcttttcagaactgactatatccagatccttggtgtgcgttttcttttcctgtccctaggagtctccaagttgcagggactatcattatggtgacccttataggctggtgtatttatatggccatcctcattttgccagatagccgtcatactcagattggtgtcttcccataatacgtatgaatcattttccctcagttctttcttttgtcctgtctgctccattaaaaattgtctatcccatgaaatttttaaaagagactttgtgcttttagagtcgcaaggtcgttgcagatctgatgtgtttaactatagaggtcagctgggtgtggtggctcacgcctgtaatcccagcactttgggaggctgaggtgggtggatcacgaggtcaggagttcaagaccagcctgaccaatatggtgaaaccccatctctactaaaaatacgaaagttagccaggcgtgggggtgcacgcccgtagtgtagtcccagctactcaggaggctgaggcagaagaatcgcttgaacccaggaggcgaaggttggagtgagccaatatcatgccactgcactctagcctggcgacagagcaagactccatctcaaaaacaaacaaacaaaaaaatatagaagta

SEQ ID NO: 100548 - DNA, 1055 bp, Homo sapiens
tgatccgctcaccttggccttgcaaagtgctgggattacaggcatgaagcatcacctctggccagaaacaaggattccttagagccaggaaattcaacattatatataattagatgtataatttcacacaagcattgtttgcaagagaacaatacttatagtagtacaacaatatttatatttattgtggcaaatgctttaaactctagcagtagtcaaagctagaaacaacttgtaataatagttaattttgaaatgtttgtcagaaagctgtttgtcagaaaggggaagagatcaccttctggaatattaggtacagagttcaaaccagcaaatgaatgctaaaagttagatcctggtgccaatttccttaaattctgtgttcatactgttgaacctcgaaagttgtagcttcctctttttctctttgaacagtataattgtccttttttgcatatgctttagaatccatactgatgtatttggttggaaagtgggaaaggagcttttagtgttctgagatcattgtgtgatgttcagaaccaaagtgtcactgttacatggtagagaatggttcatattctacctccttgttaagtcaattaagtcaatttttcctagtaaatgggaaagcaaccgccttccctatcatgaggggttttgggtttcttcccacttgctttgctgagaaattaaattatggaaatgggtatttaccctctgctccaatctaaataaacttttattccttctaccaataccttcagtagcccatgcaccaaagtcggctcctttgtttttttttttgttttgttttgtttttttgaggcagagtcttgatctctcgtccaggctgtagtgcagtggtgtgatctcagctcatggcagtctctgcctcctgggatcaagcaattctcagcttccaagtagctgggatcacaggtgcctgccaccacacctggctaaggtcctttgtgattattagcagagaatgggatctaaaaatgttcctgtgttccttctagctagtctttgctactgtgcccctagataat

SEQ ID NO: 100549 - DNA, 1028 bp, Homo sapiens
tagctgggactggcacacgccactgtgcccagctaatttttttgatttttaggcgagatgaggtctcgctatgttttccagattggtcttcgactactgagcttaggcaatcctcttgcctcagcctcccaaagttctgggattagaggtgtaacccgctgcacctggcccatatgtgtactttttaattgatctgagttctggacttttgataccatggaattctactgatgggaatttgggttgatggtacggggaacctctatatttatttactaggatgggaggaagtacaaaggttatgagtgaataaaattggtaagtattttagagcaaaactgcttctctgagtaaatttagtaaatctgcctaattatgaagttaaattgatttcatgagtgaattaacatctcaactattgaaatgtttttcatttcttttacatagtcatctcagcaaaacttaaggaaaataagaagaattggtttggaccaagtccttacgtagaggtcacagtagatggacagtcaaagaagacagaaaaatgcaacaacacaaacagtcccaagtggaagcaaccccttacagtgtaagcttggaagtatttttctgtagtatgttttgtttagtagatgattggaaatacaatttaaaaaaatgtttctcactttggttttttgttgttgttgttcctcctttctctcttctttttttttttttctttttcctaggactccttctggtttgcttttttgtttctctttagatagctgtttttatagtcactccctttctttaccttctctagtttagttggtgatgatattgctcttgtcactgaacaatagctgaagagagcccatggtcacggacctaaaaagatttctggcagcactttttattaactttgggttgaattaagggattatgagtactccccccccccccggtttttaacttaatttttaaaaatagtgttttagttagttttttctttgttttattttgagatagagcctcaccctgtc

SEQ ID NO: 100550 - DNA, 1565 bp, Homo sapiens
ccctaagaagaggagcagtgtggaatttttagtttgttttatctacccattgccgttgaaatggtgctggttaataggtacaggtagacttcaaaggaggaaagtgtttctttgtcccctcaaacttgatcacattagagagaatgagatatagagaaattcaaacatttctggaatttgtctttatatcattgaaccataggactgtggtagattatatagtgctcctagctttctgatccttgactctaacattgattctacgtgtattgcaaattcaaatttcccagtttactttggaaataccattatagagagtattccttattggcatttagcaaggaatgagtgagtctatatttgatagttggactgggcaacttgcctctagcagtgtgaaacttgatgtatgtaatgtaatcttcaaatcatgtagctgacgtgaggaactttttaatataaagtttaatgtcaggattttattcacattacagttctgctacttactggctatttgaccttaggcaatttgctttatctctgaatgtcagtttctgtatctgaagaaggaagtgataattcccatctcatagggttactataaagataaaataacttcaagctctgtaaactactgacataaggatttaatttgtaaagttactcttctgtactactaaagtaaaactagttttccaatagtttgttgcaggataagcagttttacttttgttgacaatatgtgtatgaatttacttctgtagttcaactgcaagtgaaaatgaccatgtaagcatgtagcattcagataattttcataagattactgaacataggccaatattgattgtatagtaaactgtaaggggtgcagtgagaagactttagactttaaaactgaattgtaatttatttaggatctcattgtgatattcaataaaaataatattttttccctcttttttcacttttagtatcgttacccctgtgagtaaattacattttcgtgtgtggagtcaccagacactgaaatctgatgttttgttgggaactgctgcattagatatttatgaaacattaaagtcaaacaatatgaaacgtatgtatgtaagactaatagaaattgcacttagctgtttgtttttctggaagaaatttatatgtcaaacatgcataatgactcatgttctctcatacttttaagttttacttggttataggatgaacagatagaagaattttacactattgaaagtattctgagtaaccttggtttgaccattcattttggattcagtatttttagtaaatatttatttacttagtaaatagatattagtaaagtaatacatatttaattgtggaaaaactaaaatatagagcagagatgaaagaaaaaaataaaaatcccacttcagagacaaatcaaatgaatatttttacagatttccttttcagatgcttttttttttgggagggacatggggagacaaggactcactctgttttccaggctggagtacagtggctatttacaggtgcagttgcagcacagtgtagttttg

SEQ ID NO: 100551 - DNA, 1050 bp, Homo sapiens
aatatatcattttaaaacacatttttttctacccctcgactatctaaaacatacttctaaaaattttctcatttaggacttattagatataatttatccttaaattatgtttttactcaatttaattcaggtatatattactaaataatccttattcttatgctagcccattttatactatagtcttacaaggatggaatgaacataataaacgatggagatactattttacatcatgaatatgaaacattagcatattttgtcctttttaaaagatacagtgttttggtgtcaaaagtgttcaaaccttgggtgaaacatagttaaacagtttatatgcacatatagttatattttctcggacatcacatttttaacagttaatttttaacagttaagatgccttaactgggaaaaaagtgaccattttttctgtaactttattttcttccagttgaagaagtagttgtgactttgcagcttggaggtgacaaagagccaacagagacaataggagacttgtcaatttgtcttgatgggctacagttagagtctgaagttgttaccaatggtgaaactacatgttcagaaagtaagtgactacctttttaaggtctttaatgattcttcttaaataaaatagccattgtagtatgctgtatgtaattattttgattttttttttcagattaataaaatgtttttttctggccggtgtggtggctcacgcctctaatcccagcactttgggaggctgaggcagaaagattgcttgagcttggaggttgaggctgctctgagccgtaatcacatcactgcggtccagcctaggtgacagagtgagaccttgtttctttaaaaaaaaaaaaaaagaaatgatttttttctttttaaaaaatagacattgatcactttaaacattttctttttagtgtattatttctgtgaataaaagcatgtatatttttacataagttgaaaaattagccaaatagaagttgaatcacatttgcctccatgagtaatgagttgatttatatagtatttatt

SEQ ID NO: 100552 - DNA, 1270 bp, Homo sapiens
caggtgcctgccaccactcttggctaatttttgtatttttagtagagacaggttttaccatgtaggccaggctggtcttgaactcctgacctgaggtgattcgcccaccttggcctcccaaaatgctgggattacaggtgtaagctgttgcacctggctcctccaacactgttacagtaaaaagatctggactgaatcctaaggatattttccatcaataaagcaagaagaaaataagaatattgtggcattaatttttggcaacttggattcccatttgtggctttcctaatttttaagctgttttccaggcccctgcaataagagagacgttatgggtttttctgtttctggaatcgattttattctgctggcgatcagcacttttttatgaggtatttgggatacaaagatggttaaaacactaggtttaaattagagttagacatatttcaaaaaaaaggcaggaatagtagtgcatgagtaatatacctttagtaattaacatcccgtatccattaattattaagcatttgcacaaaattttggcagactttttttgcagtcatgaaaatcacatttttccttttaaagtcatgttggaatttaagttatagtatgttctttattacaaagatttaataaaaggctttgcttacatggcatgtttagaaaagaaaaaacatgaaaactactctcttgaaactcattttctgtttaaactttgatgttaaaggtgcttctcagaatgatgatggctccagatccaaggatgaaacaaggtaagcattcactgattgcttaccacagaatgcggagagatagatttcctaaatattcattttagtgtaaacttcaggttcatgatataagaataaatgagtgtcagaaagaattcagaactcaagaagggaaatatttgcaaaagattgaagactcttagcttatcggattagagctatctggagtgggctagggataaccaaattgttgatacttcttcagcttgtagaaaataaatatactggcaccttttcagaggcagggtgttctaaactccagagccatcattgggctgttaagtttcttttccagaaaaactgagataggagctttacacatatgtgaaggtcaccactagctatggtatcatctgggccttcattagaaggggcagagctttgtaccagctgtttgctgttagcccaggtttagcactttcatgtgcctatctgcgttcaagtttggacctaaatgtggggaaaagaaa

SEQ ID NO: 100553 - DNA, 1011 bp, Homo sapiens
tgtacatgcttcgtgattagtaatgggacataggggtagacaggaccgaaaaagtaaacaagcctattaactggcagcgttggttatttcccattacttatttctttaagtaattttcacctgtgcatctacatcttaagttttatatttatcatctgccttttattttttacagttaaaattctatcctgaattttagaaaatgaaagattcttttcctattttccccaaatcttttatagcatctgtcaatggttcaccatctgccacttctgaaagtgatgggtctagtacaggctctctgccgccgacaaatacaaatacaaatacatctgaaggagcaacatctggattaataattcctcttactatatctggaggctcaggccctaggccattaaatcctgtaactcaagctcccttgccacctgggtgagtaactttttaaattaacatatgttgtctttaggattcttcataagcctacttattaataaggaaaataacagtaaacaacagtaaactccattgttttgatgactgttttttaatttcttttttttttgagatggagtgctctgtctcccagactggagtgcagtggtgtgatcttggctcactgcgacctccgccccctgggttcaagtaattctcctgccttagcctccctagtagctaggattacaggtgtgcactaccaagcccggctaatttttgtatttttagtaggggatttcaccatgttggccaggctggtctcgaactcctgacctcaagtgatccgaccacctcaacctctgaaagtgctgggattacaggcatgagcacccagccaactgtttttatgttattgtaactgattttgggggatctggagtcaaaatgaacaaggaaaacacaccatatttgaaatcttcagggcaaagtggaaaaatatattttttcatcaaaggaccctgaaagttaaccaaggccaattaataaaataatcacctaattccaattgccttt

SEQ ID NO: 100554 - DNA, 1062 bp, Homo sapiens
cccagctaatttttgaattttcagtagaaacggggtttcaccatgttggccaggctggtcttgaactcctgacctcaagtaatccacccgtctcagcctcccaaagtgttgggattacaggtgagagccactgcgcctggccatttctttccactcaaatcctgattataccctgattgagagtgacttcggtatcctaggtagacggacctcaagcctcttcaggaatatgttttctcctagagcagatacttgcatagaagaaattgaattcactgtgtgccactgcctgaagattacatttcttcactttattcctaaattgtatttgtatcatctttctaaactgatgtccttatttgccttagttcaataatggtcatttaatggaaatgcaaagacaggattaaaaagccaggtaactcatgcaagtattttaccagccttttaattttgtatttaagttgggagcagagagtggaccagcacgggcgagtttactatgtagatcatgttgagaaaagaacaacatgggatagaccagaacctctacctcctgggtaagtatctaaatttaaaaagaataattttatttagtcagaattgtggattacaactgtataatcttccctacatttctgttttactttttcttgtcagccctttctctgtccactttgttttgtggtaagtacaaattaaaaagaagagagctagacaactgattaattcagagcctgataaacaatttttgttttcacgcatatttctttcttcttttctttattttatagaaacaacatctcgctatgtcgcccaggctggtttttaactcctgagctcaagccatcctcccgcgttggcctcccaaagtgctgggattacaggcgtgagctatcatgcctggccctattttcactcatttctgacctaaagattccttaggtgggctgggcgcagtggctcacgcctgtaatcccagcactttgggagggcgaggtgggaggatcacgagctcaggagattgagaccatcctggctaacgtggtgaaaccccgtttc

SEQ ID NO: 100555 - DNA, 1050 bp, Homo sapiens
ggtggccaggctggtcttgaactactgacctcaagtgatccgcctgctttggcctcccaaagtgctaggatcacaggtgtgtgagccactgcacctggccaaaaagtgctttttgatatctgtccaaagctatatatttaatttgtgtccctgttatgattgaaacagtaaaaacaacattgaaaagaaactcaaaacttaatgactgtttgagacttactcactaaatatgtattgcattttaagaacctgactaatgcatcttatgaactttcaagaaataaatttttagaaacatttctcttaagttcacttacaaactatttaaaaatacataaaagactccagataaatcaaaagtagtttctcaaggtaaaatattctatctgtttcacaagtatttgttgaattagcttgtttttttttttttttttctgatttagctgggaacggcgggttgacaacatgggacgtatttattatgttgaccatttcacaagaacaacaacgtggcagaggccaacactggaatccgtccggaactatgaacaatggcagctacagcgtagtcagcttcaaggagcaatgcagcagtttaaccagagattcatttatggggtgagcagcctgttgtttaataaactaataagagtattttgtttctagccccttccagcatatgtcatggaaagcactaaaaagaaggtgcaagtagcatggcaacccagttgttgctgttagtaggtattatttttagaccttgtctggggtattctgtgtgtgatctagtttttcctttttgtaatttgcttaagtccaacttcctcttctttttaatgtcaaaaataagcaaaaaataagttaggacaacttaaaattcatgaacaaaagagtagtaaaaataaacccaagcagcttgaaaataattaaaacatttctaaatttactagtgccttgggtctaagagcatctgactctaaagtggttgtgcaaaactgatgataagagtttaaccactttttaccatttggagataaggcttacctaata

SEQ ID NO: 100556 - DNA, 1029 bp, Homo sapiens
cctgagtttccatctcatctctgctacttaattctgaggtttcaggtagattatttaacctatctgagttttcttatcttaaggataaagatgaattcacctaccctatgggactattaagaataaaatgaaggtcctgtgtaaaaaactaaataactgttcattattcttgctgctgttggttggattgagtagaaaggtcctatggttaggacattataaagtacgtctacttagcttctaagatgtaatatttctataacttcagtaaggatgtgcatttaatagtcaataaattaaaccttttaaagctgtgatttaaaaactataaaataaacaatgaaatgagaaatgggcaaattcaaataattttattttaccttgagcaagaagactatgccaatgctaatgctttgctttcccctgcccctgcccttcccaaagagaagagaacagacagcaatggcagagtatatttcgtcaaccacaacacacgaattacacaatgggaagaccccagaagtcaagggtaagaatagttacttgtgtatatttaatctcttaaagattataccttatttctaacaactgaagaagatcaaagttcatattcttttgccaaagacctaaaacgttaatcacctacatactttggaaagagaaaattatactattattttcatctaatggaaagtttgaagatttcttcaaagtgcaggaaaaaactttaactgggcatggtggctcatgcccattatcccagcactttgggaggccaaggagggaggattgtttgaggccaggaagacctgcgtaatgcagtgagaccctgtctctacaaaaaaaatccccaaaattgggtgtgttggcatgtatacctgtagtcccagctactcgggagactgaggtgggaggatcacctgagcccaggaagtcgagactgcagtgaactatgattgtgccagtacactccaacctggaggacaggttgagggctgtttcaaaaaaaaagaaaacaatagaaaagca

SEQ ID NO: 100557 - DNA, 1010 bp, Homo sapiens
agtcccagctgaggctgaggcaggagaatcgcttgaacctgggaggtggaggttgcagtgagccaagatatcgtgcccctgcactccagcctgggcgacagtgagactccatctataaaaaaaaaaaaaaaaaaaaaaaagcaggagagaaacaaagccagagaaaggatggtgttggggattggaaatagagatgaacgtgaagatttctaaggcagaatggttagaacttggttaacaaaatgtttaggatgagtcattagctaatggggaacataagccaagtagacggcagaagacttgagttgtgtttgatggactttgagtttaacctgtttgtaggatgtccacatagagatgtctagtatacaactgaattactgaactgaatggttttctaaaagatttctgctatgtttattgacatttgtagcttctgtacttggcaaacaagcaactctttaatatttttgtttatgttttttcctgtgtttcgtagtcaattaaatgaaaagcccttacctgaaggttgggaaatgagattcacagtggatggaattccatattttgtggaccacaatagaagaactaccacctatatagatccccgcacaggaaaatctgccctgtaagttttctaaacattgtagattaagagtaaaatactagtccttcagattttgatataaagatttgtattagcaaggagtggaagtcttagtatttcttgagttagcttgacaataggtttctgttcattaagtattttgcatttccatctccctcttggatattttatcctagagattttcatatttgttaccatttgttcacacagcactaaatgaaactatttagaatttataggtattgtactgcttaccaattagtctctgatttctgattttcagcttctttcattcccttaactttttgacgttaaaaaagctctcattacttatcccccaccccatttctgagaaagtaaccttttgatttgcttatgtgct

SEQ ID NO: 100558 - DNA, 1064 bp, Homo sapiens
ataatcttatgttaatattggttcatattttcacaatatttgacttagagtctcagcatttttctaatatgtgagtggctggaattaagaactttactgcctctgtgaaattggaagaattttcatattgatttaacgtgtagggagtagtggcacttgatggggattattatgggacttagtaatagatggaatattagattgatttcagccactttactcacatgggtaaatagtgaattttaaatttgcctatgaatagtatttcattgattctaagactaatattttcattttataatatctctgaaattacgatgtatctcaggtaaaattggaaaatacaatttagtcgttcatcaaataaaggtgcaatgttgtcttagattttttgaaatgtaataatgtatatattaccatctaccaaagatggtgtatactaccaactctgtgaaacagatgtgagtttgaacagaagcaataaaaatcaacatgagattagaaaactatcactagctgaggggtatagatccctgagaactttatagcactgttctttgatttcttggtaacctacaagatttttcatcgtaaattttcttttgatttcagagaatggttctttcttttgtcacatgaagtgttgaacccaatgtattgcctgtttgaatatgcagggaaggataactactgcttgcagataaaccccgcttcttacatcaatccagatcacctgaaatattttcgttttattggcagatttattgccatggtaagtgcaggtcaagaattatgtttactttgcttattcagcaatactaaattttctcttaggtgccataacagatcatatgagagaaagggaagtggttttttgttttgttttgttttttatttttgagacagagtcttgctctgtcacccaggctggagtacagtgacacgatcttggctcactgcaacctctgcttcctggactcagtcagttctcccgcctcagcctcccaagtagctaggattacaggtgtgcgccaccatgcctggctaatttttgtatttttagt

SEQ ID NO: 100559 - DNA, 1191 bp, Homo sapiens
catttgattctttgcatatttccttttctcaaactaacaattcttgcttttagttttaatcgcctggacctgccaccatacaagagctatgagcaactgaaggaaaagctgttgtttgccatagaagaaacagaaggatttggacaagagtaacttctgagaacttgcaccatgaatgggcaagaacttatttgcaatgtttgtccttctctgcctgttgcacatcttgtaaaattggacaatggctctttagagagttatctgagtgtaagtaaattaatgttctcatttagatttatctcccagtgatttctactcagcgtttccagaaatcaggtctgcaaatgactagtcagaaccttgcttaacatgagattttaacacaacaatgaaatttgccttgtcttattccactagtttattcctttaacaacaatattttatgtgtgtcaaaagtctcacttgggagtagtgtttttttcttttagacattctgcagacatgcagggaagtcctttggtaactgcaatatacaagattttcctattaagcctcttggtaagaggcatttgttaaaagtgcaagcttactcctgcttctggggatgtgagcaaaattcgggcttgtgttctccctctcattttagtctgacttgactattgtttttcctttctggcgcatgaatccatacatcattcctggaagtgaggcaagactcttgcatctctacaaagtagttttgtcaatttgaattcagggaaaagttggtcacagcctgcaaatgacttcatttggaagtctgattgtttcagttgcctgacaaatactacactttacaaacaatgttaacactgtgattccttcattgttttaagaagttaacctagggccgggcatggtggctcatacctgtaatcctagcactctgggaggccgaggcaggaggatccctttagcccaggagttaaagaccagcctgggcaacatagggagaccctgtcttttttttgggcagcgtggtgggggataaataaataaaaggaaaaaaaacttagcctagaattagaattaatttaattgaattcatctaaagatgtctctggtgatttttatatgttccgctatataattgatgctttatagttttatcataatccaacaacttcagttatatttaattattgttaagga

SEQ ID NO: 100560 - DNA, 1036 bp, Homo sapiens
ataagcagcagaaccctgttccatatggaaaaaagaaaaacaattttttgtccctaatgttcttccttttacatcctggaacaacaataaaaacatttttttaaacttgtctactgtaagatactgccatcataaagcagagacttacatgagtgaaagggttgcctcatcaagcagctcagtgtaaatggggaggctaggctctccccagccctatggtttttttatttcatgtaccccaggaaatactgtgtggtttctaaaagccctggttgttaaaagtagggactctgcctttttgttggtagggagaaaaaacgctattgctttgtcttacagagcgaatgtctgccaactacccgttcattatataagtctgaacttggtaatatatggctaatgaagattaagccctctataaagacttcctgttgaggtgaattctcatactgaaatgtagttacctacaatatttactagagatttatgaaattaaattaagagataatgtaagaaaatacatttttttggttctatataatgcttcatgattcatttagggacctagaaatattgtgtgaaaatatataaatatcacccaaaaggctttctgccctatatttttaaaatacagaatagttatatttgaagtagccctggccctagttctatagggcttggctatttaatatttttatggaagaagtgtttagttctggaaaaggtaaatgcttgtatatatttttgcagcctgggatctccctactccattttttcctttaatttaagtggccacatgtatatgtcttccctgctgtgttaggaaaatgggggctggatatcccaagaatcagaggttatataaaaatactgcaaatagaccgcagacataaatatctaccaaatgctatcttaaattttggtccaaactgaacatatggaaatagatttattgtaagtatttacttagagctttttcttaaatctgaactaacttgcttttagaagtctttttctttgtaagcattgtaaatgc

SEQ ID NO: 100561 - DNA, 2162 bp, Homo sapiens
aagggtggatttgagtttagggggaattgacaggtcatggtggctcgatgtatgagagaagtgtcagggcaattttgtggcctgggcacctggctggaagatgggggcatggatgctgagtgggagaagtgtatttgacagagggaaggtgaggagtttgatgtggacctggctgggatggaagtggctgtgggaggatggggcagaggcctctggttgcacaggcaccaggctggcattcgaggccagagcctgggatggaggtgtagaccatgggtgggggcagggggagtccaggcagcttctgagaggccagaccttgcagggtcaattatgggccctgaggtgggggccctgaggagggcctctccagtgattgtgatccagagccaggcaggggcgttcctgtcttccaacaacacctgccagcagttcagggatcctgggtttagggggaggtacccagcagcgcctcacaccctctctctccccccagatcctgctcatctctgattacttctatgccttcctgcggcgggagtactacctcacacatggcctctacttgaccgccaaggatggcacagaggccatgctcgtgctcaagtaggcctggctggcacagggctgcatggacctcagggggctgtggggccagaagctgggccaagccctccagccagagttgccagcaggcgagtgcttgggcagaagaggttcgagtccagggtcacaagtctctggtaccaaaagggacccatggctgactgacagcaaggcctatggggaagaactgggagctccccaacttggacccccaccttgtggctctgcacaccaaggagccccctcccagacaggaaggagaagaggcaggtgagcagggcttgttagattgtggctacttaataaatgttttttgttatgaagtctaccctgagaccacatctgcattgcactcctagagggggtggcccctaataatgttctggaacactacacacaggtgtgggtttccagagcgagcaccgcggccacagaacacaagtctgtgcgccagagcccggggatggtgcgggcagccccaccagcaccctccccactcccaagcaagcggctggaggcacagggccaggcaggcctgagcaatctttattctgcagagggacaatgaccacagatccatacaccacgtggagaccgaggggcggggagccaggggccagtctttcaggggtgggcaggtccaggcggtgggcagagcctcgggtgggtgaggggcagatgggcagacaggcaggggcctaaaaaaaagatgaaccacacagcaggggtgctgggagctgctccccaccctcccccatcccaccagccagcacccagagggacaaccctaacacgaccggcccaggatccacccaggggcagagtaggtgggttggtgccctctgactaggggggcacatgcctgcccagcccaccacggtagaggcagctcagttcaggaaccaggagctctctgggcagggcctgaccggggccgcccgactcccaggccgagcccccctactgctggctcagaagccgaaggtttcctgggaggcgtagaccatatagaggaagccgtcctcgtctttctcctgctcgtagatgtccgcgatgggcgtggacacactcaccatgctgtgctggttcaccagcaggaagaaggcctgcgtggggttcagctgcaggcggcgcctgcagccggcgggagagtatgcagctgtgaggggcttggctgcgggacggacatagccctgacccccagaatgattcccagcctttcacacccattctcaccccagctgtcacctctgacccaacaccgactgcagccccgaccttgacctttccagccaccccagaacaggggcccaccgcccggtcccatcacccctgaccccactcccaccccttctcggcgggaacccggctcccctcccgaccctagccacctcctggcggcggctgcccacgcaccggatgatcttgaccaactcgctcatgttgacatggtccgggaccaaaaacttggtcttgtccaggacgggcagctgcttctcacccttgtagcgctcgatgatcacctgggagcagggcgggcgggcagggggtcgtgt

SEQ ID NO: 100562 - DNA, 1121 bp, Homo sapiens
ccacagtcggccgccagcctcctctgcctcccagcttcctggatcccaggcaggtgggcagaggctgctgcactttgccaactgtgacggccacatgcattccccccagcgtgggctgactgtcaaatgtcagtgtctgtgtccccaacagcagcaggaggcctggggaaccaggacatgcctgggtgatagcacctgcttctctaggaatctgcagccctggtggtggacaaggctgctgtcctgagcccagtagtttcaagacacactgtattaacaacctctactggctttttacaaaaaaagtcaatctctctctctctccactgagtgacagagctgtgaactggggagagcagactccgcagggtgtaaaggtacctgaggtgtcagcacaggcctggcatgtagcaggactcagttcatgtgggtgcagaccctagggggttgtggaagaactcaggattgggcctctgacaggcaggactggcccctaactcttcacttcctaccatgtgaccttttgcagggcccataacccctgagcttcccttctctaagtaggcattgtcagccctaccctggggggttggaaagggacaatattgtttttttgttaaagggcctggaccagggcagacactcagaagatattcatttccctgtctctccatcctgccctgcactagagcatgttctgagggtttcgttctacttctgattcatcctgtctgtccctggtcacccctttatcagctagctgccccatgagctcttcatcatggtcccagagggaggcggccctggagccctcatggctgccatagagaggaatgtggaccgagccgtccctgggggcagcgctgagagggtacagaccagcaaacaactcagagagagctggccctgtgccgggcctggggccatagaactggagcaaatgcagccccatttggttgggaggccagtgggcagtgacttcacttcagggtccatgtaacaatgcagggttagagaagactcctggcaggagatgagcctctgagggataggtgggagctgcagcgctgctgggcagggcagggggagccagggaacttctgagcaggcaagcgtgcgtg

SEQ ID NO: 100563 - DNA, 1029 bp, Homo sapiens
tccagatctgtgaacccctacccagtgctgtccagcagggctttatgatgatgaaaaagtcctctgtctgcacagttcaatagggtaactagccacttgtgtgcctgagaacctgaatttttaatttaaatttcagaagccacatgtagctaggctaccatactagacagcagaactctatgccctgggctttgaaccattccccagcgctgcacccaaaggttactagaaggcagaggggcaaagttagacttccctgcccactgtgacaacccctctaagctctaaccatcccctcttcagaggtggcttagtggtgacctatctgtgctgcctaggcccccagtgctcttagccctctatggtgggttcttttcattgtttgggggctccgtcagggtagatatcacaactcattcacctttgtgtccccagcactcaggactgaagctgacacatagaagaccttgcaaacatttgtggagcgggtttttaaacctccccaataaagaggcagtgtcagtggcccagcaccacctgattctctaaacgaggcatggaagggagctgttgaactttccttgcctgctgtgggtgtccagcaaggtgtcaagaatgaactagggagtgcaggcttcagaggaagtgaatctttgttgttgttttgggtgtcaaccaggaagtgaaactgactagctgtgggaagcagcctacctataggagtgtgcctctgagtgaaggtaaacagtggtgtgggcagctgagccagggctacgcctgcaggtgatggcctagtggggctgtgacccatctggcctgactgggaggaggaagcagtgtcttctgtggtgacatcctctctgcacagacaagagtcacccagtccagcaggttgagagtcagcttggggcccctcggcagagtggccagtgacaaaccatgagaccaccaaaacatggacatgcctcagtttgtgatagtggatttcaagaatgtagaatggatttttgtggttgcccatcccacact

SEQ ID NO: 100564 - DNA, 1021 bp, Homo sapiens
ctatgctgaattggtgtttatggtaagtaaccttccatataaaattgatatgtatatatttttaaattttatggtttattgtctctctctctcttttttttttttttttgagatggggtctcactgtgttgcccaggctggtcttggactcctggacttaagtggtcctcccatttcagcctcctcagctgctgggactatggacacatgacacagtgcccggcttgtcatcttgtgtttaagaaaaaaacaaaaaacaaaaaacataggaactcaggagtttctcagaaaataaaagcaaaaacttatgtctttactttgaattcatggaactgtggcagtattatggaagtgtgaggaatagtttctgatgtgtaaccagttccaaatacttactctttttagaatttggtttctggactatatatagtcttgaattttctagctctgagattctatgattggctttaattgtgaagccggcgtggagggcattctgaatttgtcctaagcattttgccaagagattctgtgagtcattatggaagaagaggacacaggtttgaggctttcaggggcgagaagcttcagaattgggatgacaggtctatgttttgagagcatagcaatttgaaacacttgtctgggattgaaaatttgagtcaagaaatacccaggaagcccactgaggtcttccttagtaattataacaaactctatttattgaggacctactgtgtgctaggcacttgacatacatcaggcatgcaaagcagtgggtattatttccattttacaaaaaacataagtatcttgcaattctagagcagatatgggccactaaactgaagtgaacctagatgggtcctgatcctcagggatttccagttcaccctgcctgaatgggccttatctttgggtagtcaaagtgagggttgaagttctacctgattgtaagagtccagtacttggtagtccatcactatctcaaaactccaagccctggtagcactctagtact

SEQ ID NO: 100565 - DNA, 1049 bp, Homo sapiens
aactgccctaagaagtatcatatctgggtcagaaggcacacacttagaaagcacatattgccctgtcgaaaagttaatacaaatgtcactcaaatgagcagcatatgagagtgactgcccatttcctcacactatggcaacatttctcaccagcttctaatttgttatcttattgtgctttggaatggggaagattaggcataaatgagacatttttgagagttggtaagagttacaaggaactaaaaggaagcagatagtttaacataaaactgtcttataatgagtgctgcccacaatgaaaaaggatgctgtccatgaaagagagtttcccgtcatcagaaatgttcaagacttaaagccacttgctggggatgaggtaaagggggttagataaacgctaaggccctttttggttgtgggggtatctaacaatttggtctgtagctgcctgcttagtctgagtgaacttgtatatctaatttttcagtggttgaaggcctttcactgttggacttgggagtatctccgtattctggagcagtatttcatgaagtaagtgttcttattttcttttctgggtaccaagagtagtttacagtcacagataccaaagcctaacctctgttttgtacaaacatttaaaaagatgtattcttgacgatcatatttagaaacagcccgtttttagatgtcctctgcataagaaagaggttttgcaattgcaatggaaatgatccagattaagattgtaactggggaagcagatgaggcttctgtagaagttaccatttgtaaaggcaaataagttgcaaacagtccttagtccgcaaataggttgtatgctaattagcatgtaatttgttgtttggaatatgatttcccatgaaaactacggcagtaatgttgtttccttagaaagcccagaaaaacttacttaacccataaaattagcttttttttttttttttggcagggtcttattctgtcacccaggctagagtgcagtgacacaatcacggttcactgcagccttgacctcctgggct

SEQ ID NO: 100566 - DNA, 1050 bp, Homo sapiens
gacgacagagcgagactccgtctcaaaaaaaataaaaataaaaataaaaataaacattttggcattgaaaacatacacgcaagagtgaatttaacatctgtttaaaagtctctcacaatcccaggaaggcgactacttccgcttctactttcagcagcgtttcagccccgctatagcggcgcggcttcacaaaacacctgcgatcgtagaaggtttcgccccaccttctgcatacgcagcttgaggcgcccgctttccgtcgctccggcccgcctcgccgcaaggctttctgggagccgtagtccccacgtctggcctctccggcgccagcggcagcgcgcgcccacccgcggaactacagagcgtggcgcacagcgcgcgaggctcctccgcctcgccttccctccccgcccgcgcgcccgccccagttatcatggcggctcccttggtcctggtgctggtggtggctgtgacagtgcgggcggccttgttccgctccagtctggccgagttcatttccgagcgggtggaggtggtgtccccactgagctcttggaagagaggtgaggccactggctcgagcagactgtcaggccccacctgccctcccgcggcctctgtgaatgggaggcgggggcagtgaccgccagcgcgcggttcctagagaactaactgactgtctcgtggggttcttggagagggcggggcctgagggcggggctggtgaggggagggggcgtggggaccggggcgtggggacagtgtcgtgaggtttgggccctgggggccggaccacctagtggtggggatctgagggggcgtgtcccattcagtgtcctgagccgaggagtgtggtctgtgggaagggttggaataagaggaggaggtgcttgtggagcgcggcttgcagaggagtttgggatttggggcgggatcgccaggggtgctccctgggataaaaggttatgtgtgagggggtccgggatgaggggaccaattttgcttaagcgaggagagtgtgcgtgtgctttagacgtctcttctcagtct

SEQ ID NO: 100567 - DNA, 1037 bp, Homo sapiens
tattggccctttaccttcccaacttcctaggtcgtcagctaggaagggcctgacctggcctagtgcagacaattgcaggtgttttgctgctccctcgtcacctctgcccacagagagtataggagaagggataggataaggagagtttctgacttaacaagtggatgggcctagaggctgaaccaggaactccattcctgctgggagtttgctcaaggatgggctgggggtaggggtggcttagggcacaaatgctattctgggcagagctgctgtagttattaaagggaatggttctccctggagcagaactgggaatgtgagaaccaggaagctggcagggctgggaaaggaaatctgggaggctccccaagtggtcaggagagggggcaggcactggctggctggtgactgctttcactcctggctgtcactgacttgctgtgtgacctcaggcagggagcttttcccctgagcctccctcccctaaacctatctgaaatttggggaggcacagtgcaggctctggtacacagtgggtcttcagtaaatgcatgctaaatcttggtgccagtaaccccagacccttttgtagctaggcgaggggtggtgtggctaggtcaaggtctttttcacctccctgtacccctgcatcattgtattcttggggattgtttgctgagtctttcctgactgtgtacactctggactggatgcacagtaacgtgggactaggtctgccctgccactatctagccatgtatttttggatagatttatgtcttctttctgatcatcagattttaaaatgggctgggtgaatatgatggtccctgaaacagctcttaacttctctttcatattccatgaattagtaggttcttggaaggaggatgtgcctcatcaaggcctcgatattcccttccttcaagaggggccaaactttctgggcttttggtaatggagtcactagctccctgtggctacatatgggttgggatacatgaattgtgctgggtggacactagttgggggtg

SEQ ID NO: 100568 - DNA, 1043 bp, Homo sapiens
cctttcctatagattctgtagcatttgagtgtggcaatattttaattgtgtatagatttctaagaaccaacactactcagtctcctgctagtctgactcctgaagcatcagcccttgtcatactgtattgactgtgtacgtgcctttcaccttgagcatgcttcaggatttttttttaaaccacagaacttgaatacatgagggaaccagagttcaaagtcctatgcaaccttaggagggggttagagagtctgttttgattgatgttttctgaggccctagaggagtttgtatcaatttgtgagtattaatgtcagtactaccagcactttgccaaaactgtcagagggacccgtttctagagtgagtcccagttacatcaaacagtgacttccagttattccccagtaagtctgagtggttccttcaagctgggtgtctttccagcctttgccagtctagccccagcagggcaccgtgtatgaatgcagtttggtgctgttttagagtatgcctgctccccagccccctgcctggaaccctctgagcaacttgctctgacctataatgtcttaggtgcaacacggaccccaccagagctcttggatacccccctagatccatgtggctttatgtgaggggactgaatgcagacacaccatagcccccttctactactttccctctcgccctgccacctagttccacatggaaccaacaagttgagtgcatccctgttgggtgttttgtgttgagactggctgaaatgaggagactttgaccatgtgacgtgtcaacagactcaaggagacaaccacctcaactgggtcatgtggcatgcctgtgtatgtgtgtaacagaattctgattgttagactgtaatgctattcctctatgggagaaaaaaattaatataaagaaaaacaaataaaaatatatttaaagcacatgatcctttctgcctgagttgagcttaagtatgagaagcatcttgtaatcttaagcacagtagtggcataggatattatgataaagctggcctt

SEQ ID NO: 100569 - DNA, 1182 bp, Homo sapiens
gattctgagttgagtagggctccccttaggtctgccctgcttgttgtggactgtctaaagggcactgctgtaaagagttacttccactgaacatgtcctttctttcccccacagacataaccagtgcggtgcaatccaagcgaagaaaatccaagtaaacaagcaggactgcgacttgatacttggaaatgtgtgtgacttttacaaagagcaattttgagctgtgacttttttaaatcaatttctgtacagttagtaattttaataatgtggcccttttcctagtccctgcaacctgtttcataaagtgcaatggggaaagcaggactgttgagcccttttggtgttgcgagttgaagttcaaggtttctaaaatgttgtcttgtattgaaaggagctaatgccattataaatgttactagttttcacatttcctaagcagcctagagtacagggtgagcatttttagatctcctaatgatgtattgtgccgtggaagtactgtgtgtgaatagcagtagtgggggcaaaagcaatcttctcatttggaaatgttgtaaataattttattatatagtgttttggatgtatttgttgtagaaatggaccagtgaataaagagaatctaaggatttgtacaatgtgaaataacgtgttaaataaatgtcattgtcatagaacataaagttatgttattggtaagggatttttgggtgatcagctctttctttggaccttaactaagcagacacagccttgtggatggaattcctatctagtcctcattgaacctgagatgcccgcctggcaagttgaggaaaatgtacatacttgctccctcacctcattcttggctttgaagaaactagccctgttcagcactgtgccaggtattttgatatatattgctcagatttcttttgatgcaaataacaaaaccaacttagagatcaatggccacccaggattttctagggacaggaagctgtcagcagctgagatggcactttttcaccatgtcacatatctgctcctccatttgcatggtggattgctccaaaacaattgtgctgacatctcctccttgcaggaggtaagcccaaactggcctgtaagattgtgccagcatcaagaatctagtccagggccgggcatggtggcttacacctgtaatcccagcac

SEQ ID NO: 100570 - DNA, 1061 bp, Homo sapiens
tgacatacatctatggcttcaacttcattagctctgtggagaggaatattaccattttccaaaagtcatgcctttttttggagacagagtcttgctctatcacccaggctggtgtgcagttgcacgatctcggcacactgcaacctccacctctggggttgatgcaattctcctgcctcagcctcacaagtagctgggattacaggtatgtaccaccacacctagctaatttttgtatttttagtagagacggggtttcaccacattggccaggctggtcttgaactcctgacctcaagtgatccacccgtctcagcctctgggattacaggtgtgagccaccacacacagtcttgtctcttttagtgtaggaatgcactggataatattttaaagaacttctcataattgtacagcaacttcataagacactttcacaatatttttttcatttaatcttcatatcatccctgtgaggaggttaatagccaccatttatttgaatgttgttccatgccatgcatccttaatagattgagctacaagtgccctagatgtgttatctcatctaattttcacagtatctattaggaaagtaaattctgtcttatagatgagaaatctaaagttcagaaaggttaactaaattgcccaaggtcacagaattagtaaatggtgaaggttagattcaaacccaagccttctgacttcagagccctgatatttaacctatgtattgcaacagacaagatgggatttatagatcaagaatctagaatgaggctgggtgcagtggctcacgcctgtaatcccagcactttgggaggccgaggcaggcagatcatttgaggtcaggagttcgataccaccctggccaaaatggtaagaccccgtctctactaaaactacaaaaattagccaggcatggtggcgcatgcctataatcccagctacttgggaggctgaggcaggagagtcacttaaacctgggaggcggaggttgcagtgagccgagatcatgccactgcaccccagcctgggcgacagagtgaaattctgtc

SEQ ID NO: 100571 - DNA, 1868 bp, Homo sapiens
gaagcaagtggcagtgaagcaccatctgtcccaggaggcccaaacaacatgccttcacatgtagtacttccccagaatcagttaatgatgacagggccaaaacctggaccatcgcccctttcagcaactcaaggtgcaactccccagcaaccccctgtaaattccctgcccagctctcacggccaccacttcccaaatgtggctgcgccaacccagacatctaggcccaaaacaccaaacagagccagccccagaccctattatcctcagacacccaacaaccgccctcccagcacagaaccttcagaaatcagtctgtcaccagaaagactcaatgcctccatagcaggactcttccctccacagattaatattcctttacctcctaggccaaatttaaacaggggctttgatcaacaaggcctaaatccaacaactttgaaggccatcgggcaagcaccttcaaatcttaccatgaatccttccaattttgctaccccacaaactcacaaattagattctgtggtagtgaattctggaaagcagtctaattctggagcaacaaaacgggcaagtccaagcaacagtcgcaggtctagtcctgggtccagtaggaaaaccactccaagccctgggaggcaaaattcaaaagcccctaaacttactctggcctctcagacaaatgcagccctattgcagaatgtggagttgccgagaaatgtattggtcagtcccactcctctggccaatccccctgtacctgggagctttcctaacaacagtgggctgaatcctcagaattctactgtgtctgtggctgcagttgggggtgttgttgaggataacaaggagagcttgaatgtgcctcaggacagtgattgccagaattcccagagtaggaaggaacaggtaaacattgaactaaaagcagtccctgcccaagaagttaaaatggttgtccctgaagatcagtccaaaaaggatgggcagccttcggatcctaacaaacttcccagtgtcgaagagaacaaaaatttggtgtctcctgctatgagggaagcaccaacatcgttaagtcaacttcttgacaactctggagctcccaatgtgacaattaaaccccctgggcttacagatctggaagtaacacctccagtagtttctggggaggacctcaaaaaagcatctgtcattcccacactgcaggatctgtcttcttctaaagaaccttctaattccctaaacttacctcacagtaatgagctgtgttcatcccttgtgcatcccgaattgagtgaggtcagttctaacgttgcaccaagcatccctccagtaatgtcaagacctgttagctcttcctccatttccactcccttgcccccaaatcaaataactgtatttgtcacttccaatcccatcacaacttcagctaacacatcagcagctttgccaactcacttgcagtctgcattgatgtcaacagttgtcacaatgcccaatgcgggtagcaaggttatggtttctgagggacagtcagctgctcagtctaatgcccggcctcagttcattacacctgtctttatcaattcatcctcaataattcaggttatgaaaggatcacagccaagcacaattcctgcagccccactgacaaccaactctggcctgatgcctccctctgttgcagttgttggccctttacacatacctcagaacataaaattttcttctgctcctgtaccgcctaatgccctctccagtagtcctgctccaaacatccagacaggtcgacctttggtccttagctcacgagccacccctgttcagcttccttcccctccttgtacgtcttctccagttgtcccttc

SEQ ID NO: 100572 - DNA, 1419 bp, Homo sapiens
ggttgaagatacacaacccttcacacttaggccactctcccctgtgtgtacagagggtatgttttgtttcttcctcactagttatttcaacttctttttggcatgaaaatgagagcgacattattttaggagtaacctttaatctacccctaatttatgtattttaaaattgaatccaaacaaaaagctaaatccatcatgatatcaatactttgtgttatttattacaaattatttgggcatatcacacttcccgtcagtgagatgcagcagcatagctgagactgggaggtcatcagtctttggggagtatgtccagaaggcattgagagcaggaacatgcctgcttgcctcagacacatctgaactcttcttataagaatcccaggggtctttgtatacatttattgccttctttctgcaaactgggggcctgcaggctgaatttggcctataatggttttgagttgctatgcagtgtcttaaacaaaagtccgagtttaaatgcctttaaatagggcatctgctctgcagtttggcactgttgacaggactcctgctgtcttataccagtccacttctattctctactacctgcctggcccctaaaggcataggagtttgcattccctgagtaataaattcagtttgtgattgtgttatgggcactatgtgtgtcctggctttccctcttcaccattctgtcacgtcagccccaatctgtcttatcattagtgccttttggactgctgcctccagcttctggactctgtagcagccatgcccttaactgttacttttgagaggctgctatattgtctatgctgtcctctttggtatttactgtctggtgggctgattttaaagataaaaggcatccatgtcataaccctgacatcaacaggcttttgtagcaattacaaatttcttaatgtgggaaccccagactgaatgtgaaaaataggaacccactgtatttgactatgtagtcgaaaggacagttgaaccatagaaatgccatgttattggctttataaaggtgaagaagttactcgggcctaaaataaaaaaggatttttttaaaaatcttcaaaactggattctacacattgtattcattgataccatggaaatctttggccagaagacattaattgagtgctgagtctgacccacaaaatttggtagctgctctatgaaaatgttgagtcagcatttcttttgactgccagagccagttgttcttattcctacaccttcttaaaacctccctaatgtactcttcatgcaacaatggaataaatctagtttgtggaactggaattgtatcccatatatgcccagctgtatgcccactttttcccacagaaccaccgttattcttggtttgcgtatctttttatcttttctgattgtaag

SEQ ID NO: 100573 - DNA, 1035 bp, Homo sapiens
attcatggcaacatgaacaatcagcaggctggtacttctggggttcctcaagtgaacctcagcaacatgcaaggccagccccagcagggcccaccatctcagctgatgggcatgcaccagcaaatcgtgccctcccagggccagatggtccagcaacaaggaaccttgaaccctcagaaccctatgatcctttcaagggcccagcttatgccacagggccagatgatggtgaaccccccgagccaaaatcttgggccctcgccccaaaggatgaccccacccaagcagatgctttcccagcagggcccacaaatgatggcgccacataaccagatgatggggcctcaggggcaggttttgctccaacagaacccaatgatagagcagattatgaccaatcaaatgcaggggaataagcagcagtttaacactcagaaccagtccaatgtcatgccgggaccagcccagataatgaggggaccaactccaaacatgcaaggaaatatggtgcagtttacgggacagatgtcaggacagatgctgccccagcaagggcctgtgaacaacagtccatctcaggttatgggcattcagggacaggtcctgcggccaccagggcccagcccacacatggcccagcagcatggtgatcctgctactacagcaaataacgatgtcagtttatctcagatgatgcctgatgttagcattcaacaaaccaacatggtcccccctcatgtgcaggccatgcagggaaacagtgcctcgggaaaccacttctcaggccatgggatgtctttcaatgcacctttcagtggagctcccaatggaaatcagatgtcctgtggtcaaaatccaggcttcccagtcaataaggatgtcacgctaacgagcccattgttggtcaacttattgcagagtgacatatctgcaggccattttggggtaaacaataagcaaaataataccaacgcaaataaaccgaagaagaagaaaccccctcggaagaagaaaaatagtcagcaagatctaaag

SEQ ID NO: 100574 - DNA, 1076 bp, Homo sapiens
aacagccacagggaattcgaccccagtttactgccccaactcaggtgcctgttcctccaggctggaaccagctgccttctggagcccttcaacctcctccagcccagggttctctgggcacaatgactgcaaaccaagggtggaagaaggctcccttgcccggcccaatgcaacagcaactccaggcaagaccatccttagccacggtacagacgccttcccaccctccccctccatatccctttggcagccagcaagcctcacaagcccacacaaactttcctcagatgagcaacccaggccagttcacagctcctcagatgaagagtttgcagggagggccctctagggtcccaactcccttgcagcagccccacctcaccaacaagtctcctgcctcctcaccctcctccttccagcagggatcccctgcatcctccccaacggttaaccaaactcagcagcagatgggaccaaggccacctcaaaataacccacttccccagggatttcagcagcctgtcagctctccgggtcggaatcctatggttcaacagggaaatgtgccacctaacttcatggtgatgcagcagcaaccaccaaaccaggggccacagagtttacatccaggcctaggaggtgaggaacactgtagctatttgtgttggtaaatttgctggagctagatcttagtagaacttcagtttttagagttaatggagggagtggagtaaggatataattatttggttttgtggatatggtggtgacacttgatataacttaaagttaacttgatacgttatgcagcatcttactggttaaatttaagctagctctctggactaaaattcaggtaaaattcaatgtagagatgttcattttgtttttcaaattatttttgcttgatcttgtactagtaaattaaaatgtccagaagaaaaatgcattttgttaacaatttaaacttctcagttgctgaaaaattaagattatgcaatagagcaaaataaaaagaacagggtctcattgaagaaaaggcccttttagttatcaattttgataatcctagttaa

SEQ ID NO: 100575 - DNA, 1078 bp, Homo sapiens
gctgggctggaggatcgcttgagcccaggaatttgagaccagcctaggcaacatagcgaccccatctctataaaatatagaacgattagctgggcacagtggtgtgtgcctgtggtcccagtggcatgtgcccatggtcccagctatttgggaggctgactcagaaggatcacttgggcccgggaagtcgagatggcagtgagctgtgattgtgccacttggcagactgggcaacagagcgagaccctgtcaaaaaaaaaaaaacaaattttccatatcttttcatattcttgaaataactcattaaaaaacaaaaattgtgccaattccagtactctattttagggatcttttttctaggaataataaggatgaacaaccctgccactgttatgatacccccgggtggaaatgtgtcatcttccatgatggcaccaggccccaatccagagctgcagcccaggactcctcgccctgcttctcagtcaggtaatgacttccaatctttgaggatgaagagtctgaaactttctgcacagatcattataaaattcagttatctctgatgctgaatttctaatttccaaactcacaatgtcaaccttctttacaaaatctgacctgatttcttcaaactaaatgtcattattttcttttcagaatttctcattgttttcttatcaattataccccaacatttctaaaagtgtgccttggcctgcgtagtcctgcaagatgctcattacatagaattctgtagtcaagtaaatttggtaaatgcatcattctttaccctccctcctggagattcaaaagtaacatattggaggcactgaaagtcctacagtgaagaaacgcatctaagtttgttaggttcagtgtttcccaaacctaattgttttgttttcttataatgctaattaacatagttctccagaatatgatttggtaaatactggtctccatgttttacacttcgctcttaatgtccactactgaccaagctctttttaagacagaattcatcatcttggtatgttgcttcatacatagaaggtattcacaagcatttatttta

SEQ ID NO: 100576 - DNA, 1029 bp, Homo sapiens
cccaaacttcctgccttttgctgtttggaggcctacatgtaatggaaaggaaattgccctgagaatcagagctgggttttaatgtcatctctgatgctactggttagccacaggcttctgagcaaatcacttagcctttctgggccttggtttcctctcctgtaaaatggtcttggactaaatattgtctaatcttttctaaattcctatgattgtgttatctcattccttttagcaagttttccctgtttttttttccacattagaacaagtgaactccatgtctggaaaagttaacattcaatgtacaatggtttaagagctggaaggggctttaggcaacatgtaggcactttcctctatccttagatatttctcattttgagaaagcatattcctctatgaccattatctcttttttccttcttttcacaggtgttgaatgaccattatcttaatattagaatgtataactgaatgaaggatacagaagtttaagtttagctgagttaataacaaaagagaaaattgttttgcctgaggttgttgaataactttttttattttttatttattttttgaggcagtgtctcaccccatcacccaggctggaatgcagtggcatgatctcagctcactgcagccttgatctcccaggctcaagcaattctcccacctcagcttcccaagtagctgggactacaggcgcacgccactgcacccagctaattttctgtttattttttgtagagatgaggtctcactatgttgcccagggtgatctcaaactcctgagctcaagtgatctgcccgcctcggcctcccaaagtgctgggattacggacatgcgccactgcacgcagccaaataacttttttatcagctaactgtgcctgggatttgctttccaatctgtaaaatgtaactacaattaataatacctcctcaattacttaacttttttaaaaagtattttttattgtataatacatgtaacataaaatttaccatgttaaccattattaagta

SEQ ID NO: 100577 - DNA, 1011 bp, Homo sapiens
tgtttgtttgtttgtttgtttttggagacagcatctcactcccttgcccaggctggagtgcagtggtgcaaacttggctcactgcaacctctgcctcccaggttcaagtgattctcctgcctcagcctcccaaatagctggctcatacctgtaatcccaacactttaggaggccaaggtgggtggatcacttgagttcaggagtttgagaccagcctggccaacatggtaaaaccccatctctactaaaagtacaaaaattagccaggcgtgctggcatgtgcatctaatcgcacctacttgagaggctgagccttccatcaattcttggtgctccttggcttgtagctgcatcactccatctttgcctctgttgtcacatggcgttttccctgtatgtctctgtgtccaaatttcccttataaggtcactagtaggtcccaccctactccagtaggagtaacttcatcttaattgattacctctgcagcgactctgtttccaaatcaggtcacattctgaggtactgagagttaagactaacatatttggcagggatgggattggggggcacaagtcaacacataacaggtagtgtttgagataacatagaggcattaaattaaaatttattaaaatggaagggtaagattgcaacaaatgggattaaggagagagtaaccaaaggaatgatggacataggaaaatgtaaggaatatttaggtaatgaaatagtgagaagtctgatttgctggtttgttgaggagttgtggagaagtgaagccgacgtactttcttggggccctggatgccaggtctaagacatttgaatgttgctgagtgaccagtgtgtgggagcaggatggcactgcggaattttgaaatggtagataattgattcaagctttgagtaactgagtcaagttttagagacattctaatatgatcaggtgatcatggataagtaaacaccctgtagaaaaacagatggtcaatgacaacacacccagcc

SEQ ID NO: 100578 - DNA, 1041 bp, Homo sapiens
ggagttttttaaatttctggtttggggtggtgtctgtcaaagaggtttaaaaaagtgaaaggaagtctgggcgtgttggctcacgcctgtaatcccagcactttgggaggccgaggcgggcggatcacgaggtcaggagatcgagaccatcctggctaacatggtgaaaccccatctctactaaaaatacaaaaaattagccgggcgtggtggcgggcgcctgtagtcgcagctactcgggaggctgaggcaggagaatggtgtgaacccgggaggcggagcttgcagtgagccgagatcgcaccactgcactccagcccaggcaacagagcgtgactccgtctcaaaaaaaaaaaaaaaagtgaaaggaaaatgaggggagaattctcattgataataagggcgaaaaggtttttttggcagagtaatagagttttggaaaccattgcaaagctgtcaagtgtggtgtagtttttggttaaggaaatcagaggtgtcagcagacataaaagacaggggaaaacatgggaagtgtcctacctatagtgtagaaaaagcacaactatctatgtcagaggtcgacagactgtggtccataggtcaaatctggcccacgatctgtttttgtaaataacgttttattggaacatagccacactcatttatttatatattgtccatatcttcttttgtggtaccaatagcagagttgagtagtcgtgacagagatgtgttgtgtcagctcacaaagctggaaatactctttacaaaaacatttgccaacccctgatctatgtgtttgagtgttggatgttcaacctctaatttgccatccaatgtctatatgatgatagagaatgaataaacgtcttggctctgccctttgggctggattacccatgctctgtgtacctgcagcataacacagacccctgaatatttatatcagtcagtgatggcaaggtctattgttctggagtgtactgtgtggtaactgtggtagtgccagctttacacggattagataatgctcgggcttgt

SEQ ID NO: 100579 - DNA, 1038 bp, Homo sapiens
ctccaggcctggggaacaggcgggagccggtcgtggggtcgtggtcagggtcgcggagaaggaacactgggtccgaagggaaccgggattggggtctatgggctgagaggatggcaggacgtggaactgggttaggccttaggcggtgttagagccctaatgcaggtaggacctggggattggggtggaggcatgggggccaagctcaggctgtcagggctggagcagttctttgctgggagggaaggaggtgattgatgaggaatgagggccctttgggtacagacgctggttcagattggggcagtccttggggtactggggctgaattgcaaagctgtataactcccaaggctctgaagacttatgtcccaagcatcctccaccccctcttgggggaagcaacaggaaaaaggaggtgtttgatgagagaaaagggggacaaagggagactgaggtttgggtgcaggagctggccagcaaaagaggcacagagagtggaactggttggcaaggaaggagagaacctttatcaacttagggagttgtgtgtgtctttaaaaggagggacctggctgtttgggggcggtgacccaaggtgtcttccctggaaggggacagcccacagcttaagagcagagtcacctggagaggtcatcagaaaggcgttattgaagccagtaaaatggtgaagaagagtgaatgtataaaaactacaaaggcctgagagatcaagtaaagatttcaaatcaggtagtgattttagctgaaacatagaaaggtaaagttgacttttcaagatcttacaagttagtggcagaggggtactagaaattgtcggctgcttcctcactaaacacattgccttaaaggaatttgctagctgggagaaaggtgttaagaaatgaagcataacattcttgtgatgaaactaaaagcaaacaaacaaaaacaacaagaaatgaagcataacagtatataccagataactattaaatttgttttcttcctgtaatgagtgtggcaatacaaaggctg

SEQ ID NO: 100580 - DNA, 1048 bp, Homo sapiens
ggcacactattaacatgtagtcctctgccagcacacaccatgggagccggaaacacttaagaaaactgtttcttccattgacttgaaagctatgtcactctaccttctgcccactccacccctaaattatctccatatgctttggaatatccctcaataagtctttagaaacacaattttggcctctctttcatagagatgggggtagggatggaataagcaaagggaattatcttttttttcccactcactctgatggtgtgtaattgagtgtgtgggcacaaatacacaacagagggactattatgagtgtgctatgagtgctcatgtgtgagtgatgtgggtggctctgaaataccatctgagggtgctggtatgaatgatggcctgatagacatatgtgtcatcaggagtgtgataaaggagatgagatgggagcatggagaaaaggagatggaagggagatggatgctgtgaaaagggtgctggcagggctggaatccctgaggaggatcttcctccagctctgcccagcctccatttggtggtcagtaggggtgggcataagaccctaacctgttccccattcttcccacagggtgtggttcacacagttgggggctacatgctctatgtagccacaaccttcaagtatgtgtttgacttccatgcagaggatgtgttctggtgcacggcagacattggttggatcactggtcattcctacgtcacctatgggccactggccaatggtgccaccagtgttttggtgagaagggagccacctggcctagctgggggatggacaagattatcctgggtgactacctcccaaggctgcttggtctagagggagggggacttatacaatcatctgttttctggagaaagagaagtcctgagggggttgcgtatcctgactaggatggtatcttggcttgtctggccagggagtgaagatatggttggtcagaaagggcaaaatactgaacctgagggaatggtagggggatgaatagaaggactattaggaaagactgggaatgac

SEQ ID NO: 100581 - DNA, 1028 bp, Homo sapiens
ctttggttcgaagtagatgccccacgtgcttgttcatcacgagtgtcttttcctgcctatagaaatggaggcaggggacacacatcacctggactcagccccaaacccaggaccttccctggacccagctgagcagtacctgggtaactgtctataccaagaaagtgctaggattttagagtctctatgcctctctggagtctccttctagtcctaggttgtcaaaccatgtgttctgagtcctcttggtgctatttggagtttccttcacggttgcaaaggacttctcatcagggcttcatctgataccctggtaaggtgggcaggtcttgggtccttggcctcatttaatagataaagaaacaggtaataaagctagtgattggcagagctggcaccgaagcccaggattcctgactctttccagtgttcccctctaggctggctcacttggctggcactcttgcaagcaggtagtggaaagagcttctcctgattggctcacctgacatagaccccaaagatgcccagctctgaaatgcactggaccactcgggcagggctgccaggccgtagcaggcaattctcaaaaggctcaggttcgatcttctccatgaggatgtaggaggccctctcctcactgtccttcagctgtttcagggcctgtaccatttcctccccatataggttgttacctgcaatgaaactggccagtcaccctggaccctctgcctacctcctccatcccatgccctcacttttggggccacatgggcaagtcagcagcctcagttcctggcacccgctcagtgaagccagggcatatctggcttctcaggagggaagctcactttgacaggagagcccttactcatgcagtgaacacatcttccactacactgttctgccctggttctcctcctacctacagctgttccttctcaagctccattgctggctccttctcttaaatgctggggtcccaggggaattggtcctccacgcttgctctctcccccatgtacatt

SEQ ID NO: 100582 - DNA, 1048 bp, Homo sapiens
ctttctgcctcctgccagggtgaagaaggggaccaggccatcgccgaggcccttgctgcccctagccggtttgtgctaaagccccagagagagggtggaggtaggtggatctccctttgcagggctcctcaatgagagggactagcaggctgtggccagtgctcattggcacttactctgggcacagtcccgggcatgggggaaactattggaactgacacaggccacatgttggacagtgtcccctaagaccctgtgaccaagtccgggagcacaggggaatctgattaaccagcattgaagggtttggacaagttttacctgaggtgcctgtgggtagattgttgggaagtagagtagggtcatattaggagactggagagaatacatgtctgttttcctttctagtttgaaactccttgaggtcaggggtcatgtctgcctctccagaggagaggatttttttaatctttgtcttaagaggtgggtaggaatttcccaggtggaaaggaggaagagtgttccatacaaaagggacaacctcaagccaaggcaccgggccatgaaagtgtgagatgtttggaggttaatgagaaactggtgaggctggagggggagctgggaggggacagggatttaggctggaaaaatggtttgcatcctgattataaagggccttgaatatatactgagaaattggattttatcttaagggcagtgggaagccattagggagttttaagccaggaagggacacattgatccaggactcaagtggttagcagtggtgggaacttgcaaaacttacagtttctgcattgtagaagatgtcctggaatgaggggagacactggaagcagaaagaccgtggaagaggctgatacagttgttcagaagagcaacgtagaggcctgggctagggctatgactatggggccaactggagagacatgtcctagatagtgagagggtagtggaagggaggagttaaatatgactcaggggtaccttttgcctgattgggagtaggaaggtccaggaggggcag

SEQ ID NO: 100583 - DNA, 1050 bp, Homo sapiens
taaattttaatttgcacagaaattcatcaacccatgacatcattacaatatttcatctgcccactggagaagggtcagaggcatcttcatttttgaagttttctattttcaggaaatcatatgtgatagcatcaggtgtctatgcctgaggtaatctcaaggttcctgagagagggaacatctgttctttcagggaagcggtgttcttattcttattccaggaggtggggcggtatgggggttgaggggagaaacaaaagaagaacaagttctatagtagcctcgggccacctgtgctctttccccagtgctctggtgctactgattgctcaagagaaggaaagaaacatatttgaccagcgtgccatagagaatgagctactggccaggtaagtaaaggaagggggacttctaggtgtggctccaggattaggggtggggcactcagaacatagcatccattccctctggctcttgcccatttttcccaggaacatccatgtgatccgacgaacatttgaagatatctctgaaaaggggtctctggaccaagaccgaaggctgtttgtgtaagcattcccaagaatccagtggaaggctggtttatgaaactcatcctgccaccctcttccccaaaatgattctttcttctgggagatgtgatggcttgcttccttctctcataattcctgaaatatctcatcctcccaggaaattttggagaaagccagccacgctgtgcttctatcagagctgttgacattctggatcagggtctccttagagatcatcttagttttcatatgccctaagttcccaaaagttttcttgcctctcctagtaaggtgaggtcaggcctgagaagctgagctgggcagtcagggaggaagaggagcagctggctcatgctgtgattggtctggatgccactgtctgagctcgagcctggatttgtgttccaagccaagccttatccttttctctaggggccaccaccaggtagatttggtgctacatatttgggtagcattgcagcacatatatttagac

SEQ ID NO: 100584 - DNA, 1098 bp, Homo sapiens
caacacatcaaaaccccatctctacaacaaacaaacaaacaaacaaaaattagccaggcatggtggcatgcacctgtagtctcagctactcaggaggctgaggtgggaggaccgcttgaacccaggaggcagaggttacagtgcgccgagatcacaccattgcactccagctgggcaacagacccagtctcaaaagcaacaacaaaacaaaaccgtaccctgtacaaaaacagaaattatgaaaaattatccccttcgggccatccctcacctaggataatagaatactgacttcttttttatttttattttttttataccgactcttgcttgatccacaatataatactgacttctaacctcagagattagtgttgtctattttcagaatttgtttgaatggaatcctacattatgtattcctttcttctttctctccgcattgtctctgtgagaacctcactgtttcaattctctttgtagagcttagattgtaccttgcctacctcctgccactagaaaagacctgcacaagggcaggagcttggtctgtgtccccggcaccttgccaagtgcctgcacatcatagaaagtcaataaatacctagtaagtgaacgaaccaaacctgatagataataggattttaatctcctatggcatcagaggctggagagctgggctggagcaatttatagaaagcccagaaagtgggaaaaattcttttcattgttcaaggatgctcagaaggtagggtttcttgtcagggaccaacagaattagcctggagaatcagaacctctagcaagtctaacttacacctatcatgtgggtctgagtcctagagttacctactcagtgtatgaacctggggctgagaaaccaagcctcaaaatgggtctagatcttcctcgtaggttcccttccaccacccagggtgcatcttcctgctgagataagctcacaaacaaacatgacaacgcaaagaggaaacccaatgctctgagtgatttgcaacaaatactataacctgcaaggacttaagtaagatactgactttcaatacctgaagagcttgtaatcccagcactttcggaggc

SEQ ID NO: 100585 - DNA, 1031 bp, Homo sapiens
attcaagagattcaataaatatatcaacaccgatgcaaaggtaaagttaacccagggctctgtggagtgtgctgggttgtccagaagttcacctggagtcctggtctgccaggctttaggcacaggttttacgttagagacgacgggggagtctgggcagtctttggcaaacattcattggaacctgctctgtctggctttgtgctagaccctgggaatgcagggatgaaaaccggggctgcttgtgggtagggagtgagggtgggaatgggtggcttgtgcgcctgccgtgacgcagcatggtgggtgccacggtgggagccgctgtagggagggactgggcctggtgtgttaggctcaccgagtgtgtgtgacagaaacccagctcaggctagctgaagtaaaattaaaagtaaaaattaaaggaatccagcacccttgagcgtaaaaccactggagagagtgtcggatctgtgctgaattccggggagtgcctcttagtacctgggtggtgaggggaggtccctcagcttatctgagcctctgtcttcctatctgaagcagtggggctggtagaggtcgctgatgccccttgtagtgactatccccccgggccatggccatacctggccagcagcccactgcctgctgtgagcttggtttctgtatagttccaggtattcctgaagcagatcaacagctccctggtggactccaacatgctggtgcgctgtgtcactctgtccctggaccgatttgaaaaccaggtggatatgaaaggtacatgaaaggcaggctgtcaaggcaagtcatgcagggtaagaatgctggcatcagacaccctgtctccagcagggagacaagaatgactgagggagctgcaccagatgcccacgtggccggcctcaaggtggcggcttccagggcaattggctttgctgccttgttcaacactttaataaggtgaaaatccattgttgctagcaagatgcaaagaaaaccagaaaaagaccttcctcttctgggctggt

SEQ ID NO: 100586 - DNA, 1028 bp, Homo sapiens
tccatcacccaggctggagtgcagtcagtggtgcgatctcggctcactgcaacttccgcctcccaggttcaagtgattctcctgcctcagcctcctgagtagccagaattacaggcgcagcaactatgcctggctaatttttgtatttttagtagagacagggtttgccatgttgcccaggctggtctcaagctcctgacctcaagcgatctgcccgcctcggcctcccaaagtgctgtgattacaggtgtaaccaccacgccccgccttattttttattgagtgtgatggcatgtttttagcaggaagggggccacattagcttaatctgctgttgatcagatgtggaagtgaacagatggttttctaactaaagaaaagtcctcatggtacatgaggacagaggcttagagaagcaggctcccaccagagtgtctgcttgtgttattttggaaccttgtggctgtggtcctaacattgaggctgtgcatgtgtttcaggacatcaccttgaagatacagtttttgaggcttcttcagagcttcagtgaccaccacgagtaagtacaagagtgtccctgcaaggagagttgttgggctgtcttcggaaggcctcgatctccttgtctggtccctgacctcagctcgagaggaggccctggagctggtggaagcccactgtcccctcagtgttagcaggtgtgacactgcagtcggacctcccgtctttccagacttccttatggcaggcactgccccaagctttcttctaaccctcatagccaccccaggaactgagtatggaagtcgttggccccttactacctttggaatcaatggatttctcaacctactgcccctctaaagcaagagtggacagcgtggctattcccaggggccggcaggaacttcagacaggcaaagccgactgcttactgagcagctggaggattcttccctccacaaggaggtgtgctcccatttttcttgaaagacattctgcgctcatttattttttaaccttcgatg

SEQ ID NO: 100587 - DNA, 1017 bp, Homo sapiens
aggagacaaatcttaaggaatttgtttaaggttacaaagtttgcacatggtaaagctaagagtcaaacccaggactcttgcatcccaaaggactcttgaatcatatgcaggactctctgaatcccaaactcatgcttctgtgataggaactaccggacattatgccttgtaggattattgtgagcattaatgagcaaagttagaaagtgggtttgtgtgtgctgggcataggggatacacggatgttttcttcagaccctggccctccttactgacagtactgatacttgtcctgaatatcattatcgtgtgtactgagcacgaggttttgctagatttttcaagcacatttgtcttaatactttttccttcctatcccattcaggttcacagaatgattgcagagttcaagctgatccctggacttaataatttgtttgacaaactgatttggaggaagcattcagcatctgcccttgtcctccatggtcacaaccagaactgtgactgtagcccggtaagcaggagacccccggggacagatggggcctcactggcttggagtagttgtttcaagacctgctgctgaccctttgaccttttttcctttgggagtagagcagaaactaaaatcatatcttatagtcccctaattggaagctaccttggagtaggatctgagtgaactccactccccaccccaacctatgcagaaatcccttttaagatcttcctaggctgggcacagtgactcaggcctgtaatcccagcactttgggaggccgagcgggcagatcacttgaggtcaagagttacagaccagcctggccaacatggtgaaaccctgtctcactagtgtgagagacacttgcgtctctcactaaaaatacaaaaattggccaggtatggtgttgggtgcctgtaatcccaactcttcgggaggctgaggcaccagaattgcttgaacccaggaggcagaggttgcagtgagctgagatcacgccactggactccagc

SEQ ID NO: 100588 - DNA, 1580 bp, Homo sapiens
tcaggagttcaagaccagcctggccaacatggtgaaaccccatctctactaaaaaatacaaaaattagccaggcgtggtggcgggcgcctgtaatccccactacttgggaggctgaggcaggagaatcacttgaacccaggaggtggagtttgcagtgagtcaagattgcgccactgcactccagcctgggcgacaatgagataccatctcaaaaaaaaaaatattaaaaaagtagccaggtgtaatgacacgcacctgtagtcctagctacttgggaagctgaggtaggaggattgcttgggcctaggagtttgagtctgcagtaagctatgatgacactactgctccgcagcttgagcaacagagtgagaccctgtctcttaaaagagagagatgattaaactgtggggtaaaacggcgggaagtgattgaatcagctgcttgtatcagtgtagataaacttcaaaatgttggatgaaaagtaaggtatagtatggtatcattcacactgtgcatgcagagcagtaacatgtattttaatggaaatatttgtaagtataaaaacatgcacgggaataataaacacagagttcaaaataatgtttacgtctgcagggagagaaaaaaatgcgactggatgggggatacacagaggcctttagctatatttgaagtattttattttttaaaaaagcaaatctgtagcaagaatggtaatttatgatttccaaaacttgagtggtaggcatttcctttttttttaaataggcaaaatataccacaagaacaattgaaaacagtggtgctcaaaaggtaaatttagtcctcagactaatcctgtgaggtagattagttccgttttacagataaacaagcaaagactcgaaaggtttttgtaacttaaccaaagtttcagagctgcaagttacagagctgggataggaacctaagtgatctagccactaagccccgtatgtaaggggatgcgaaagagaggcacatccaatctcttgagtgaattgagcatggggattgtttcatttttgtcttctgtaggaaatgatccgactagatgaagtccccaatctgagttccttagtatccaatttcgatcagcagcagctcgctaatttctgccggattctggctgtcaccatttcagagatggatacagggaatgatgacaagcacacgcttcttgccaaaaatgctcaacagaagaagagcttgagtttggggccttctgcagctgaaatcaatcaaggtaaagtctccaagttctcagaattttgagattatagctctgaggcccttactaaatcatctagttttttttctttttcttttcttttctttttttttttttttccttttttgagatgggatcgtcactatgtcacccaggcaggagtgcagtggcacaatcgtggctcactgcagccttgacctccccaggctcaggtgatcctcccacctcagccacctgagtagctggaactataggcaggtgccaccacaccgggctaatttttgtattttttgtagagatggggtttcgccatgttgcccaggctggtct

SEQ ID NO: 100589 - DNA, 1059 bp, Homo sapiens
tgtctctactaaaaatataaaaattagcccagcatggtggtgcatgcctgtagtcccagctacttgggaggctgggacagaaaaattgcttgaacccaggaggcagaggttgcagtgagcagagattgtgccattgcgctctggcctgggcatcacagtgagactccgccttaaaaaaaaaaatcttaaaatttaagacaaaacaaaaaaccataagaagtgggctgggggtggtgggacctgttttgggaaccatatactgagttagacagggctagaggaactggtgagctacaagttacagttgccaataatagtagtagcttacatttgttttgtactagggaaaaggaaaagtggaagcagttgttccccaatgccccctgcacagcaaattcctgtcctccattactagaaatagaggcgagtatgggattcatgagagcttctaggaatcatgcactcgttttgggcacattcactgatacccttgctaccaggtcctgtgcattgagtctcaggagaaagggtaggatatatgccttcatcaaagtatggtcagattatttgggaaatagatgcaggaacagattattaaaagttcatgtgatctgtgcagtgaaagagaaacacccaatccagtggaagtaaattagtgggatgaaggatagcaggtgttatctgagtagcacggggatggttcaaaatgagaaaagttgatgtagtacatgccatttacagattttaaggagtaatgagtgagaatagaaccaaatagcacaaggcattccataaaattatcattcttaataaaagctagcaatagaaggaaaacttataaactatatatagggtatttattaaaatttaacttataggatattaaaatttacagcaaatattgaacttaattttaatgttttggaattatttctggtaaagtcaagaaaaagacaagaattcttgctctcactctggataaatggtcacatacatgtgtacacagagagtacctgtaagaatgttcattgcaacattgtttaatagtgaaaaactgta

SEQ ID NO: 100590 - DNA, 1059 bp, Homo sapiens
atattccccaccacctccaccttagtttattttctccgcacatagagtgatataccatatacacggctacactattctgtaccttctttcttcttctttttttttttttaattaaaacaattttaggccgggcgcagtggctcacgcctgtaatcccagcactttgggaggccaaggcaggtggatcgtgaggtcaggagttcgagaccaacctgtccaagatggtgaaaccctgtctctactaaaaataccaaaattagatgggcacggtggcaggcacttgtaatcccagctactcaggaggctgaggcaggagaattgcttgaagccgggaggcagaggttgccgtgagccaagatcataccactgcactctagcctgggtgatgagctctcaaaaaaaaattaaatggttagtgtttcctggtgtgattgtgccataatttatttacccaggccccagttgactggcatttataatttttccacaccatttctcttacagacaaggttgcagtaaagatcttttacatatttttgtatacatgtgagtatatacctttggaacaagaacgtatgttttttattgtttataaatctgaagtttacctacctaagaagttttgtcagtttatatccccaggaacaaagtatgagcgtctgtttacccataccatcaccaacatactgtgtttatgtgtgtatttttatagactttgttactgaagtataaccttcatacagaaaagtacaccaataattaccacaaaatacattcacttttgcactaccacccaaattaggaaatagaacattaccagtacccagaagcccccttccacaaacagtgtattttaagtatttactaagcagttatgagaaaagtgatatttttccatagttttttttaatcagctttattaagatatggttcatataccatacatttcacccatttgaagtacacaattcagtggttcttagtatatttgcagatatgtgcaaccatcaccacagtcaactttagagcattttcatcacctcaaaaaagaaactccat

SEQ ID NO: 100591 - DNA, 2180 bp, Homo sapiens
ggtgagggcaggaagggagcaggggccaggtcatgacttgcatttttatcctgcatgaaatggagggctcacagaaagttgtgagtagagaattgacaggaagacttatgttatacagatactgtaggagcttggtgtgtgtctcacgcctgttatcctggcactttgggaggccaaggtaggaggaattgcttgagcccagggatttgagaccagcctgggcaacatggtgtgagaccctgtccctattttttaaaatagtgtgtgtatataaactgcagggctaagattggaagctgggagcccatttggaagcttatgtgataatccaggtgagagatgatggtggcttgggaaagagtgaagttctgaaaagttcagtgatttgctcacaggccctcagctgctttgtggcagaacaggccttcttaagggattgcctgacccttactactaaattgtgatggtgttccagcttgcttccttctcccacatgtcagatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataaccactggataatttttttatttttatttttttgaggctaaactataataaattgcttttggctatcatattttggttatcatgttttacatattgggctgtctcatgagatttcattcaaagaaaggattggtggctacgggcaattgtgactctagttaattttctcatgcagctggagagacggctaaatgcggttagctggctccaaagatcctaggggtcgatagttgaatctcccttccttttctggtgtctttgtggaaagtgttgtcataaatgtatttctttgttagttcttgctccaacatgtgcttcttacttttttttttttttttttttttttgagacagagtctcactcagtcacccaggctggagtgcagtggtgtgatctcggctcactacaacctctgcctcccaggttcaagcaattctccagcttcagcctcctgagtaactgggactataggcgtgcatctggctacaccgcatctggctaatttttttatttttatttttattttttgtatttttagtagagatgaggtttcaccatgttgcctaggctggtctcgaactcctgacgtcaggtgatccacccgcctcggcctcccaaagtgctgggattatgggcgtgagccaccatgccccggctgcttcttactctttagttgacctatctatccacctgtccttccaagcaacgaagatttattaagcaccttttttcttttgagacagggtctccctctgtcacccaggttggaatgtagtggcatgatcacgactcactgcagcctcgacctcccaggctcaagtgatcctcccatctcagcctctggagtagctgggaccacaggcacacaccactataatttgcctgatttttaaaaatttttttgcagagacggtgtctccctatgttgcccaggctgatctcaaactcctgggctcaaacaatcccctgcctcagcctcctgattaactgggatttcaggcgtgagccatggggctgggcaggcacctttgtgtgccagccgcagccccagaggttcagcagcaaacaaggcaaacagtttttattcttgtgaaactaaatttctagcagaaagaaataacctagtaaatagataaagtaacattgtgatcagttccatgaagaaaacacggggctgtgc

SEQ ID NO: 100592 - DNA, 1026 bp, Homo sapiens
gccatggtgtccttaatcccacctagctgttagaatagttagtgttggcagccaggcagcctgtgcttagctaaagttaggaatcctgctactaaggaggaagcggggaacagatattgggaattaggcaacaacctccgccaccttctctatgccagaacctggccacctttctctcccttgtggtggaagtcactggtcagccttaatgctggtctccactgagcttcaagctttgggtatactggctctgaaactcagcactgggtgaggtatcctgtgttcctgctagttggggccttatggacaagatatggaggggagtagtccctcacggccctaagaggccccaggccatctctgtgcagccactgagtgaggagggtctgctttggactttgcagaacttattgaaagcgcaatgtacctctaccgtgccacgggggatcccaccctcctagaactcggaagagatgctgtggaatccattgaaaaaatcagcaaggtggagtgcggatttgcaacagtaagtgtttgcatggccccaagaactgggaagagtctccccttgctgctaaaaagcctctttaagggtagagctttgggagttctgacatatcagcactagaagggaccttggagatatacataatgctcatattttacagatggggagaccaaagaacagagaagctaagtgccttgctaaagatctcacagctagtagaggtagagctagaattagttccttgggatcttgaccccggcccttggcattcctcccacagtggagatctttgatctgtttgaataggtgactttgaaaaggtgagtttagcgaaaagttttgtgagacactaaaatagattttaaggggaatccagagtcccatagccctatattcaaacctgggactccttaacaaagcagtcctgcttagtctcacagatatttcttgaatgtctttcacatgccaggcactctgctaggcccaagggttacagcagtggccttgctctcatggag

SEQ ID NO: 100593 - DNA, 1061 bp, Homo sapiens
taaatacataaacgcgtaaatggttgtttattaaatatcacgtactatacataattgtatgtgttatacttttatgactggcagcacagtaggtgtgtttacaccagtatcaccacaaacaagtaagtaatgcattgcattataaaattacaacagctgtgatatctttaggctgtggtgatttttcacctctattataattttataggaccaccatctctacagttcagtgttgaccaacatgttgttatatggcacatgactgtatatagagtttatttagtactatccatggtttcagacatccactgagggtcttggaacgtattctcctcacataaggggggactactttactcatttattcaacaaatatttattgaataccacggatgtaccaagcattgtgccaagctctgaacatggactgtttcatataatccttacaactcctgtttgagattatcttatttatttgcatgtatatttggtactttgttcattcagaaaatgtttattgctcattgtactagtgtgggggattctgcagtagacaaaacaaagtcccaggcctcatggatttacaatctaggggagagatatgagggataaattcaagttcctactagaatgtaagttctctgaaggctggattttgtcttgtttacaaactcataggagcctggaacctagtaggtgcttagcgaatgtttgtggtataaataaatgactgaaaaattccacagatacctaacattactgtattagaccattttcactgctgataaagacgtactcaagactgggtaatttataaagaaaaagaggtttaatggactcacagttccacatggctggggaggcctcacaatcgtggcggaaggcgaaaggcacatcttacatggtgcaggcaagagagaatgagagccaagtgaaaggggaaacctcttataaaaccatcagatcttgtgagacttattcactaccatgagaacagtatgggggaaacggcccccatgattcaattatctcccaccaggtcccttccacaacacgtgaga

SEQ ID NO: 100594 - DNA, 1038 bp, Homo sapiens
tagaaccactctgtcagcttcttggtggatgttcttattgagttaatttatggaaatacgtaaagcacgtctgtgtcttcagatagtggaatcacatgctgggtgctgagaaatcagacagattgcggcaacagcaaattctcatctcccatctcacactcactctaggcaggacataaacactccaaatcatttttctttttcattttttgctcaatgtgtataattaagtcctcataaatgtgcatgagatgcatctctactatgcagatgtacaggaaggctggccatgatccagcattgcccttccctctcagggtctgcatgtttcccaagaagcactggggcacctgccctgcatctccctgggcagtcagggttgggggtgagtagatccttctttggccatcggccttcccgttgggaccgtgtgtctttctctctctcaggtcggcaaccacattgatgtgctcactggcaagtgggtggcccaggacgcaggcatcggggctggcgtggactcctactttgagtacttggtgaaaggagccatcctgcttcaggataagaagctcatggccatgttcctaggtaaaaatggcagagtaagggagcttttcccctcatttttcttgctgatgtgtgatttgtttaaaaacttttttttgagacagagtcttgctccatctcccaggctggagtgcagtggcacaatctaggctcactgcaacctctgcctcccaggttcaagtgattctcatgcctcagcctcctgagtagctgggcatgtgatggtgtggactacaggcgcacaccatcacatccagctaatttttgtatttttagtagaaacggggtttcaccatgttggccaggctggtctcaaactccggacctcaggtgatctgcccgccttggcctcccaaagtgttgggatcacaggtgtgagccaccacgcctggcctgagtgcctgcagaatcagttctgaattcagagtcactatggacttacactgcccacttcatgcccactacagc

SEQ ID NO: 100595 - DNA, 1026 bp, Homo sapiens
gagagctgaggatagcgggtgagctaggttcaggtctcactcatggctcatggctcatggcttgagcgtctccttgcagacattgtgtcctgtgtgattcatccctggaggaaactctggaaactctgcctagctgctcctcctttataatttaattatttttggtcattggtcattttataaaaaaaggtcaagaaacaggattttgtcactcctcttctttttattacagcctgactttttctgaaatattgcttagagcccttcctggttgtgacttgctctcccgctggtgcctgccagattgcaagtttcttgtctgtggcagacacagttgctagaccctgtggttcttggaagtgtcgacacctttgttcacagtttggtgacgcataggctgctctggagttgtttgacctttaggcccagagaggaaatctctgcctctggctggttgtccagttctcgtcttgaaccagaaggcacttgggtgccacttgggtggggcgggcagagaactggactggggctggggtgggcacaggggaggcgttcccatcccagctctgtttgactctctctgtgtgacctgtggctgaattacttctttacaggcatggttttccctacctataaatcgagggtcatactatatccgtggtttagtggtttatatcctattttgcttccctttaaaaataatttagcccctatactctttatttaaagcagagatctttatttaaagtctatgaatggctttgtttattattattattattttgagacagggtctcgctctgtcacccaggctggagtgcagtggtgcaatctcagctcactgcagcccacgcctcttgggttcaaacgattctcgtgcctcagtctcccagatagccagaattacaggcgtgcaccaccacgcttgcctaatttttgtatttttagtagaaatagggtttcaccatgttggccaggctggtctcgaactcctggcctcaagtgatctgcctgccttggccaccc

SEQ ID NO: 100596 - DNA, 1096 bp, Homo sapiens
caggagtttgagaccagcctgatcaacatggtgaaaccccgtctctactaaaaatacaaaaattagccgggcatggtggtgcataatcccagctactcggggctgaggcaggagaatcgcttgaacccaggaggcggagtttgaagtgagccaagatcacgccactgcactctaccctgggcagcagagcgagactctgtctcaaaaaaacgaaacaaaaaacctaagacttctatgcgtagtttgcgttctttatattgtgtccatttaaatgacaacatcgtgactcttaattgggacctaggaatttacttaaccagtctcttggtatgaagtctctagatgatttctagctctcagtgttttcttctgctgtcaccaatcctaggacagaaactggaggtcttaagtggaattagtgagggccacatcaacataggatcccagactctgaatctgcctccatgcatgtaagagcctcattgtcaggtctcttttttatttccagattttggggaatgtctcagaattccaaagagtggttgaagtgctccaggacagcgtggactttgatattgatgtgaacgcctctgtgtttgaaacaaacattcgaggtaagggctgctctctaggacctttaaaagaaaaaagagtgtgaagttgcctctgtaaaccaagaagtggtaaataggattttaaggactgaccatgccaggacccttggccaaaacctctgaccgacagagctcttcttccctcctggagggtgaggtggggaagtctcaggatttccccatcagtttcagatatgaaagtgagcaggagactaagagactggaaagaaatacaccagattactcacctctttaatatgtatttgatactaggcatacagctatgaacaagaaagatatgatccttgccttcttggaacttattgtctgtccaatccaattttctgcagtgatggaaatgtcttatagctgtgttttgtccagtatggtagccacgaaccacatgagctattgagcatttgaaatgtatctactacaactatggaattgaatttttaatttcatttaattttaatgatatt

SEQ ID NO: 100597 - DNA, 1031 bp, Homo sapiens
agcacatagaagtcttgataacaatctttttgataactcatagttttgcactgtttataacacagtttaatcacccattaatgggtggacagttgggttctttccagcctcttgctgttctaagcaatactgccatgaacactctcaaacagctgttcactgtgaattaaattcctagaggtgaaaattggtgaaaggcctgtgctttaagctgcaatcttatactgcctcccaatggtagaggagaatgccagactataggtgatgtatttaattacaattgagctacatcagccaaccctcccaggtgcattaagtgggtcagagaatacctgcgattttcactgtggtttctctgttgtgactgtaagtgggacaggcagaggcattactttgcctcatttagttttagggggatcagatctagggcagccataatatctggtatttgattttcttactaagcggctgggatttctgtccttttgcagtttttctctgactctaattgatgcactggacaccttgctggtaagtatctcgtctgtttcttttcctttccactgttacataaccaacatccttcctcttttggcagcgtgactgtgggtgaaaaatgaattcctctcctaggccttttatttgcatctcatgattctgaagcgtccggctgtggttgcctagctagataggggaaaaacgaactacaacttatgcagattcatttatttagcaaacatttatagaggacctgttatgtacggagaattgtgataggcttgcatagctctatgggggatacagagactttgacatctcctgttttcagaggcttacattctagtggccatgttcaatgataataaaagggtatcaggctgagcatggtggctcacacctgtaatcccagcactttggaaggccgaggcaggcagatcacctgaggtcaggggtttgagaccagcctggccaatatggtgaaactccatctctattaaaatacaaaaaattagcccagcatagtggcacat

SEQ ID NO: 100598 - DNA, 1070 bp, Homo sapiens
agagttgtaagctcttaaaagggacaggaattgctcactcggggagctccgtttttgagaagtgagtcagctgacgctcccggccgaataaagctccttccttctttaacccggtgtctgaggagttttgtctgcggcttgtcctgctaggtaataatggtaaaggctgaacatttctcatgcttaccctgccttcatacttaataaggttgttgaaaaaaatgaatgagagaatgcattttaaatgctccgtacagtactagtacacaataagtgctcaatacatgctagctgttattattaaaacattaattaataacagtagtaacaacagccactgactttaagacacgttgatcagtgttgccgaaaccgtacatccgaagttgctcttcggccgcgtttcgctgcccattgcattcaggggcttgtagtccggaagtgagaggctgatttctcagcgcgcaggcgcagtggcgcggattcccggaagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacaggtgaactgtgacccgccctttcgcagttggggaatgggaagcgtgaacccggtcctttccctttccgtccatcccagaccccgacttgctccgacacagccgctaggtcccagggagaaatcagctagtgattcccactttccgccctgtatcttgttcttcccccgcttgtttttgtgttcttgccccatgcctgatttctcgtcccccacccagggagcgagtcaaggccatgttctaccacgcctacgacagctacctggagaatgcctttcccttcgatgagctgcgacctctcacctgtgacgggcacgacacctggggcaggtagtgcgagcggaggggcaaggggcggccagggtctgactctctgggcctcggcgggcgggtcag

SEQ ID NO: 100599 - DNA, 2220 bp, Homo sapiens
tctcattcgtcagcactccactcccctgctgggctccagacatggacttctgtccctcaaggcacagctggactcatccctttccccaaacctgcccttcctccggcttcatttccatcaatacctccatcatcaacccttccgcgagacactcctggcccctcctctccctcatgcctcacaaccgaccagccggaggtctaggtcgatgacagctcctaaaaagctcctgaatgaataatgaatgaatgaacgcgagcaggctaggcgtggggccaggcggggtcgcgcccagaccgctcgcgaccatagagtccgccggaggccggaggtagaggggctggatgcgtggcggggagcgccgggctctcccggaagtctccctggacggaagtggaaacggaaacctttttagggagtccaaggtacagtcgccgcgtgcggagcttgttactggttacttggtaagctggtgtgaggggaacctgggagggtcagctccggtcctgggtcgggaggggtgggggccagaggattcagggccggaggttctggtgggggcccagtgggcgggacccgaggacggaggggccgggaggccgagaggggcggggtcgcggcggggcctgagggacggaggccgggatacttgggaaaggatccgccggccttgaactcccgcctccgccgcccctaggcctcatggcggtccgagcttcgttcgagaacaactgtgagatcggctgctttgccaagctcaccaacacctactgtctggtagcgatcggaggctcagagaacttctacaggtgcggcgggagccccggggcttacggtggcggggaggcgtgcgcaggagtcaagagctccggcagtgggagggtgccggcccctctgccccgccaccaccgagtccatgtccctacagtgtgttcgagggcgagctctccgataccatccccgtggtgcacgcgtctatcgccggctgccgcatcatcgggcgcatgtgtgtgggtaaggcaggtggaggacgccgagggagggagtggtctccaagcaccattaattacacccccggagggaacccggagtgacctagggattcccagggtatcatctgttatctctgggcactatagaatctctcaggccaagcgtcaggagatcggggcaaccctctagcaaaggctgctggataatagtaataacaaataatgtaaagtgctttcactcctgttctcattccttcgtcacaaagacactagaaggtaggagttactggcctaacttgactgatgaggaagttgagacttgacctaagtgactcagtaagttccacacctagttcctagtgttggagaaggatttttctcttttttttttttttttgaggccagatttttgctctttcgcccaggctggagtgcagtggcaagatcacagctgtctgcatcctcaacttcttaggctcaagtgatcctcccacctcagcctaccaggtagctagggccacaggcacgtgccaccacacctggctaatttttacatttttggtagagacgcggcctccctgtgttgcccagcctggccttgatctcctgggctcaagtgatcttcttaccttggtctcttaaagtgttgggattataggcgagagccactatacccagccgaggatttgtatctcatctctccctgccactgactgggcaaggtgctttctctttctaagcatccatttctgtctctgtaaagattagctaagatatgcggtcttcctgctcagttacgttggaatcttaaattccctttaccacatctctaccctaccttcctacctgtcagcactgttaattctggtcgttggtcctttcctttttattattattattatttttttttgagatggagttttcgctcttgttgcccaggctggagtgcaatggcacgatcttggctcactgcaacactctcttcaagtgattctcctgcctcagcctcccaagtagctgggattacaggcgcatcccgccacacccggctaatttttttgtatttttagtagagatggagtttcaccatgttggccaggctggtcttgaactcctgacctcaggtgatcctcccacctcggcctcccaaagtgctgggattacaggcgtgagccactgcgcccggccggtcctttcattaagctggatctgtcttccattactgctg

SEQ ID NO: 100600 - DNA, 1047 bp, Homo sapiens
tgactgctttctctgaaccaccttagtgaaattatctaggagatcagagacggcttggcctgggacggcttggtctgggacctgggatggtcagaagcccccctcatgccccgtccccttccttcctctcctctgggaggctggttcctgacgctggctcctcacctctgccctgcctctgtcgcttcctccttccccctcccctggttgcagatacagtacctggactccatgaacggggaggatctgcttctgacaggggaggtgagctggcgccctctagtggagaagaatcctcagagcatcctgaagccccattctccgacttacaacgacgagggactttgatgggctgggccctccgcacggcccgccagctggcttcgaggaacctccaggagagaagtgcctgttggtccaggaccctgcagaaagtggcctgaactgacctctgaacagcatctgtcaaatacctggccccatttgtgttgagtttcctcttagtgtgcccaggagtctgatctgctggggtacagggctgggagaacccctagctctcccggggtgtcctctcccttaggggaagccccgagtgagagtcccccagcacacactccccaaccccctccagcaactacatgtgactgatagcttttcccaaaggccaaggaagggatggtgtaggttcaaaagggaaaccccccagggcctgctgtggcctaggagcagattgtaatgctgccgagtccggtcggtgaccacgcgttgtccctcggctttcagccatggggttgagttggccattaaaagaaacagagacttctctctgccatggcccttctttattccagggacttagaaacttgcctgagatggtggacgcagtaatgagggcaccgcgcagctcagttagagacggagaaagggaagaggctgggatggtctctgctgctcttgcctctagttcatggagatgtgtctctgttcaggccaagatacagccagccaggcctgtcgtctgggacccaggaggcctctgatgaccaa

SEQ ID NO: 100601 - DNA, 1008 bp, Homo sapiens
gcatggccatcaagtgacacagctggcattcgaactctgtgctctggctcccagaccccacggttttgactgtatccccgctgtctgccaaagcatgctcctaatctttgtatccaacagattacacttaacaaatagttcaagaatgctataagtagagcaggtaacttcatctgttttgaagaagtagaagattgagactttggtttagtcagctgccaccatcactgatcttggcagaggtggaattaggacttgatctcccttctaactccaagtcagcacatcgattccacacactaccttggcacctggacagagcaacttctcagggcctgttccatcagccaccttcaccccaggaagcaagactctcagccctccctcctctagaggtccaagctagaaaatgtccttagctggtggctggggctcttattttgctctgtaatctttaagcttcccaacagaagtctcctctgccaaaagaggcagcgttaggcacacacacacatgcaagctctgagcctggccctctgtggccccagcaatcctgctgaacatcctgttcccctacttagggagaggctgggcccagagttgggtaagagtgaagacaaggtagctggctcccttcccccaaggaccagttgccttgccttggtccttggaccaagcaagaaggcacagtccatgcccacctccattcctgggagaaacatacattcacaatattcccagcccgtgccctgtggacagcagggggagcattgctgctatggacagcagggggagcattgctgctactgtttctcttctcagcctctcaagtgttgcctgggccaggcgcagtacggagtactgcctgagtcccagctctgcatcacctaactggtggcttggcccctctggaccccctgttctccctctgtatgtaataaaatgaagggattgggccagatacccttgtaagaccccttccacctctactgtgtgactgccccattt

SEQ ID NO: 100602 - DNA, 1108 bp, Homo sapiens
gttattggcacttggtaaataatgaatgatgggacccgtctccagacttgaatcactttggggcacctgtagatgggggagagggcagacttagtagagaaaatatgtgtgctaagtcttagaggataaggagttagcatcccttccatcagtggataaagaagagaagaattcctggcagcagtatgactaagaaatagatgacagcatgatgtatctgtgcacatactttactgactgcagggtgaagtaagatggggaggcaagaggaggggaggcaaaaaagatggccaagagcagatcactagaagccttgtagagtccatggaggagttaaaacttgatctcccatcagtccctgtatccacatagtctggttcctctgttaagcagtcacataaatatctttaaggcagcaacagtgaaaaggggaaagagagcagcgaattggcctcaaatgaactggcatctctttaaagctaatattcctccttgagaatgctactttaattaaacatgtgccctgcaagattcattattgccttacttgtgttctctgttggttgtctcattcattaatctgccgattagtaaccctgaactcttgcatcccttccttttttttgcattccctttttaatatactatgctgtttcccctgggacataaactccaggacccgtccctggcctgctcgtgtttgttttctttgccccttgtgcctgcctctgctataatatttgtagtatgtgttaagtaatccttaaggtaacatttttattatgtcataaaaagtgcatggcaaatatattataactcatggactttgtttaaaaatgaacggataatttattgagtgtgttacatgagcctcactcccctccccatttcagctgagacctgctgctcatttagccaagcctcctattgagtgctccctccctgtgacatgctgggaaagcaggcctgtggttggctagaggtgacatcatagtttatgtactcaataaaaatttaattaagtcattacaggaattgcagtcatcatttaaccctctgatttcttctgtttagtttattattaaacattcagtaataccagtcactg

SEQ ID NO: 100603 - DNA, 1021 bp, Homo sapiens
gggtgtggtggtgcgtgcctgtaatcccagctacttgggaggctgactttagctaatttaagcaaacaaaggatttattggaaggtaactaaggctcatggaatggagagtttaacaacagagctcaggaaggaaagatacagggcagctaagggatcttagcaataggaacttatgtatagtctctttggggtgacccaactttactattttatttatttattttttagaaatgaggtcttgctgtgttggccaggttggtctttaattcttggcctcaagcagttctcctgccatggccttccaaagtgctaggattacaggcatgagccactgtgccctgccaagggtgatccaactgtagcttccttttatatttggttgtttgtactctcagaagcaagagtcagattagctaagcttcagctatgtgcccatctctgtgatgagaggacagcattctaggatcaacagcctgccaactcgtggaaatgggaaagagtaggtcctgaacataaggaagaaatgcagagagagaaacctcagtgtcacagtacttctaagatctactgacccattgaggcagatgatggaggcaacctgaccaatccatggaatagcctctgggtgtttctcttggccatagaatcttgaacgccctggcctgtgaccagtgccaacccattgtaaccatatatatctgacattctttcttgaaacctctctggtttctccatgttcattcttaagtacggttggtaagacaaagacttttgactattaaaataaatgaggggagaaaactttttgacctttgcatatggcttttcctttaatatagataataataattaccttttcatatttctgatttatctgttcatgagaaagatttgctctgggatgctattacatctacttggtcagacccttgcttcatcctgttatttttttattttgatatagacataatactgtgcatttgaccttgtcgaatctcatcttctttttaaggacagtt

SEQ ID NO: 100604 - DNA, 1208 bp, Homo sapiens
caggatgctgtatttggacattttcaatagcacctagcataagctgtcatatcttgaagggatttataggtgcatctgtgacaccacactggattctggctttctggaggacaaagatcctatctttcatccgtctcctgttctgcctggcatgagtaaggcacatagcaggcactcagttgatgttggctgaatcttttaggatgacttgggcagagcagggtgggcataaatgctttagtttctccatctgtgcctggggaaatagtaaccccttattttggagcctttgaggacaatttaaaacgatatgtgtgaagtgtttggagccctttgaaaggagggtactggagaaattaatggtgtttttgctgttcttgggaaagccctttgtggttcccagtgaataaattacttggagtgagttttctcacacctcctactctgctctgttcaccgtagcttttttttttttttttaaataactgtctgctgtaatacttctttgcccatgacttataaagatatatatttttggtgttggacttttgacccctttctgctcccaggagagaaattttgatcagaataataaaaggtgtaaactgtgtgtgttgccccctttcctaggccttgggcagtttagctgctggggttaggaatcagctggcttgtggtatgtgtatggttatggggcaagtaggagatgattcctgttaagcgctgagcaggcttctgtctcctgctcttcttttcatccctgtcccataccgttttgctaagattcttcagatttcaaatgaaccttgttgtctttggcattttcgataggtgtttgtggctatactccttctccttcaaagacagaaggtgtttatcgtctcctgtgctttaggtcccaaggtgagttggctgccagagaagagcctccctctagaaggacagtgggagaactgaaaaacactcaccaatcttggagctacaagagtggagttagacttagttccacaattaaccagcaggctccaatgcagagcctggaccaggttatttctaagggcctttcctgcttgaaaaaaaatccatgagataaaaattttccagcccagggtagaatttccaagagtgaacacagtttgcaaaactttctacttttctccaagcctctcttgccctgtagcactggaagaactggctccgtccctaat

SEQ ID NO: 100605 - DNA, 1242 bp, Homo sapiens
taacatttattagataaatcatacctgctttattagtctctgatccaagtgtatatcagtgcagtcctgcaggaattggggaatttttcccctatcgcattttatccagccgttttttctatttggattgttgtagatagggtgctgccccataagggagtgttttagatcagcgtttctcatactttaatgtgcctatggttcacctgaggatcttgttaaaatacagattctgattcagtaagtttcaggacaggggtgagaaaatctacagttctgaaaagcttccaggtgatgcggatgttgctagtgacgcagggtggggtaggggacaatagcaaggttttaggtggtcccccaatacaggctcttaaattgccttcatgaagagaagtgcccaaattccggtttagttacaaagactataactaaaggatgatggttttaaaataatagagatttggaagagttggggaattactattactgctttctgctatagttgacttgataccttctttctaacctcatggcataaatagacatgccttatataggcaagacaattgtatattaatcactgggttgtgagtgcatgcatggatgagtgtgagtgcatgtgtgtgtttgaggggatctcagtcttccgtgtgtgtacaacctataaatgggacacgtggctagggagaagtaataggcagtgtagagccagtctggcctggttctcaccctgactggcaaatctttcctcttctgtgcttcagtttctgtattaaaagaaaggtggggacaggggaggcctaactacatgagccccaagttttcagctttttttcagcttgaaaatctatggtttgaaggtggtaatttgcaaatctatctctgtgttatttggcatcccaggtgtacctctgtaagaaaacatataaaatgtagaatttataaaaccaatcaatgtagtagtgatttttctcatgccaaaaacttagaggtgattgctttgagtggattggtgtgtggaagatcaagaaataagagagccactttcgagttagtgatgaataataaatttgcatcaaaaactcctttgaaattagaattctattctgatttggtgggaaattttttattttacaaaaatttgcttttcaccaactttttggagcccaactattgtgaaaaatggagcagactcatatatcatcgtgaagctggtacaaaaagcaggtgttaaatttgagg

SEQ ID NO: 100606 - DNA, 1007 bp, Homo sapiens
atacaactgtgataggtgcaatgagaggatgtgacaaggctatgtgggagaagctgggaacctcatttagtttaggggtgggtcagtcagggaaggcttcactgaagaggacatttacattgacacctaaagggtgagtagaagttagcaagtgaaagagtggatgaaaaagccttccaggtagagggatctagtggttttcaaactttttatcagcagagtcctttttaaaaatgaaatcttatgctcagccaccatatatgataaatatgatgaaaggaggtgggaatgacctgcttgcttcacatcttcacaacatgtccactgaaaaaagactgttaagtagttccatggaaactcagaatgtagtttaaaaactacagatctagtccaattctctcattttgcaaatggggagacagttttggcaattttaaggaattgtctcaggccacttactcagtagtggctgacccgagacaactctgaagttaactatggttacctgccccttctaaacactttgcttcctttctgattgtcctatttggtggtcaggggataggggtctcttcccctgagtatgaacatgtcatatgagcacagcaaacatttacggatcaccagctgtatgatgggccccgtgtttcttggcgctcactatctgtgtcctgggagaggccacaggtaaacctgaaactagcacagggtgatgtacagattatatgggatcacgggggaaggggggttgcctggggatggtcaaggaaagcagttgccttggccttctgggggccagaacagactatatgggattgaggagtaattaagaggcaaagaagttattgtaaactacttttcaagaagtttcaaatgaggggatgatcgcttgagggaaaaacagttcagaagggaagcattaattgttttttattttaaaatggggaaacactggaatgatttcataagctgaagggaagaagcctttgggaaagaaaagaaggaat

SEQ ID NO: 100607 - DNA, 1032 bp, Homo sapiens
tttgaaaggatgtttactagataactttgtcttggccagctgttcattattgaaggttcttcagttaatattgtagtattgaataataagactttttacgtatttaacatatcatgtttcaattcatagcctggtgtaaactacttataaaacttaagaaaagtttataaataactgttttatactattagctcatatagtatggttttatatttgtctcatttaggagttacaaaatattgtgggctaggaagggcttgtattactgttttcattttgttttattttgttttcagaaacagttgaggctcaaaggggctaagtgactcacccagggttgcctagccaagccttgaacctgtgttgtctggtttaaaatccagggatttctccactataacatattgtctgtgaatgagtgtaattgcaaattagaaaatgtaattcattttaatattttttgtattttgttatatttaaatgcaaactacctctgtgagattttctattagtattggaaactgatgtttatactaattatagtgtgaatctattggtgagctttgtcttagcttagtctttgaagtagttacctagggagaaagtaaattttttagtaacgctactcttcaggttttctgagactcaatttgagaatttccttttgagacctatagcatgttcatttttattacattctgttgtggcccatctttgtcatttgtgggtagattaagttttcatatcaaaccaaagtgcttccaaactgtggctagtgaataaaaagggaacaaatctggaatataccttctggatgcagaagatgacaaatatctttcaaataattacactgactttcctgtggcttggattctaaagagtaggccagacaggtttgaaataagagaaaggggctgggtgcagtggctcacacgtgtaatcccagcagtttgggaagccaaggcaggaggatcccttgagctgaggagttcaagaccagcctgggcagaaaaaaaaaaaaaaagaaacaag

SEQ ID NO: 100608 - DNA, 1776 bp, Homo sapiens
tccctgcagcctcgatcttctgggctcaagtgatcctcccacctcagcctcccaagcagcttaagactataggcatgcaccaccacacccagccaattaaaaaaaaatttgtagaaatagagtcttgctatgttccccaggctgagtcttaaactctggcctcaagcaatcctctcaccttgacctcccaaagtgttggaattacaggtgtgagctattgtgcctggcccaaattcttttatttcttcaggtattcaacagatatttcttgggcatctaccatgtactagacacccttctaggtgctgatcttgggtcttcctggtgagctgatcacggggaagtgggctaagtaaggttggaaagatcctatagtctttactttgaaacagctctgttcagattaaccctgtaagtgctcagtgttgcatagatctgtgtttttattcttcagtggccccagatgagccagtcccgagcatgtggtggatcagaacagattcctggaatagacatacagctgaataggaagtatcacaccacacgtaaggtgagaattatcagtgcattctgtgtttatagagtgctttcacacaggtgttctttggatctcaacaaaattgttagctaggtgagttttagcgaatgcagaaggtgaggctcagggggtaaagtgacttgcccaaggtcacaaggatggtaagtaagtggcagacaaaatgaatttttttttttcagggacaaggtcttgctctgtcacccaggctagagtagagtggtgccttcatagctgactgtagtctcgaactcccaagctcgagctatcctcctgcctcagccttctgaatagctgagacttacagtcatgcaccactgtgtactgccaatttttaaatttttgtagagaccagggtctcgttttgttacctaggttggtctcaaactcctggcttcaagcgatcctcctgcctcagcctccctaagtgctgggattgtttttaaaattttttttaacagatgaggtcttgctctgttaccctggtggagtgcagtggcatgatcatggctcactactgccttgaactcctgggcttaggtgatcctcccacctcggcctcccaaagtactgggattactgagattataggtgtgagccaccatgccagcctgaatatttggacctaagccttctgaggctatgtcctatgtttcttccattgttgtgtctggaaaacacttaagaggaaaacatatgaattttttacatgttaaaaataaagtgatatttaacttttggataattttttattggttagatagcttgcctttgcttggagagggttaacattagaacagactttccttggaggttatttgcaaactacaagactctgtagtcattaataaaatttgtgatacctttactaaaaaatgcaagagtttaaaaacattcagtgcttgattgcagttttgaatgacttttgactgctttcaggcagtatttttttttccttttcctattacatcaataagcatagaatgttttacttctcagaattgttcttgggagatgggggtcaagatttccttttaaaagtcttctttttgatagaacttttattctaataccccacatctgtcatctgctagatatgggttaatagacatacagtcaatgaggtaggcatgtcttgctctgaaatttggagggcatctattaggtacagttccaaatgtgttttcactgaatgataagatgcttaaaaaaatgaaaat

SEQ ID NO: 100609 - DNA, 1746 bp, Homo sapiens
ctcactgtaacctccgccttctgggttcaaacgattctcctgcctcagcctcctgagtagctgggattacaggcacacaccaccatgcctggctaatttttgtttttttttggaggggggtagagatggtggtttgccatgttgcccaggctggtctctaactcctggactcaggcaaccctcccgcctcggcctcccaaagtgttgggattacaggcgtcagccaccacgcccagcctattgatattttctaatctaagcaaaggaaaaattgaggtctttaagggtcgagtgaattttttgcgggaagtgcaaggacaagagtgggtagtacaaaaaagtaaatgtgtgtgtttataagtgtgtaggtgtggagaaactagatgtccttgatactagatacataggtactttagtagttcaatatagtgtgaaatgttagctaatggtaggatagaaatacagtagatggtaggacagccacagaaggaatctactggttactcctagagctgtgaggaaaaagaaggatctaatagaacctaatagaagaggacccagcccaaagcacagcttgtggaaactgctgttggctgtgttctttgaaccagtttaagtgctttgtgttttaggtggaccattgcattgatgtatgtgatgtaatggggaggtgttctgtgtttagtctgtgttttacaaagcctgcttgatacttatgaattaaagcctaagtgtccttgggactgaccagaagaatcctgactaattttttaatatcctcgtttggaaagaaaagtaaatagtaacattccacaattagaaattctattttttcttcgttagggttaaagaaaaaaaatcattttcattccatgtgttccatttcttcttggaataaaccagaattgaagagtcagccctcttcctgctccctctcacccttttttattgtaaaggtaatatagcattagtgagagtttggaaactagatttttttttttttgccagaattattttggctatagattcttaaatttatccataattctaacttaacaaaataactctttggtttcttgtgtgttctttctaaacttgcccatatgcagtctacgcagtcatgttttacctataattttatacatattataagcatttaacatttttcatgttgttaacaataataataatctctgagtaaaccgtgcagtctgagtgatgatgatgtgtcagtgtaggtttgttctttgtatcaaatgcaccactctggtatgggatgttgatggcgggggaggctgtgcatgtgggggaaggggtatgtgggaactctgccctttccaggaagttttgctatgagcctaaaactgctgttaaaaaaaaaaaaaaaagtctatttaaaaaaaaaaaaatcccagccaggcacccaggctcatgcctgtagtcccattttgggagttcaaggcattttgggagttcaaggcaggaagatcactcacttgagcccaggagtttgaggccagcctgggcaacatatggagacactgtctctacaaaaatacaaaaatcagcagggtgtgatgacagatgcctgtagtcccagcaactcaggaggctgaggcaggagaattgcttgagccggggaggtggaggttgcagtcagctgagattgcaccactgcactccagcctgggccatagagccagaccttgtctcaaaaaacaaaaacaaaacaacaacaacaaaaac

SEQ ID NO: 100610 - DNA, 1050 bp, Homo sapiens
cagagtctcgctcatatagaaagtattatttaaatgcccaaataaggccaggcacggtggcccatgcctgtaatcccagaattttgggaggccgaggcaggtgtatcacctgaggtcaggagtttgagaccagcctggccaacatggcaaaaccctgtctctactaaaaatacaaaaattagctgagtgtggtggcgcatgcctgtaatcccagctactcgggaggctgagttagaagaatcacttcaatctgggaagcggaggttgcagtgagccaagattgtgccactgcactccagcctgggacacagagcgagactccatctcaaaaaagaaaaaaatgcccaaatagaaactataagatgttatggccttaccttactgtcaccacccatttcccctgttcatagcaagtttgcctaagatcctcaggggcctttgctttgggctgtttgtgccagctgtgttcattgcccagggcctgttctttttgctgcaggtgctgcagtaccgaagctggtgccaagagctggagaagcggctagaagccactggagtgagtgaggctgagctctctgcaccccctgggtcctcagtgaatatacttgttaggtttcatttgttgactgagggaggttggagtgtacaagtgaggtgtttggtggaaggctctctttctcagcctctgagaggtttatcacactgatatcttcattggacctagctggcctgtcagattccaacccttggttttcaaaggacgaaatgtaaattagattggaaggagtgtgggattagcaggaagaagtgcatgtttcctccagcaggtgtcagtgtttcttttagaaagatgcaggcctttgcgagcctacagcatgtctgcagcaaagggatgtctgtgctattagaactggctttgaaaaacccatttatttgcctttgttccagctgcctctcagtacctcctcacattttcctcagaaaagttctctcagaggaaggaaagaaccaaaacttattgagcaccctcaatgcagtccaggcagcatg

SEQ ID NO: 100611 - DNA, 1054 bp, Homo sapiens
gaagcatattgctaacaaaggggagaaagaataaaaagaaagtggactgccatggaagggagccttagggaactggtctgagtgatgttctctttggaggtaagtaaggcttgtctctgtctggcgcagggaccaatcccccagaggtgggaaaatgtggaggagccaaacctggatgagctgctggtccgattggaggaggagcaacagaggtgatggaccccaaactttctgacctgggtgattggccagttggtggagaaggctgatgggaaacttctgccctgagggctaatgtggacttcagccatagccctctaattcctgcaatggaaaatttcagtggttgccatcttactcccaggaggtccaagggttggactagacctttattttgcacccacttttacccctccccagtgcaggtgtgagagtctagcagaggtgaacacccagcttcgactgcacatggaaaaagctgacgtggtgaataaagcccttagggaagatgtggaaaaactgacagtggactggagccgggcccgggatgagctaatgaggaaggagagccagtggcagatggagcaggaggtaggaagaacggggactggaactgtgagaggaagcctgtgtattctggatgctgccctggtcagtactggaaggagttaacttcaggacttggatgaaaactgagctgttgctgttaaagtccctgaccatccttacctgcgcatgctggcagcctcagccttcttgggccttcagcttagacctgccactacccgcctagtctaggttctgctgggaggtagcatgacactcagagcaactctgttcctgcagcagtgacgagcttaggtttttgatggatctgaaagcttactgattcctggtctggaggtcttgcatatctagatgctaaggaggtagatatgaaactgaatgggaaagaaagagctgttatgggccctggggaattttcaggtcccagctgaaggaaacaaatgtttcctgcatttttgctttgtgctcagtggtttatgtatatcat

SEQ ID NO: 100612 - DNA, 2228 bp, Homo sapiens
tttgtatttttagtagagacagggtttcaccatgttggtcaggctggtctcaaactcctgacctcaagtgatccacctgcctcagcctcccaaagtgttgggattacaagcgtgagccactgcaactcgccgaaatgtcacctcttctatgaagccttctctgacctcagtagcctgctaagttactgtgcccttgtagtcttttgacctcttattacagcattgatctcactgatgatttagtttcccctaccttctttttttggtgaggctgttttactttttggattataatgaagtaggtttttaaaaaataatgacatagaagggcagggaaatgagcagagagccccattgaatctcaggacaaagttcatatatgcccatgacgagggttgtatcttcacctgttggaggtacatacataaaatgcagggctattttgttttgtttttgcttttggaggcactgagaagtacaaaagcaggccatgtcttcgtaagtttttatttctagtactttgtacttcacctgccgtatactagacactcaatacattttgtttctttgttttttgagacagagtctagctctgttgcccaggctggagtgcagtagtgtaaacacagctcaccgcagccttaacctcctgggctgaagcaattctcttgcctcagcctccaaagtagctgggattacaggcacgcaccactatgcctggctaactttttaatttttttgtagagacggggtctcactatgtttcccaggccggtctggaactcctgagctcaagcagtctttccaccttggcctcccaaagttctaggattacaggttgagccaccgtggctggccagtgaatgtttgttgagtgatgcaatacttaaacaaatgaccatacagtgtgttaaggttcttagagatggtatagaataaaattattaagacttttgctgagtgaggaggatcacttgagcccaggagtttgagaccagcctggacaacatagtgagaccttgtctctactaaaagtaaaaataaaaaaagaatagccatgtggtggcatgcacctataattctagctacttgggaagctgaggcaggaggattgcttgagagtgagctatgattgcaccactgtattccagcctgggcaacagagcaagaccctgtctcaaaaaaaaaattggaaaaaaatttaaacttttagatagcattcattcaagaaatatttatttagccactcacataatagcaagcagtaagctctaagatatagtgttaagtgtttggtgattttgctggactttgagattaatatcaagaaggttgaacataatcttccccaaattgcccttcctttttccctatcagagtcagaacctcgggctggagggaccttgggactatcccaagtgcaattctgatgttcttattggcttcagggtgcttgacttcaagatcaagcgaggcctggaagggcctgggccagggctttccttcagctcttgggcccccaaacacgtgttccagccttgagatgtggtaaatccctgcatgtgtctgagtggttttttgcttccccacttcaaggctatagcatcatgtggtattcagggagtgcagacgggctgggggtgcctaagggatttgggggaggctgcagttgggagtggttggggttggggctggggctggggtgtgctgcatcgtagctctgtccacatccatgggctgttctggtgacagtgctatgctcttctctttagggtgaccgagctctctgctctgttgacccagtctcagaagcaaaatgaagattatgaaaagatgataaaggctctgagagagacagtggagatcctggtacatgatcctttgctctggaaaggagttgggcgtgggcttgtaggttccttgtgctttatggacagatagtgcaggataccagttacatattccatgatgaaatcctctaaagctaaaaaataaattttggctgaatctgaaaattaattaactcattcatttattcattgaataaatactattgactgtctactatccctactgtattcctggggaaattgcaatggcatatgtatgcagtgtgtccttaccagagaattggcacatacattcagagacacattggcaaattagtgagttaccaggaagcggatatgtggagagatttaaaatctagtcacatgggaaacaactga

SEQ ID NO: 100613 - DNA, 1182 bp, Homo sapiens
tcacatggacagattatttgtagaatgatgataatatttaccttgaagggttgctgggaagatgagagcaacgttttggaaaacgccagcatagaacctggcatatggtaggtctttaataactgggagcagggatataccttcatctttgctgtatttccctcctctcctgtgccccagttccttgtacctggtaggcatgaatagtggaagcttgaagggctgccataagggtcatgacttgtgctaagaatgatctccctgtaccaaggagaagggcagacaacccctaacaacaaaaaattagctgtagctgaatgtggtggcatgtgcctgtagccatggcaaggtgagatgggaggatcacatgagcccccaggagtttgaggcttcagtgagctaagaagatacacagagaagtctcactctcatttgtgctttctccatcccatttcccttccccctttaggcaaccattttagctgacttcttgtttatcttgccagtgctccttcatgcaaatacgggcatatattctttcttcccccactttcttgcataaaaggtagtgtatcatgtatatactgttctgcaccttgatttttttcacttgacatgtcttagaaatctttccttatcagtgtttatagaccatcctcattctgttgcatagcaaaggtgattatattcctgttacctttggggttatggcccatccctaagagttcctctagacccctctctttcccatcttagtcaggagatgctgatgggcctggaagccaaacagtcagaatcactcagtgaactgatcactcttcgggaagccctggagtcaagtcacctggaaggggagttactgaggcaagagcaaacggaagtgaccgcagcgctggctagggtgcgtggcctcctctcctcacttgctgggtgggcggcttcgaaagtgtgttcccatgcagcctgcctcattcttcaccttcaagccaggatccctcatctttcctcaatcattagtctgcttctgggttctctattccaacataccctctatattggaattagaatgggctttctaaagtatatacctggttatgtcagtctcttaaaaccattcaacggctttctagctctgtggtgccacattcaaagctttttgtcatgtgcctcaaagtgtgtttt

SEQ ID NO: 100614 - DNA, 1031 bp, Homo sapiens
tataaaaaattaaaacactacagaaattatctggaaagtgaaaaagtcttacttcctagaaatgaccagtgttactagtttgcagtatatcttccaattttaaaaaagaatgcctataacaattcttcactgaggctgggcgcagtggctcatgcctgtaatcccagcactttaggaggccgaggcgggcggatcacgaggtcagaggttcgagaccagcctgaccaacatagtgaaaccctgtctctactaaaaatacaaaaattagcccggcatggtggcacatgcctgtaatcccaactactcgggaggctgaggcaggagaatctcttgaatctgggaggcggaggttgcagtgagccgagattgtgccactgcactccaacctggatgacagagcgacactgctcaaaaaaacaaaaagaattcttcactgattctccactacttcattcacaccacccagtttgaattagaagcttctccttatactctgatagcacctcatgcttattttaactaccacattcctcatgctataattatctgtttatatgtctctaccattagaccaaaagctccttgaaggcaaagctatatcttatttgtttttatttctccagcttttagcatagtgcctaccacataacaggggccaagtaaatttttttcctgagccaatgaatgacctggctcaaaggtcatctttctcctctacaaaacctctcattgtcctaataattgtacggactctcccttcacagagtccctttctcgggacattgatgactttcttcccagtattatgtgtgcatcttctcaaggccaaaacctccttaggggcaggtcttctgctgtccctagcacagggtcttgctcacaggggagcattcttcctgggctgggggctctgtgggcggatcagggaaatagataaatgccacgtgctattgggtaagcaatccgggctcacagagctgggtccagaatctctgaagaggcaatgaccctaacctggtggtagcggcccc

SEQ ID NO: 100615 - DNA, 1036 bp, Homo sapiens
tgtgtcagccattgtaggagcttggattttgttctaagagcaatgggaaactgttgggtggtatgtatgtatgtatttgtttgagactgagtctcgctctgtcacccaggctagagtgcggtggcactatctcagctcactgcaaccttcgcctcccaggttcaagcaattcttgtgcctcagcttcccaagtagctgggattacaggtgcccgccaccatgcttggctaatttttgtatttttagtggagaaagggtttcaccatgttggccagggtcgtctcaaacttctgacctcaagtgatccacccaccttggtttccctaagtgttgggatgataggcgtgagccaccgcgcctgggcagttggatggtatttaaaaagcaggggtgggatatgatttatttatatatacgtatacatatgtatatacatatatgtatatgtattctctactctcctgagtagagaatagtgtgtgtgtgtttttaggggatcgtggcatcaagtggaagtagggatatggttaggagactgtttccatggtctaggtgagagactattaccaattcatggactctgaccaagaaacctgggtgagccagtgcactttgtgagggaggagagggactaggaagtgagaaggtgaggtggaaacaatgtggattgctggctcctgcctcagcttttgccaccccaccaaaaaaaccagtatttctatgacacagatttcctctactcaatgatttcttatccctcttcaggagaccactgggatactacagacccagctccaggaggctcaacgggagctgaaggaggcagcccggcagcacagagatgaccttgctgccctccaagaagagagcagctccctgctgcaggataagatggacctgcagaagcaggtcccctcctcctccccaccaagtcccatggtccttccccaacacagccaggctttcccacttcctcttgcaggacagggagaaccttggccctgctgcctggtttgggagggtagatgggtgggcc

SEQ ID NO: 100616 - DNA, 1147 bp, Homo sapiens
tgcagatcataactcactgcagtcttgacttcccaagctcaagcaattctcccacctcagccccctgagtagctgggactacagatgtgtgccatcacactggctaatttttaaatttttatagagacagggtctcactatgttgcccagactgatctcgaactcctggtctcaagcagtctgctcgccttggcctcccaaagtgttgagattacaggtgtgagccaccgcacccagcccagccaagatttttatttgtgcctgcctctatgcagcatatgtgaggctgggaggcagatgaccaggccgaattgtattgaggaagggggtggttaagaacagtgtgtaggaattggtagaatcgccagagcattggaaatggccactgactatggtaaacctcgaaggaccctgaagccctaggtgaggagcatcttcccaccggccccctgccctgccatcttggtcttcatgcccttaattttccaggtggaggacttgaagtctcagctggtggcccaggatgactcccagaggctggtggagcaggaggttcaggagaagctgagagagacccaggagtataaccgaattcagaaggagctggagagagagaaagccaggtaggctagataggccatggaggtggcttttgtctatctggctgccatggtcactgtgatattgacagttgtttgctcaggccaccttgcctttcatgtctgcaactctgggatgtacatgtagccatgtggagaggacatggttcctgtcttcaaagcttgaacttcatttatttagtaaatatttcgtgaacgcctgttatgcaccaggcaccatgcttggggatacagtgataaacaagactgtatggtccctgccccagtagaatttatagttttgtggggaagacattaatcaaataataactcaaattattacaggttatgacacatggaggaaacagggtgagagagagaagagactttagaaccattgttagggaaggcctttctcaggaagttgcatttaaactgagcactcagcatgaagtggagctacccatgtaaaagggtgagggggagttctattccgtaagaggagaaataatatgcaaaggccgtgaggcagataaaagtttacagtg

SEQ ID NO: 100617 - DNA, 1016 bp, Homo sapiens
aggggaggagaggaaagggatggggaagatttggacatgttgaacgtgaggtactaatataaggtatgtgtgaaatttgccagagaagaataaggttgatagctaggcatggtggcgcatgcctgcaatcccagctactctggaggctgaggcacgagaatcatttgaacccgggaggcagaggctgcagtgagccgagatcgtgccactgtaccccagcctgggtaacagagcaagactctgtctcaataaaaaaaaaacacaaaaaaacctgtgaggttgaaatggggcatcatctgcaggaagtacctaggagcacttattatagtaagtgctcaataaatgatagcttttattgttacatcataatcattatcattactatttctattttgattattaatgctatgtttagaatactcagatgagaaggtaatttttcattccctaagagaatggcccagcactctgacccctctctttttagcctgactctgtcactgatggaaaaggaacagagactccttgttttacaagaagctgactctattcgacaacaagagctgagtgccctgcgccaggacatgcaggaggcccagggagaacagaaagagctcagtgctcaggtacttcccactctggttatgagctctgcatccctggcagaagcctgattctgaagcggtggattgattgctctgagtcctctcatggagaggacccatctatttttcctgattacaggataggctggtgcctcaacacccctacaggagggggaagccaggactagacaaggcgggggcttgggaatctgacccagagatggacatggctcctgtgggaaacctgacagcccacagcaaagtgcacacgggtgtagcccatgcaggcctggttccagcacaccggcttcaaagtatgctgggtctggttggcaagatgtagcagggagaatgagcaaccagaaatactccagatcaggcaggcagcagcaagacttccagggactcagt

SEQ ID NO: 100618 - DNA, 1035 bp, Homo sapiens
ggcctgggcctggttcccgggctgctgctctgcggccagcgcttctagctggctctctgtgctgcgcagtcgcagctgtagttgggctgccttggcttcctgggcccacaaggaggctcgcagctgctgctccgtgatatgagacgcctccagctcctccagcagctgtgcttcctgggccagaaagtcagcctccttttccttcacctcttgccttagtaattccatctgtcaaggaagaattttacataatataagcaggaagcggataccctctcctcaggccttcccaggccagaccccactcaatccttgtacaaactctgatcagggctgggaggatttcagctcagctctcaggcaggtagaggggctctgaaatgagtgttaccctagatctaacacctggctgcctgccgactactgaacacatgggcccaggctgctatgctaatgggcttcagccctggcttcctgggcagatatgctggctccttgctatgaccagaactctgccctgaaacctcgacgctgcgcctagtaagaccagtcacaataacatagctaccatgtattgaatgcttattgtgttcctgacactttatatattcctataatggttataggaattaggaacaagaattgttcacccttgttttatggatgaagaagctgacgttcacacaattagaaagcttacattcaaactcaagaccattgaacagccaaacctgtgtgcccttaacccctgcaagccaccatctggctcttacaccccattccttccctcctagttccatcttttctctgtatacaatatctggggttctgatgggggcagactgagtccctggaagtcttgctgctgcctgcctgatctggagtatttctggttgctcattctccctgctacatcttgccaaccagacccagcatactttgaagccggtgtgctggaaccaggcctgcatgggctacacccgtgtgcactttgctgtgggctgtcaggtttcccacaggagccatgtccatctc

SEQ ID NO: 100619 - DNA, 1027 bp, Homo sapiens
gtaatcccagctactcaggaggctgaggcaggagaatcacttgaacctgggaggtggaggttgcagtgagccaagattgtgccattgcactccaggttgaacgacaaaagtgaaactccatctcaaacaaacacaaaaaaaccctgggcagatgtatggcattgttttccatcatcttccactcagctatgaattaattcttggtacccaggcttccaagagaaaccctagaaatcagtgaccactgagatttgaggttggcatttataggcatgttctaggcctaggtctgaaagagctcataaattccacctcacagtgaacctatcagtcaatacaaattgagtgtcatccatatgtcagccactctgggctgggtatacaaaaaggagaaagacctggtctctgcctaaagaaggcttgtgacatggtggaggaaccaaactgcattctactggaaagcagaactgagagaattaattggatcaataacagacgcaagtgatgcactgttggaactaggaggagggggcaattcatcctgatttgggaagggtcagaaggaaagaagagatgacctttgggctgagctttgaagtaggagtgttgagagggaagtggtgacccctgggctaactttgagcaggagctctgtttcaaaagacatagataggtcagaaggggatggattctcacactccatccaagtggagcagagcctgtcatcacttcaggaagctaaatacacatgtgtttaaaggaagtaacccggcaatctgggagtaggtccacaatggcggcccaccacagaagctgagaatgaggagagagcttgagccctgcattgttttgtggaagatgaggaactcacgtttagccatgcccttcctttcccaggatgttctgagggatcaggtccagaaactggaagagcgtctaactgatactgaggctgagaagagccaggtccacacagagttgcaggatctgcagagacagctctcccagaatcaggaaggtgagaagc

SEQ ID NO: 100620 - DNA, 1091 bp, Homo sapiens
ggcagccaaggagaacctgacagcccaggtggaacacctgcaagcagctgtcgtagaagccagggctcaggcaagtgctgctggcatcctggaagaagacctgagaacggctcgctcagcactgaagctgaaaaatgaggaagtagagagtgagcgtgagagagcccaggctctgcaagagcagggcgaactgaaggtggcccaagggaaggctctgcaagagaatttggccctcctgacccagaccctagctgaaagagaagaggaggtggagactctgcggggacaaatccaggaactggagaagcaacgggaaatgcagaaggctgctttggaattgctgtctctggacctgaagaagaggaaccaagaggtagatctgcagcaagaacagattcaggagctagagaagtgtaggtctgttttagagcatctgcccatggccgtccaggagcgagagcagaagctgactgtgcagagggagcagatcagagagctcgagaaggatcgggagactcagaggaacgtcttggagcatcagcttctagaacttgagaagaaagaccaaatgattgagtcccagagaggacaggttcaggacctgaaaaagcagttggttactctggaatgcctggccctggaactggaggaaaaccatcacaagatggagtgccagcaaaaactgatcaaggagctggagggccagagggaaacccagagagtggctttgacccaccttacgctggacctagaagaaaggagccaggagctgcaggcacaaagcagccagatccatgacctggagagccacagcaccgttctggcaagagagctgcaggagagggaccaggaggtgaagtctcagcgagaacagatcgaggagctgcagaggcagaaagagcatctgactcaggatctcgagaggagagaccaggagctgatgctgcagaaggagaggattcaggttctcgaggatcagaggacccggcagaccaagatcctggaggaggacctggaacagatcaagctgtccttgagagagcgaggccgggagctgaccactcagaggcagctgatgcaggaacgggcag

SEQ ID NO: 100621 - DNA, 1035 bp, Homo sapiens
ggatgaagagctgagacatcagcaggaacgggagcagctgctggagaagtctctggcccagagggtccaagagaatatgatccaagagaagcagaatctggggcaagagagagaagaggaggagataaggggccttcatcagagtgtaagggagctacagctgactctagcccaaaaggaacaggagattctggagctgagggagacccagcaaaggaacaacctggaagccttaccccacagccacaaaacctccccaatggaggaacaatctctaaaacttgattctttagagcccaggctgcagcgggagctggagcggctacaggcagccctgagacagacagaagccagggagattgagtggagggagaaggcccaggacttggcactctccctagcgcagaccaaggccagtgtcagcagtctgcaggaggtagccatgttcctacaagcctctgtcctggagcgggactcagaacagcaaaggctgcaggtaagtcactccatggggagtaagggccaggggacacacccctgtctggctgagctcagggactgcccaccaccctgggccctgtggcacctcaggggtatgagaaagctgagatcatgagcacctcaacatcggtgggattcaggctactgtgctagtcgggagatacagagaggataagacccccacagtccctgccctcacagagttcacagtctagtgggtaaacaacgataatgcagtgtggttggtgcctaatgggggaagtttagtatgccccaggcatgctggagggatgcccaccctttcctgggagtgggtcctgaaaggctttctggtaaaagtggtgtttaagattagacctgggccaggcacggtggctcacgccggtaatcccagcactttgggaagccgaggcgggcagatcacttgaggtcaggagttcgagaccagtctggccaacatggtgaaaccccgtctctactaaaaatacaaaaattagccaggtatgctggcatgtgcctgtgatcccagctact

SEQ ID NO: 100622 - DNA, 1024 bp, Homo sapiens
cagagcctctaggaaaaataagacaaaagcctgaggagaacattgaaccgctgtttgtgtggaggatgggttggtctggatatgaggttggcaaggtgtgattttgctccatacctccgtaccctaggatgaactggagctcaccagacgggctctggagaaggagcggctacacagcccaggtgcaaccagcacagcagaactggggtccagaggggagcagggtgtgcagctgggagaggtgagctgggggctctgggggaacaggtgacccagcagggagctcctgtccaggggtttgtccccttcccttgggaactgggttcctgaagcttaaacctgccagattggtctgtgtgtcctctgtctgttccctacctgtcttaggggctgcccaggtgagattcacaggtctttcccacaggtctcaggagtggaggctgagcctagtcctgatggaatggagaagcagtcatggagacaaaggcttgaacacctgcagcaagcagtggcccggctggagattgacaggagcaggctgcagcgccacaatgtccagctgcggagtaccttggagcaggtgacccctcttcttgtccagtgggcatgcatctccacttctcgtgtggtccctagagcataggctcagtaaattacagcctgtgggccaaatccagcctgctgcctgtttctgaaaattaagtttgtttttttttttcccgagacagagtcttgctctgtctcctagagctggagtggaatggtacgatctccgctcactgcaacctccacctcccgggttcaagcaatcctcctgccccagcctcctgaatagctgggattacaggcatgcaccaccatgcctggctaattgttgtatttttagtagagatggtgtttcactatgttggccaggctggtcttgaactcctgaccttgtgatccgcctgcctcagctttccaaagtgctgggattacaggtgtgagccaccacgcccagccctgaaaattaagttttattgga

SEQ ID NO: 100623 - DNA, 1038 bp, Homo sapiens
gcatgcctggctattttttgcatttttagtagagatgaggctaccaccatgcctggctattttttgtatttttagtagagatggagtttgaccatattggccaggctggtctcgaactcctgacctcatgatccacccgcctcagcctcccaaagtgttgggatacaggcatgagccaccatgcttggcctacatgtagagtcttgaaagccaggcagaaaactttagactccatgctgaaggcattgaggagcaggaattttaagagaagaagatacaagaatctttcctgccggggcacagttgtgcaagacacagaacaaagccttgggccccagggatgaccctgaccctggtaagacagccagttgtcctggttgcacctggggaggaagggggagggaactgacctggggcccttcccacagcaacccacagccacatcctaccccttttcctattccccctcaccgtgtctttgctatcttccactccactagggaaccagaccatcttccaaaatctgagaaagaattggaggtgggggagtttgggccacaagacctgggaaagtcctgcaagtgtccccagtaagccaatagaaggtcttcccagagcccctgctgttactccctgcagtgacctcccctcacccccacacagagaatgtctggggacacctccatcaccttatcacttagagcatctgaagtccacaccaggtcagagagcttccgcagtagcatctccagctgcatccaggagccctggtcgctggcattcctgggatagatgaagcattgtgtgtggtttggttccccacgtccatctcaaagccctggacttggggcctgcttcatcttgggaaggggagcagaaactgatggaactgtggggcaggcctggccttcctgctcccgccctctccccagcacccacctgaaaaccacggggtattggtcgatgtcgttgccaaggctggagccctgcgggatctgtgggcgccccaacagcacacaagtcccacaatagaaatca

SEQ ID NO: 100624 - DNA, 2434 bp, Homo sapiens
ctgggggttcacagcctccagcctaggcctccaggcaaagccagcacctgctactctgtgtgcctaacgtacaagtgaagctggtattttaagaaatctggaacctggccaggcatggtggctcatgcttgtaatcccagctactcaggaggctgaggcaagagaatcgcttgaataaggcgaggctgcagtgagccaagatcatgccactgctctccagcctgggcaacagagtgagaccttgtctcaaaaaaaaaaaaaaaaaagaaaaatctggaaccccaggagtttgcaggctgtggaaggaggagtttctaggcagggaatgggggattcttatctcggggaggttgtccccttaggaccatagcctccccttcctcccacatctccgcagacggacccaggtgtccctgtctgctactgtcatcagagctttggatgagctctggatggtgttgtttacagatcaacatgacccactacatccagcacctgtcatttggggaggactatccaggcattgtgaaccccctggaccacaccaatgtcactgcgccccaaggtaccagcccgggaggcagcccccagccgcagaaggccggccgggcacccatacccagtgctttgttttcccctcagcctccatgatgttccagtactttgtgaaggtggtgcccactgtgtacatgaaggtggacggagaggtgagtcagggagctccctaccagagtctcctgcgcggtgccaagcactggagttcctgcattttgttccgtcagcctggggagtgaaagctgcctcgtcctcacatggcgaataaaagactgaggcacagagagggtgggggatttgccctcccaggcagagtgcaggcctggggctgttagatttaaagcgcctgctctttctgctgccctcaccgcttctatccgttcctccggtgcccaccgtctgcctgcctcactgttctctgtggtctgcctgggctgggggttaggcaaggcaagtctctgtgtacccgctcccaaggctgccctggcctgtggagcagcatctcagcagagtggcaggatgcgaggggctgagggcagaggaagtcaggtcagccttggtgcgtctttggagagctgcttctcagcctggacccccgtgagaacacccaccaaatgctgccaggataggtaaactgtaaagacttggcacctggaggggaaggctgaggccaagactaggagagggggtctggcgggccaggccttgcagtgcaggccactagcacggtgctgtgttctctccttacacggccaaggctcaacaggaaaggggaaggagcaggggtggggctgatggtggctggagccaggtcctagccctagccctggcccaggctcccctcccaccccaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtgaggatgggggcaaagcggcctctgggggcctgggcctgagggaggaggatgcctgctgagcccaccctctccttctaccaggtccttcacccacttcctgacaggtgtgtgcgccatcattgggggcatgttcacaggtaagaggcccagggcgtctgtgagctgtggggtggggagggtaaagcctgggtgccccaggtttggttgggggtgaaggggcagatgctggcctggccagttaagtgacaaggctctcagcgtcaaaagccaaggcccccactgggccagtgccagcccttgtctctctcccagtggctggactcatcgattcgctcatctaccactcagcacgagccatccagaagaaaattgatctagggaagacaacgtagtcaccctcggtgcttcctctgtctcctctttctccctggcctgtggttgtcccccagcctctgccaccctccacctcctcggtcagccccagccccaggttgataaatctattgattgattgtgatagtactcactggtctccgtgtgatccttgccatggccagagcctcatcctggccactcactgaaggcaattgtgactgacagatcggggcccagagccctcgggagccccacatgggcatcccctagttaaccggggtttattcaaaccagattcatgtccagcccacagccctgtcctgggtccctcctccactgtggtcctcaggcctctcgggttcagccccagggctcagatggaccttttcagcgtgagcttcctggagccaccatggcccccaggctcatgagtgatcaaccccaggccactaattcagggccctgagtgcatattggggcttgccacttcttcattgatgggtaaagctgg

SEQ ID NO: 100625 - DNA, 1150 bp, Homo sapiens
cttgagggttatggaacaaaggacttttttttttttttttttttttgagatggactcttgctctgtcacccaggctggagtgcagtgacgcgatctcagctcactgcaacctgcacctcctgggttcaagtgattctcctgcctcagccttcctagtagcttggattacaggcgtgtgccaccatgcccagctaatttttatatttttagtagagacgggctttcaccatgttggctggggtggtcacaaactcctgacctcaagtgatccgcctgccttagcctcccaaagtgctgggattacaggtgtgagccatcgcacccggcctgtaacaagggacttcttatgagtgtggggatgtgtggctggggtgtttgcaggggtttaggaggaggatctgcttcaggacatgaatgggcttgtccccagcaatacttcatgctgttgctgctgactgatggtgctgtgacggatgtggaagccacacgtgaggctgtggtgcgtgcctcgaacctgcccatgtcagtgatcattgtgggtgtgggtggtgctgactttgaggccatggagcagctggacgctgatggtggacccctgcatacacgttctgggcaggctgctgcccgcgacattgtgcagtttgtaccctaccgccggttccagaatgtgagtaggtgcaaatttgatctgggagtttaccctttcacctttccctgatgtgagtagggttgaggcccaagggatgctcaccttttcctctaagcctgggatatggttgggttcttgagcatgaaatacagactttgggcagctgttctgggccaccactgacttttcccttttcttggcaggcccctcgggaggcattggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccagaggtccctctgggccacaacccaacccttctcactctcctcagtgctagcactttgtattttttgatacttttatacttgtttctgcttttgctgctcttgatcccacctttgc

SEQ ID NO: 100626 - DNA, 1090 bp, Homo sapiens
tgacgggtcacatgatctcatcggtaccttccacaccagcttggcccagctgcaggcagtcccggtgagtgctggtcttgccaggggtgtggaaatgggcctagatagctgaagcttgtgggagagaggaaggagaaggcagctcgagtccttgactgatgctctgagaatttcctaccctaatttttctgtcctcaccaggctgagtttgaatgcatccaccctgagaagcagcagaaaaagaaaagctacaagaactctggaactatccgtgtcaagatttgtcgggtgagacaaaagcccatgtaaccaaggctctgattcctgagctccatgacaccaactgctatcaccccaggcatgaccctggtttcatttgcaggtagaaacagagtactcctttctggactatgtgatgggaggctgtcagatcaacttcactgtaagttactttaccaagggcaagagaacaggtctggggctcagggtggcctttagctgccttcctcacctcctcccaggtgggcgtggacttcactggctccaatggagacccctcctcacctgactccctacactacctgagtccaacaggggtcaatgagtacctgatggcactgtggagtgtgggcagcgtggttcaggactatgactcgtgagtacctgcttctctgggctatacccgctccctgcagatgcttcagcctctgagcttacagtcccctcactgccttttgcccaatacactgtcctcccacagagacaagctgttccctgcatttggatttggggcccaggttccccctgactggcaggtgagctccctctctttctgccactcctgttttcagtttcagggtcctgattttgggggatgtggtaaatttacttgctacttggcactcagctttaagaggagatgcagggttggattcctgcaggcacgtagacagcaagtgctcaggactccatagctcctataggaatcttggcacacgccagtgtcctttttcattcttagcagaggtcatggggaaagaacctcattttcattcttgtctccaggtctcgcatgaatttgccttgaatt

SEQ ID NO: 100627 - DNA, 1043 bp, Homo sapiens
cccttttcaatatcttcagaccagggttggttgtatctgccatcttctgtgccagtgagctcacctaggggtggaggggtttggaggctatgaggccttctcttccttgggtgtcacgggggtggacgtatgctcagccctgcctgggtgatgcctgctggccttcccaagctgggacctgtagtcggggaaggggagagaaggctccctggtgcttgacccagctccttttccctcagatggcccactgcgtgaccttggttcagctgtccatttcctgtgaccatctcattgacaaggacatcggctccaagtctgacccactctgcgtccttttacaggatgtgggagggggcagctgggctgaggtgaggcggattatggaggttaaggttgtggagggaggctaggattgtgttttggggtggaggctgtgactgtgatgcttactggcctctgcccacagcttggccggactgaacgggtgcggaactgctcaagccctgagttctccaagactctacagcttgagtaccgctttgagacagtccagaagctacgctttggaatctatgacatagacaacaagacgccagagctgagggatgatgacttcctagggggtgctgagtgttccctaggacaggtatgtagggctggggattaggatccttcagatgcaggtctgtgagacaacctagcctgcctggaggtagggggcaagcaggacctaaccctgcctgttatcctgaaactcccttccctgcttttccccagattgtgtccagccaggtactgactctccccttgatgctgaagcctggaaaacctgctgggcgggggaccatcacggtaaggaacccagcaagggttgaggagggacttaacatcaatgaattcatgaggtgatgtagtctcccctacctaggtctcagctcaggaattaaaggacaatcgtgtagtaaccatggaggtagaggccagaaacctagataagaaggtgtgtctggaagtaggccctggtaatccaagagttaaggggc

SEQ ID NO: 100628 - DNA, 1038 bp, Homo sapiens
ggacacagggataacaagaggtctgagggtgattgttatggtggctgcaggaggacggaattacccaggtgttgtcgtggtgaaccatgcaagaaaataatgttcccagcagagggaaggggtgaatcagagaagcttggtgctgcctgattacaagggcgagacatcagttagtttggagctggctgggcagggagctggggctggagatgaactttcagatttcattctgcaaatatgtattgtctaggtgcttgggatagagcaataaacagaacagctaaatattcctttctcacagaatttatattctagtgggggaaacagtatatacatgtatataatgttagacattgagaaaaagcaaaaaaggggtatgcaatgccaggggcagtggggttgaaattttagaggggctaaaagggagagcctttatatatatatgtatatataaaacagggaagattattttgagtaaagacttgtggggaaagggagcagtgagccatgtggatataatgcagagaaagaacacattccaggtactgcaaagtgtttggggtagaaacaaacttggctggctgggtgtggtggcacacactatcatgccaggactttgggaggctgaggtgggtggattgcttgatccgaggagttgcccagcagcctgggcaacatagtgagaccctgtctctacaaaaaaaaaaaaaaaaaaatagctgggtgtggtgatgcacacctgtagtcccagctacttgggaggctgaggtgggagggatcgcttgaacccaaggggcagaggttgtggtgagctgagatctcaccactgcacttcagcctgggtgacagtgagactctgtctcacgaaagaaggaacaaacaaacttggcttatttgaggagtgacaaagtggctgaaatggagtgagcaagagagacactccgagatcaggttaaagaaatctggaccttccaggaccttataggccatggtatagtttggactttttttcttttcttttctttttggaaatggagt

SEQ ID NO: 100629 - DNA, 1609 bp, Homo sapiens
agctttgctagggagtttggctccgaacctaaaggcagctatacggggcttttacttggaatagagactggaagctggcatctgggatgaccaggtggagcagtgctaggacagaaaccaagcaggacgcaagagactaataaggcctgaagttaggtaggggttgttgaactggaagtggaggctttgggcttagaatgaacagtcaagaagatttgaggtgtggatttggggggaaagctgatgaggcctttttatttattttgcttgttttgtttttgttttttatttcatataaggccttttaaaaaatacaaaacagtataaaatattgaaacaatacagaattatggagttcacaaaattcttatcttccactcctttgagctacctaaaacatttgatgcatcttctatttttctgtgtgtgtatttatttatgtttgtattcaaatctgttataaagatacacctacaattgaagtttaaaatggaagtttacaattgaagtaaaaaatggtcatactcttcctattattattattattatttgagatggagtcttgtgtacagtgccatgatctcggctcactgcaacctccaactcccaggttcaagtgattctcctggctcccgagtagctgggactacaggtgtgcaccaccacacccagctgatatttgtatttttggtagagactgggtttcaccacgttggccacgctggtcttgaactgacctcaagtgatccgcctgcctcggcgtcccaaaacgctgggattacaacagtgagccactgcgcccggcctatttttgattttttcataggataccaatataatatagttctggcttgttttttagccactattcagcattccgttgttcagatgtatcatatttagttgatagacctttaagctgccttagatttttcactattcccagcattagtgaaatgagcattcttttttatttgtctctgtactgtgtaaacactgcctgggagagcatgtgaggtgacatgcatggagttcagattgtgacttgggggaagctgtgatcctgatcccttgagggagcatgtattctgctctgggtctgtccttggggaacccccaagggagtgatcaggatggtcagaagtctgcaggccacattctaggggcaacagccaaaagaactgcggctgtttctccagatttcagctgggactgttcacagcttccaggtatcagatgagttctcatagggagatagggtaaggccttcccatggagccctaggctggggaagaactaccaggtagaagtaagaattccacagagttaggtcagtttgggtaggatttgtatggacctagactttctgatgattggattgtaagactgggttttctatcactgggactgttcatgcaggggccagggtgctgtggaggggcagtatgtgaagcaagttgaactctgaagcattccaactttgataacagcattccagatggaaactatgagggaccaagatgaggtgctgtgggctgcgagggaggagcgattgactgaggatcagtataggggagggctgacgctggaggcatctcagggtatagct

SEQ ID NO: 100630 - DNA, 1829 bp, Homo sapiens
gtgttgccaaatactttgtgtcagcctgactccttagtagtatatggatctaaaccaaatttattgaaaatttcagtttatgagtaccattcagtagcccttagtcatatgtatgaataaggaatgtgtagttttatagaaaggattttcatttttggttcagtttgtgacctgtgaggaatatccttagagctgctgatgtaaatttggagaatcctcgagttagaaaagtagggataagaaaacttgtctaccttctccatgtcctttgatggggccaaaaaggaaaaagaagagtggtggtggttggtgtagtttgtcttttcagtcttacgggaaacaatgttccatgggtggtcctttgtaagcctatggaggattttctgattggctttcaagacttgatcctgcatctgtgagctgatccagcatgccaaggtaggcaataggagtgtgagcatgacattggtttattaaaggagtggccctgccacccagaccttcagccctctatgccaccttcttgcagcctctgtacaacttctggtcattacctggggtggataaggaattgggaattgcaggctggtgcctttctgggttaggactttggaagtggaagagggaagtgttaaggactgacaaatgaatttcagctcatttggcactgaattagatcccactggacccaggagaaatctgttcttggttatgaataggaaaattagaacctcccaaggcaagggaagggtggccatagaaaatgaagggcaagttactcccttgtagcagagaatgggattccctatcgacagtagtatgctggtaaactggctggcagggtgaaggaagccatgactttttgcagttgcccaatttctacagttttaaacttaccaaggccacctgcttcaacgatttcctgatatgtaacagttggctcttgcaagccatacaagcttgcgccagcacactgctgcagacttgcctcaagtatttgaattcccattatgtgctcaggtatatgctgtgtggcaggagatgctgaaacagtgtttattctgaagagctttgtcatttaattgacaggcaagaagctggagaaacatcgacagaatacagtcgtgtggcatgaattgaatatagtggtccagagtgagaagttgagtgctggaaagatcatgaaaaggggagcatatataagctaggcttgaaggataacgataatagctaacacgtggtcatagcagttccagcctctgtactaagcatcatgcatacattatttatattaatcttcagaaatagatactatcccccagtttacacctgaggaacctgaagtttagtgagattaagtatttgcccaagttatatagatatgacatcaatttagtgttgtagtatgtcattattgtggctaggaaggaataaggccagtatttggagcctggtcacttcactgcagaacccacactcttgcccactgcatcagattgcaacaatataaaaaggggggcttttcaaagagaggaaaaaagtctaacaacagtccaaggtttgagattaggtaggaatcagaatatttgagttctagtcttcatttcacttaaccatatatgtggccttagccaaaccacatcttccctctatgccttggattgagggacttgaattagatggccactcagttcttttttatttctgacattttgtgaattttaagttataaaaatgggaatgagtatgcctttcttaagggacactgagagaatgtgccctgctagggcacattgaggttggcagagggagtaaacagaagaaaacaa

SEQ ID NO: 100631 - DNA, 1011 bp, Homo sapiens
tgttggccaggctggtctcgaactcctgacctcaggtgatccacccacctcagcctcccaaagtgctgggattacaggcatgagccaccatgcccggccctatttttttttaattaaaatgttaaaggttagggcatagagactcagcaaacgtcatatagagaagtggtaaatggcacagctgagcattggaattggctccccagttgttccagacatctggatattgatcttagtaacttactagtttcaagtcattttgcttaattaatggcttgccatttcatgataggagatgactatttcgttgtggggcaatgcccagcaagagaacataattcagtatgaacagtcaaaggtgttgagtgtatttaactcattttaggaatgagctgtactgtattcaaatgggctacttgatggttcattacctccattctgctgctgttcatttcctccctttgcttgcttatatagtaaacctgctcgtaaccaggacttaaaactcttagactgaagccccttcactgctgtctctagcctcagcctcctaatgggtgggagtagttcattcatagcttttgattggtggataagacttgtcaggctgggtgtggtgggtcacacctgtaatcccagcactttgggaggccgaggtgggaggatcgcttgagcccaggaattgagactagcgtgagtaacatagcaagaccctgtctcaaaaaaaaaaaaaaaaagccttgtcacttagagtttgtgcttcatatcaaatgataacaaccacattgtgctacaccacaagtcacacagtgggaaggatttaagagggttaaatagtttttttgtttcttttttttttttttttttttttttttgagatggtcttgctctgctgcccaggctggagtgcagtggtacagtcagctcactgtaacctcgatgtcctgggctcaagcaatcctgcttcagcctcctaagtagctatttttttttttttttaatttttttgta

SEQ ID NO: 100632 - DNA, 2995 bp, Homo sapiens
aaggcaggaggaccacatgagttctggttggtaagtgtccttgtcatgaaaacacttgccttacaaggctctaattatgatttccctagtcagtgctctgaagatgtgtcacattatattataaacaatacggaaggggagataggtgagatgatatgaaaaacaaattttctcactgtcataaaaggctctaattatggttactttccttgtgatgaaaaacttggccttacagggctctagttatggttactttccctagtcaatgctctgaaaatgtgtcacattataaacaatacagaaggagagatagatgagagatcatgaaaaccaaattttatcttttacatggcccctttgtcttcgtttgaaacatccccaacatttcctacaaatcagcgtagttacaaaggggtcagtcttttaaaataagtatttcctattaaactatatatatatacagtgcctttttggtgttgtgagtcagtggaacactgaaatacagcggttgtgtaatttaagagtggcaacagtttcatttgataagatttgaaaaggctttttatcactacaatcttagaggattgacagtacaggatttttgtttaagagaaggattgtttagactcaagaggtgactatgttgtgggtcttttgataattcatgaatacagatttgctttgaccgatcactagatactgcctcctcaatttcaaaagcaatataacgtttgtatatgctgtttaatttaagttaatgttaagtaatcatttctcattccaaagacaatgcaaaaaacttcagcactgcttgagagttgtatttcagccacagatattttctccattggaaagctattttcattttagaaaaatgggttgtttgaagatgaaagtcttttatcttttttcacaatttattttggttatatgttcgtacattcttattaaatatttcatacactttattgcaactactttgttatttctacatcttagataaatgctgaaaaggaaaacgatttcattgttcatctaattaaataaattaaaagagcggtttgtgtagaaattggagagaactatgttttatatgaatcacaacagtgctcgttgtggactgtaattaaatgctttgccctctggaacttgatttttgtgtatctgagatttattaacagtgctaactgctaaggatactgtttatcttgttctgggcattggagtttcagtttttaaaaaattcttgaaaatgtattctgtgaaactactcatacctctcttcctgcgaattttctcctaagaactaggtttggggtagaaatgaattgacattattttctcatttgctttgtatggtatgaaggatttgtaaagctttgctcaaagttgtgtgcatttgtaaacactatcatgatattttcaattttatgtgtaaattttattgtctgtttttggtgactctgacattaatggaagagaatattttccattagatttaattttttttcctctcccttctgattttttttttattggtgttcatttttcttttgatttaaaggattagagaaatctacaaatgtatgtcataaataagcaaatttgtaaacttttctgaactttagtgaaacatttagttcacaagcataatttggaggtgtgttctgtgtttacacagtagtttggatgtacaattattattagtggctttttaaaaaatgaaacagtgttaagtgaaatgtagttcctagctttgtactccaagttgtcaaagcatcaacaatgaaaattcgattaggaaactttatttaaaatttcaggtagtaatattcagtgtagttaaggccagtcttaacccactggatgaaaatctaggactgtatggaagtaagcaaacattacatttttaggtggaaatagtcagccttgcataaaaacaaggatgcgtgaaagccttaaattccagctcccttttactggagtctgtggttgtgtacaggtatgggccaagtgtaaaatctcatcaattttaagaacactcgggaaatgagtaaagaaaatgtaaaattgctgctagtcaaatcttttggaaagaatttctggaagtggtcactttaaaaattattttccacccttgcaaaattgccacatttaaattgttttactggcagttctatagtagtccagactttagaaaccaaacacaacaaaatggcttgttgccaatatggccacaacattgccagcaaatactgccttggcatcactcagcagaggtttttgtttataaagatgaagtcttgaatactgttcaataaacttgtcaaaaaataaaacaggctgatgcttttaatgctttaactgcacaaaagtactttactgagctataatattatcttgtcagggtttttgttttgttttgtttttaaacctgaaaatattttgtgcctttggagaggtagatttggtaatcttggagaggtaaaaattgttgcttatccttgcctgctaatgctgaagtgtcaagagaagaggatacttggaacagcagggaggaaacttgattcaagtccatagtatccaccttttcagaattttatgtgtatgatgtgttggcaaacaaagcccttaaatgttgaaaactttttatcttgaaagagtttagcttgtattagaatttggatacccagtgtgttttagagggggctagacatataattccaggtagtagctgagccattattaaataatcgggatttgactaagcaatggacaaatcactgagtgaaatcagctgcctacagatatccaaaatggcttttaccatctgaaaggggtggactgtgtgataatatgtctccttttcttgttcaggagagatcagttatgtaattcattgttacctgctttccagtgttttacagcaagaaatagtttatcaactatgtgcatcatcactaatctcccaaaagtagagcttttacagggtatg

SEQ ID NO: 100633 - DNA, 2801 bp, Homo sapiens
ccaggtcaaaatcgcccagtgggcagaaaagatcaaggtcaagatcaccacatgaggctggtttttgtgtttacttgaaagggctaccatttgaagcagaaaacaaacatgtcattgatttttttaaaaagctggatattgtggaagatagtatttatatagcttatggacccaatgggaaagcaactggcgaaggctttgtagagttcagaaatgaggctgactataaggctgctctgtgtcgtcataaacagtacatgggcaatcgctttattcaagttcatccaattactaagaaaggtatgctagaaaagatagatatgattcgaaaaagactgcagaacttcagctatgaccagagggaaatgatactaaatccagagggggatgtcaactctgccaaagtctgtgcccacataacaaatattccattcagcattacaaagatggatgttcttcagttcctagaaggaatcccagtggatgaaaatgctgtacatgttcttgttgataacaatgggcaaggtctaggacaggcattggttcagtttaaaaatgaagatgatgcacgtaagtctgaacgcttacaccgtaaaaaacttaatgggagagaagcttttgttcatgtagttaccctagaagatatgagagagattgagaaaaatccccctgcccaaggaaaaaagggattaaagatgcctgtgccaggtaatcctgcagttccaggaatgcccaatgcgggactgcccggtgtgggactgcccagtgcaggacttcccggtgcaggcctgcccagcacaggactgcctggttcagcaataaccagtgcaggactgcctggtgcgggaatgcccagtgcaggaatacctagtgcaggaggtgaagagcatgccttcctgactgtaggatcaaaggaagccaataatgggcctccatttaactttcctggtaattttggtggatcaaatgcctttgggccaccaatccctcctccaggattaggaggcggggcctttggtgatgctaggcctggtatgccttcagttggaaacagtggtttgcctggtctaggactggatgttccgggttttggaggtggaccaaacaatttaagtgggccatcgggatttggagggggccctcagaattttggaaatggccctggtagcttaggcggtcccccggggtttggaagtggccctcctggtcttggaagtgcccctgggcatttgggtgggccaccagcttttgggcctggccccggccccggccccggccctggcccaatccatattggtggtccccctggctttgcatctagttctggaaaaccaggaccgacagtaattaaagtgcaaaacatgccctttactgtgtctattgatgagattttagatttcttttatggctatcaagtaatcccaggctcagtgtgtttaaaatacaatgaaaaaggtatgcccacaggtgaagccatggtggcctttgagtctcgggatgaagccacagctgctgtcattgacttaaatgacaggcctataggttcaagaaaagtaaaacttgtattagggtagccattcacatcattttttatagggtagatcttcatattgctgtgattaatgcatccagattgttttcctagtatttccaggttagaacctgtggattgtttcaattgcatatagcttggtttccataacatagagcattggttgactgtttacagaagactcactcaccaggataaacattgctgtatgttacagtaaagctatctggagagaacacataaatgattttggcataccattagagaaaccatttgtaaaactcaaatgaccacataaagcttatcaaggagtctagattggttttgttttataccatatgggatgaagaaaatagaaatgtcagtagaactcattgagggtgctcttgccagctgctgaaaatagaagttggctactctcagaatttggtttaaagctggacagatttgctttgttatagggtaaagctttgtctaaagtcctcattttcttttaaaattgaataaaatttctgtatacagattcattgtatgtacctttattgcttcttaagggtccttgctgtatagacagtcctgcttcagaagttgctgctttgtttgtctaattgactcatttgtaaatgagcagaactgttttgttggtttttttccctaaatataaaagtccacacttcgtttgtgctataacctcaaactttgatttctaatgtcacacttaaaactgtgtggaataagacttttgccataaaaataaactatggagtcctttatctaccagagcctttttggtttgaccgccacgatttaggttagtcagtttaaaaattgttcatgttgtttggatggtatcgaaaaccagaaaccacttttaataatgtgtttaagatacttgatttgaagtccttttcatatggactaattgtagtatcaatttcctcctgtcccgattatgtgaaattttggcctttaaacaaagaggggcccattcataagaaagtgttatatctaggtttttaaaactgaagttgaaattatctttgttagcagtagtagtatagaataaaagatccgtatgctggttcgtagattgatacgtgttagtcctgttatttggaggctttttggcatagttgttcgatcaggagcctgtttactaaaagtcttcatacagagtacaagtgcagccgccagaggagaaaattgagattcttgaccctttcatactcttttctttggtattcaggac

SEQ ID NO: 100634 - DNA, 1132 bp, Homo sapiens
acaaggcagattgaaaagttttaggatgaataaaataatggaaccagttctcatttaagacttgaatctacttttagtcttaagtattatttacaattcattagtattctagttttttgcttctgttggatggattttgagactgagctctataaaatcacactcttgataattctatgaaattatcaagtatatagggaagatgctaagccagttttaaatactaacttctatatattctttgcatgttttttccctatagattgttaaactttgtttcctgatttgacttagacatttcttttaaatcttactgaatgattagtggtctgaatgatgtatatgtattttactgtcctacagttgttttttcttgaactttttgagtcttgggactgaactgtttccaaaattaatgccttctggaagttgaaattgtctacgttttacattgtaaatggcacgtaatgttcagtttttagaatatctaaattaaagacattgcctgtgatagcttgagggaatatttgagggcctaatatggtagctggtcattcttgtagctaaaaacttggtgtgataaacaggagtctgacctggccgttgccttttctcatctgcaggtgtgtgtggtttcagcgcagcatggctgtggtcatccgtttgcaaggtctcccaattgtggcggggaccatggacattcgccacttcttctctggattgaccattcctgatgggggcgtgcatattgtagggggtgaactgggtgaggctttcatcgtttttgccactgatgaagatgcaaggcttggtatgatgcgcacaggtggtacaattaaagggtcaaaagtaacactattgttgagtagtaagacggaaatgcagaatatgattgaactgagtcgtaggcgttttgaaactgccaacttagatataccaccagcaaatgccagtagatcaggaccaccacctagctcaggaatgagtagcagggtaaacttgcccacaacagtatccaactttaataatccatcacccagtgtagttactgccaccacttctgttcatgaaagcaacaaaaacatacagacattttccacagccagcgtaggaacagctcctccaaatatgg

SEQ ID NO: 100635 - DNA, 3653 bp, Homo sapiens
ctgtacataaatattacagtacttcatgctcttgctcattgctttacttgaagcaggtttttttctgtttcacattttcctttgtgacctgttaaactactagatatggctttcaaatgaagaatttttaaactccttagacttagttaggctaggccaggcgtggtggctcacacctgtaatctcagcactttgggaggctgaggcgggtggatcacttgaggtgaggagttaagagaccagcctgggtaacataatgaaacccctgtctctactaaaaatacaaaaataagctgcgggtggtggcgcaagcctgtagtcagtcccagctactccagaggctgaggcatgagaatagcttgaacccagggaggcggaggttgcaatgagcctaatgagcctagatcgcgccactgcactctagcctgggcgacagagcgataccctgtctcaaaaaaagaaaaaaaaaagaggctagatttctacaacatgtaaaagattaatacaatgctctagacttttgattgtgttgattacatatttgcatagctttttgtggtaaaaccatctcactattctttagcaacttgagtagttgactagacgatgaatagtttgtcctttagaaaatcacacagatttttgaaatatgttttactttttggcgatgaatattaaggtcattagttgtattttggtcttggaagatactaatttaagatgagcatcatttggaaaagtagtcgtaggtaatcttaatactgaacagtggcaaatttcttctctctccgaattaaaacatgacctttgaaaaaaaataaaaagcaaaaaatgacctttgaatatagttgtctagacatttggtcatatatgcttgtgacttgttaataacctcaccagtttggaagaaatgacagtgaaagatgagtgacctgtttttattttgggatatactcttaatatgtcaggcatttttagggtgtttttaaattttattttattttatttatttaaattttacaagtttttgagaactgttgtgatgtcagaggaaaaaacactttcccttaatattttgttaatattttgagctccagtggaattagtccttatagcaagaactcatacttcatttgttttgtgatgttggatgctattttgtgcaaaataaaatatattgaaagaataattgcagtaatttccatgagtacccttgaattgctatcttaagttgtccaagaattgttattgtgcgaacttgtgccttttcatcacaaatttggtgagaacctggggaaatagacttgtgttacggagttttctggactggtttaattataaagtgatcaaagcaattagctgtgaagctgagctttatgactgttttaattttcagtggattcgttattgggctaagttaatgacactcttgtaaatatataattattttgagatactcaaatttgaaagcaataccaactaaaaagcatgtgtgggattttgttacggtgtctttctttttttttttttttttgatatgcattctaatgaagtactctggtggtttcagactcgccttcgtaatgtacagtgtggcctgtgcgtgttgttttgtgtttcctgcattgatttttgcctccgtttattctctattgcagtctaaaagttggttttaattggttgcccacaggattgacttggcctctacttcttgttaaggaaattcatctcttgttttatcaggtaagagattttgaatagagagttcgtttttatacaaaataaaatgagatagcttattaagaaatatgaaaatatatgtagcaactatattgtgtgtgtgtgtgtgtgtgtgtgtgtgtgtgtgtgtttttgtttgcttgttttttgttttgagacggagtcttgctcagttgcccaggctagactctgttgcccaggctggagtgcagtggtgccatctcggctcactgcaacctccgcctcccgggttcaagcacttctctgcctcagcctcccgaatagctgggattacaggcgcctgccaccatacccggctaatttttttgtatttttagtagagatggggttttatcctcttggccaggctggtcttgaactcctgaccttgtgatccacctgccttagcctcccaaagtgctgggattacaggcatgagccgccacccaggccggtgtggttttttacaagtttatctgagggataggggtggggtagatgggtgctttgaacagttgttcctttgggggtcaatttcatttatatggatctatttatcttgtgattttcctgataggcagtaagttttattccttagtagcattttagactaattacaaatacagatgcttgttattgatatgtttatttatatttcctaagagtttaagtatagataatgggtcacatgttttagagtacaaattttagactttaaatggaaccttagcaagtggaatctaaccctcttgtttaagtaactaagataggcccaagttaggttgaaatgacttagctgtcaaacagttacttagtaacagaaaagcagatacttttttaaatttttttttaaatttttatttgttttatttatttatttctttttgagacagagtttcgctcttgttgcccaggctggagtgcagtggcgtgatctctgcctcccgggttcaagtgattcttctgcctcagcctccctagtagctgggattacaggcacctgccaccatgcccagctaattttttgtgtttttagtagagacggggtttcaccttgttggccaggctggtcttgaactcctgacctcgggtgatccacccacctcatcctcccaaagtgctggggttacaggtgtgagccaccgcacctggctgcggatattatttcatattttttggaagctagaaacaatttttctcatcagatggctttatgaataaatcttgtattccactttggtttaatattcagccctttccagctggtaatctgaggcagattttcaatagcatattctcatgtgtaccttgtacaaactttcagtaaatccctgctcttaacagaaaatggcttgaagacttaactgtgtatgtcactttagccctgtgtttaatttttgtgttcttgggactatatcaagtttctgtttgattgtcccagtgcaaactagtctctctctctctctcaagttgttttgagtacctggattgcccatgatgtttcccctatacaaagtgattaaccgttttttgaagttgaacaggaaatgctatcacattttgcatacagccacatattctagattgagcaaggaatgtgaatttgatttaatgacttggaaactgcttgatgaacctccttataggctgctaaatagtaaatgagaaaagagactgttggtgtgatgttttttagcgttaatttttcttgttgactcttgaagtttgtaaatgaaaagcttccccacacttcccaaatttctagtgctttataatggcctcacaaaaagcattttctgtttgctagtccatttttctggattaaatttgaaggtggctttttatttttgtgtatgtgtctgtgagaaaactgtcaaagccaagcagtttgtttcttgtttgtatacggcagt

SEQ ID NO: 100636 - DNA, 2726 bp, Homo sapiens
gctaaacatttactcatctgcgtggtgtcatgctgagaattgcagactttaagagatttctgggccctaaaaccctccttggctccaggattctcagagataacctaatataaattgaagaagttggtagggaccgttttatattattcaataatagagtcagtataacccactggaaaaaagtgtgatggcaactgaaggtttgttgaagggagaggctaggcttgtgactgcagtattttagagcttcttgcttgaatggtttgaaatggtgtaatttttgcaaaatgcagtcttagcaacaagaattgtctgggaccttgttaactagtgtatattgttaatgcatctcagagcatttgcagtcgagaaaaatccctcaagtctggacacatagggaaatcttgttttttaaattatagaactacaatacaagactggttgtacttgtttttgaaatttggcagttttgataagaatggaggatttctggatttagtggaaagtgtgcagacattttcaaagagtataaaaagttgggaagaactgttacaggtggttcaaataacgttatggtaatttatgaagaaagtgaaatgtttggcgtgtttatacaaaacaatgaagatgtgcttagtatatattattggacagatttttaatgaaacagggaatacatttttatatatgctcgattaaatgtgattactttgcttatggattgtaatgtataattttcattttctttatgttcaaatctgttagatgaaaaatgtgaagctttagaaataattgtgtggttacttgcaacgtattgttacatgctaataccagtactctttgggcttctttcaccttctttgacacgtcaaatgttttgatgattgagtattgagagtttgggagttgttagtacagtctttaggtgtgaaacttgatgttgtgggccagtgtgttccaggtgctggaatccagtgacagtgttgatagtttttactccattttgcagagagccattctgtcattgtatgaatgtatgttttcttctgtagatgttgtaggaagaaccaagtgtcagtagttggttgcacaaaagatgcttttagatgtccctccctaaaatgcagagactgatgatgtccacttttatatcttttgtctggcccacaagtgcttaatagtaaatgttcatggagtaaaggaatattgttaaatgttttcaactaaacagaaaagataattttatctaaactacagttttatcagattttactaccacacccatataccttttggtttgcacaaaatttaattaagtttaaagccagcttttaagactcaaaaacagagtgaatgtggttgtttaggttagaagtataattttgctctgaagtgaaaatgaaggtagcaacatttttgttggcatttggggggattgaaacataacttaatatttttgacaggaggaatatcttatttagaaatgtcttctgatttgctgcctttgagtacggaatggaggttaatggaaaaattgagtaatgcgttataaaaagtacacatctccatcagtgtcagaataattttttcattaagagtgatcccagactttgatatatggtccatttgggaatggggaacaaaatcaagtggctgaaactgtggttgtttcataatgtttattataatgtgattatactgtttttagcattgtgcccgttgtgattggttctctgttgctaatctctgaggtgaacatttgagagtttgtttcttttggatctgaagaacctagctctgctgtaccctggttcttgttgattaaagagtgataactgaacaaagttaaagttcacttttggatgtttactaccagatgaagagtgaaaatagtcgttttagtttgtgccttgacttcttgatgaagagatttgttgtcagacatttttttctgaaattccaagtgattagaatggctagtaaatacgaaagtctgtcttgccataatatgttaaatttttgtagcagatacttgtgatttgtgcatgcatccggtattttgtcaagttgaagcaagcctttatgttaggactaattcctgataatatgaatggaaaacatactaaagccagcttcttgttttagatcttctgaagtatatcagtggctttaatgacaaatcaggcccattttctcctttcctatcattatgctgtatgtatagatagaatatgtattttagatgttttattgtttagttattattttagtcttatccttctaaagttcagcaaagctttaggtaaatggcgtggatttttgaaatcctgcattcagtcgctagctgacatttagaatacaggaatagtagtttcctggaaaacagtgacacttatgttaaattcttgtggtttttacaaagtgaggtgtcaacacagaagtatttcagttctatttccatttacctttcccttttgaagaggtataataccaagggttgtgaagttctgacttgtagcatcaactttctgcatggttttccttggtatggggtggggtgggtattcctctttgctgaaatagaagagaatcataaatttctatctggattgattttgtgctttaagttgtacacataaaacttgaactaggcatttgtcaaattcagctgggcctttcagccttgccttgtggaatgagaaatatcttccttttaaaggtaattt

SEQ ID NO: 100637 - DNA, 2726 bp, Homo sapiens; identical to SEQ ID NO: 100636

SEQ ID NO: 100638 - DNA, 2726 bp, Homo sapiens; identical to SEQ ID NO: 100636

SEQ ID NO: 100639 - DNA, 2726 bp, Homo sapiens; identical to SEQ ID NO: 100636

SEQ ID NO: 100640 - DNA, 1036 bp, Homo sapiens
ggggctgtgcggggctcgtggtgccccttggtggcccggggcggggccttcggaggccttcgagcccgcggcaactagcgccccacacaaagggtcgaggcagggctgcagggggagtgggatgccacttaggcctctgagatctgagaggatgcaaggaggacgcaagaggatgagcctgcgtaccgaagtggggacgaggccatagcgaggactcccccgtggtctgagagggggcaggccagagctggctggctcagcggcctgcgagctaacggggactgcagtaaaaacacgcctacatcccgagtacggaggatttcttgtctcccccagtgaagcagaggttataactacatctctgtgcctggaggtggggagataatcgtagtgaggacactccttcaacccgaaatggaaaggaggcctttgtggcctaccagcaaaaggggacccaggtcacacctgtggggaggaagctgtagtcggtacactcctgtgagttcagaaaggaagtgtcacaaccggccgccttcgtggcctgaaggtggaggggtttgcagtgaaatgcctccgaggtccattgctggggaggggctttactcgagggtgtagcagttttgagaagccggcgtctgaagctaggaggtgagggggtggggtgagtacgcctcctgaggctctgagaattgtagtaagatgccaggcctttggtcccccagtagggaaggggctgctgtgagcagcacatttacggctccctcgggagaggatcctgtggcatttcaggaggacgagatccagtgggctgcggagggtgggtgcttttgatggagagttaattgagtttctctgaagcttggctgcattagtttgcagccacgtgaattgggtggtgggagggactttgaggatctacaggttagtgacggggttggacgccagtgcagcaggcttagctgctaggttgtaaacgtacgggctttttgtgtgcctccaacgtgtgctttatagtgacaaatctgaggggctcttg

SEQ ID NO: 100641 - DNA, 1036 bp, Homo sapiens; identical to SEQ ID NO: 100640

SEQ ID NO: 100642 - DNA, 1036 bp, Homo sapiens; identical to SEQ ID NO: 100640

SEQ ID NO: 100643 - DNA, 1036 bp, Homo sapiens; identical to SEQ ID NO: 100640

SEQ ID NO: 100644 - DNA, 1025 bp, Homo sapiens
aagaaaactcttccttgtcctggtgctgctggcaccttgttctgagggagacattatgggcttcaaaacccatggccttttagtagttatcagctcatttatttctggataagtaaatgaaccctgtgtccagttatcaagcgccttttgcataccaggcactatgctcagtactggagatacagtggtccccatgagtacataggatgataggtggggctgatacatagtcacttccagttataggagaagggcttctcaaactgtctttctgagctggttaatggttactgcctaatccttccttgcctgctccttagtatgaccacaagcgaatctcaaagttgtcagagcggctgatacagaatataatgaagagccttccagatgtggtgatgaatggggaccctaagcaccattatcccggtatggacttgctctttctatcctcattctggtagaggctgagactctgagacctctctcacagtatttctttcctccaggctgtatcaacctctcctttgcatatgtggaaggggaaagtctgctgatggcactgaaggacgttgccttatcctcagggaggtgagctggacggcatagacagggcctgcggcagggccacttagaagagtcatacaggctattaaacttcccagtgtggagatgataggcacaagacctcttgattaagggtaaaggtcattttgtaagtgcctctctttttttggttggctgggtagctgggtacagactgaagtttaccaccctaggaagacttcctggggtagaattttgtgccttttatcgtcccaggggatgtatgtgtctgttgtgggttacactagcagttctgttacaggcctctagaattgaagatgctccaaaggccactaagtgtttggctgcccttcaggctggtgcagatggtgcattacgtcctggggaagtgagcacatggtcctctgctgcgtcttcttgtcaaacccatgtggtatcatgctctgtcacactttgccagc

SEQ ID NO: 100645 - DNA, 1037 bp, Homo sapiens
gaattcattcactgctgcgtgtgccagtagtttgttccttttgattgataagtagtagtccatgttatggatgtacgaaaatcgtctgttgaaggaatctgggtagtttctaggtttttggtattacgaataaagttattgtgaacatttgtgtaagatgttttgtgaatttaattttcatttctctgggataaatgcccaagtgtacagttactgggttctatggtaatttcatgtttagtttgatgagaaacagaaactgtcaaactgttttccaaagtggctgtgatatttacattcccactaacaatgtatgaaccattcagagtctgtgcatcctcaccaacattttgtgttgtcactgtttttagttaactattcagataggtatgtagtataagactccttttcatgactaagtttgcctatattctgatttaggaggactttgtttgtactatctagtcaccttactcctgcatatccctaggaactagaggctgctatccagccagatactagcctggtgtcagtcatgactgtgaacaatgagattggagtgaagcagcctattgcagaaataggtgagtatcatggcttatccctgatccctgcccaccatggggctctgtatgaggtagtatactgagagctgtaatactctatggagtgtagttaggaaatcaagggaaagcctaagtactttgttcaaggacattggaagtgtcataggcagtatttgaatccaggtctattaccattttttttttcattgagacagagtatcactctgtcacctaggctggagtgcagtggtgtgatctcagctccctgcaacctcctcactctgggttcaaatgatcctaccgcctcagcctcttgagtagctgggactacaggtgtgtaccactatgcctggctaatttttgtatttttagtagagatgaggttttgccatgttggccaggctggtcttgaactcctaacctcaggtgatccgtctgccttggcctcccaaagtgctgggattacaggcg

SEQ ID NO: 100646 - DNA, 1044 bp, Homo sapiens
ttacaggcatgcaccaccacgccttgctagtgtttttttgtattttagtagagacggggtttcaccatgttagccaggatggtctctatctcctgacctcgtgatccacccacttcggcctcccaaagtgctgggattacaggcgtgagccaccgtgcccggccacacttggctaattttttatatttttagtagagatggggtttcaccatattggccaggctggtctcgaactcctgacctcgtgatccacctgcctcggcctcccaaagtgctgggattacaggcatgagccgccatgcctggctctaatttttgtatttttagtagagacagagtttcaccatgttggtcaggctggtcttgaccttttgacctcaggtgatccacccatctcggactcccagagtgctgggattacaggcatgagccactgtacctggcctggaggacatgtttcttgcatttgttggtgttttctggtttgtatgggagccactggccacatgtgcaggatgccagggactcacattcaccatggcaaagctctggcctcctccttccctgcactgatgcttctcatcctgctaaagaagtagtgtcattttcttgaatcttatccaccagattttggatatcagcattcctagacaaatcctaacatgctgtttgtagatggacccctcaatccaaactccaaagtgttctcatcattcattatttcctctctttttcatcttatttacattcagtcatcaatcagtaacatttatatctatggccatttccttataatgtctctggaattatacttttccctccctcactcccaccttcccttcttccctccctgcctcccttccttcctttctccctcttttccctccctccctcttttcctccctccctctctctctctctccctctgtctttctttttttggagacagggtcttgctgagttgtccaggctggagtgcagtggtatggtcatagctcactgtggcctcagacttctgggctcatagctcactgcggcctcaga

SEQ ID NO: 100647 - DNA, 2561 bp, Homo sapiens
ctgtatcttttaacttttttttttttttgagacggagttacctaggctggcatgcagggatttgatactggctcactgcaacctcagcctcctaggctcaagcgattctcctgcttcagcctcttgaatagctgggatttcaggcatctgccaccactcgtggctaaattttggattttcagtagagaccggatttctccatcatggccaggctggtctcaaactcctgatctctggtgatctgcccacttcggcctcccaaagtgctgggattacaggcatgagtcaccgcgcccggcctcattgaaaatttatttttcaataccagactgcagtgttctttggggcagagacgttctgtcaatgtgctttttttccaaagtattttttttaattcatagaatatttaaattttttgatacatttgtaaatatatagtttgttagtttcaatagtatttaagagtccttaatactttcttacagagaagaagaagttggatgggataccgagattaaggatgatgtgattgaagaatgtaataaacatggaggagttattcatatttatgttgacaaaaattcagctcaggtattttcatctttttttataaatgatgttaggttgttcgtctctaccttaatcttcgcacattatgtggtgcatgttatggttaaccgtcttccattatagtttttgtgtgtgtgtgcctgaaagtagctttaatatagtggctaaataaaccctccaaaataaaagaaaatcagtaacaatttgatcagggtatgagaggatttctagtaatgctcaaagcttgccatgaaatcttggcatcttgattcattcttaggctgcatacaaatcgtagagaaaagataaaacggcaaatttgagagtagaagtcattttttaataaaattctagtatacctattagccagtggaaccattatggtaaaccagtttgtggttatagagcactaagtttctacaggcaacttgaataaacataacttgggtccattttgcatacagcaacatctttaccttttttttcattttttctgtagggcaatgtgtatgtgaagtgcccatcaattgctgcagctattgctgctgtcaatgcattgcatggcaggtggtttgctggtgagtttgaatttattttttgactgattgttattaaggctctataatgaagatgctaaacccaacatgtctgtttcttttaataggtaaaatgataacagcagcatatgtacctcttccaacttaccacaacctgtttcctgattctatgacagcaacacagctactggttccaagtagacgatgaaggaagatatagtcccttatgtatatagctttttttctttcttgagaattcatcttgagttatcttttatttagataaaaataaagaggcaaggatctactgtcatttgtatgcaatttcctgttaccttgaaaaaataaaaatgttaacaggaatgcagtgtgctcattctccctaaatagtaaatcccactgtatacaaaactgttctcttgttctgccttttaaaatgttcatgtagaaaattaatgaactataggaatagctctaggagaacaaatgtgctttctgtaaaaaggcagaccagggatgtaatgtttttaatgtttcagaagcctaactttttacacagtggttacatttcacatttcactaatgttgatatttggctgatggttgagcagtttctgaaatacacatttagtgtatggaaatacaagacagctaaagggctgtttggttagcatctcatcttgcattctgatcaattggcaagaaagggagatttcaaaattatatttcttgatggtatcttttcaattaatgtatctgtaaaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaaggccacaggagatcttcatttttcaaatgttttaaagttacagaaatttgagaacagaattagcttcttttagtctcaattcagtacttgcctcttgggaaaatgttccgagtctgcggaaacttgccctcacgttgtcccccatgaattcctttattctattagagtctagccctgtgtattttagaagaatgtatcaaaactgaggggtttaccaaaaagaaaaggaaacagcctggccttaaaacctgggcattcttggtctcctgcattgtctgggcatatttatgaagaaattttcaccatttacaatacatacttaacaaaatggcttaacttcaaactggtttccaaaattg

SEQ ID NO: 100648 - DNA, 1065 bp, Homo sapiens
gacattgtctttaaacacttggatgattttatatgtcttaattctttaataatttgtagatttaaaaaacttcgtgggcagaaagcgaagaaataggaaaggatatagatttatttggcatttcaaaggattttgttttattatcccctcttatttgggtataaactcaaatctattttatccttcatctgtttggattgatgtgtattgagattttgtctaattgaactgattttgataacacataaagtttaatttccctgttaaaataggactcccaaatttctgaatgtctgtttcaagtattaggttacctcagttttctggcacctaaaagctactgataacatacattagtagcaatattaaataaggtaaaataactccagtgacatcctagttacatgcttggggtgggtttttggtttcgttttaaagtatttatgagggatactttcatgcattttccatgaaactaatttttctctttctttttttagcttcagctttagctgcagctgcctctgttcagccacttgcaacacaatgtttccaactctctaacatgtttaaccctcaaacgtaagtaatggactttattcttgatatttcctatcaaggcgtcaatagagttgttttatatatttctcttttttttttttttttttttttttaagatggagtttcgctcttgttgtctaggctggagtgcaatggcgcgatcttggcttactgcaacctccgcctcctgggttcaagcgattctcctgcctcagccttccgagtggctgggattacaggcatgcgccaccacacctggctaattttgtagttttagtagagatggggtttcaccatgttggtcaggctggtctcaaactcccgacctgaggtgatccgcccaccttagcctaccaaagtgctgggattacaggcatgagccaccgggcccggcctggtatttccgtatttcatttgaaactgcatagttttgatccttttaaaataatttttcggccaggtgcggaaactatgcctagctagtgattaggatgctaataacta

SEQ ID NO: 100649 - DNA, 1966 bp, Homo sapiens
ttaaaaaaataatatatgcatactgttggaatggtgtatttcccaatggtgatgttcttcctaaattgggaaatcatggaaactgttacagctttttgatgtgcagtatttacaattttataatatccttttaaagtgttaagtactatggccactaaaaatataaatacttgcatttcccaagtacttggaattgaattctcaagatcagggtttttcactcattttctgaccggtgtgcttccctttccccatttcccattattcccagctgtatagtagtgtagtgaaaatcacttgagatgtggaagagtagtctagtctaggaagagagagggaaaagtaagtttcccaggataagagggggaaaaaaggccccaaagccttctcaatgaggaatggggaaggaggttttgctgccaggttttactaagtgcatttgaatgaaccctgctattgtagtcctcttttattaatgctttcctgacatttaccctgttagttgaggctcttcattgttcctgcactgagctgtagaattctcttttgttatagatttgcaaacaagactttcccagcagactgaaggtgagttgaagtgttcatattttttatttttgtctttgaaatagaattaaatgtagtaagacagttttctatatttattgtcatatttttataccagtaatttggaccaaattttgacacagtgacacatagtggtatattcatagtaatctgtctgtatttcagaagacctaacccaaattaatggacttaaaaaaaatcaaaataacaatttttttttttgctttagtttgcttaaaattttcaaccttgtttttgttttatgcctacctgtgtgttctaagtgttgataagttgcatatagaagtcaggaaatgaagtattctcttattaacgagtaggcaagtattttagaacctggaatctggaagttgtcttagtataaagttgtgaatcatgctataaaactcacctttttttgcttaagacatagtactcagtgatttatttaagccagtaccaagcaataagaggtttatacatacttaaattacatgcacatttcagagaaaccattcattaagtaggctatgatttcttgtttttagttatcactaaatctctgttgcttgacatgagcattttgctgttaatgtaagttctatatcttttgtaggagtatgcttaatgtttagggaaatgattatgagaaagatatgtcatgttccatcacagtcaagaattaaattttttcacaaacaagatgcttctaatcagtgctgttttgttaagagatttttaaaagattttcctagatttactgtgttctgcattgatctagcttgaacgtgaatgtttgtatagtacgttttcttaatattttttagtattcatagtatataatcatactaaacttgagaaactggaagaatcaagtcttcctcagttctgtttagactttctagttttttttaaggatacttccatatcttctgtaagctacacagtgagcttcatttttgcacagttataatacactctcgaatctttaacttttttccagcagaatttgacatgttatattaaaattttgttttatttaaaataaaactttatgaaagaaaaaacttatatgttacagagaagctaaagcacctgtaatgctaccagaaagttatcatttatgatatatttcatgcacagccctaatttctcggtgtaatatttctgatactttaagtgatcgtttattttaattaccataatttctaatgcactgttttatccttagctttgtttgttattatgttttggaatgaaatttggtcagataatatgattacggtgagttctgtaacagctactggtaatatttttgtaaatcacgtgaaagcattggagcaactgtcttggaaaatgctctttaaacttcaaaccc

SEQ ID NO: 100650 - DNA, 1050 bp, Homo sapiens
ggctgaggcaggagaatcacttgaacttgggagggggaggttgcagtgagccgagattgcgccattgcactccagcctgtgcaacaagagcctgtgcaacaagagcgatactccatctcaaaaaaaaaagagagtttcacaattgttgcccaggttggtctcgatctctgggatttaagtgaaccacctcccttggcctcccagagtgctagctaagttacaggcgtcaaccaccacactcggccctccttgcaatttattttagtgaagtgatcatgatattaatgacccaggaaacttcgtttctctgctctcaacatagtaggaactttaagactattcttttacaggtacaggtttgcagattccgccagcagcacagcaagctctacagatgagtggctctttggcatttggtgctgtggcaggtaggaattgaatcttttctaattttaaatcgttttttcatctaattcgaaaattttccaaatttttacatttaaaaggacttactgagaattcaattcatcaagtacttatagcctgttagtttgtagtcttctatttaaggaagtggagacatagggtagaattaaccatgcatcaaaatgagttgtcaggacagttttaaaccctgcaccccagtttttagtcgaaattcattgacataagtttattttcaaatatatcagttttattgaatactacaaggtgtatattgtttgatcgaaaaaatatttataatattagaatttagaaaatatcagaggcacttaaaaaagctttacttaaaactattgtagtagtaagagtgttgagacagttatttttctttatagtacataaaaatttaagatcatgaattgggaggtggagcttttggaggcaacaggaaaagaagggtgaattgacgtttttacaattatgtataaagggatttagttcataaaacactcattcccctgtgccccccaaccccccgcccccttttttttttttttttttttttttggataacagtagacttgctctgttgcccaggctggagtg

SEQ ID NO: 100651 - DNA, 1105 bp, Homo sapiens
ttttatatatgaggattatattgactattttgtccctgggcacatttttgttagaaaagtactaaattctacctcaggtggtctgcctgcctcggcctctccaagtgttgagattacaggtgtgagccactgcacccagccagttttcacattttctaaccacaatccccatgttctcaaatataaagctgtcattacttgtaatatcttttatttaaactaccacatcaacaagcctaatttgcgttagctagcgtcgtcatcatgtatgttgtgtttgctacttacagcttgcagtttctaccttagtattcagaagtaattattgaatatgctaaaaatataaatatatttttaagtatagtttgtattttaaaaattaaagcactgtctcctgtccttgcctcccctatcatgtagttttctgactcagaatgtgccaaaaaggctttggaacaacttaatggatttgaactagcaggaagaccaatgaaagttggtcatgttactgaacgtactgatgcttcgagtgctagttcatttttggacagtgatgaactggaaaggactggaattgatttgggaacaactggtcgtcttcagttaatggcaagacttgcagagggtaagtgtttcttgctattacgaatgatttactgtgggtattgtagtggaaaagaaaggtagccatgtaaactaagaaagggaaaaagattttatcttattttgtagttggcgttatccttggtcacactgcatattattttatagatgatgtgccttgtattaatgtatggaaatctatattatgtgttttgaatgccacagtataagttgcaagatttcttttcctttatgtagtgtttatatgtcatacttaggaataaatttagttgcagctattataatgttacaagtttttctttttgtaatttcttattttttgatgcagggtctggctctgttgcccaatttggagtgcagttgtgcgatcctggctcaccgcaacctctgcctctttggctgaagccatcctcccaccctaatctctaaatagctgggactaacagttgcaaacaaccaccaccacgcctggctaatttct

SEQ ID NO: 100652 - DNA, 1057 bp, Homo sapiens
tttttttgtttttgttttgttttttgagaccaagtctcgctctgttgtccaggctggagtacagtggcgtgctctggggtcattgcaacctctgcctcccgggttcaagcaattcttctgcttcagcattccaagtagctgggcgtacaggcatgcgccaccaagcccagacaatttttgtatttttggtggagacctgatttcgtcatgttggccaggctggtcccaaactcctgacctcaggtgatccgcctccctcaacctcccaaaatgctgggattacaggcgccgaccaccacgcccagcctaatttttttcattttacatataaaattatagtttctagacttaaaaaagacttcttggtgatgaggttttgtgataagtcttctattttggaggatgaggagactggtagatttttaaaaccatgtctcagggaagaaagtagttttgtactctgcttttaagttatagtaattatgcttttcaattatagattgaaagtatccagctgatgatggacagtgaaactggtcgatccaagggatatggatttattacagtaagtaattaccataattatattacttagggtttttttttttttaaactacatttgctgtgttgctcagattagtctctagctcctggccttaaatgatgtcccaccttagccttccaaactgctgggattacaggactgagcctctgtgtccgatcaaaaaagtttttttcacaacaaagggtaatatgcccttgtaacaaaaggcaggcacagctcacacatgaatgtgaaaaccaaatcatcacacttaggtactcctaaaattttttgatccaagttgcatagtagaagtacaataatagttaataatggtggggaaggtggcatgtttaatattttcaagtgctttaaattagtttttgtggccgggcgcggtggcttatgcctgtaatcccagcactttgggaggccgaggcgggtggatcacctgagattaggagtttgagaccagcctggccaacatggcgaaaccccgtctctagtaaaaat

SEQ ID NO: 100653 - DNA, 1039 bp, Homo sapiens
cctcagcctcctgagtagctgggactacaggtgcccaccaccgcacccggctaattttttctatatttggtagagatggtgtttcactgtgttagccagtatggtcttgatctcttgatgtcgtgatctggctgctttagcctactaaagtgctgggattacaggtgtgagccatcgtgcccagccaaaaactgtactcttgaagctgtaactccctaatttcctgcaggcccttggtaaaatgttatctacctcctctttctgaattttgcatattctagatgcctcctattaagttgatatgtagtatctgacttacgtagggtagtatttttatcactctaaactttaacattagttgttatgcaaatggaaggtgtatgtctttaaactgctgtgtgttatctctgtgtgacgtgtattttgtcttctaggcagaaaaaaacagagctgcagcaatggcaaacaatttacaaaagggaagtgctggacctatgaggctttatgtgggctcattacacttcaacataactgaagatatgcttcgtgggatctttgagccttttggaagagtaagtccaggttcttcaatgaatcttcagtaggttgttgatctgagtataactacataatttctgtatgtcttgctttgttatctttctgtgagttaatattaagaggataagggctggttttataaaaatttctgtgacaacatagattaaaataggtcacttgatagattcttaaaagaatgttactgttattcataatgccatgtgaaatgcataatgggtattagagttaataaaaagtccacattggctgggcatggtggctcatgcctgtaatcccagctacttggggtgctgaggcaggaggatgacattagcccaggatttcaaggttgcagtgagccatgattatgccacttcactccaccttgggtaacagtgtgatcctgtgtcaaaagaaggaaaattgttaaatcatacgaagactattattttttagtaggattttttttaaaagattgttt

SEQ ID NO: 100654 - DNA, 1481 bp, Homo sapiens
cagcttactctgtttactgaacatgtttgagaattattttaggccaggcgtagtggctcacacctgttatcccaccactttgggaggccaaggcaggcggatcatctgaggtcaggagttcgagaccagcctagttaacatggtgaaatgccgtagctatgggggagtttagggcaaaaggattgcttgagatcagtagttcaagaccaacttgtgcagcatagcaagacctggtttctaaagatggaaatattgttgtggagttgggaaaggagtgagggtacagtatatactgctcaggtgacaggtacactaaaatctcagaattcaccattaaagaactcatctatgtaaccaaaacccacctgtacctgaaaacctgttgaactatatgaagaaataaaaaagataaaaattattttaaaatctgttatgaaattaattttatatgttttactcctattagagaacctattgataatttaactcctgaggaaagagatgcaaggacagtcttctgtatgcagctggcggcaagaattcgaccaagggatttggaagagtttttctctacagtaggaaaggtaatcttaacctgtttagggaggtcaagtaggtagaaattgcaagagaaaacatgtaaacatcaaatacttcatttgatttagtagcagtatttgtttgtggtaatgtttccattttgcctcttgtagtattggagttgataaatgttactacaaatttgttcaaagataaagataggatataggaattgtcctacagatttacttttttaattaaatttttaaaaataccttcatccttcaacagtgtctcttgaaataattctacatgtgttacaatggatgtttgcacaaacaactgtgttttctttctaggttcgagatgtgaggatgatttctgacagaaattcaagacgttccaaaggaattgcttatgtggagttcgtcgatgttagctcagtgcctctagcaataggattaactggccaacgagttttaggcgtgccaatcatagtacaggcatcacaggtaatttttttgttggttaagagtttgattattggtggtgttgaaagcctcctgttgcatggtatagtgctgttgtgttctgtgactgctgctcattacgttgagtcggatgttttcaggactttttttttttttttaactttgcgtttattaacattgatacagttttctcaagactgtcgtcctgtcgtttctccttgtgtttgaaatgtaatgattttgccttttttttgttttgtttttgagatggagtctctctcaccaggctggagtgcaatggcatgatcgctgctcactgcaacctccacctcctgggttcaagcgattctcctgcctcagcctcctgagtagctgggattacaggagcctgccaccacgttcggctactttttgtgtttttagtagagatggggtttcatcatgttggcc

SEQ ID NO: 100655 - DNA, 1322 bp, Homo sapiens
aacaactgaagtatgtagtgtgttaagtggtgtcatgctgtcttaagagttactggtgaatggggaaatacctaagttgcatgactaaagaattcactttagtttttaaaagaagtctttcaaaaagaagatgtatatgaaaattgtatatgtacatgtacacacatagattcccaagagaggatctgcaaagatacacaccaaattgttaaccatagttactgctggtgtgagggaagttcagagggatttattttttatatatgtgtgtgtgtgtttttttttttttaattctcaagactgtatatatatatgtagcttacaaagatatctaaagtctgaaaatgggtgtgtgcattttcagaatctaaaaattttgaggctgtaacctttggtcttggcacctctcagtggtccaggatggataaatacaagggcagcttgcctgggaataaagttaagagacaagtatttttgtttcctcttcataactgaggtggaaaagcagtagcctaaacaatgttagtcttgctggagagcgcatgaatgcgatcttagcaagaccctaaacctgtaactagtgtaattttgtgtttcctttttagctccggaccaaaatttaacagtgccatccgaggaaagattgggttgcctcatagcatcaaattaaggtttttaaacatacttctgaattgtttaaattgtttttcaaggaactaacatgctgtacttgtttggataacttctgaaactttttaactttgcagcagacgacgttcccgaagcaaaagtccattcagaaaagacaagagccctgtgaggtagtttacttctttaaagcctttagctcttaaaaagcttttgcagcttatggtactgttaaatttgatgatatttagtaatttggaccatattaaatcttgcttttgctttcttttgcacttccagtactttaaggtcaagtgaatttctactgagttttcagtagttttcactttaatttcatataattaaagcaacagttatatatttatttatttatttatttatttattttgagacggagtctcactcagtcacccaggatggagtgcagtagtgcagtcttggcttactgcaacctccgcctcctgggttcaagcagttcttctacctcagccctccaagtagctgggattacaggcatgcaccaccatgcctcgctatttttttattttagtagcgatgggatttcaccatgttggctagcctagtgttgagctccggacctcagatggtccacccaccttggcctctcaaagtggtaggattgcaggtgtgag

SEQ ID NO: 100656 - DNA, 6328 bp, Homo sapiens
accttatgttaatgaaaaacgagagaaaaatagccatttatttgatttctttttggctcttttcctcctaagatccctaaatgcttcatagtaagtatgtcagtctttctcactacaactgtgttaggtaggttgataaaatttcataaaacagatgagaaaatatataatgttattcagggcttgttaagccactattttttttttttgtagttcccctaaaataatgtggtaatggattaaaaatgatataatttgtagaaaatgtgctccttttttctggtataagcttggatgggagtcatttatagttcctcaccaatcacaagaaattgtggggatcaggttgggtttagtcttgatgtgggatctgatgcaaccaaccagaggtatggtttatgtcatctggttttagactttctgccacagtaatggtttcctaatgtttttgttttgcaattctctaatcaaaagaaaacccaggaaggtgtatccatataaattgacataaattatccaatttaggtgtcaggccgagtggctaaagatttcgcttcaagtgccagaaggataagaacgtacacttttgggtacagaccttcgttactgtaccattgtctcatgtcgctttttgccactaaggtcatctccggtgtctacttgtttttatcctgtgtataagctgattaaggctacaagcttttacaaggaagctgagcatcaagttctccatgtgtgatattcggtggcctttgtctaatgtagagaaccacaggactaaataggagaatggacaattttctttaaccatgagattgtctaagggaagatcctttcaaaacactttggtaatcttaaaatactttccagtcagacttctcgtcaattataggtgataaataaatgattcccttgttcaatcaggactcttgattttctgaaggaactttatgtttcaaattaattttaaagttacctggaagaaaatttttgtatttaggaatagatataaaacatacagaacactctgctttaaacctttagtactaaattaaatttcttaaccaaaggaaagtgccgtgttgcatttttcattctaaaacttcattgtcttaaaagccacattgagctatagtttgttaggtagtagaaaaatggcatgttctgagaaacagttgactgagtataaatttttttaattgtataattctgattcttaacatacacttcatagtatcctagaatagtaaaaggaacaaagttattgtgacacagactggttgtcaacctattttctgaagagctgtaaacctgagtttttgcatatgtcaaggtatgcatcctaagtgcttgagcttgccctcatgggaatattatttgttaaagtaaccagttttgcaaagtctaaatcagcgtccattccgttaagctctttagagaattactcaataaaagataacattaaaatgacacagttgaaatatattggctactgtggtgtggattatctataaattttggaataaatgacttttctattttttttcttattttccagaatactttgcattaaaaatttagatcttcttacatggaagaggtcaaatccagttatagcaaaacacctttactgcagaggccatataaccaaaaagtccaaaggcccagcccagtggaccatttacttcagtgatgttcagtacaaaatttcactgccattaaagactttggaaagtcccttttaagttgtaacaggatttgactattagtgtggatttcgataacccttctttagttaatgtaataaatgctctttgaagctggaaatatactggtttcttgcacccttgtagttttctctgggcttttatgcaaaagattgtattttctgaatgtcttagtatgttgctgtctttttacctgcctggggttgccttcagatgtgggtgaggacttgtttacaaaaagtcctagaagaccttaagttaaaattagctctccaattttcaagtgttttcttttggcagaataagttttgggtcctatgagaggtaaataggttggttgcctctcttgctatagcccatctagagcagaacaaaaactttgtttttgagggggatggagttactttttaccttgttccctaattgaatatatttaggacttttggttttagaaatctcagagttctatagttggaatagtgtcacagagatagtgttaggtttcttaggcaacaaaattggagtgttacctattgcccatctgggcatggctttgatgagttctatataaataatgagtgtagcctaattttctgtcatgtgctacctagcatatacatttctgacagtcaggtggattatcttgaaattttagacaaactttctgcctccttggaaagctctacatctccttgtgattggagtgtgggtttcaagattccagaaggtgggtgtcttcattttctattttcaatgcactctaaagatgacctgcttacaggttctctgaggcagacctcagttgctcttgtgatatgtaactttgctttgataaggaataaacaattacatatccagataatgatacagaattgtcaaaatgtttaatcattaagccactacaaatagacattttcgtggaataaactgattttgaaatgtctttcaatttatattgaaatatctgaaggcacctctaaaatttgggtgatgacacagaggtatagattataagatttaattatgaatgggtggtatactgtgaagactacggaagtgagcagaaagatatgtttggcttttttggtttttagttagagattttaaaaaggtctgtgaaggtcaagttgatcattggttttgattgcatcccacaggtttctataaactggcttaaaaatggcatactccattttctggtgtattcattgtaactttaggaagtatttgaaatggtcacattaaagtctaggaatgtcaaattgtattttaatgcgttagttctttttctttttctttttttttggagacagtcttgctctgttgctcaggctggagtacagtggcatgatttcggctcactccaacctctgcctcccaggttcaagcgattctcctgcctcagcctccacagtagctggaactacaggcctgtgccaccacgacccactacttcttgcattttttagtagagatgggttttcaccgtgtcgactaggctggtcttgaactcctgacctcaggtgacctgccttcctcagcctcccaaagtgctgagattacaggtgtgagccaccgcacttggagttgggtttttttttttttttttgagatggtgttttgctctttttgcccaggctggagtgcaatggcatggtctcagcttgctgcaacctccacctcccgggttcaagcaattctcttgcttcagcctcccaagtagctgtgattaccggcatgcaccatcaggcctggctaatttttgtatttttggtagagaggggatttcaccgtgttggccgggctggtctcaaactcctgacctcaagtgatctgcctgcctcggcctcccaaagggttgggattacaggcgtgagccactgcactggcctgcattagttcttattgtcctttgtcattacggttttgcccatgaaaaccaaaatgttgatgtctatgtgaccctttgaacgtgttaaatatttccatatgtaaatgggggcaaaattgacttaatggtaaattactatatttgatgaaaatttttataaatgaaccagtactagtacttgaatgtgaaaatattctattgtaagtttgttttattaatttattttgtggattacagtaatgcttttgttggcctgttgtatgacaaactatttaaaggttcacattttgatttgtatttgccaacaagcccttttgcttgttaaagctatagctaactctcaggagataattgcagttctactcttagaggatggtgtctttcaaataatgtcttgtctgctgattttcagtaatgttaatataaggcaaaagggatattgtttactatacgtagcaatttttttagacagagtcttactctgtcgcccaggctggagtaccagtggcgggatcttggctcactgcaacctccgcttcccgggtttgagcaattctcctgccttagcctcccgagtagctgggactacaggcgcacggtactatgcccggctaatttttgtatttttattagggacggggtttcactacattggccagactggtcttgaactcctgaccttgtgatctgcctgcctcggcctaccaaagtgctgagattacaggatttttttttttttttaagtatgattatgtaccattgtatcatagtaaaactagccaaagaaatttatgaaaggatgaaaaaatgattctggccataaaaggtagtatattttggtgggttcttaagccagcatgataatggcgagtttttttcttctcaggaggaaaaaaagcaagagcagaagtcgtagtcatgaacgaaagagaagcaaaagtaaggaacggaagcgaagtagagacagagaaaggaaaaagagcaaaagccgtgaaagaaagcgaagtagaagcaaagagaggcgacggagccgctcaagaagtcgagatcgaagatttagaggccgctacagaagtccttagtatgtaactatagttatgattttggtttgagggttattctctgggtattcagatggcagtttaacttgagtgatttgaattgtgaatttttatttttttaatgattggttaaaaagtattgaattaaggatattggcattgaatactagtaaagtgaaaatacagtgcatagacaaataagtaaaaatttgcttttactaggcatactgactattttctgttaaactatcagagtttctaaattgtatgccagtcaacgcaaactggatgaaagcactagagtgcttgaaaaagatgacattgtagtgcccaaatacctaagaaagcttaacaagtgtctgggctgttacagtatttgctaaatacatatttacttaaaattgtaaagttctgatgaatactaagttacacatgtataattagttaacagtaaataaaaagtctgtcaccgtggctgttttcagctgaaatgtcaggccagttgtgaatttgttgtgtatgctcattgataaagatccttttttgggctcatctgtatttaaggtttgttaataataataaaaggtattccaaactaaaagtgttttgaagattagatcactagaaatttggatgtggatatttaaagttggaaacaaatatattatggttattaaataactatattaaccacctacaattctaaggattgcatctagcaatctttaatgctttatgaggttaattcctcttaataaacacagtgctgtaaactctgggatatattaaaaataacccttctaacttctaagatttgaatggttaaggatggaattcaaagacaaacagacccgaatcacttgggcaagatacttaatcccctaagctaagcatttgttttctaaccttttaaggagataataagtttcagataagctattaatgagtaatgaatgagaagaaaatgtaaagtgctcagaggacttaatggattcatgaaatgttttggcattacatgaattccgattctggctcttttatctttaaaataaaaagaattaaactccgtgatgctggtttcctccaagctgcttatttcattaactttttaatagctgaaaatgggaccacaatgctattttaatttcgaatgctgtacaacattaggaacttctctgcttttgtcccatttatcaagattctgagcatttttaaaatgggattatgttaaatctttttaccaggatgaactaaataaggggaaaggaattagcttaattcctttgagtgatggatactttgtttgctgggatcatggcttaactttaataaaaaattacttagttcttaatgttgggtttgaggctgtaactcagaatattttataattaaaggggaaagaaaatagcttataactaattacttgagaactgtaatacatccagtaaatgattctcagtcatcagcattagtctgaattgcaaagggtcaagttaatataaagtgttttatttggaaatacttgcatgttgtaggtaggcatggtgttcatgaaaactaattcaaatgtgtggatcacaggccactatgtatttatttatttcgctgttcttctggaataagttagcaggatgagcactaatggacaa

SEQ ID NO: 100657 - DNA, 3539 bp, Homo sapiens
taagttttcgagtgtgtcggctgagaagaaaaattcagtcgatttgaaaaacgtttaccaggccgggcgcggtggctcacgcctgtaatcccagcagtttgggaggcagaggcaggcggatcacttgaggttaggagttcgagaccaacctcatcaacatggtgaaaccccgtctctaccaaaaatacaaaaattagccgggcgtggtggcaggcgcctgtgatcccagctattcgggaggtgaggtggtaggatcgctggaacctgggaggcggagcttgcagtgagccgagatcgcgctactgcacttcagcctgggcaactagagcgaaactccgtctcaaaaaaaaaaaaaaaaaaaaagaaaaatgtttactcacggaatcgtcttgttcttttcctaggcgtttagagaaaatgttagacgatataggcaacaagagtgaaacttgtttcacattgtaagagaaatgtttactcaagaaattgtcttgttctcttcctaggcgtttagagaaaatggcagacgatattgatattgaagcaatgcttgaggctccttacaagaaggtgagaaaaaacatgtcggtgaggtttatatatttcttaatttagcattattcacgaaactactgctgaaatgtaaactaacctccccggagccctcttgatttatcttatcagagatgcattacgtgtaacttacaaaagtaaatatatgctattgatgtaataatattgtgcagtagtttcacttcagcgtgatgaataaatgcccatctatctctctttgtagacttgcctaacgatatctcacctctactcccatgaattcacctttgattccagtgtgaactgtcaatcataaggtagtaattgagtgacttatcgctgtaccgtggtcccctaggtaaaatgactcaactaagaattaccacctccagtttggtatagcaaaaaggtgaatgtagtggtttgggaaaaagcaggggtccaagaataacaaagcatgaccagtctgtggcaagttaaatcttctaacagtcttataagaagaaatgggtgagattttaaaatttatgtatctatgtaagactggtgatagtaaatcttaaaacagtccagtggcaatctgctgctcagttaataattactaaaattcttggatccctgaatagaaattaaaaaaaaaaaatacaagaggcagtagagtcaatacaagcttaatacaagcttagagtaaatacaagcttagagtcacttgatgactgttttactgttctccatattgtttttatttttaattaggccctaccatagtatttcacactaaaaacaaaggaattatattggctaatatagtctttgactcatttcggtatctcagtaaaagtaaactgtcttttcattgtttcaccagttggtggtgaaaatagcagtatgcatgcattatcactggtgtcacaaactgtaagctttgtaagttagcactttactcctatagctgatgtaatcaaactttaaaataaacatttcactaaaccttttaaaaataatacatttgttttggattgtatagcacgaccatgtggtaccaatttggatgaattcttgatagatttaaatagtgtatgtaattttgtaatgcttagactcttgaagagctactttctgttttaatgttaagattcttgtgtcttagttttttttaacatggatgtaattccatgtaaacaggtatggaagtaggaaatgtttaggctggacttggtggattattaattgactttcttgggttcttgggagtcaacattactaaagcagtgtgaatccctgtttgcttcagggcgagatgtgtgacagaggtggcatcaagctcttacagtcccaaccctccaacggaaatgggcgaagatctcaggaatggcatcggtcacaggaaatcgatagtggctggctgctagcatggccacttggggcttaggcagaaatagagccatggtactgaccaaagggaccatagcacatggaataaaactcaaaacaggacttcatgttttatggaaattatatttaaccacttcaacattgtaaatctggataacttttaatatctaaactatataagaaagtaaaatttaacatgttaatatggaaaatttttttatttttgtatcttgatgacttaaatgtaagcaacaaagtggttaaacacatacccatctaaatttttttatagccttccatgttaaactataagtaaataattagttttaaaattgttttgtattttcttattcctgttccctttaccctttgacaacttgaaatgttaccacttcgtcctcatgatgttcttctatcaaccctgcttaggatgagaacaagttgagcagtgccaacggccatgaagaacgtagcaaaaagtgagttttaagaaggggcttgggggagggtggtgagcttttttgtggttttagaccttaagttgtgttcctgtggctaaagtatacaaaattctcttctgaagcttttctttgctgcttttagaaaattggttctttgccttttgagacaaactcttggaggaactgtggatttttttgcttagatttcagaatatagtttcagataccttcccctccaagtccatcatgacaatctggtgacaagttctgtattagaggttgtcttgttttaaatttgttaactttggtttgatatttggttatcttactgataaaactgttatatatccattgatcttaaaaggtagaaagagttaaattaggtgataactaggccatggaaagtattgtttgccctaaagtgccgaaggagtcaaagctgtgaattatttctgcaacttgctgctcagaggcccttttggaagtgatggaacaggtacttaagtacttctaaaggtggctttcattatcttaggccttttaaactctagacttaacagggtggggattttggaaattatgaatatatctgtacactttatttgggtaagatgagtgactcaatagaactctgctatagactagtacagaaaacagtgtacgaaaagtcttaggtaacagatatgatgagatccactttttttttttcttttcttgtgagtcggagtcttgctctgtagcccaggctggagcgcagtggcgcagtctgggctcactgcaacctccgcctcctgggttcaagtgattctttgatttttttttttttctttgacatggagtctggcagtgtcgcccaggctggggtgcagtggttctatcacggctcactgcaaccactgcctcccagattcaagtgattcccctgcctcagcctccgattagctgggactacaggcgcgcgccatcacgcctggctaattttttttttatttttagtagagagggagtttcaccgtgttagccagaatggtctccatctcctgacctctcatgatcctcctgctgtggcctcccaaagtgttgggattacaggtgtgagccaccgcgcctggccttttttttttttttttt

SEQ ID NO: 100658 - DNA, 1331 bp, Homo sapiens
ctggccttctgatacacttttccacttcctctccaccctcagcggataatctgaatatggccgttttatcctatcgccataaggactaggttgccttatggcgaccttgacagccatctgtgtgggaggccggagcgggggcgatcggctgtgccggaggaatcttcagatggccgtgaggaggcgccacgagggggaggtgaccgctgagctccactcagcgaagagctctctgaaagattgacaggcagcctaccaactgtctttgccctagagacccgctctgtctcgcgagatttgggtgcttacgcggagggggagtgaaaggcgcctcactgaatgggggatgggaatatctgtggcgcaatcattgcgcgagattgggctacggtcgccggagccatacttaggtctcgcgatacttcggccgctcaaatttggagcttggggcagcttctcgcgagagcccgtgctgagggctctgtgaggccccgtgtgtttgtgtgtgtgtatgtgtgctggtgaatgtgagtacagggaagcagcggccgccatttcagggagcttgtcgacgctgtcgcaggggtggatcctgagctgccgaagccgccgtcctgctctcccgcgtgggcttctctaattccattgttttttttagattctctcgggcctagccgtccttggaacccgatattcgggctgggcggttccgcggcctgggcctaggggcttaacagtagcaacagaagcggcggcggcggcagcagcagcagcagcagcagcaatctcttcccgaacacgagcaccacaggcgcccgaaggccggaacaggtacggggcgttgcggacccgcgtattatctcagctttctcgaggtttggctccattttgggctgaggggcgcttttggaggtctttagcgaccggggtggggggtggttttcgagaaatcggccctgtttcagtgaccgcgcccttattttccagtcgggtatagtctggattcttggggcggtagggacccccgagaggccgcggtagaatggtgacctgtctccttcgaggcctgggccggccgcgacctcccaacatggcgccagttgaacgctgccttggctcataacccctcccaatggagggagtttctctttgcccctaaaatggcagcgcgggtttttgcccggaaagaggcgctctcgttcgggtctcccagtttctgtttttggagttgacagcagagttttaaatattggatattgaagtcttcattttcgtgtgtttcgtgtaagaggcgttttggatttacttacgtaagccaaacctggttaaag

SEQ ID NO: 100659 - DNA, 1024 bp, Homo sapiens
aatctcttgaacccgggaggcagaggttgcagtgagccgacatagcaccactgcactccagcctgggtgacagagagagactccgtctcaaaaaaaaaaaaaagaaaccagattggtctttgccaggagctggagggaaggaggaatgtggggtgactacttaatggctataaggtttcctgttggggtaataagaatttaccagaactagatccacctagttaagagttccaggtagtggtagcgatagatgctctggatcgagttgtaaagcccaaaatgaaaagagtcaagagattccttgagaagagagaaccaaaactcaatgaaaatattaaaaatgcaatgctgattaaagggggaaatgcaaacgcaacagtgacacaagtacttaaagatgtgtgtgcactgaaaaaaccatacggtgtactgtataaaaagaaaaatgttacaagaccttttgaggatcagacatcactggaattactttcaaagaagtcagattgttctttattcatgtttggctcctataataagaagcggccaaataatctagtaataggtcatatgtatgactaccatgtgctggatatgattgaattaggtattgagaattttgtctctctaaaagacattaagaacagtaaatgtcctgagggaacaaaacccatgctaatatttgctggtgatgatttcaatgtaacagaagattacagaagactaaaaagtcttcttactgatttcttcagaggccccacagtatcaaatatctgcctggctggattagaatatgttctgcacttcactgcactgaatgggaagatttactttcgaagatataagttgctgttgaagaaatctggttgcagaacaccacggattgaattggaagagataggaccctcattgaatctggttctgaggaggacacacctggcatccgatgacctttatacattatctatgaaaatgccaaaagctctcaagccaaagaagaagaaaaatatctccaatgatacttttg

SEQ ID NO: 100660 - DNA, 1096 bp, Homo sapiens
tgcagagcacgcagagtccttctgtcggttggtcctggagcggcgcagccggagtggggccgtgaggtgagctcgcggccaggcgaagccggccggccgggccgggttgggccgggcccgcgctgcgcgcgcgccgtgcgggcggggacggcgacggacgccaccgctgcttcggtcccctgcccggccccgctccccgcctggccccgctcgcccagcctggagggaggccctgggactgctgctgagagcgtggcgggcgtgcgagcggtgcccaatccccggggctacccgcaagagtggcggcggctgccgccaatcagcgccgcccgagggggctgggccgtggggtgcgggcccggggcgcggagcgggccgtgttgggggtgcgggtaagccctagggcccgagcctgagctgtgtgggcacctagagcctcatcagcagcctctgctattgccttgcgctttgggaatatgttttttaaaattggctttttttatcctattctggggagcacattcctttctcaagaccccaaatatgggagtgtcccttttctctatagttttgaaaactgggcggcacaccccctttcttaagctctagctctggaattttatctaaatttctaaaagccctcccccccccaaatttagggcgtaccctcttccgtcagcccccaaagtgggagcacattccttttttcgggcctccaatttgattctgcatttccgttccaatttagaggttcaccctgttatcgggtcctcagatctggggtccattagctaaagttttgggatactttcttgtatcccctctactccaaggaagaattccccttttccaggtcccaaatctgacagcatgccttctggaatttcttacatttaggggccacttcctttcctcagcccttcaaacctgaggttgggccgaaaacaatgtccaaattttgaagtttatgggtacttatttccagtttcacaaataagggaattcactgccttctcccgagactgtattattggggttacacacttttcacgtgttccccaaatcaaactaccttatttcctgaaggagactcatt

SEQ ID NO: 100661 - DNA, 1014 bp, Homo sapiens
cttccacgtgatcctgttgccagccctaatcaggacaaacctgaatgactagactattttgtgtccctgtcctcctccaacccctattcctcacatgagtgtcagatcctattcagtaacggatttgatctggatttggctctagtcctagctcttccatttactgtgagacctcaggcaagtcacttaatgctatgggcctgcttctccccatttgtaaaatgaggggctgatgatctgcaatgtccaccctggctgaatcttggtcgctaccttgcttagaaaccccattgcctgtggtagcttgttgcagcagatctgatttctttcatgtgctcccttgggcagcctgccagttattcccttgtccaagtcacttctgccattatctttttttctagctgaggcagccagcttgttctcaacccaacttcagcgttcttcttgcttccatgtcttcttccagttccatgctgtatttcattcagaactacctgaaatcctcaaagaagtcttcctgagttctccattcaatgtttgtgacttctctgccttaccaagaaggagtctgtaccttatataccccgtatttacttgtcagttctcttatctaatgtatacttaaaaagggacttcatttcctccataccacagctttgttttttggtttgaattagcagggcaggtggcatgaaatttaaagaggaagcaagcaggttgtttgcctttggctgggatttggggaaagtatgagatgtaatgtttttagtccccttccccaagatctcctgtatctgtgggaatcagttgcctggtatgtcttcctggattgtaaaggtgcttaaacttcctttctgaagtttgaaagtgtatcctaagtgcaaataccatttgacaattactcgtggttgggtgggtgcagtggcttacgcctgtaatcccaacactttgggaggccagagtgggaggattgcttgaagccaggagttcaagaccagcctgggcaacaaagtg

SEQ ID NO: 100662 - DNA, 2050 bp, Homo sapiens
atctgcttagataggcagtttcagcatagagtgatgaatgctgtggcccagagggtaggttaggttgccatgggagaatgcaggtgtgaaggaagtccttcagggaggttccaatggctaatcctggtcatgaaggaccaggaagagaaagcagcttgtttggccaggtgcagtggcttatgcctttaaccccagcactttgggaggcttagtgagggagggggcagatcacctggtcaggagttcgagaccaccctggccaacatggtgaaactagagactagcccgtctctagtaaaaatacaaaaattagcctggcatggtggcttgctcctgtaattccagctacttgggaggctgaggcaggagagtcgcttgaatctgggagacagaggttgcagtgagccaagattgtgccattgcactccagcctgggtgacagtgcaagactccatcaaaaaaaaaaaaaaaacaaaagcagcttgtttatacaaaggccctggaggtcggaactgcagggtgtttggatgtggcaggagtatgggtggtaagaacagtaataacccttttttctttttctttttctttttttgtgacgcagtcttgctctgtcttccaggctggagtgcagtggcgggatctcggctcactgtaacctccacctgccgggttcaagcaattctcctgccttagcctcctgagtagctaggactacaggcgtgcaccaccatgcctggctaattttttatatttttagtggagacagggtttcaccatgtcggctaggctggtctcgaactcctgacctcatgatccgcctgcctgtgccccacaaagtggtgggattgcaggcgtgagccatggcgcccagcccccgcccccccccccccctttttttttatacacagttttactcttgttccccagtccggagtgcagtggctcgatctcagctcactgcaacctccgcctcccgggttcaggcaattctcctgcctcagcctcctgagtagctgggattacaggcgtctgccaccatccccagctgatttttttttgtgtttagtagagatgggttttcaccacattggccaggctggtcttgaatttctgatctcaggtgatccgcccgcctctgcctcctaaaatgctagaattacatgcatgagccaccatgcccagcaagaacagtagtaaccctgcaagcttattgtgtgccaggctctgctaaataacttttttttttttgacggagtctcgctctgtcatcccggctggagtgcaatggtgtgatcccggctcactgcaacctctgccttttgggttcaagcgattctccttcctcagcctcccctgtaggtgggattacaggcgcatgccaccacgcctggctaattcttgtgtttttagtagaggcgggatttcaccatgttgacaaggctggtctcaaactcctgacctcaggtgatccgcctgcctcagcctcccaaagtgctgggattacaggtgtgagccaccgggcctgacctgtgctaataacttttatcttcacaacacctatatgatggtttgaagtaggtgctggtgatatcctcattttacagatggggagcctgaagctcagagaggaaatgacttgtgcaagtttatctggaaagtggtggggctgaggtccaaactcaggcactcttattccagagttctggctcataaccgctgtgtcccacagcccctctgctaaagcttgcctgcttctctccttttaagctccaaaagagagtttcttttggcttggttataatggctaactcactaatggcccaaatgctgcgctgagtaccttgaatatggttctgtaggggagccgctgaactgttttttttgtttgtttgtttttgttttttgagacagagccttgctctgttgcccaggctggactgcagtggcgcgatcttggctcactgcaacctccacctcctgggttcgagcgattctcctgtctcagcctcctgagtagctggaattacaggcgtgtgccaccatgcccggc

SEQ ID NO: 100663 - DNA, 1442 bp, Homo sapiens
ttccaaaagtagcaccaagtattaatatctcaacttttgtttgcttcgtttttaattttttttgtttttaagagacgagcgtttgctatgtttctcaggctggtcttgaactcctgggctcaaagaaacaacttggctctgccttccaagtagctggggctataggcatacattactgtgcctggcatttgtttgcttcctttgtaactctttaaatttcattgcaattacagtttgcagttatttatcagtttgctggctaaatttttgtgtttccccggtagactgaagggttcttgagggcaggagctgtgtctcttttggtcttgattgtttccttaaatagtcgctgagcaaatatttgttgaataatgcatcagcagatgactgaatttaactgtgaaagcagttgtttttttgtagttctgaggggtggcccttggcccttgtaggtgagtggtaagcagtgttgagggagggtcttcttagttccagaaaccacaggaagctgcacgatggaggaataggaaccagtggaagacacacctgtgttagaatgaggacaccaacagggtttcatggagctttgtgttttgaataatgcctgtttttttatgtgtagtgaatgatgctacactctgggtggactttgcctaagtttcataaatatttaattggctttttcaggagaataaaggcagccccgttgatgactgaaaatgacaaagcatccacctaacagacgaggaatcagctttgaagtgggagcccagttggaagcccgggaccgtttaaaaaactggtacttttacatttttctgttaattaaagcccttcagtaaaggatttttgccagcactgatagagtggtagcttaggctttttttgtggtgtttttctacttcctgactcttggaagatgtgaggaaatgtcagtcttttctctttgatgcagggatcccagtgtcagggtgactgtcctgtaaccccctgtatatatttgtttcccccttttgcctgttcatctgaaagagttctgggaaaaagaagcaggaatggctacagggaagggaagagttaatagtggcagctctcttgctcctggctgcctgtctgaaaaaagaggaaagatcagggatggaatagtgaagaaaaaggggttcgattggagcagctcatgtgttgtgaacaccccatcctattttctgggcatgatcttgtatgttgaaatacagtcatcatgtaagggcacactgtcagggtgattaggttcagaagctgaggggttatagtcccagctgtgtcattgacttgtgacctctggctggtaattagctgctttgtgcattggcttatctataaatgtgggtattggtaatattgacctcatagggttattctgagaatcaaatgatagaatatgtaaggaaagaccttataga

SEQ ID NO: 100664 - DNA, 1036 bp, Homo sapiens
gaatcacttgaacctgggaggtggaggctgcattgagccaagatcgcgccactgcactccagcctgggtgactgagcgagactccgtcccggaaaaaaaaaaaaaagaaaaaagaaaaaataattaggtaattaggtacattttcaacacagttgtttttgggctattttttttttttggagacaagagtcttgctctttcattcaggctggagtgtagtggcgtgatctcggctcactgcagtctttgcctcctaggttcaagcaattcctctgcctcagccttctgagttgctgagattacaggcatgcaccacgatgcccggccaattttttgtatttttagtagagacagggtttcaccatgttggccaggctggtctccaactcctgacctcagatgatctgcctgcctcggcctcccaaagtgctgggattacaggcgtgagccaccaagcctgcctgtttttgggctatttgtattatctataattagttccttttttggtttcagtatatatatatgtgtgtgtgtgtgtgtgtgtatatatataatatactgcgtgtgtgtatatatattatatattgtatgtatatatattatataagtagtatcatacaacttgttttttttctgtgtctttgttttttatattcaatatgtttttgtgatttacccatacttaactccgcaccctcctcgcccacccctgatatagggtcttactctattgctcaggctggagtgtaatggcacaatcatagttcactgtggcctccaactcctgggctcaagtgatcctcctgccttagccctccatgtatctgggactacatcttaacttctgtatagagttttattgtatgaatataccacattttgtttatctagtcccctactaatggacgtttgtttgtttgtttatttatttatgatggagtctagctctgtcacccaggctggagtgtggtggcacaatcttggctcattgcaacatccgcctcctgggttcaagcagttcagcctcagctgggat

SEQ ID NO: 100665 - DNA, 1042 bp, Homo sapiens
gacacccatgtggatgtggtgactgcaggaatgtttacatgtggagtccagttaagagcagaaggctcatagccgggtgcggtggctcacgcctgtaatcccagcactttgggaggctgaggtgggtggatcatgaggtcaggagatcgagaccatcctggctaacacggtgaaaccctgtcactattaaaaatacaaaaaattggctgggcgtggtggcgggtgcctgtagtccagctactcgggaggctgaggcaggagaatggtgtgaacccgggaggcggagcttgcagtgagccaagatgacgccactgcgctccagcctgggcaacagagcgagactccatctcagaaaaaaaaaaaaaaaaaagcagaaggctcttcaccgggtttagagttagatgtagatatcgatcttgattgtgcctcttcctagtcattctctttgaggctccatttccatgaatgtaaaaagggggcagtaataataatgactccttaagtcttcatggcatgatcaagtgagataccttagataaagatagtttacaaaccctagagtaagctgcactcattagttttatttatttatttatttatttatttctgagacagagtttcgctcttgttgcccaggctggagtgcaatggcatgatctcggcccaccacaacctccgcctcctgggttcaagcaattctcctgcctcagcctcccgagtagctgggattacaggcatgtgccaccatgcccaggctaattttgtatttttagtagagacggagtttctccattttagtcaggctggtctcgaactccaggcttcaggtgatccgcccgccttggcttctcaaagtgctgggattataggtgtgagccaccgcgcccagcctcattaattactaatagccatgtgggtgaacactgatgagttgtagtgggaattcggaaggaaattgtcatcctttctgtttttttctccccggccccatgatgtttctttagttagtatttctggtatataggggggaacaaaacagatt

SEQ ID NO: 100666 - DNA, 1066 bp, Homo sapiens
cctaaggtcgggagttcgagaccagcctggccaacatggcgaaaccccatctctactaaaaatacaaaaattagctgggcatggtggcgggcgctgtaatccccgctactcgggaggctgaggcagggagaattgcttgaacccaggaggttgcggtgagccaagatcacaccactgcactccagcctgggtgacagagcgagactctgtctcaaaaataaaataaaataaaatagttcataaactaaggaatatgcaggttaggatttggacctcaagtctgttaccctccataatttgtgatttgacccaactacacagagtctctaaacggtaggcctggtaaccttctcctttgggaagaggtttggaaatgtaccattatggatatttggatatttggggtgggtattaaaggaatgccaatttttttttttctgactcaggtatccagctcacatagaagacattgactacgaggaaggaaaagtactcatccatttcaagcgttggaaccatcgttatgatgagtggttctgctgggacagtccttatttacgccctttagagaaaatacagctgaggaaagagggcttgcatgaagaggatggatcttctgtgagtaacaaatctgggaagttctgtagtatgcaaggtcagccattgggctgtttgtgtttcaatctttgatgttagtagcagctggagaccagttcttatttaggcctatagttgtaaccctgagatctctatgacacctggggctcttgaagaatcccaattttgtttgtttgttttttgagacggagtctcgctgtgttgcccaggctggagtgcagtggtgcagtctctgctcactgcagtctccacctctcgggttcaagcgattctcgtgcctcagcctccctagtagctgggattacaggtgcccaccctggctaatttttgtatttttagtagagatggggttttgccatcttggccaggctggtctcaaactcctgaccaattttacggcattgtatccctaacttctagaacactgcctggcacattgtagatcttc

SEQ ID NO: 100667 - DNA, 1079 bp, Homo sapiens
tttttttatgttttttaggaatttcaaataaatgagcaggtccttgcttgctggtctgattgtcgtttttacccggccaaagtcactgctgttaacaaggatggtaaggcatttgagttgtagttgtttttactcatgacttaggtggtggggggggatgtttgtaatatcagagcttgatagtatattttcagtatttatttactgcctaggtatccgctttattcaagttaatcactatgtcaggagttgggtagaaattataagtgtaaagaaaactggacaaaaaagatagtttgactttttaccccctgaatttcagtcattgttttctaaaacagtcacagttcatctgtcactctgcctggaagtatgcaggtacttgctgtctaggagttcctaatataattgatgacatagtcctgaatatttgtgaatagcttagaaattaaatgaacactaacaaactttaaaaaatgtgctttctagatgcaaggtgactgagggtggtctgtaacattggagttgctagtggaaactgggatgccggaatttagagcactgagttgggtttcatttgccagagttgaacatgtgaagagacaggatggggaacttgactaatagaggctcaattttgctagtaaaagggcagacaaagagttatgaggataatatgtacggtcaggatcctggcacctggagaatagagtctgggtcccagtgataccattgtaagcacattccactagggtgtgtgtggtctccatgatctctgaagtgagtgtttagggaagtcaggcctcttgatgccactgtagggttgactattaggccagcctgacttttcatttgatgaagttattcagatatttattaatactctgctaactgctgggcctcaggctgaccaagttttgtctgagaatgattttttttttcttgttcttttttgggacagagtcttgctctgttgcccaggctggagtgcagtggtgccagctcagctcactgcaacctccatctcctgagttcaagcgattctcctgcctcagcctcccgagtagctgggattacca

SEQ ID NO: 100668 - DNA, 1285 bp, Homo sapiens
ggaggcagggcaggatggtgcaggttaatcatggtaggcacctgtctctataaggttttgtgtttgtgtgtgggatggatcagaaactctttgaaataatgatttcaaaaatgattaggtttggattagagctgatggtcagtttgtgcttcatcacgattcactgtgggattacttgtgggattgggagcgacaatgctagtctctcttttcactctttccttggtattttctgctgtgcctcaggttcattcgtagcagtggccaccagcttaatggccctgcgaggagaagctctgccggcaaggcggcccctttatttcctgtaaatgtcacttatgtcttgttggtgctgccaggaggaggcaggggatatagtgaagtcatgccttgtagatttatctttagaaggcttggtctgattttcttgccactcttaatctccttggatgttttgctaaagctgagtgttgagcaggctggtgggtggggactgtagccagagtgtggaagtggcagctgctggcactgaggagtctggcatgattgaatcagaactaaataacaactttagtttcttaaggaagtctgttagcactcggaaaatagggcatataatgccatattatttagcttttttcacctggagtggttcttcagcagtggagattaagcattatttagtacgaaggcagcggcagttggtagccttgttagaccctcagtctgtgttgttacaaaagacagtaaaagatgggtttctactttcagggaatctttgtttggaagccatctctggtgagctgacctcacctctttgctggggctgcttagcttccccctccgtttttttttttttttttttttttttttttggtgacagaatcttgctctgttgtccaggctggagtgcagtggcacaatctctgctcactgcaacctccacctcctgggttcaagcaattctcctgcctcagcctcctgagcagctgggactacaggcacatgccacaccacacctggctaatttatatatatatatatatttttaaggtttcaaatgtactttatttcttcattaatgccatatcttaatgggtacacagtgctttaacttggcatcaattatgagctgtttttttttttttttttttttttttttttgagacggagtctctatgagctgttttttaaacaattcattattacatcagctggtatgattactgttctctccattttggggggtgactctgccaacaggggatgggttccattctattcc

SEQ ID NO: 100669 - DNA, 1018 bp, Homo sapiens
attgtctgcaatgctgagtccttaaccctcagaggggcaagaccaggaatctttgtttcatcttaaagtctaaggacaaaaactccttgagggagtctgaggcaggtagcccttctgtcacgttagaggagatggaacaggatacacttattttgagttccttcatttacatgttgtttgttaggtagtgtttgtggccacaggagaactctattattagctacctacgggaggattccatgtgaagacaatcttttagtaatatacatgaaaccatctgagtaaaatgtgggcctctctgttgtccattattctgtctgatttattgaagcccaagttaggctgtgtttagcatgaaagtttcaagatgatcctttgtagtcctttggaagttaaaaggatcaaagaccgagatatatctaaggacggtcatcccttagcacctttggccatagtttgggtcatttcagcactctgaaatgggtctgtggtttggaattagactgaggagcttgagcaataggcagtgcggggtggtgggaaaaaattggttggaggtcagtagacaggcttggattccaaagatagctgtctcagacttaatcatggaactcaggttccttttatgtaagtcctccttctggaatctgccatcaggagtaagcttcaaaattaactccaagtagctgaaaatgttggactgttaggtaacattactcaatattgacttttggatgttggaaatgcctgtaaaaatggcagttttcattttgatgtaactgatcctgaactaactttgttgataaaatagttgaaagtagagtcttgggtggtttgttggcacacataatatttaagatttcaagataactggagtcttaaaactcccatccccccatctccgtccccagacttgccagagttgcaccatggttgcttgagagggttctgtttagaattccatagcattgtttatcataactgctttgcttgccaacaccctgacaatataggcagg

SEQ ID NO: 100670 - DNA, 1005 bp, Homo sapiens
aggtcttgaactcctgacctcaagtgattcacccgcctcggtctcccaaagtgctgggattacaggcgtgagccatcacacctggccaagttattttaaaatgtacaattatttttgactatagtcaccctgttgtgctagcaaatactagatcttactcattctttctaacttttttgtaccccttaaccatcgacacgttcccccacccctgcctactacccttcctagcctctggtaaccctccctctactctctatctccgtaagttcaattgttttaatttttagctcctacaaataggtgagaacatcaaagtttgtctatgtcttgctagctagtttcgtcatgtattggtgacacctgtgacaaataatcacctttattttgtaattaccaggaataaaggtcagtaggtaattactaattgtctatggcagtggttcttggactttggtgtacatcagaatcacctggaggagttgttaaaaatgcacattcctgtgccctgttcccagttgctgtttcagtgtatctgaggtgggactggtaacttgcatttctaatgagttcccaggagttgctcatgctgctgctgtgggaccacactttgagaagcactggtttactctgaggcaggtactgtgtgtggaagaaagtggtataagttatggtctctggccttgaagagcctgcttttgagttgtgatctgtacttatatgaaggtagacctaagtttgaagctctgtaggctggtgccaaatgagcctaagaagttcagatcgggggtaatcattagtagctgaaaagcccggaagcttttacagaactgttgtgggtatttgagccaggcacttaaagatcagtgagtggcacattcccagaaggaaaacacttttaatacagatgtggagttagaagtgtcgctggcagtttcagtgggtagcttgtcactttgagttggtgggtattggatggtggtaatgggaaataaggtttggaaa

SEQ ID NO: 100671 - DNA, 1009 bp, Homo sapiens
tccatcaaacagatatcattgttcttaacgttttggtgtgtaacttgacttaacaatttgatgtatacatctttctgtgttttttattaaacgtacgtgtgtgtatttatttattttcaaaattggagttgtggtacattaatatagtactgctcttttaactaacatttccccatgttccttaatattctgagaatataatttttaacagctatgtagtattctgtaatatgtatgtaactactttgtgtaaccaattcccaaatggtcattaaggatatttgtaaatccaggtacacaagtctgattattattttagctaattttatttctaggaatttattctagttcaaaggtataacctttttagttttgactcaaattgccatctcctccctgaactcccaacaagaagggcaatttcagtttatatttctgctggctgttaccgagaatgcctgttctcaaacctggctgctttcagaatagtttgggggacttgaaaaaatatttccttgtttattatttttccctgtagaacaaattaaacttttatttgttgagtatttaggtactccttcctgcttccagtgaaaacctatgtgcctagtgtgtgctaggtgctgggcatcccatatgaacatagtatggtggtctctgctcttttgaggtcctagaagagagatatgtacacaaataaacttaattatagttttggaatctctagagctttcagacctggccttattatgaaacagtcacaatagaggaccctcgatttttagtgtgaattttaaagaatgtaatttagggagaacataactaagaagcggtatttcctaccaatagacaaaaactccaagtagctcaggaacatagtaggtggcttgttgaactgagcacagcctttacctgatagagaaagcagagaccctggttctgggttggataatctttatagttttcctgttaagcttccagttatcagtttttgtttttctatagacaa

SEQ ID NO: 100672 - DNA, 1253 bp, Homo sapiens
tttgctcattttagaatattgtgggtaatgctaggcctaaagaaacagatcacaaaagtctttcatcatctcctgataaacgagagaagtttaaagaacagagaaaagcaacagtgaatgtgaagaaagacaaagaagataaacccttaaagacagaaaagcgacccaagcagcctgataaagaaggaaagttaatctgttctgaaaaggggaaagtgtcagagaaaagtcttcccaagaacgagaaggaagacaaggaaaacatttccgaaaatgacagagagtattctggagatgcccaagtggataagaaacctgaaaatgacattgtgaagagtccacaagaaaacttgagggaacccaaaagaaaacgaggcagacccccttccatagctcctactggtgagttttttaagtgggctctgcaatgggcaatgccagagtattcttctgtggccctttgtggttctttgtaacttgtgtacgtcaatcgtttatttttgtgactgattttgaattgtcttatgatctggaaacaagttgtgttcatgaagctgaatttaagtgaggtacatatccaagtgaatctaagttgggaagcatgttcataactgagtttgctaaagtagtggttaactgttgactagatacttcagcttatatgataaaacctgataaaccgaggccttttgcttatgctttttcaaatgatctcagtttaagtcagcttaatagaatctagaatcaggaaatagagttttaatgagacagacatgaaagaaaagtaatagtaaaaaggtatgggcttctgaaggagatggggacaaaggaacattgaaactagaaaagcatgggtgcattttgaaattgagctccttggagagtgattattgattagaaattttcacagtctaaataaaaagccgagatggctaattggtaagagtcaaggttagagggtatagatttagggaagaatgcagttattaaaaaacttaaaatttggaattcttctagaataaccaagaatgaaacaagccctgatttcttcctaagccaaacactcgttctccaaatcaattcaatggcatgaagaggcccccccggttctctggactgagcctgccattgattaatatgtgcagtgaccttcagacattcttgattgtgcattctttatgtgttcagttgaaaaactgtgaatcccctagcacgttttaaagcagtatttatctttttctcacaagtttaaa

SEQ ID NO: 100673 - DNA, 1108 bp, Homo sapiens
tacaaaaattagccgggtgtggtgtcgggtgcctgtaatcccacctactccggaggctgaggcaggagaatcgtttgcacctgggaggcggaggttgcagtgagcagagatcgcggcactgcactccagcttgggtgacagagcgagactccatctcaaaaaaaaaaaatccacaaattctcttggacatttttcttgtaccctcaaaactaggcccagtgctaagataattaatgtagcaagtagaggttgaaaactggagctggatcatagaaaagattcaggaggtcaattggcaaggtatcaccatctcctgtaaggaagtaatttctcactcattttactttttttcttttatcttaagtaagaatgcccttttgatggcccatttataatgcagtgatttctgcatatatatatgtatatatgttttatttatatataaaaatgacagacactaagaaattatgtatctttttttgtgtggttttataaacatggtagctgtggattcaaactctcaaactttgcaaccaataacattggaactgagaagaaggaaaatatcaaaaggatgtgaagtcccattaaaacgtcctcggcttgacaaaaattcatgtgagtctacagtttgtttatgtgtggctagaatttgacgttgtttgggtcaacttcctctatattcatcctgtcccccattccctataggctctaatgtttgtctctggtcacatgaggtaatgtgagttggatgcagttggatcagaaggagtttttgctagaagaaaaataaatcccaaagcacaaactgtactaatgttgggttctgtggtatcatctccatatccataaatcacatttgatttggatgccactggaaatttaatggcttaggaagggatgggtttcatatgcagagtgaaactttaaaaatactacttattggcctggcgcagtggctcatgcctgtaatcccagcagtttgggaggctgaggtgggtggatcatctgaggtcaggagtttgagaacagcctggccaacatggtgaaaccctatctttactaaaaatataaaaattagccgggtgtggccaggcgcggtagctca

SEQ ID NO: 100674 - DNA, 1029 bp, Homo sapiens
atagagtgagactctgtcctataaaaaataaaaatacaaaataaaatactatttattgatttaaaaaaataccctctggagtgagttggctcaaatgtttaaataaatttaaaataaaatagtatcctgttggctccaaaaaggatttgtgatagctctaagtaaggctcttataaacctttttaagtcgactttgcaagttagtacatttgggaagccccaaaatagaacatagttgtcaagattcggacatgacctagcacatgttttcagaccatgaatccttaaagaagtgaaattctatcctggcagggacacttttcccttacttaaaactgtaaactagtaaagggtatttccttttatcactactctaacattccagtagtctctctgtaaagtccttttagagacatccagccctgaaatctgtagtagcacagttatttcttcttgttggtctcttgactacaactctcttaatggtttaatagcccaggaaaagtcaaaaaactactcggaaaacactgacaaagacttatcgaggagacgttcctccaggctgtccactaatgggacccatgagatcctagatcctgacttggttgtatcagatttggttgatacggatcctttgcaagacacgttgtctagtaccaaggaatctgaagaaggtgagtcagtctgttcaggaattgtcttgccaacctggttcctatttagtgagaatcaatgtaaatcattatgttctgccttccacaagtattaaattgtcttgaaatcaaactattgaatgtgctgcagtgtttttataatgtattgctcttcactgatgatttattcaatagacatactttctggatgcatttgtggttggttttgcttatctaccgttcagtgttggcctggaggtacactgttcgaagagccctgcttctctctctctgctgccatctcattcgtgcctttgtgtttatacttccagctatttttcctttcactttaacctctttctttgagaagctcaca

SEQ ID NO: 100675 - DNA, 1048 bp, Homo sapiens
ggcttttttctttttttgttttcagacagagtttggctcttgttgcccaggctgcagtgcaatggtgtgatcgcagctcatttcaacctccacctagcaggttcaagtgattctcctgcctcagccccccgagtagctgggattacaggcacctgccaccacgcccagctaattttttgtatttttagtagagatggggtttcaccatgttggccaggctggtcttgaactcctgacctcaggtgatctgcctgccttggcttcccaaaatgctgggattacaggcatgagccactgtgccccgccaacatgtactgttatttatgttttaaaaagataaaacaatgttcagtattttggtggaacaagcttggtactatcctgcattgtatagagtattacaaaagaaaatctttaggtgtcatagtaaaagatgtcccaaaaggtggagataataatcacactgaaatgtgaatagtcatactaggaaccttgtggttggttttgaatttcacactttcaggaggacgtagacgaaatgaagtgctttcagggtgatatgcgtcccagccagggcatatgaagactggttgaagaaatgtttcacacttggttgataattataatagctgtctccagccatgttccagaaataacataagcctgcttatgatgtattttatatttgaaatgataatggcttccatgtgttgatcacctactttgtgccaagtacatacattatccataaccttttctccaaatctttgaaataggtggtattcttcccttaagaatctggataattagactagcttgcacagctaatttatgctgctaatgaaaggtagacctgggattaaatgttgtgctttttgtactataccatactgcctctggcatgagcatgcagtgaggctgtgggtggtggacacttcccctcttctgcttatgatcaggttaattcctgaaatttaaaatgacattgaatagtcatagtagataatattgagcacttatgtgccgtacacctttctaagctctttgc

SEQ ID NO: 100676 - DNA, 1107 bp, Homo sapiens
gtgctgggattacaggtgtgaaccaccatgcccagcccatttcttttgtatttttaataaagatggggttttaccatgttggtcaggctggtcatgaactcctgatctcgagtgatccacctgccttggcctcccaaagtactaggattacaagtgtgagctgctctgcttgacctgagatcctttatttttatttttatttttatctttttaaggatttttccttaaagtatatgaaaccctgaaaacttgtacgactgtttaaaataaacatgttgatttcttcttcctaaagatgaatcacaattgagtcttatttgacctgaagttgttttcattctctctaaacagtaatttgaggaggtaatggcagtctgatgtctcaggctacatttgcacgctagtctttcaccctcagttgtcatgtgttaatgcatgttttgtaataactgggataaatacaaggaacctttgcttttgtttttatttttttcagtaacaaatacttttaagaaaacagatgattttgggtcatctaatgcaccagctgtcgacctagaccataagtttagatgcaaagttgtggactgtttaaaatttttccgcaaagccaaactgttgcactatcacatgaagtatttccatggaatggagaagtcactggagccagaagagagcccgggaaagaggcatgtccaaaccaggggcccttcagcttcagacaagcccagccaggagaccctgaccaggaagcgggtctctgccagttccccaagtaagtatcttcattcttcattgtgtcatggatggctcagttgcttggccacagtgcttgtgttttctgacacacaaagcaggcattaggtttgtctgttccagttgaatcccacaggactgaacatattaagtgatcctctgggctgtgccacggagctgtggccttcctacaggaagcaggaacacctaactgagaattaccttgaaaaatcgcttagcctctgaaggccttgctgcttccagtatgagtggggacagtcaagcaaagggaccttattcagaagccagcaggagaactcgtgctcagagcagcatgggtgccatcgtccc

SEQ ID NO: 100677 - DNA, 1071 bp, Homo sapiens
agtctcttaccagggcttgtgggctcaacctagtatgggccctggaaggggaggcatccactcacccaggtgttacaaagtcctgctggcattgaaaagccttctcacttgctgccttggccagtgtgccctgctgcaggatggtacagatgaaggcatcgaagtgtaagcagatgtgcaggtgaatgatggtatttgttcacacacacgactcttaaaacacatctttgagccctcttgagaaaggattcccttcttaaaaactgtgtctagccctcacaaaaatgtttagaaaaatctatatattctgacttgggacttaaaggatgccacgttttattcttggtgtatcttctagcttagaaaaacaatcttatcagaaaaagaggagagggtcaatacttaagaggaggtgtttgggccccttcatctgctctccacacctctttttggttgaattgtccctgagcctttgtgctgcttgaaaaggaggcttgttggttggatgagattgattctagaatgcaccagtgttaactagggttattcattccttcctgatcctgttcttccagaatgcccctgcagtgaggagatcagtgacacctcccaggaaccttctccacccaaggcatttgctgttaccaggtgtgggtcctcacacaagccaggggtccatatgagcccgcagcttcatggcccagaatctggacaccacaaagggaaagtgaaagcattgggtaaggaggctcttctgtcctgatcatttgctgatcatttattggaaaatacaagcatacctgggagatattatgggtttggttctaggccactacaataaaacaaataaagctagtcagacataatttttattttcccagtgtttacaaaacttatgtttatactatattgtagtctcttaagtgttcagtagcatatgtctaaaacaatgcatataccttaattggaaaatattgttgtgttgagaaatgtcaagttttttggagtaagtcctcaaaagcatagacaataaataaagaaatggacaagtgggattgcatcaagctgaaa

SEQ ID NO: 100678 - DNA, 1023 bp, Homo sapiens
caggcagcatgcttcgtttgggctgttactaaatgacagatccaaggacagattggcatcctcgtttccttgccctatgaatgttcttgtttggaggtatgggactataatgtcatttttcattcttgacaatcaaaggttttttaattttataacctaaaatagtaactgttgttttccctttcctcgtagaggaggataatttgagtgagtcctcttctgagagctttctctggagtgatgatgagtatggccaagatgtggatgtgaccaccaacccagatgaggaacttgatggggatgaccgctatgacttcgaggtggtccgctgcatctgtgaggtccaggaggaaaatgacttcatgattcaggtaggcagagcttccaggaaacaggtctagagaagcacaaactggtccttggagggaattttgaggccagcaacaatggcaagtcatagcagagccccagaaacacagcacgaacggcagcagactgagcttctctttttcgtttggcttcctcagagttccaggctgccatacatagtccattgatggagtaagagaggactttagggatcactgagtctaaacctctcatgctctgcttgaggcagctgggacccgcaaatgggaagggccttgcctgtggtcacaaagtgaggagttgaacagcagggactgaaatctttggagtggcagtttaatcttcccatggactcttatcttctctttgaggtaaattttctttaagatccaaagtcatgcaggctggctttataacttctatgtttctttttctttattttcctgacatttgagtctgtcatcttcatctctgagatgtgcctgtggtgggtgggacctccttacctgcttggggaaaccatgcctggccagcacctgcctgccctgtcccttgtctgtaaattgcagttctgggagaggtggcgctggctggctggctcctaagggtgtcacaagttccctgggtgtcttgacagctgcccaactggcttgg

SEQ ID NO: 100679 - DNA, 1002 bp, Homo sapiens
attgtcaactccctcctttccctctctgccttctggccctctccccctgtcccctcaatactcagggaaggaagtggagccttgggttgaaagaactggtttagcaacgagtcaggttatgttcttatccacctttgcctttcaatagctatgtgatctttggtaaggtttagagagaataaatgcaaagtactaacccatgattactccagcaggggtcttagtgaattggtttgctcattagtggttaatagtattaatagtagcttattacataaagctatgtgctgggctctgtaataggagcttttacatatgacccattgaatcttcacaaacagccccaggaggagggtaggaattgtgtatcccattttgcagatggggaaaataaagcccaggagaactaacctgtgcaaagtcacacagctaatgagtgtctgagccataattcaaactcagctttaagatgtcactcgtgggactgaggaactgaatttttagcttaccttgttaatttcaatgtagagccacatgtggctagtggctaccatactggacagtgcagttccagatgtgtggcagcagctcagttccacgttagtcaggagggagtgctccttcctcccctctccttctatcctcccatgcccctcccctcagcaggtgggtcttacttttggatggagaacaccttctgagtttaatttttgttgcttctttaattctaacagtgtgaagagtgccagtgctggcagcatggggtctgcatgggattactggaagaaaatgtgcccgagaaatacacctgttatgtttgccaagaccctccaggtagagatttctggagtcagggatataacagtatgtagccttttccttggcacagctggctgtgacacattctaaatgtctgcggtcttgagactcatttcttcagcatcggctagactccagctcctcctcgcctctgttgctatcctgccttgtggccagctatcc

SEQ ID NO: 100680 - DNA, 1024 bp, Homo sapiens
aggaagtaggaatgatgctggttgagtgagttgtcccagagttgaaatccagtcaggtcttctgactgagagtccagtcccactcactgtgtgtgaccacagtgggagctcactaaggagtggtctcctaggagaccacggattcacattcgctcttgtttagcaaatggtagtgtgtggtcagatggcccaggtggagctgctgtccctactgggagagtatttaggaattgagaacccctgcaatggtgccagttactccaaagcccatgtcctctttgtcctctcaacagaagccgggagcatcctgatctgccgctgtggtgccagccttggaaacagcactcaggggaggggagatctcatttcagaaacatccctgtcactgacaccaggagcaaggaggaagctccaagctatagaactttgaacggggcagtggagaagcccaggcccctggccctgcccctgccgcgttctgtggaggaatcctatatcaccagtgagcattgctaccagaagccccgcgcctattaccctgccgtggagcagaagctggtggtggagacgaggggctctgccctcgacgatgcggtcaaccccctccatgagaacggcgatgattccctttccccgcgcctgggctggcctctagaccaagacaggagcaagggggacagtgaccccaaacccggctccccaaaggtatgtggctgccttgtacttgttcttcattcattgcgtgaatgcttgcaagttatcctcctagtttgaatgctctatggaagatatttattaataaaactgtatttaaatttgcttaccatagatatgttttggtttgccaaaatgggtgcaaagtcaggagagcccacttaagccaaagatccttggttccaggaagcacccacaaaatggcatagtcaagtgtggcacgtggggtggggggcgcgggtgcagagggagggagaggtgggaagtagcaaggagatatggattagcaaaactcatcttttctttaagg

SEQ ID NO: 100681 - DNA, 1625 bp, Homo sapiens
gaattccaaaccgaagcaggcagggtctggaacccaaaggacagcattttctacccacttcttaatattgacagcttccccgttctatttaatgtccaaaaatgtttcccaaaatttcaaactctttcactgtaaagatttgttacaaagaatgtggtttggggaattaccttattttatattgttgtaaacaaacttcaaattctacatgtgcgacttttctccttcctgaagggtgtttagtagtcagcgttttcagaattgttttgttactatactttaacattttacatttcctgtttgtattattttgtgagagcaaggtgatcatgctgcttaaggtccaggtacaacctatttgtaccttttgagacaatatttgtgttacttttgcaggttacggttccacatgtaattgctatattttgttttgtttttccttactaggcaaagttaaaatgttccatgctttgaggagtgacccatttcactactttgttttcttatcactaaaggcaaaaatcaaagcacagttgtccattaacacttataagttaattatgggtttatgagtctgtaatgttatatgctgcaaacatttactatgtaaacgtgaagtagccaataatatctcaatagtagtaacagtatctttagcgacctttggaatagttaagcacaggtcattgtggacatgaattcaggcctctgtactaaaatctatttcagggaatgttctgtctagtgatttgctcaccatttgatatataatgaattataggacaagtataagctgatctgctatagctgtccatcagagagaatacacgtggctataacatctataacaaaacgacgattcctctacaagaggctgtttctcactgctaacgttggtgtttctggcgtgggaagaaatgcacaggcgtgcatggcatgcacgttcagacagctgcattgtaagagttctgtcatgcagtctgaaaagggaagaaacaggatggctttctgtagccacacctgtgaggcgtgatgattgttgtattattagattactgatttttcttttctgaaaatacatttgagttttaatcacatctgtggaagctgtaacttttaaggtagtcaatttcatgtcttgttcaacgatgtaagcagaaactgaattgccctaattttgccaactggccattattgggattattgtttaaatttttggtaaaggaagtaatctcctttcattcattgtgacttttgttcttagggaagcagagaagactccccaagttcttataacctcattgtgcttccctaatttaaagccatgttgaggggctccattcccaattcctgggtcaaggtgaattaaccctatgttggagcactggaaaccgttatttgcaaacattgctgttaccatttagaaatatgtgcactatcagctgggtgcagtggctcacgtctgtaatcccagcactttgggaggccgaggcaggtggatcacctgaggtcaggagttcgagaccagcctggccaacagggtgaaaccccgtctctactaaaagtacaaaaattagctgggcgtggtggcggacgcctgtaatctcagctacttgggaggctga

SEQ ID NO: 100682 - DNA, 1011 bp, Homo sapiens
ctgtagctctgatggcccctccttcgggaatgattagggtgacggctggccggggctcgttcgagtggcgcccggccggtggtgacccgaacaggagagcgggacggcgaccattctctcgggaggggcccatctggagaaagtcctctcgcttggtcaaactaggagggcgatagcaccggccttactgcgacgatgacaaagtacaacacaccgtctggcgcgaaggagatgctcgagaaccctttgctgttgttatttttcgcgtgtcctccgaaaccaagggaaatgcggctctgtgggttctgttaacgtcagcatttaataagtgaactctaaatgcattgccccttatggtggccgctggcctcctgagttgactcagctcttgcaacgtagctagttgataaccctcgaaatatagcgaattgagatgtgctatattgtaaaatacgggacttagtacgaaaaaactgatgtaaaaattatctcaatactttttaatactgattacatgttggaatataatgttttgcatatattgggtcaaataaaaatgttattaatttcacctgtgtttttactttttaaatgcagcttctaaaaacatttaaattgcatgtgcagtttacattatatttctgttgagcagccttgggttagagtgttggagtgaggctaccttggtggaatcccctttgacgatacccagctcagagttgttaggaggattaaataaattaagccgttggagagaaagggcttttaagaagtttgctcttgtttttattaggtaaactgcttgctatctctgagctactgttttcttatcagtaaaatgtggatgtaatagaacttacctctcagaggtaattgagaattcagtgagatgatgtaggtaaaagcacgtggccctgacagccctcggccaggtggttttctgtttggtagctgactcacaaatagttttgtttttgtttttgtttttgttttgagactgagtcctccgcc

SEQ ID NO: 100683 - DNA, 2030 bp, Homo sapiens
cggccgcctctttaggccacggagccgcgcagatccggttcccgggtgaccactctgtcgccattgggcgagacctacctagtcctgacgacaacggacaaaggccttaaggggcctggaaggtgagcgaagtcccgaacgacgacgggtggaacggttagcggccatcgggcggttggtcttcattctaccagactttgctgtcggaagagagaaatggtagaatgacaggccacgtttggcccgttggaaatgcccaccaccctctgggaagatttactggccgtttatggaaggcctgtgtatataatatgaaaaagctgctctcaactccaccccaaccttttaatagaaaacatttgtcacatctagcccttctagatggaaagaggttgccgacgtatgataaaatagagttagaaagttacacatcttgtaaattctcatttgtttaaaagaaatcatagaaaatacatgtcttctggagatgacttttggaaatggagttgttaagacggcctctggaagcgatacgtccacgtttgttaagtgggttagatgacatggagctggaagacctgagaaggaagagaagaaggttctatgctagactggtcatatttagaagacattttcatattctatccattgttttgtgtgcattttattcctcactactgtgtatatagttgacaatgctaagcttttttgaaatgtctcttctttttagatgttctgaagtgcctgatatgttaaaattagaggtagcaaaatcacattttgtaaatacctttttgttacaattcataggaaatatttttgggggggaatggccaaatcacctgttgagtaatactcattgtgtttgtgcagtggttcaggggaggagagaggagggggaggtgcagagagctctatgccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgatggagatgggaagggttctaggccagaatgttcacatttggaagactctttcaaattataactgttgttacatgtttgcagtttattcaagactgctgtatacatagtagacaaattaactccttacttgaaacatctagtctatctagatgtttagaagtgcccgatgtatgttaaatgtataggtagtaaaataccactttgtaaatatctttttgctaaaattcataggaaatgcttttggaaattgaattgtgaagccacctttgtgaacagtatagtaatgtctatacttgttcaatagtttagaggaggtaggagggaagaaattgcaaaaggtaatattactagtgtgttcatacttggacattttcagacaccatttttctatatgttttgtgcattttgttttgctctgtatatagtatatataatggacaaatagtcctaatttttcaacatctagtctctagatgttaaagaggttgccagtgtatgacaaaggagtaaaattagcatattttgtacactttgtgttgaaattcgtaggaaaacttgtcttctgtaaagacttttgcataggaatttgtttgaccatctctaagcattacacgtgcctgtacttgtccactggattgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctagtctttctagatatttggaagtgcttgatgtatttaaaagtggtagtagaataacactttgtaaatagcttttaaaaactgat

SEQ ID NO: 100684 - DNA, 1075 bp, Homo sapiens
ttagtagagacagggtttcaccatgttggccatgctgatctcaaactcctgacctcaggtgatctgcccgcctgcctcggcctcccaaagtgcttggattacaggcatgagacactgcgcctggcctcaactctggtttccgttgatagaatattcatattcactttctcctccttcctttcttcgctttctccttcctccttctctttgttccctcctccctccctccctccctctctctcttctttactccttttctcccttcctttctttctttttggcagcacgttgcattgttgagcttgaggtcaactaaaacctttaagtcactttcactgtaattactgttgattgagattctttctacactgtatttggggcacttgctcatttggaagggcactgtccaatatggcagccattgtggccattcaaatttaaagtacttaaaattaaatacaattattattttgcatttcctcagttggactagccacgcttcaagtgctcaatagccacagagggctagtagccactgtatcagacagcaaagattcaggacatttccatcatcatggaaagttctgtgggactgctctggtttggacctaagagcaggagtttatacttacaatctgaggcacgtcatcttgagagttccagctcagcctccaaaactgctgagagctttaagaaactgattctggtttccggagtcttcattttccctcccaacctcatgacaacagtagatttgatcaacgtttcataccttcctctgcttcatctaaaaccaactgataaaaatacccagcagaacagagaggcttgcaatcgagccctctatgtgacaccctgctctccagtcccatgcggcagttgtgcagtcatttaacaaattaggcctatatcctaggtgctgtgctgggtaccaggtacctacaaggaagtcagaagacatcaattaaaaaaaaaaaagagtcctgctgagttgggtgctctagtagttcaaatgtctttgcttcccattcaaggctgcctcttctgtctgttttgtggttgttaaaagtggaag

SEQ ID NO: 100685 - DNA, 1051 bp, Homo sapiens
gtgggggccccgggtggggtctgctcctcttcttcgcccggcctctgagcccgccgcagctcaggttgacgccgggcccacgtggggaagccggcggcgggtccccagcgccgggagggttcgcggggctcagccccttcctctgctcccctccccgggaccggcgcgcggccccagctccggcggctccggcggctccggcgctcccctggtgttggctgctcgccgccgctgcttgctcgttcgcccgcccgctgctgcttggggggccgggatcgccgccgcctcctccgggggagccggccggggcggggcggagcggcgagagggggtgtggggggcgggcgaggagggggctgagcgccgtgggagggagagcaggagcgagcgcgcgagagagcggggcatttctgcgcagctctagcgcgcctcggagcccgccggggcagccgccggacaccaggaccgcgagccagacagctcccggaagccgcgccgccgccgccaggttagccgcacccgccgtccccctccgcgtcccggggaccccgccgcgtcgggtcccgcgtgtgcgtgtggggtggccgccgagggcggcgggctcgattcccgatctttgggcactgacaggccggcgggccggctccaggagccgcgggcttcggttcgtgtgtgtggggactgtcgcgggtttgtgtgtcggggctccagtctctgggtgtgtgttaggtgtgagcgcgcgtgtgcccgtggatccgtgcgagcggctgctcggtgtgcgcgcgcgtgcgtgtgtgcgccgggtgtgcatctgtgtgtgcgtgtgtgagggtgtgtgccttgcgtgtcttcgcgagtggtgcgtgcgtatctgggtgagggtgcgtgtgtctgcgtgtgtctgtcggtgaatgtatctgtgagagggtgtgtccgaatgtgtagcagtgtgtacacctctgggtgagggcgtgtgccagtggcttcgcttgtggctgcagcctgtggcgggtgtgggtgtgtgtgtgcgcgcgcgtcgctgtgtgcgcgc

SEQ ID NO: 100686 - DNA, 1085 bp, Homo sapiens
gcagaagtgatctctgaatccacctccctcatgccacgctatgcaggtgggaagcagaggcctgggaggaggagatggcacccaagaacaccgagtgaactggcctcgcgcgctctggatgggctgtgcgcactctggatggacctaggcctgtgttagggtgaggagggggccagggaacccatgaaggatgtacatgacaagcaaacgttaagctgggagcagtctgttgctagggtgtgtgcgtgatcccaggtgagtgggatgtgagtgggccggagccgtcatcattccaggctttccttccggaaaaggagaaagggccacataggtgggaaccaggggaatattgggatgtgggggaaatcagggggtggcttgagaagaggaggctgttgccaagcagcaagagacatgactgtatgagaacagaacaggcaccctagcgtctgtgggcctggcactgtacagccctggactgtagtggtatcacctccattgcaggggaagaaaccagggcttccaaggtcagagctaggaagaatggagtcaggagtggcatccagggctggaggacttcagagccatgtctctggcatgccctgggtggcagccattccagttcttgtgaggtcctggggtcaaaggggtcaaggaggtactcagcccagggcaagtcatcttttgcttcctttcacttcttctccatcaatctgcccattgagcgggcctgttttcttctactttacccaccccccttaatttgttgatgaaaaatatttattgagcacctattatgtgccaggcactgcccttgatttcatggaacttatgccatcgcttcttggcacagagggctatcccacattgccagggagtgatgggaagaaggaggggagggggccactggccacttctctctccctttacatgagcccctccctcttctcagcctctatccccttgcaaatgcccctagccccagatggttcttgttggaactacctcctgctgaaatgaaaaccagtcagagttaattgttaaacctaatagctggtgagagtttcactctcctgggctggtgg

SEQ ID NO: 100687 - DNA, 1076 bp, Homo sapiens
gacagagtgagactccgtctcaaaaaaacaaaacaaaacaaaacaaaaaacccaaaaaacacaaatctgactatgtcactcagtgactttcctctgcccttagaataaaatctaaattccttaccatggcgttcagagccctgagtgagccggttcctgcctcccccttccagccatctatctctattggtctccatagatcattggaaattattctattggtcatttccgtcagccacaggagtcttctctgttcatttagcaaatttattccagtctcaagacctttacacatgcttaggttccctctgcttagaattcttttcctggctctttgccgccttggctccttcttatcctctacgtcgcagtttaatttagtcctcccaccccctgcactgcttttttcaccacctcttgattccttcataatgcttatcacaatttgtagctatttgtctttttcttttaatgtcatgttcactcttgattccatgtggcatggcgcacagtaggtattcaataagtatctattggatgaatgaatgaatgaattgtaaggaaatgagagagtgctggttgagtgcctggcatagggtatggctcttaggaggtgctcaataaatggcagcttttagtgagaactgacatggcagagaaaataaatacccactgatagattgcatacatggtgggtaggggaggcagcgggtaattaagattggaaagtgatgcactcgtgccagatcttgggggtccctgatgctcagccaaagagtttagacttcctgaaagagtagctggaagtcattgctgggccattaatgtaactataaagccctacttctaagatgtgggctcagccactttgcgtactcaaggggctgtgctgtatggtggtggggttgcagggttggggacaaacccagagagagacaggctgggaacctttctggtgtcattctctgagacaggctattcctacaggcccagaaggaggggacacagttaggagcatcctgtgttttctgattccacatggccattacattgtttctggggagtggaggataggg

SEQ ID NO: 100688 - DNA, 1060 bp, Homo sapiens
ggtggcctgatggggctgggttggactgtgttgaaggggcttacctgcccgggctgtgctgtgctgtgctgtgttggcccgactgtattggttatgggaggctgtgctgggcagttgggctgggttggctgcactggctcaggcctggcagtcttgtccctggtgtgatcctgggctcagcctggtgtgatcagcgtagtcaccaatccaagacattcattctagaagctggcatggcctccgtggccatgctgacagacttgtccattcacgtagtggagagtgattcatcagagctggtggtggcagcagtaactctgacagagtggaactgctctcaccatcctgtcacttggcctctaaaaataactcctgccggttccgagtgaccgcaccgccaggtgtctggaggtgcagtcctgtggttgtggctatgtgagggagggtgtgtttgtgtgtgtgtgtgtgtgtgtgtgtgtgtgtgtgtgtgtgtgtgttggggatagaggtgccatctgggggcctcttgattggttgacctctgagccagggctttggggtgggagtatgagaggcagaccaggctcgctcttttctaccctctcatagctggggacagagacagctagtgggggtagcagtatttttcaggactgtgtgctcactccctgctgaaaaagggcagagagagtggaatggagagggtgacttcagaggcaatatgacaagggtgaggcaggctctggggaagcacagcatttagccaatcaacatctatgtcccacaaaagcccacataaaagctcatcgtcttagtgaagtctttaatgtagggttcctttaaattagatacaaaatacaaaatacacacatatacagctaatttcttatcgtggctgattagagatcatctagcccaagtcttaaccaaggggattatctatctatcactcagggggtgatctatgcatgggcttcatgagctctcttgatacctgaaagatgataaaggtaggtatgtgtgtgtgtgagtgtgactttgtgtgtgtgtatgtgtgtgc

SEQ ID NO: 100689 - DNA, 1021 bp, Homo sapiens
aaatgtctgtagtgatgaaatgttctacatctgcaccgtccagtatggtaaccactaaccacatgtggctatgagttttacattttgttccattaaatttaaatttaaataatcacatttggccagttgctagacagtgcagtgcacttggtttgtcattcaaggctctgcttggcaccagctcctttctatctcctcagggatagcctcaaccctcagtatcccaggctccaggtcatatgcagcgtttcctgattctaccttgtaattcccagcactatggcttgtgttatgctctctcctcagtctacattgtccttctgccctgcctttaatgcccaacccacatatgacctcttcctcgaaacctcctttgacacctgctgctctctaatctttttctcctctgaactccccaacactctgtcctcttcttacaacctttagtgctttctgttttacattgcagttggctggtgtgggtactttctcttactaaactgtgagcttttggaggatgtgactgttttctgtagagagctcttgcttcctactgtaggtccctccaggtacacagaggagttcgacaaatcccacaaacctttgtactggcacactggggatacagagatcggtaccataacttccctgtcctcaagctgctcacaggcttctacgagagtctgattcatgcccagagaaccactgaagccaatggttattttaggcagggagataaaagccacagagggcccagttggcgaggggagtccggcaggagctgcctaagcagaaggctgtgtttacatacacagacgacttctctgcccagcctggcctagtgtggggagatgggaacattcaggcgtcactgcctggctgccttgtgaagttgcggattaaccagtgatgcagcggctggtctagccgtctggtccctgcagatggatggatgaagagaggactgaaaagacagcagagcagtgccagcttctggaagtgaagtgctggctgggtggag

SEQ ID NO: 100690 - DNA, 1120 bp, Homo sapiens
agagtattttacatcctgaaaatctctagcatatattcatctctgggacaaaaacattaaaaaaaggaaactttattgatgttataacataaacacagaaaagtgcacagatcataagtttacacatacttgtgtaactaccccccagacatgaacagaatatgtcagtatctccagaataaacctgtgtgaagcccaatgtgtgtaggattaatgatagaacaaacacaggccttggagtcaggcatgcctggggttgaatcctgggcccctgcacctactagcagtgtgaccttggatgagtgatttaacttcagtttcctcccctgtaaaatcaaggtggatctataatgtctgccttacagggaagtaggagatttaaaattgaaaatataggcaagttgctaggcacagtgccagcacataagtggggactcagatgctctctgcaatggcgatgttaattgatggtgatgctgcagcaccttctggcacctgggaccagggacacacacacagcttttctcctgttgcctctcactgctcccagcctctgtatgatactctccagctctcttctgactgcaaggaattagagatgctgtgatgatgcaaacctcagctgacacttcaggcacccgacgggaggctgggtggacatctgtatctagtgggtacatggccagatttttcatgttctggcctcaggaatgtggctcccagacctcctagaggggctgatttcccaagaagcagctggaagcatggggacctattaagaaacatagccgaggtggagataaggcagaactcagcctcaggagtgtcctggcatcctgggtggactcctgactcctacttgctccctggcctctggctttcggtgtgaagatggccaacacatactatgcacatattgtgaactgggcactgatgtgggccttcaggggtgtgtgtgggcggagggaagggagtatgatgaaaagtggccattatcctaaagctcatagtgcaatggaagtttaaaacccttggacaggtcacatgaccctgaacttgagggtggcaggacggagacagagaggccaagaggttatttctagccagaggagttggtgca

SEQ ID NO: 100691 - DNA, 1253 bp, Homo sapiens
gctccatagcaactagccatggctagtagctaccatattggttagcacagacctaaaaacagggagtttataagggttgaagctcagagtttggcaccagacatacctgtcagtcatattccgaccctgccatttattagctggatgaactttggggtcgctaacccttctgagcctcagttacttcagctgtgaaagggattaataatttcagtgccagagaattgctttgaggattaaacaaatgaatgtgtgtccagtgccaggcacagaggaagtgctcagaaaatggtggtgcttcaccttctagtatcctctgatgtgctggggtacgtgcctccactagattgattgtgaattcaagggcagaggctgtattcaattcctccagccttccccagtgtccagggcctggcttggtgtgagcattactgcttgctgaatgaaagattaagtccttgggctgggagtgctccccaccccaccctgcttgcccagtagtcaagggccctggtggctgggagtcaggagaccactgactacttgtgggtgaccttggcaagtcactgctttgcttagaaccttggtttcctcctttgaaagataaaagggagataggaggggccctgcctgaagtgtttggttgaatctctgccccgcagtgaccttgggggtctgtggctgactctgtgtcccttgctttcccagccagtggagcgaatcacttccgttctcctcctggctttcctgtatcctggacttttgcaccattaagttccatccagttaaaatttaagaggaaagaatttctcctgcctcctagacagagcagagagggaatgaagggtcctgtcccttctcttctgccagcatctgctgacctcccatcacagcagcccagtgacagacatggggcagggattctcccattttataggtgagaaaattgaggctcagagatgtcaaataacctgcctaagtaatacaaaaagaaatggtagcgctagggctggaagcagaatttgcagctaaggaactgaggaaccccttttttggatgggctcctctttccttctttctccatgagacttggtcctaggttgagtcctatccctgtgcctcagtttccctgcctggggaatgaaaacagtcaagtaactcaagtagtaattgcaactgatgcctatgggggccatacattcttaagtgtctctcctgcttcctccagcctgatttttctggaaagggttatt

SEQ ID NO: 100692 - DNA, 1036 bp, Homo sapiens
ttggcggggggttggtcctgctgtaggatgagcggtgggtgggcgctgggctcccaccggctggcccagtctcttttcggagagcactcctgctgccgcctccagaggccaagggctctttggatttctgctgcttctgacgctgcaggaggagttcttggctggagcctgggatgctggcgagcccttgccctcatctctcctcactctggttacggacccttccccgctctgggcttgcctccccttccgtctcccttccaagtacctcagagctgctaggagggatcttagccctaggacttctgcagttctggcctggcattgtcctggccagtgaccgtcccctgatcagagggagagggcttgtgtgtcccacttgtgtctggcaccttcacacttggggaggtccaagggcccgagaggctggggtctcagggatgggcatggggggccaatgtctacagccattggggtacttactgggtgcagaggccactgactggcagacgtatatggctcaaagtggtccatggagaccttgaagtctggacaaggaccaaaagggagttctggggatgctggtctctccctcagctgccagccatcgtcgttgcttttccctcggagctctgaggatgcattggtgggggagagagcaccacgtgttcccacattcacttctggatccgcatagcacctcctctgcacccaaaggtgggaatgtgagacggccagatttaggacctctccagggctgtgcggggtccagcggcttggcttcattcccaccccatccccccaccctcagcattaggagccttccagaatcagtggcacttgagccaggtcaagatctggggcctggatggtgccctccgcagctcttggaagacagtgcctcctgtcccgggcaagggtgtggagaatagaggcagctgtgtgcctctctgcccacccattcctccagatggagcctgcggcagaggcagcctgtgccagcctcccctatgagccaccgtggcccaggaaggct

SEQ ID NO: 100693 - DNA, 1025 bp, Homo sapiens
agcatgtgggcaactatgtcagcgagctccgcttcgcccctaaccagacccgggagctggaggagaggatcatggagctgcataagacatataggtaagagggtgccagccagggccttctgtggctccttggccagtgggagccttccttgcaggcctgaatgtcctaggccgccacatactgtgctgtttgtaccccgcctggctctgcccctagcttgaggtatatctaagagcaaatcatctctgtaaataggaacgatagtgactggctgtgtggccttgatgaccttttgggacccaagtttcttaagctcctctataggtgtgataattccctgtccttggcctctgagaataagtttatctgccaactggagaaaataatcgctactgtgtctctgagtaagtgtcctcatgtctagatcttggtgtagagttcaaaagtttggacccgaaagccagcctgctagggttcctatactggctctgccactttctaactagaggatctcaggaaggtcatttcacttcctatgctttggtttcctcatctgttcaaggtggatgctgttaaacccaccctgtaggattgttgggaagcctaaatagcacatattaaaggcacactgcatgttggctgttagtgttgctgtctgtggatcgaggggttgaacagttgatcatgcaggggaaagtacctcgttccagcagttggacgataattaactagtgtgattgtaggctggttatttaacctatctaagccccatttttcacctgtatatgcacaaagttagattatcagtgtctctcaactattggcatttggggcaggagaattcattgtgcagaatgttcagcatccctgggacccagtaaatgcccataacaccttctcagtccttgtaacaacccagatactcccctttgccattgcttctgtacaggttcccctggagaggagcccttggaactaaatgatttgtagggtccttttaagctggaagtatttggggctgtaa

SEQ ID NO: 100694 - DNA, 1005 bp, Homo sapiens
ctgccattgatggaagcctcactctgtgccagccactcttccataaatatttatatacattagcttgttcattcctcacctccgctttctaaagcaggcactgcttctagatgaggaaaccaagacccagcaatattatgtaacttacccaaggtcacacagtcaagaacagatggatttgagatttgaacccaggctctagtgctgtagaaaccaggaaggagtcctgggctgggaggcagctctgccactcactggccatgtgatcagaagtctacttcacccctctgggcaatgggtgaggggtgtggaagagttggctccactccaggcgtggttgggcagggctgggctggttctctgtctgttctctgggaggggtctcacatggttgcctggctatctccacccacttcagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaaggtaggagcctggctttctcatactctctgccctggggatcaggaggctgacctgaggtctagcctcggccttgaccttcacatgcctccagctgtggccaagcacccttactatggagtgcaccatggcagggccttgcctttgggtcatctctcaatacctggcccttgccgggatggggtgggcatgggagtgggcatgctgcctgtcctgtactctccccagctttgccctgcttttccagaggggcactctgtcccctagaggactcaggcctccttttgcacactcttaatttgcccctctgactgggatctggatctgcaccactctcttcctcctcagagcatgaccaggtgtcaccaacagctctaggagtgtgaggttcaagtgtgtccccttcctatttccccatgccccactcaggtgcacacacac

SEQ ID NO: 100695 - DNA, 1025 bp, Homo sapiens
ctcaattcttgtgcccagctgtgggacttactgctcttcttcctggtctctaattctcctaatcttcctgaacactccacagcattctagtttctctatctggctgtatctcaccctgtctgctattggtgagtcagtacctgaaaggtatctggaaggtccagggtggttggggaaggtagtgtcccatcacagaggagactagatgcaattttttcctgcccctggtccctagtgtgggagcttggccattcttctggatgtccctggcttgaggaggatctgtactgtgggcctccccagggcctgagcagttgtgcatgttgggctaggaggggcccagactggacatcctgttaagtacagtggcccaagtctcagccagaaagtggacactgggatccaggagggatctaggaggcacctgaatgagtcagagcagcccagtgaataggattagtgagttattatagctctctggcagttgctgcctgctatgccttagttgtaacagagggaagtcacctctgtgactaagaccgggcttatagcaccacagggaactcacccagacctgtgggctttgggtagaggttggctgttcagaggctgtagagccaggcaagggagaagcgaaggtggcttgactagacatctcctctttttcatcttcagtgctctgtgccttgggatgtgcacctgttggggtggttctccttgccctggtttgtctctggggctgccatgagagtgacacaggtcagagtgggaataacgttgctggtggagggtggtgatggtgactgctgccatcatccctgcaccctgcatccccgcttggagctgttcccctaacaccaccaccctctccatctatccctagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccg

SEQ ID NO: 100696 - DNA, 1047 bp, Homo sapiens
ctgaggttactgtcttcaccttcctgtgccccttcctcctgcccacccagaaccaccctctgtggtcttaagaaaaccctttctctggggtgaggggaatgtaccagattctgccaagcagttggaagcaatgggtaacccatgctgtctccatgctgtgataaggaaatgtccccatcccagagatccataaagggccagcccctccctcatccattgtttctcaggagggacaggactgcaaccattctgggaagacagaacagcctgcattgcctttggcctcgaaggagaggcaggaatgatctccctctttcaggtcctggtgaggcaggtgactctagaggcaggccctgacttctatgcttagggtcaggggtcatgctagaggcaggctctgacttccatgcttagggtcaggggtcatgctagaagcaggctctgacttctatgcttagggtcaggggtcatggcacccaaatgccttctgccttaaggtcttttctctgttcagaagcctgaatggtctagcagtggttagttagggcacgacattccaggcatctccggcctgcgtcttctctgaactcccctggagcttgggcccatcaaggaggcaggcaaaagtggacatctttctctaaggagtatccttagggttgtagagagattggtcaggcaagtgtttgaaatgaggaggccattgcttctatgcccagggcggcagcaagtggagggctctttgaacttcctgtggcccttcatggatgctgggcatagaatccaggcccaggcaggaggctgtgctccctcctctgatgggattttatggactatcagggttggaagctactgagcgatcatctgggcagaactttcttccccaatatctgccgctcccctgttgatgtatgctctcctctgagggcctgtacctttctccattctcagagaaaacttctttagctgctgcaaacgtgctggaactttaagaaagacataaatgagctacataagtgataaaacataagtcatacttctactcta

SEQ ID NO: 100697 - DNA, 1058 bp, Homo sapiens
tcagcctcccaaagtgctgggattacaggcgtgagccaccgcgcttggcctctggtgcctttgatgcacgatgatgcttagatctttacctctctcccttccttgatgcattctattgagttcttttctgctctttctatgggttttgttagaattagaatgggccctggtatttgtttcttttagattgaacaccacagtgttcaagctgtttaagccattgtggtgcctggcactaacgtggtcatgtggtatctccatgactactatgctttcttcccagaagcccttgtagaaaggttcgatttcaggctgtggcctgtggaacttaatgcatcccttcaatttgccattaggtcacagttggcacccatattccatggttgtgaaataagttagcaaagatctccggcctcaaaaatcaggctttcttttcctgactctgtcttctactaacagtgaccttgggcaagtcactgtccatctctagacctgtttcctcatttacacaatatggaaatgagactggataacattgtaagagtacttttgactctaacattcaaagactccatgtgatggaaatgactttcccctctgacggtggcagttatgttattaaaagaggaagaggaagggtcctggcccatctgtggatctccatttccccatggctgacatgggaagggcataagaccccatcccattttatcaagttgggggcagtggttgaggaaaattggtcaataatttatcaagtgcctgatgggaagagggaccttgatgagaatggctggcacgtcatgccttcctctccccagccagttctggggatgtgctgtcccaaagtcaaacatttcagtggtagattggtcccctcttacaaagggaaaaactcacccattcttcaggtacctgatatttcatgttaactcttcttgctccaattgaaacacagggttcagagcattgggtatttatagaaagagagtacactaggccagaagagctcggtctcctaaaagtgaccaccatgcagcaggaagaaaggcaggcag

SEQ ID NO: 100698 - DNA, 1037 bp, Homo sapiens
gaagcacacacggaactagagcccgtgtcccccaattcaggctgtgaaaccacgctggcagaagctactggaactggggtaactggccgcgtgagcccccgcccccaccgctgctccccgcccatgggggctggccgcatgctctgtagtttttagaagcatgtttcagtggcccctcgtcatttctgcaatcagaggctgcttatccatccctgtgagttttttccctaaacgggcctgggtgtagctcaggctgaatgatgggcttctctgcttggcccatgttagcttggccacaaagaccctcagcttttggtgtgacctggtgcccagagggtcacacaacccccatggagaaggtggcgccaccaccagcaaatgacacacctgctttgccttgccgctcatacccgctgggttcctgcctaccttgcttggcttgtccagcgatctttcttcatcctttcccatccctggttctcccgccttgggaaagttgacagtccagaggtttccatccttcacttctggttccctctcagtcccagtgccaagtttctttctgcctccttaagactaactgtcttctctaatccagaacaaatccggagatgcggtcagggaagagaagcgctccaccaacttagcagccaacacccctgggaagggggggcgcctgagatttgccagcccctcgggccctcaggtctctgcagcccctctgtgccctgatgacccagtcaccttcacccggccaggatgcatcgccgccttaggttcccacctgctgtggcagcacctctcgtgctgctcaactctggcttgtctggaatgtctccctcacacctctcaaccttccagaaactggctaaatggaggctcgcttagcaagtgaatgtctaagcccactgaatccctagaaccagaagccaagttctttacaaatctttcatgggtattaggttggtctttaaaaagaatgttatgaaccagccaaaaatgtgtgtgtggtgtttaatccctgacaggccagttga

SEQ ID NO: 100699 - DNA, 1020 bp, Homo sapiens
ccctccttagtttctgtttctcaacgcccacctgcacggatgggcctggggtccgggcttccatccctgcctttcgtgcaatgctgcttccaataagctcccagatccaatacccttggatggagcctcctgtccaggagtcactggcaggacgtttgctttgtacttgcttttgccatcagtgtgagaccctcagaaaggggcatctccactcttgagtcgtttttgttttttttatgcttgttatgatttcaaggaacctttcctggggtgtttttcatttcctggcctgctcttccattcaggatgtcgacacagccccgagatttctcctgacattcaccatcttgatttctctttctctctctctccccaccccacatccccattcttttgattttatctggccatagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgaggtacagtggagcttcctcaagagccaggcccgctgggcaccgcatgctcagagggccctgggccacccgtgagaagaccgagcacccagcctgcagcctgaagctctgtctcgtgttgcatgactgcccctccgcagaacagcatggttctgtgctcgcatgtttgccatctcggtttacccctaacacgcgctcc

SEQ ID NO: 100700 - DNA, 2843 bp, Homo sapiens
gaacacccatgatgtgtatagttctgtaccagccactgtgaatccagcttgaagaagggaacatcccggggctctagggcccacatgccactgggagagacagagagagaaggcagggaaccagcttagatgctggtgcccaggctggggtggggctggagtgcaaggaggtggatgcagagaaggggtcagggttaagggatgcctggaggggggaaagcacaggatttggtcgttggtaggatgttcaggggacaagaggaaagatgagctcgtgacaccgttcactagccaatggttctcaaaatgtggttccaggaacctgttagcaaggcaggtcctttgggctcctccttagacctattgactcggaaactctagggtggggcccagcagtgtgtgtttttccaagccctccagctgatgcctctgaagttggagaactgctgatgtaaacagagtgatgggggaaagtgctctttagtgacaagcgtgtgttggaagtggaagaagcagtgaattcctttcgagatcggatgagtctgaggtgcctgtggaacatttccagggcaaaatgtctaggacacaactggttttaaaggcctagggtccaataaatatctgggctataggtgaagggataggggactttgacctccatgaggcagcagaagctgttgagtagccgaggtggcccagagagcgggtggcaagtgaggagagcctgaatgtggaggaagagagggctgagtttgccttggtcagggagaggaaccactcctcctggaggcaggtgacgggactggccaaggatacaggagaggaagggaggagcagagggtgcctcgttttgaatgactgatgtccctagtggtggcctctgtttttagtgtgaaggtggaggtgaggctttgccctgggaaagacagaacaatgagagaataagaggctttaagggagaacttcccagaatgatgctaggattcataggggttagtggctgttaaggggaaaggaagcattgagcccggaagctgcccttgggaagcctgctgctgggccacattctggaactgcaggtgcatctgggaacgtgccttgtggtgcagtaccaaggaaccaggctgctggcagcctcagcaggatgcaggtgtgggagcggcaggggaaagtcagcgagtttcttttctcacctgtcccttggtaggcagaagtccagatctagtgccatgcctggaccagaatcagaggtcaggccactgaggacctgcagaatggacacagttctgggcccctggacagacaaggctgagccctgagatggtgcagaaagtaggaggtagaagcaggcagctgggccctggcgccagatcgggggcagtaagtcaggggacaattccaggaagatctagcaattagaatttaaggtagggccaagagagctgtctgaagggaaagattcccaagggcagagtggcgtgcacagtgtgttggacttggagtcagacaacatggagttaagttccagctctaccactaacttgctgggagactgaactcttaagtttctcttgccctccagtttctcatctgtaaatcaggaatattaaaaataatgcccaactggtgttatgagaattaaacgagatgaggcatgtaacatccttaaaatgatgcctcgcacatagcaagcactcagaaagtcattattattattatattctaaatagccagcttatgcccctatatttatcctatgtattttggtttgcaaaaccttttctactccattagcttcataggttctgtgtgggattggggcaagggtccttttttacagatgaatctgtgaggcccatagagaggaagtggctctgccccaagtcacatggcttgaaggtggcagggcaggacacgagcctgaatctggcaactcctctgctagtgcttccggagaacaatgccatgtcttgatcactacagtgttcctaacgccagacagtctgtaaatgtttgttgaatgagcgagtgtgcaagtgtgcgagtgaacaaatgtgtgcctgagtgagcaagggatgaatgaggcggaactgaacgatgccttcagtcctttgcttctattatttctactcaaccttgtggtcgtgatagctacatggccacatgctccgcccatcctgggggcccacccggctgagagctggccatctgagcactattgtttccccaggagaacagtctcaagtccgggaagggggcagctgccatgatcccaggcccacagacggtggccacggaaatccgttctctttctccggtaagtgggcaaggccagctcaggctaggggactccacactgagaatatgggcatggacccatgtatggctggcaggaagtgcagcgttgagcccagaaggcacccttctaggtgcaaagccaggaaactggacccttttcagatgcccacagggctccctggtgcctgctagaatctcatgagtggccctccccaccgcccacacatgtaagtggggcattggtgacatgtgagggtaaagcggcccctcaccttggtggtgctgctgagggttcttttgcatctgccctccctactaaccaggaagagcaatggactaggaggccagaggcttggattctggacctgcctctgttggtgcctgcccagtgaccctgagtctgtcactgtagggtctctttcagctcttgcattctccaagtctgtggttctcattgtttagctccgcagagagcgtgcacctggctatgacaggatggggcatcaggagggctgtgtttccaccttggatccttttggtcattc

SEQ ID NO: 100701 - DNA, 1026 bp, Homo sapiens
cttaaagaagttaagaaacttgccaggcactgtggcgtgcacctgtaatcccagctacttgggaggctgaggcagaaggatcacttgcagccaggaattcaaggctgtaatgtgcattgattgtgcctgtgaatagctattgcactccagcctgagcaacatagtaagactcgtctgttaaaaactgtttaaagtaaaggaagttaagaaactcacccaagattacagagctagcaggcccatagagtgggatttgaactcagggagtctgatttcagagcctgctcctttaaacactgagttttggagccaaacctggaatccagacttcatttctttatttaaacactgctgtctgtggtttaatctccaggacacagcaagcccacggacaacagaaaggaaaaccaaatgaaaaaagaacatctgcaatcgtgactaaacatttcttagagctgacaagataggaagaaaaagtaaaatgatgatgatcttagcttctcggtgttaaaggacattttaacacattgtcaggccaaagtaaaagattaccacctccctggaaacaagcgagcaaacacacatgggctctggaatccaacagatgtgggttcggttctctgctgccacacacaagctgcgtggccttggagtgcaatagctactcacaggcatgatgattacacattacagccttgagtttctcacctcaagagatccttccacctcagcctcccaagtagctgggattacaggtgcaagtcactctaccttgctgagtcacaataaagggcatatggtaaagggtagcaaaaacaacctcttgccatgtattttaaaacaagtgacagaagttactaatttttcttgtcctcttccttcctttccccccactccccaccccccattctaccccatgcctctggcttccaggaatcctgacctctgtgaagagatcctggcatttctggtccaacccaagccagagaaccattaagaaggggccttcattctggattctccgac

SEQ ID NO: 100702 - DNA, 1569 bp, Homo sapiens
gatgcccccaggcggcccaggttagatgcgtccctttggcttgtcagtgatgacatacaccttagctgcttagctggtgctggcctgaggcagggcaggaaatcagaatagcatttgcttctctgggcaaatgggaagttcagcggggcagcagaatcagtggcattccccctggtgcaggccggtgggtccactccaactccccctgagtgtagcagcacactttccatacaccaggttctttctacaatcctggtggaaaagccacagaaccttcttcctgcccttcttgagagttccccctctttctgggtcaagagctggagtggtggctccatcctctctgggccacttcggtctaggaactcatctttgcaggaaccaggagtcctgagcacactgaacacacctcagagggaggatccttgttgtggattttgcacctggctttggggcaggggtgaagtgaccaggcttagcttgtggagtttatgggccaccagggtttggggaaatcaccatcccgcggatgctgtgacctcccttctacggagatgcaggcagtgccacgagggaggaggggacctgcaaagctagaatctagggcactgtttcctccccatccttctctttgtagagaatagagacgtttgtcttgtctgtcttcaacctacttttccttttctcttttttgtttctcatcctctctgtgccacctctccacccaggaggccatgtagcatagtggaaaaagtccctgagggcggttaggagttctgggtgaccatcctggctcagctcctaactcaccatgtgacatcaggctatccccattccccctcttgggcctcagtttcccgacttgcaaaataagcagaaagaaccagatgctctccagggtctttttctactttgctatctcatgggtcttcattttctcttattttgttttctctggatcttttccatctgagggtacaggaagtaccaggacctgtttcagtttttgaatcctgcaagcacattccaagactggcctgaaactgcatgagcaacatcactcgaaataattttttttttcaaaagcaccttaacaaccaattgcgatgctgtcctgttcctttttactcacacccttctctcctttctcgtccccatgctcccccacctcagtgctccgtgctgtatgcgtgtgctctctgttcttgtatactcaatataagtgaaataaatgtgtttgatgctgaaccatacttccttggcacctctcctctctctctctctctctctctctctctctctctctctcactgtctctctctgactttggccactggtacaagttggcactgtgggaggggctaaaactgaagtggagacatcccaacttagaacatgtttatgcaacaaatatttggaactcaaggtggtccaggccttgggtgactctccaggcacaacacaaacaagacaaaagtccctgcccttcatgaacccacaggctagtggaggaaacagatgccaacacaggcaaacagtccgttacagagcactcagcactaggaagga

SEQ ID NO: 100703 - DNA, 1711 bp, Homo sapiens
cagtattctgtggtaaccagagacccagttacttgcccagggacagtggtgtctggatcatcaggtctctgtttgagatgggcatctgatagaaattgggaacataatattttttgagtgctactttgtgccaggtcttattctaaatgctatacatgtactatatccattcatgtaatctttgctacaaccctcaaataaggaaattgaggccttaatagattgagtaacttgcccaaggtcacacagctgctaagtggcagagctaagatttgaagctaggcagtttggctccagagcccatgctcttagccaccaagctgctcatagagattaaatcacagagccctgtggttaagcaaacaaaaataatctgcctggcaggctgaccctggaataagtactcatgaatttttcttttgtgggaggttccagaactgttcccacccaatggagaatctgttttatctttccgttgcccacattgtgaagcattagatgtgtggccttgggcaagcccttgaccttatctatgaaatgaggcaaataccatcttcctgatcgccttgtggagttgggctgagggttacatggtatagtgcagtatttcctgaccctggagcagaccatccacattagaatcacctggggagcttgttagagctacagatacgaaggccccatcatctctcctccaccagaacctctgagggtgaagcttgggtagctttacttttaacagactctcagtgattctgatgggcagccaggtttgaaatccacttggcataatatccatgaacacattttgtaaacttaaaatgccaggcaaatactgggaatacctcttctctagcagtctgattttatagaaatccaaagccacaggttggtttcccatggcttgaattcatagcggttcagcagacatctattgagtacctgttaggtgcaaaatctcctgccaggctctgcaggagtgacaaggataaaagctcatctgttgctgaggtccagtggaattcatggccttgtgaatagtgatggagagtgtcagctggtcctcctctccctcagaatcacttctcctctctgcacctttcaggtgaactccagtttgcttttgtgtgcttcctgctggggaatgtgtacgaggcatttgagcattggaagcggctcctgaacctcctgtgccggtcagaagcagccatgatgaagcaccacaccctctacatcaacctcatctccatcctgtaccaccagcttggtgagatccccgctgacttcttcgtagacattgtctcccaagacaacttcctcaccagcaccttacaggtgagcagtctttctgactgagctgatgcacatgtgggtcagaattgaggcaacagtatgtgttttgtttctcgctattcttccatgaccccaaaatttttaaatttcagtttcctagtcttgggatatttcctgcttttctctctcttactcaattgtaagtgcctctatgccagaaattttctctctgtaccaccctctccctacacctcgtccccagagtgcctaacactggggtacttggatttgaattcctcccactgctttggtttactcagcttaaaacagcgtttctttctccctgtagccatgaattgctacaacccagtaaagcagaattttgaagtttgttattcccagtgaaacatctgcagct

SEQ ID NO: 100704 - DNA, 3238 bp, Homo sapiens
atttttattcagtcatttaactcctctcagcttccatttccttaaaataggcattctgttgtatctttccagggtattgggaggatccagttggatgctctgtgaaacttctttgaaaacagtaaaatagtataagaaggaatcatgggtttgctattactcttagggagggactgggatccaggacaatctggaatggggtttcagatgtggaaaaaattaccattctgctcccctgcccatgtttgtattaaatgaaactgttcatgagagcatcagaataaggggttgatatccagaatatataaagaactcctacaactcaacaatgcaaaaacaacccaatttacaaatgggcaaggaagttgaatggacatttcaccaaagaagatatacaaatggccaatgtgcacatgaaaacatactcaatatccactgatcattagggaaatgcaaatccaaactgcagtaagatactacctcctacctattagaatggcatgatttaaacacacagagaaaataacaggcgttggccaggatgtggagaaatgagaacctttgtgcattgctggtgggaatataaaatggtacggcccctgtgaaaaactgtggcagttcatcagaatttaaacagggagttcccgtatgatccaacagctccactcctgggtttctgtgcaaaagaactgaaagcagagaccctaagagatatgtgtacacccatgttcatagcagcattattcacgatagccagaaggtaaaaacaacacaaataggcattgacagatgactagacaaacaaaatgtggtatctgcatacaacagaatattattcagccttcaaaagaaaggaaattctgacacatgctgcatcattaatgaaccttgaaggatattatgctaagtgaaataagccagttgcaaaaggacaaatgctgtatgattccacttagatgaggtgcctagagtagtcagattcatagagacagaaagtagaatgtgggttgccagggcctggtgggaggagggaagggggatagggtagtcgaattcacagagttggaaagtagaatgtgggttgccagggcctggagggaagagggaagggggagttgctgtttaatggctgcagagttttggccggggatgatggggtcattctgaagatggatggtggtgatggttgtacaacagtgtcagtgtacttaatgctactcaactgtacacttaaaatggctaaaataatatgtatattttgccacagtttaaaaaataaaaatatttttaaatggttgaaatggtagatcttatgtacagatgctcctcagcttcacatggggttatgtcttaataaactgtaaatcagatataccgtaagtaaaaaatgcattgattacacctaacgtccctaacattgtagctcagcctcacccacctcaaacgtgctcagaacactaacactagcctacagttgtgcaaaatcatttaacacaaagcctattttataaggaagtgttgaatatctcatgtaatttcttgaatactgtactgaaagaaacaattcaaagtgcagcttcttctgaatgtgtatcactttgcatcatcataaagtcgaagtgtcataaattgaatgtaagtcagggtccatctgtatattttaccacaattaaaaaaaaaatcaaagacagcttttaagggggatagaagcctcaaactggcagcctgtggcccatttagaagattagagcagcaattcagtcgtgttggcttggggcctgggactttatgggatccaggggcttataagcacccccaagcctttcttaggaccttagtaccgactggtgtagctactacctgttcctctgggttactgcccgggtgtccagtagaaccccccagggggtggagccagggtaatggcccccagcctctgcccagatagtaattttccattctagtcctgccctagcatctcagctgggtttggaccttctttcttggtttggggggagcatagcaggtgtcctgggcctatgccagcagcagctgatctacccgccccagaagagccgaacaccatgaggaaatttccacagctttctcgccccctgccctccgtcttctcaggagtgacttatcctctgttctctgtaggttttcttttcctctgcctgcagcattgccgtggatgccaccctgagaaagaaagctgaaaagttccaagctcacctgaccaagaagttccggtgggactttgctgcggaacctgaggactgtgccccggtggtggtggagctccctgagggcatcgagatgggctaactcggggagcgctctcagctgcgaggggccccttcccacagggctgcagtcctggcctctccatttacttcttcccatcctgggacctgccagggcagcaatctctccaggtcctgcaaagatggagccagaattccctttttcactgataaatatatttcttcattgccaaagaggctgtacccatcctgaaggcacatttgtgggttccccatcagccaggccttggtgctaacctggctgaatttcacacaggctcttacacacacacgctcctaggagacatctgcctacacggcaaccatatttcctctgaatgagaaggaattgaaccaaaagtccaagaaagaactgattgcttgttccataggagcttaggaaacaagaaaccctggattgcccagggggtctgagaagttggttggtgactttttttgcggttaaatgaagggtgatggggagatcagcccgaattgccgcctgcctcttgctaaataggagcagaggacttggcctgcagctccttgggagcccttgattgggaagagagtttcaagggaggcagctggattcaatctagcaggtggtcagcttcagctttctccatcgaaatcccattctcctgtccagaggcccagtgggtcatctcccaaggtgggtgtggaccctggcctcagaggccttgctggtgctgtcacctcccacctgttccattccgaggcctcacccagaagtgggaccctccccttcctcaccagagccaccgtgactgtttctgatgacctggagagtcaacaacaaccagaaaggtttctgcccagagcaggcttcttaaggcctttacgaagttttgtgccttccaagtgctgaagaagacctggtcagcctaaatcttcccagtcccgctgtg

SEQ ID NO: 100705 - DNA, 1443 bp, Homo sapiens
caagagattgagacaatcctgaccaacatggtgaaaccccgtctctactaaaaatacaaaaattagctgggtgtggtggcgcatgcctgtagtcccagctaatcaggaggctgaggcatgaacccgggaggtggaggttgcagtgagccgagattgcgccactgcactccagcctggccacagagtgagactccatctcaaaaaaaaaaaaaaaaaaaaaaaaaaaaaaaaacaaaaaggcttggatttaggtttctgatatagaatctgcgggctcccacaggtatttaaaagttgacccttgtgttattttaaatgttttgaaaacggaaactacatttatacaggataatatggctgggctgccaaaaaaaaaataggtctcttttgtttggggctgcagtgacatccactttaggtcttctcctgctcgtcccaacgggcagtcctctgtatgtctttgatgaataagaaatgtgaaaacagattaattattacttaatacttacagtatttttggaaggcagacgctttcggaacagaaccagtggtgttgctgatctcacgctcccttccagctctaacacatctacgtgtgaagctattggcaggacctggcctgatttaaaaaccctctcaaatgcaggcctcatggggtctatctcttatttgcaaggctggctcatcctattagcagaatcagcagaggtagcgactttctaaccccttccgctgtccccatgacaaaccctccctgctgtgagcctccctcgttcccatcgaatttctcaccacttgagcagtggaagagttccccactgttgactgcctcttaccattatctccccaccatcatccccttgtaaatattccttaatattcccagggcactgggacatgctggtctctccaactaatcagactttggcttgactgagatgctgtcccctgctgacatgggggctgaaaatgcagagtgaatgccacggtcaaggccagcactgagtcacgtccgccagattgaaatcaggaccatactcctttcaggggaaggctcacctgagctacccagtaatccgggagcccgtgtggtcctgcagctctgcagacgctgcttctcttttcagtcccccgctgactgtagatggcacttccccacctcagattcactggatctggcctggacaggctttgtttctgttagagctttctagacccttccatcttcagagcatccaaggtctccggtactggctagttatcccccaaccctgggctcctggacgggcctccctgctgagagatgggctgagtggtgggatgagagtgggaaataatgtcagctgctcactactggggggcagggtgcgcaggcattcatctggcactcagctccccctgtcccctgccccaccaccaccccacccacccccagcctgccag

SEQ ID NO: 100706 - DNA, 1037 bp, Homo sapiens
tgcaatttaaagggggtggcatttggacaaagatttaaaggtgagcaagtgagccatgtaggggtctagagagtgttcctgcagaacaaacggcgaaggcaaaggccctggggcaggagcctgtcttttgtattggaggagcatcagggggtcagggtcagtaggcaggagtggggtgaccaaagacgagaatactaggagaggaaaccagggaccaggttgtccagggcctataggctgttgtaagacctgtccattttatcagcgaaatgggcacacggttgagggtttcaagcagaagcgtgtcatgacctgacttccatgtttttgctttttttttttcgagatggggtctcactatgtggcccaggctggggtgcagtggctattcacaggcgctgtcactgcggcctacagccttaaactcccagagtcaagtgacccacctcagcctcctcagtagctgggactacaggcatgagctacacccagcagctgacttctgtttgtaacaggatcccaagctgctgtgtcggacacagactgcagggggtaagtaagggtggaagcagaaggaccgctaaggagctagtgtgacaatccaggtgagaggcagcagtgactcaggccacagtcgtgtcgggtgcaggctgtgctgtaccatgattcagaagatggatccaaagggatgtctttgatggtcccttctagcctgataggccccacttccccagggtcgcagatctgggcagaatgccaacttgttgggcccgcacccgcacaggagttacctcttgactgtcccatcatggggtgtgttgaaccttcctattctcagatgtccatggtacatttggggaggtggggcaatgaggaaggattgggagggctgtcacgggttttctgggtgatggggtggcagtggaggacttgaagtggctctgttgagaagcagtgggtgagtcagggccccctgatagactgtggttgcaccatcagcacctgtgcggatgttcttactgctgatgggcagtgag

SEQ ID NO: 100707 - DNA, 1015 bp, Homo sapiens
acctgcagtggtgaccacattttgatgccgaccttccagaggtttctccaagtctgtctgctgtggcagatagattcattcattcattcaacaaatatttgttgagtgcccacttgatgccagaccctgtggtgggcagaggggacatggctctgagtgaaagggactctcctggcccttagggaactcaaaaagcaggtaaaacagtgatgaggcccacggaggagggtcacaggaacatgggccctgactggagtcacaaaggcttcctggaggaggtgacacttgaactgagacctaagggatgaggagaagttgccccagcaaagaggagcagaagaaaacattccagcagagggaactgcaaatgtgcaaaccccggggtgtgaggaaggtggggttttcagggaagaggaaggaagatggtgaggctggagtgttgggatgtggagggaggacaggtgaagcactagaggatggcgggggccagacggtatggggccttctgcactgtggtcagggtttggggatttacataagagcgtgggttgtggcgccagaaggtctagatgcaaatccagctctgctgcttattaggggcttgacttcagcaagttacctaacttctctgtgcctcagtcccctcatctgtaaagtaggggcagtgatggtccctgcctcataagactgttgtgaggatgaagtgaggtaataaagtgcgtaggacagcacgtggcacacagcaagtgcttataaatggtagctcatataatgtcacagtcatctgtagatggagggcatctgtgcagatgactttgcaatagggtcacattagtcctgctcatctgcagctacttcttcccttgatgctggccatcctcctgagtcagtgactaccgagtattattctatttgaaatttctgagttgtagtatagcacgtgttgtagagtgtactaatcttaagcagatagtatagcttgatatatgtgtatatctcacccttgtaactacca

SEQ ID NO: 100708 - DNA, 1043 bp, Homo sapiens
actgtactccagcctggggaacagagtgagactctgtcaaaagaaaaacaaaaagagctctatagttctagctcttacatttaggtctttgatccattttgagttatttttttgtgcctggtgtgaggtaggggtcaaatttaattattttgcatgtgaacaataagttgtgctggcaccatttgttgaaaggactgttctttctccattgaatggtcttggcacccctttcgaaaatcaattaaccataaatgtgagatttgttgttgtagttgtttgtagatcctcagttctgttccattgatctatccttatgacagttccacattgacttgattattgtagctttgtaataagtttcgaaacttattatcttttaatatctgtagactctgtagtgatgtgacctgtttcattcctgatatttgtaatatgtgtctgatctttctttctcatttttaatttttgatcagactgggtacatatttttcaatggtattgatctttttgaaggacagcttttggtgtcactgattttttcttattgtttgttttctcttttattgatttgctgttctgatgctattttctttctcccacttagttcagggttaatttgtttttctttttctagttttgttttttttaaggtaaaagcagaggtcattaatcttaaagcttttgtcttcatgaatataggcatttagtgctataaagtttcctctaagtactgctttagcagcaccccacacattttgatatattatattttcatttttattcagttcatagtactttctagtttcccttttgcttccctctttgacccatgggttttttagaaatgtgttatctaatttccaaatatttgaggatttttcagggatctttctgttaattgtttttagtttaattccactgagattatataacatattttgcataactttaatcttctaaaatgtattgagacttgtttaatggcccagaatctggtccatcttggtaaatgttccatgaaaagagtatgtattctgttgtta

SEQ ID NO: 100709 - DNA, 1037 bp, Homo sapiens
aattttttttttttttcttaagacggagtctctctctattatccagatggaatacagtggcgcgatcttggctcactgcaacctccacctcctgggttcaagcaattcttctgcctcagcctcctgagtagctgcgactacaggcatgcgccaccatacccagctaatttatatatttttagtagagatggggtgtcaccatattggccaggctggtcttgaactcctgaccttgtgatctgcctgacttggtctcccaaagtgctgggattacaggtgtgagccatcgcgcccggcctaatttttgtatttttagcagagacggggcttcaccatgttgggcaggccggtcttgaacgcctgacctcaggtgacccacccacctcagtctcccaaattcctgggattacatgcgtgagtcaccatacctggccaaggttggaattttatctatgtttggcctggcaatttcagctccaggaaattttaagaaaacagttcagattgttggagccaaacagtcatgagtttgaacctggatgtaccacaggtcaccagttatgtgacctgggactagttactctacctttctgaagtttcatttgcttatctgtaaaattgggattttaatacttatatcatctggttgtagtgaggttaactgaagtaatgtgtgcaagatattcagcttagggccagacacagcgcaaaccttgtgcccctgggggatgtcttgatgacgtggatggaaaaaactgagtcagaagtggcctccaccaagcttttggtcctgacacttcctctctatccctgattatgtataggaaataaaaaggctgagccggacacagtggctcatgcctgtaatcccagcactttgggaggccgaggtgtggggatcacttgaggtcaggagttcgagaccagcctggccaacatggtgaaaccccatctctactaaaaatacaaaaattaggccaggtgcgatggctcacgcctgtaatcccagcactttggtaggccaagtcaggcggatc

SEQ ID NO: 100710 - DNA, 1008 bp, Homo sapiens
cagagctgcccaagcatcccctcttaggggcctggtctccctgcctgtaatgacttgttgactcccaggggttgcaaactcaggggcctgcaggacctggcagatcagatcagagaggaatattgtcgagtgaaggatgacaggttcctgtttctaagcgctgctcccaccctgtggccagggccctcctcccctgcctccagagggacagttccctttagagagtttgccaatccagtccatgcccatggaacacctatagtgtgttgccctgagctgcggggcacctccaccacgaacttcctccatttccatcctcgtaaccacctacgacatctttccatgcccatttggctgacgacgagacaaaggccacagagctgaagtttctggcctccagggtcacctaggagacaactgttgatgccccatcctgatttcctcccctgaccaatattggcagctccatcagaatcatgttcttccctaggacccttgcgcttgctgtttcctctgcctgagactctgcccccagacacctgcagggcttcccgcctgtgttaaatgtcgcctcctcaaagagccctcctctcacccttctccctgctctgttatgcctatggctgtgatcacaccctgacatgttgtacatttgtttgtttaatctgcatctttcccaccggacttcaagtcagcagccctgtgtgtttggcttacatcttatctccattccctaggatgatggctggcatgagtaccagcaggtgtttgtggatgagtgactctcctaactgtgggtgtgtgtgggactaaggggacaatgggggtccagcagtcccaggggcagggaaactgggaaactggagggcccagagggcagcccccatcagctgctccccactcctctggtttccttggctgccttgatgtgcccacccttgactgtggccttgcatccaaccagagtgggcgtcagtccagctttgctcccgcctgctgtggagacag

SEQ ID NO: 100711 - DNA, 1016 bp, Homo sapiens
aaaggggagtctgtttggggctggaggcctcagcccagtaggttcccagccttgaaggccaggcccagctcccaccaaggccccatgacagcctcggtactaccaatgctgatgaatgcctgggcgccagcagccaccccgctcagtggaatcagctgtgatttatgggattggggcccgcagggagcaactgtctgagctcagagaagcctcagaaaaatgggtcaatgcagggcagggctgggatggaggtaacctctgccaactggaaaggctcagagactggctcctctgccgcatagtcctggtggggaaactgaggcccatggaggggcctttgctggcagagaggccctctagtgggcagcagaaatcaaaagccagaactagtgtccagtactgggaggtaccttatagacttcagggtagccagggaaggcctctcagcagaggcgacatttgtgctaggccctgaggcatgagaaggagccatgctggtaggaggtgagctggtggtgggagcagcaagggcctgagcttggaggtgggacagaggctggcacgttcaggaaagaacaaggagggcagggcacctgagggactgagtgagggggaggggagagggagaggatgctagagaggagcggggactgctcagccctgaggggccttctggccctcagccccagtttgggccttttcctaagtgccctggaaagcctctgaagtgccggcagctcaccggctcacattttacaaagacccctctggcctctgtgaaagtgaattggagcagcatgtggaaggcagggagtctgaggagacggctgcagacatcgtggcaacgaacagctgtggcttggacccagggtggccaagaaagacccaagcctgggagctagaatttgtccctgggattctagtttaagccactcatctcctctgggtagtgaccaattttaatgtctcaaaactgtgatcccttgatgccccacaccagggcccaggaaccgtgt

SEQ ID NO: 100712 - DNA, 1063 bp, Homo sapiens
aaagaggagctggcctgagatcacattgctggggtgtgtagagcccagccgaccatggctccctacctgtccccaggtactcatcttcctttcttaatccccaacctccagctgctcttagaagtgttttccaggggaacctggtcttgggagcctggttgggatttcagaaccttggacagctcccagtggacctgggcctcggctgggcctagggccctgggtgtgaggtcctattcagtgggatgagaccctccacctcatcttggccgtgtggaggcagcaggactctggatgagccagcaaagctaagggtcccccctccttccctaggcacatcgagtccactggacccagaggctctttgggaggggaggagccagggccctacttccatgtctcagcacctccacacccctcctgggccttgccatcaccatggaaacaggtggaggatgcactcccaaagaccccacttcaggaacttgggcttgggaagctcaggactaaatttgaagggacctaaagtcactactgcctctgttttccctccagcccattatacaagatggggaaactgaggcctagagaaaggaaggctggattcttgacatgtcccagctggaaggttcccaggtatcagctggccccactgttccattatatagacgagagaactgaggcaaagggaccatcttcagagaggtgccccctgcaattggcttctggaggaatcgctttttttccttcctcacaggtgccataatttgaagcatgtgttgtttttgtgtttggtatctcttctcctgctggtggacaaaccaaggtcagggccatttgtttgtggtcatatcccagggtctggtacacactgtggcagatagagcgttggctctggggccagctggcctaagttcaaattccagcttctgccaaggctgtgagactttgggcaggtcacttctcttctctctcaggctcttcatctgtgaaatgggagaatgatggcatctgcatcccaggcttgttttgaagattgactcagatggtataagcctcaagc

SEQ ID NO: 100713 - DNA, 1039 bp, Homo sapiens
tccagtctgggattgagaatgctaaaagctacctggccctgagctatccagtagggtaaccatgagccacatgtggctattgaacttcaaattaaatttaaaaatcagttttgtattttatttaatttttattattattattttttgagacagagtctctgtcacccaggctggagtgcagtggcacgatctcggctcactgtaacctccgtctcccagattcaaggaattctcgtgcctcagcctcccaagtagctggaatttcaggcacatgccaccaccatgcctggctaatttttgtataaaaatcagtcttttaattgcactagtcacatttccaatgtgcagtagccacacgtggctcacggccaccctatgggagagtgcagattagagcatttccatcatggcacaaattcttttggacagcattcctccatgccttgaaaatccgtgcccatgtgttattttaagccctgatccttccgcaggggcttctgagacttagggagagatctggggctctggaatctgacccagagttcgaatccctgctcagccatttgcttgctgtgtagcctgaggcaaaggaacttccttctcctttctgaggctcggtgtcctcatttgtggcctacacaaagctgtgggttcaaggagaaagctaggtaaagggcttcccagttggtactgcgtgcaaggacctgctatgaggcacatagcggtgttcctagagctgtgagagactgcacaggctgttcctatcagaacattgccggaggggacgcctcccaggcccttgcagcttggagccactgcccaagcttctcaaaatgaggcaaggcatgctgggagttcatcgggcactgggggctgatctggagcagtggccagtgggtgtgactggcttggagcagttggtaggtgaggtcaaggctagaactggtaaggctgggaggaagggccagcccgctgaatcctgggtaggggcatgcgtcctctctgcataaaactccattgtctactagctgattagggg

SEQ ID NO: 100714 - DNA, 1047 bp, Homo sapiens
aataatccggcaactgcaaacatatgcattttgcaagtaagttcactgcacctttcttgattacagtgataaattagaaacgacccaattctctgtttgtgagagttggttaaataacttacatccggccaggcaatgccattttccgcagctatagaaacagtgctgtaaatctctatttgttgacatggaaacttgtccatggcgcattgttggggaaaaacaggaggttaaaaattgatgtatgttgtgtgacatccggatttggaatctttcctgagtgttaggatttgcagggaggaacaggatatctacttaggtatctactgatttttttttcacttttgttatgaaaaatatatataaacatatgcgtgctcctgcctagggagatgctcagaagagtagtcattaaactgttgatagtggcttcctctggatggtgagatataggtgagctctattttgatttttgtttctatcattcagagttttttcaagtaaggtgatggaaaacccaccccaaactagtttaaacaaaaaatagattcgattgacttgtaactgtaaagttcagaggtctgatggcttcaggctcagctggatccaggacctcagggccaccaggacttgatttctgtttctcaactctgggttgtttccatgttctcattaagctctcatgtacaggtaataagatttctgtccaaagaaataagcaagaattcttccctgattgctcaaacacaagtcccagaactaagtcttggccttgatttgtcaaatttgtgggatgtgcccacccctcaatcaattgctgttgctaaggagaatttggtgctctgattggcagcctgggcctgtgtaccatccaccaccagctgggggtggggtcaataccactggaacctcaagagtggagagtggggaaaagtggcttccccagaagtagatgtaggctatgacctaaagtagaccaaatggtagccaaacccagcaacccccacctcctgtaattatctgaattgcccaagatgcatggttttc

SEQ ID NO: 100715 - DNA, 1014 bp, Homo sapiens
gtggagcctcagttttctcctatgtaaagcagaggtgatgatagtgctgccccaggtgttgtggggaaggtgggaggagagcgtgtcaagggcaggttctccacggtgcctggcacataggaagtgcttggtgacgggaagtaattctggttaccacggtccaggggcagaggtgggtgagagagctggctggcactggagctccagatcgccacctgggcaactgtgtaaggacctggagtgtgttgcctggagaagggaaaccagagaggggcttggcttcctgcctttccatctctgttggaggaggcagggtctgggtctggcactcacaggaaaagctccagggaaggagatcccagcttaggctaggaaaaccttttggatacaaagaattctctgcagatgggctagcttgggtgataggtagcgatctcctcatcactgagagtattcaagcagcagctgcaccatagcttggcagagagtctgtagaggatttgtgattcagctgatgatctggaaggtcctttccagcccagagagtgtgtgatttcaggtccttccttctctgaaccttggtttcctcatctgtaatacaaggataacagcagcccccatcttagagttggttgcaaagtttaagtgaaatcatccaaataaagtgcttaacccagatttggcgcatagcaagcgctcggtgaatggtggctattattactgtggatgttgcgctagattcctgggcgtgtcacttccatctgagagcctcaggcgcctctgctcatcagggtgctcctgcctgcctgcccttcgggacccactttctgcccttctcattgccaccgtctctgtctccagctcccccttcaacctccctgggaggtggtaggatttccagacccttctgggccccttttagctcccacttgagcaagagttggcaggttggggcggcggatgccatccgcctcccatatgcttcctgctatttagaggaaaactctccccgcg

SEQ ID NO: 100716 - DNA, 1058 bp, Homo sapiens
ctggttaaaagccttagggtggatggtgcctggcacatgctaaatgcacaacaaatactagccactagtattatcatcatccttgttatcattattatttgggctagaacagcgcctagcacttaatatgggctcagtaaatgttaatgttttttcccttgtcctttcctacagctgtggctactcaaggaataccagggcatttcagacttagctcagattggtgtaaccagtggcagaaatgcaagagtaaggacaggcagaggctgccacatccagggtagaatgtagacaccagtccctccatacacacagacacacgcacatgcatgcacgcacgcacctgtgtcccaaaatctcatgcatcccatctgagtctggagttgccctctgcttggttttgatgggcgaaagggaagaggaaggcccggcaaggcctgggctctctgcaggcctggctggaggcagagtgcaggagacgcttgagtgtcagccacagtaggagggttcggggaagctggagtaattctatttggctggagtagaaagtgggtggtgggaaggcgtgggaagcaagtttgagcttcattcagcacctcctgagtgagcccaagtaccgggcctcgtgccagggactggggaagtggttggaaaagatgggcacgcttcctgccctcaacaagctctggttctgggacagggaggcagtggcaaacatgctagcagtaagctagcgacactctgggtgatgctcaaatagccccaggtgccaagagagagggggccacaggacagtggtagtgagtaccttccagagacagggtggtcagagaggccctctttgtcctctcaagcacacactggagctggccctgcaaatgctggatgggtaaagtggcgggaggcagaggaggcagcgagaacaaaggttgggaaggtggccgaagccagaccctggaggcctcgagggccaggcccatgggagatgctcttgagaaagactattctggtggtgggtgcgggatcctgtcagggggaagagatggaaccaggagacc

SEQ ID NO: 100717 - DNA, 1051 bp, Homo sapiens
gctgcagtgagctgagatcacaccactgcatccagcctgggtgacagtgagaccctgtctcaaaaaaagtaaaaataatttaaaaaataataattagccaggcatggtggcacattcctgtagtcccagctacttgggaggctgaggcagaaggatcacttgagcccaagaattcgaggttacagtaagttatgatcatgccactacactccagcctggatgagagagcaagaccctgtctgcattaaagagagagagagagagagagagagagagagagagagagagagagagagagagagagagagagagagagagaatctcagaggcaggcaggcaagccagggccagtgcagtgattcagatgaaacatcaagggcccaggcctctgacacccttagcatgcatctttcattctcatggctacaaaatggctgctcctctgccatgtgctgcatctgaattctagacaggaaaaggagagtaaagcctgcatgcttcgcgagtttccttttcctaccagggaaacaaagacttcctggaagccccactttgtggatttttgcctacttctcttttgccagatttggacacatggacaccctagctgcaagggaagctgatgaagtgaatatttctaactgagcccttctgttaggaaaaagggaagaatagctagcaggatagctagcatgatccaccttaaagtacccacctcacagggaaagattctaagagatatttaatgtacataaaataatcggcaacctttcaataaatggtggctgcctttattctactactctacctacatgtattcattcattcattcagcaagcaagcaagcatatattgtgttttgggcactgaacacagtactgcacatgacagtgacagtccctgcccctttggcactcacaacagatagggaagatgggcaaggaaacaaattcactctacttcaatcagtgtcaaaacagaggatttatttttgtctgtgttttcttaccactgtggtttctccacctaaagcaatggctgggacacacta

SEQ ID NO: 100718 - DNA, 1024 bp, Homo sapiens
tgatttcatttttctatagctagcctattgtcccagcagcattaattgaacaccctgtccttttctcactgatttgaaataccatctctgttttatgtttaagcgcccatgtatttatggatctgtttctgggaactctgttctgtttcattgatctctttgtctatctctttgtctatttcggttctacactaatcactgtatctcatcatttttcaacagggacatcttggcatttggggtacaacaatccttccttgggtgggactgtcctgctcattataagttcttgagcacccgtcatccagtccttggcactcagtagaaccctcccctgagtgagtgttatgaagaaaaataccctgagcgagtgttatgaagaaaaacacgtttgcaaagtcgccctaggagggcagtcccttggctattgagaactgccacagatagctgtattatgtggcttgatatctggtaggacaagcctccccgtccccacttcttgattcttcctttgtatgttctcttcgcactctgctttgctgccatcagtggaatccatagcatgacactgtcaggcatctctggagatgggactcccatcaggcaaggcagcccactcctttgtgtgtgtctgtctggggcctgattgttagaaagtgctgtcttacactgagctgaagttggcctccctgtgtcccacttcctccccagctcctggagcccccagaacacacgtccctcccccgtggcccacccttcattgacctcagagagcagacatttcccctccacctcaactcttttctctagactcccaaactcaataaccccggttccctctgatgtgcgtcaaagacttggcttagtggcaggcagcgtggtatgtttgaacttgagtcagacacattgagttagaattcctgctcacttacctattagctgtgtgactctgggaaaggcagttaacctctctgtgcctcatttgttaaattggggtaatagaccctctacctcagagggttga

SEQ ID NO: 100719 - DNA, 1087 bp, Homo sapiens
tggctgggcgtggtgacgtgtgcctttaatcccagctgtttgggaggctgaggcaggagaatcgcttgaacctgggaagcagaggttgcagtgagccgagatcgcacaactgtactatggtctgggtgacagagtgagactgtctcaaaaaaaaaaaaaaagagagaataggttttagtccaagggccatgggagtctttgaaaggatctgaacagcagtcatctgagtgagagatagtggggactcggcctggggcagggctgtggaggtggtaggtggaggaactctggggatatgtggaagggagacttgtttttacagtttgtgctgctgaatgggatgctggggtagtgaaagaggagtcaagggtacttcccggtttctgacctgaacaagcaggaggatgatgttgtcatgagtagaatcggggcagactgtgggcggagcaggtcggggcgggtgagagatcccgtgttctatcttggacctgtcagacatccagggcaagatgtcaaggaggcagttagagatctgagtctggcgtctgagagacagattgggcggaagatgtaaattcaggagttgtcagataggtggtgtttaaggccatgcgtcaggatgagatcagcagaggagagggtgtgttagagcaaggcggagagcacccgggtcctctagcatttagacgtcagaggagagaagccagcaagagccggagcaggtatgagagatgtgggttgagcacgggaagggtgcccaaagacacagccatggcgcaacacagccagccactctctaccttcaccccaccccaggcagcagcaaggccctggaggcccccacagaatccatccttccccttccacacatcgtcccttcagaggtctaaggcagagaatgtgtcctccatggactgctatgtacacccccagaatgttcggccattccacctcacttcatttctaagccttcatcatctaactcagcattgagcaggaccacccctcccttcacttagactctctacctctgttaatgcaaccttagacagaagtaggctttctggtagtaacaaatatacaagat

SEQ ID NO: 100720 - DNA, 1108 bp, Homo sapiens
gctgcccatccaccgtgatggcttcagcaccctccaatttccccgtggcgaggccaaggcccgtggtgagagccctggccgcatccgccacctggtccactcagtccagcggcttttcttcaccaaggcaccctcactggagggcacagcgggcaaggtcggtggcaatggcagcaagaagggtggcatggaggacggcaagggccggagggccaaaagcaaggagcgggccaaggctggggagcccaaacggcgcagccgctccaacatctcaggctggtggagctccgatgacaacttggacggcgaggccggcgccttccgcagcagtggcccagcctctgggctgatgacactaggccgccaggcagaacgcagccagccacgctacttcatgcacgcctacaacaccatcagtgggcacatgctcaaaaccaccaagaacaacactactgagctgactgccccaccacccccgcccgcacccccagccacctgccccagccttggggtgggcactgacaccaactacgtcaaacggggctcctggtccactctgaccctcagccacgcccacgaggtctgccagaagacctcagccaccttggataagagcctgctcaagtccaaatcctgccaccagggtctagcctaccattacctgcaggtgggtctctggcagggtcaggggtgggatgagggctctggggacggcaccagttttgaggcctagacgtaccacagattcacttggaaagtcacttcattctgggcctctgtggctcagctataaaatgggtggcctagtggtacctgctaatcagggagtccttccactggtcatgctctcaacagagattaattagggcctttctgagcccagccctgagcagggactaaaatatgttcctgccctttagaagacaaatctggaagctgtgccatcccaaccccctcacagaaccaattgcatgacattctaattgccagcctctccctgccacccccatcagactgacagttttttgaggacagggatcacatctgatgcagccatgtgtccccaaggcccaggacaggatctggcatgcaggaagtgctcaggaaa

SEQ ID NO: 100721 - DNA, 1039 bp, Homo sapiens
ggagtgcaatggcaggatcctggctcactgcaacctccgcctcctgggttccagtgattctcctgcctcagcctcctgagtagctgggattataggtgcgagccaccaagactgaccaatttttgtgtttttagtagagatggggttttatcatgttggccaggctggtctcgaattcctgacctcaggtgagcacctgcctcagcctcccaaagtgctgggattactgacgtgagccactgcacccagccatgagatgcattttgaacgagatgatcttcggggtctaacaaagcgctgacttcttatcatcttatatgaaattccagaaacagtgagactattttctttttcaataggaggaaactgaaatccaggcagtatgtgatatatttagggctcttgtggttctgaaactgcttccttggtttagaagcattagggagggtgatgtgtgaccgggcttcctctcaaaatggtatagttgggtctgatcatgtaacaatgccgcagaaacaccatgagagggtagccctgtgggccctggagtctgtgctgcctgcttgggtgacaggaggtgagtgggtggcttagcaacagtttctgagcagtgatgtacaaggccatgttcccaagggacagtggggatagtggggctggactagcaagtggcttgtaggcagaatgcactggccctaggctgggcagtctgctgagggtttatgggaaggctgggtggggctggagtgggagtcctggacattaccttccctttgtggaaagtgggcctctgacacagagggcatggagaatggtgcagtacctgtgtagacatggcccttgggcagtgtgcatgtgtatgctatagagagtgggaatgctgtgtacactgaatgagtgggcttggacatctgtggtgacatgtgcagtctggtgaggggtatgctgtgtgcatgtggaggcggggacagtgcaaggtagatacacgttgagatgtgtgtccacagtgcagtagttgctggcgcgaatgtccagaggg

SEQ ID NO: 100722 - DNA, 1097 bp, Homo sapiens
tcaagtttccttgcaattgaccctgaatcccccaccccagccccagccctggtccttccataaccctcaccctctctttcctgcagatttttggacaggcctccctgatcccccagttgtttggccatgagcagcaggtcagtatgtttgcccttctcttccaccccaatcccagagtgtaggcctgggccttaggcctgccctctgagtggtcccagcacccggcccaggctggtacaagcagagccatcaccaggaaagccacttccagtggatggagttgagggtcacattggtgtcctgactctccactccctacccttattgcttcacctctatgtgcttcagtttcctccttttgaaaatggggaagaatgagctaggtgctctggatggggcaagaaacaactccaggactcctgccctcctctctcctcccagaaagcctgggtcaggcctggggagactgagttggacaggtcaggggctgggggctgatgatattagcttccaggtcccagcccccagatcccttggcttttctcctttctggagcgccaggaggacatttaaagatgttggggtgttggagtgtgtgtggagactttccaacttcacacaggttggtgaggttgtgctgctcatggcactgtggctgccctgagggcaccacctcctagacattcctatcctgcccctggaagtggccctctcctccctcccaggccaaagaccaaaaaccaggggcaggaaaggtactctgagatcaaccccactttgtagccaggagtgggtaagggacttgtgcaaggtcacacatcccacaggggcaaaactaggaccagacctccagctcctgattccagccgtggatgccccatgtgtccctctcccccatgtcacagaagctgtgtgttcctcctgaacacatgattcaagaagttatttaaagagcccacagtgggccaagcgacctcttcctcatccacctttaataggcgagtggtaaggatgtgatgcgttaacatacaaagcccccaggacagtgccccctacacagtaaatcctcagtgatacacataccagcagcgctgacc

SEQ ID NO: 100723 - DNA, 2382 bp, Homo sapiens
gccgggccacatgccaagcgggctgcgcgcgcccctgcccggcccgggagtccctgacgacgcgcgcgcggctgacgcggggggcggggaggggcggggcaggtgcgggactttaacccggagccccgcccctcgggcgtacaaaaccggagcctcgggccgggctgcgtgagggaggagggtgagtgcccgccgctggccgccgccgccgccgccagtccgtccgtctgtccggtccacgtcgtcgctgccgcctcctcagcccggacgcccggggcccgcccagcgccgcccggagcagccgcggccccgcgaggagacgggggccgccccgcccggcccggcccggccctgccccgcccccgccctcgccctcctcctcctcctcctcctccccgtctgtccgtccgtccgtccgtccgcccgcccgcccgcccgcccgcgcttccgtcctgtccagccgccagtcctccagcccgtgtccccgctccgcccgctttgtctctccccggctcgctgtctctttgtctctgccctcgcgctcctccgcagcccctccctcgctccccatctcgggtccccttctcagagcgctcttcagccctcagagccgccctttctgggcgaccccactcttcgggactccccctcagagcgcccccagatcttttggggttccccttgagaacaccttccactctccccaagggctccccgtgagtttcttgcacatcctttgggggttctgcaccccaagtcgctggggtctcgcctcctctgaacccccattgcccctgggctttccctcttctgggtgttccccatatccactgggagctcctaggtcccaagttggggtctttctccttgggaccccccaatatgtcctcagctccctgacttcaggagctcctctctgctttcccctggtttgtcccctgtcgctgtctctccttgttctctctcaggtctccgagcacccccacttctcgggatcggggtcccctgctttgctctccctgcccctctgtgcccccacatctgtctcggtggtctcgccactctgtgcctcttgcgctgaaggcccccctttgagcctgcttctttgcctggggcccttggcccccccttgctttttcagccctagccccctgtctccccttctctctgctccttgtctccctctccctttttctgtctttgccgggtctctgggtctctgacccccatccggccctcatggctttgtgtctggagctcttgaagcaatgtgagtggtggggtgtccgggtcgggccggagttggcccgcaggctggccgcggccgaggctccatggggttggcgctggggcaagggctggcgctagggcaagggggctctgaggcctcccacaaagggggaaaggagggaggggccaggctgtctggcggaggagggagtggggggccttcctgctctgaggcttctgctttagttgcttgagtgtgtggagggcaccacgggctgggcatccctgcccacttggccccgcatggcctggcactttgtgatcgcttgtgggcaggccgggctattttggagccggcaggatgtgatatcatttggacgtttatttagccccggctgggtgtgggggctgcgttcttgccagcttgagtaatgaaattttgcaggggggtgggggtggggtcagcctcctaggcagctaggctgtggggttcatggccagaactttgcagaacaccagagtgggcaagtgaacaaaggtctgtgctgcctggatcttgctgagattcgattcaggatgagcagggagaggacttcttaatctgaccaccctgaggattgactttggtagtctaacctctggggccttggttctgccagcttcaaggtgttgtaaccttgagcgagacccttgtcctctctgtcagtttccctatctgtaaaaagtggataattgtgctggcctcacactgttgtcatgatgatcaaatgaaacatctgtagacacgctttgtgaactgtcagcctgtctttaaacagccccatcgagggagaggagcttgcccaagggtaaacagctggctggctcctgccagagctgggacagggatccaggactaggacattacagtccagggctctttaacctcctccccactacctggttattcgagaatgcacctgcccttccaatagagcagggagacggctgtttcttaattcaggccccaatcctgcttgttctttgttagtccgtttgtaaagatagatgggcgtgcccatcgggatgtctgtgcagggggacagttggattttccatgttccatcccattgttgtttaagggtgggccctgcttggacagtggcacttgga

SEQ ID NO: 100724 - DNA, 1384 bp, Homo sapiens
gtctctctctctctctctctgtctctctcctctctctctctctctgtctctgtctctctctctctctctctcctctctctctctctctctctctctctctctctctctctctctctctcccccccccttctctcggccctgccttcctagccctgggccaggctctgagaggatggggattaatagacagacaaggcgtctctgccctgaggaacttatggtctgacaagaagacaagcctacaattatgagagactgtgtgacactctgtaattaagcgtctgctgaggaaaagcattgtctgagaaggaagaagtgagcatgagccagaggaaacaagagccctttgaggggagctggatttgcagaggcagagggtggtgccgacattccagggaggtgggtgcagagggcatggctggatgataagtgtgcatttagggaaacagcagtatgctagttttgctgaggcatcagggctctggctggaaaatctgggtggagccaggaggttgtaggcagtgttaaacagctgaaaagcagaggcactggggaggcatggaaggttttagagcagaggtagcacaactggaagactttccagaggatgaatcaggctgggtaaattggaatgaataaaaatcacaacagggaggaggctttgcaggcatccagatgacacaagagggtgaggtttgggtggggcccatgggagtgggaagagccaattggggtagcagaggatgctgtgctcccttaggaaagcttggccagcgctctgatgggccagaagggaaaatgttgggtgttgctggtttggggcaggaagtagcagtctgagcacatttcttgtacacctgctgtttgcctggctctgcgccaggggctccacaagggcgctcatgaaatctgtacaataagccagaggcagatggacttcccatccctgttttgcagataaggaaaaggtagctcaggcccaaggccaactgtctccaaaccgtgtctcttcccacagctcagctctgcttcttggaaagggaactcctgcttttagggtcccaaggggctgagccttctttccctttaattaggagcaagcacatttatcctaaaagcccacaaatcttgctttctaaggatcctgaaggtcagggtgccagtttagaattccttaaaggtggaagagtcagaggagctagggaccctcacacaagcagttttacacactggactgtgagaaggttccggagttgtgctgtgtatatgtccagtctgatagtaggcatgtccaccactgggtctgttggaattctcagccagcccccaccagagaggggcccagccaacgcaatcagtcacccacaaaggcgggaagggactt

SEQ ID NO: 100725 - DNA, 1081 bp, Homo sapiens
ctttttcattctgaaaatgtatatattttaaaaggcaccccgccttcacccccagattcaaatttgtttcctccatgagctcctctcgtgctgcacctgcttagcaacggtgaagccagtgagctcattcaaatatttactgaccttgccgggcgcgatggctcatgcctgtaatcccagcattttgggagtccaaggcaggcagatcacaaagtcaggagttcgagacctctactcgacctggccaatatggtgaaaccccgtctctactaaaaatacaaaaattagccgggcgtggtggtgggtgtctgtagtcccagctactcaggaggctgaggcagaagaatcacttgaacctgggaggcggaggttgcagtgagccgagattgcacctctgcactccagcctgggtgacagagcaagactccatctcaaaaataaataaataaataaataaataaactgacctcctgaatcccagtgctggcttggctgctatactcttgcccttcactgaacctcagttttcctcatctgaatagttgggagactcattcctgcctttctcatgtccctggctatttggtaaaccagccagtaggaagacatcgtgaaatgtattaaagtggtcttagctagacagagtgggcatgccagggtcagcagagattctgaagtctagaccagttccctgggtgggccgttgtcagtcctagcagatggccaggtcagccctcaggctggaaattttagggcagctattggtaggtgtctcctcttgctgtgctgagatacggtcaagatcatacttaggcttttgttggaagaacatacaagacgagagaaaaaaaaagatcatacttaggggctcccggaatttgctctgccctaggttgctgagacctctagaacctgtgcaggctaaaggaactcagtcggtagatccgagagaggtggtcagggagaccaggagcatgtctacactgccagcagacttttgcctcctcccccaagccagcaggatggcccaaaaaggctcccccagcagatcatctttgcagctccttttttagctccagtg

SEQ ID NO: 100726 - DNA, 1050 bp, Homo sapiens
agcctggctggggtagggactgggtggggccccgcagggagaggcgccaggctacagacaggcagtggcgtcctggcctggcccactgctgtctgggagacagccagtaggatgggttctctggtgaagtcagccccatgtgggtgtggtcccagccgggctccaggtaggccttttaaactcccatccttccggggcagagctgagctggagctgggcttctgtcagcttgggaaagaaatcctggcttcccaaacccagctttcacagagcatttcactttccctgaaggtaagagccagtgccctgtctttaccatgaaaactcttaaacttttggtcactgtgggcacttacttacctcctatagtttctttttgggacccagatgtcctgaaagccaaaggatggaggagctggaactgctggcttctcaccattttatgtcgctgagttgttgggtggcctcaggcaagacccttcccttctctggcctgcagattcctcatttgtttgtcagcaggagggagctccttctatctctgctattaagttgaatttggttcctggaagctggtgagagagtatcgtaacacccagtttggttggcctgtgtctttcagatattaactgttacctgattagctggggtctcaagttcctatttcctgtgcttttactaaggaaattctcagacttatcaatgcaaatatggtatcaattttgttgctagaccaaatatgattttttaaaatagagatttcccactatgctacccacgttggtctcaaactcctgggcccaagcagtctgcccgccttggcctcccaaagtgctgggattacaggtgtgagctaccatgcctggccagcaaatacgatttttatgtacctctcttctcctttgcacagtcacagggtccctaagtacagagctggagtccagtccctaagggcacctactgagcatacagtaggtgatcaggaagcccacaccccagaggtcatatgtacctatagttaagagcatctctgtagagttggactgctgg

SEQ ID NO: 100727 - DNA, 2287 bp, Homo sapiens
cctgcaaaatagagatgctaataatacctgactgtagtccagcatgaggacaacagaaacttgtgcaaagcactaagcacagtgcctggtacagaggaagcatttgagaagtattagctgctgctgttactgacatccagggggaaagagaagacttgaaatagccaaaaactgtccatgtcccatgcctggaaagatgtagatggattgggtgggctgtttggagtggagtcagttatttgatggctgtttgccaagtgcagggctcttatggggaaaggtggcctgggttaggggagaggcgaatgctctgcgtgagggaaggggaagaagggcagactgtccagggttcaggaaacccaagatcaggctggagaatctatccagggctgtcagaatctgccaggtatgtggagctagagttctctctgcagggtcatcactccatctgggcagtttcctactgggggctgtgacgaggacctattattgactgcggagaataggttggatagttctagcctctcctggaactttcttgccttccccctggcgtggctgttgccctgcacagggatgcagtaataggagttgtctgcctgcctgtggagtgcagaccaaggtggggtggggaagaggggcctgtctgacatcacccagtaaaggtagggctgccaccgttgctgctgtcccagcagtttctttaaaagaggcacatgcagcagtgtgtgggaagggtggggggtggagggcagggattgggctcctccctccttcctaccccacctccacttctctttccaaacaatcagccattcatttacttgagtgccaagtgctgtgccaggagccagggagagactagggaacaagattgacttccctccagcttggagtccccacccaagcaggtaacaaataaacaggatactgtctaatctgttagtgatgagaaccctaaaggaaacaagtagatgctgagaaattggggaaggcatctcagggaaagtgactgctggatgggaaggaggcagtcaagggccgactgggaggtgtcacgaccctgaggtgggggtatcttgagggaacaggagaggtaggggttacatctggagtagtctcaaggtcaggcaggaccctgggggtctcggtgaacctaaagaggtgtgataatgaatgtactgcaagtgaatatgtttatatgtttcttcctttttttttgagatggagtcccgctctgtcacccaggctggaatgtagtgacatgatcttgactcactgtagcctcgcctgccgggttcaagtgattcccctgcctcagcctcctgagtagctgggattacaggcgcctgccaccatgcctggctaatttttgtatttttagtagagatgggattttgccatgttgaccaggctggtctcgaactcctgaccttgtgatccgcccgcctcggcctcccaaagtgctgggattacaggcgtgagccaccaagcccggctctccatacaatctcttacccaattcctgtccaagattctatgatactaacacatccattactgcctttgtacacctctgatctttattttctgtttggattatttttcttttatttatatttgctgaatttcagtaaagagattgtaggcagattattaaccagcccttgctcacaaatacagttaactcaaatcagaaaatttttaaaaatgcttagttttaaatattttatttgtgacttttaggtttggaatgagtaaaatcaaagcagtttgataactgctggggctcattcttcagtgggccgctcactagtccatttttaacactgtcttaatgaccatcttaaccttttttttgtttgttttgagacagagtctcactctgtcgcccaggctggagtgcagtggcgcagtttcggctcactgcaaccttcgcctcccgggttcaagcaattctcgtgcctcagcctcccgagtagctggattgcaggcacgcgccaccacacctggttaatttttgtatttttagtagagacagggtttcaccatgttggccaggctggtctcaaactcctgagctcaggtgatccacctgccttggcctcccaaagtgctgggattacacacgcgcccggcccttcttaaccatttttaagtgtgcagttcattggcactaagtacattcccattgttgtatagccatcatcactatccgtctctttaactcttcatcttcccaaactgaaactccgtgcctattaaacactaactccccattaccccc

SEQ ID NO: 100728 - DNA, 1001 bp, Homo sapiens
tacgctaagcacaacttttggtgcatatgtgtcacacgccccgtttgtgacaagtccgtcccagacacactaatcacttgttgaatcagtcctgggctttctcatgcaactccatatggctgccacagtgcccagtcagtggaggaggcttttcattgtcatctccacatttctatgggtttcttgaggacaaggactactcattctgggtccctagtggctggcactgtgcatggctttccctctgtaaataagcatttgctggaatggggtggagttgagacttctccctgtgtggatcaccttctgtcttcaggttccagtttgacgatatcccttgcctggaattacctatgataccctcagtattatccagagttcagtggggactgcgccctctctggtcctgtgactttcctgtaacagtgcatcctcagtgtctgtggtcagctgacgtcactaagccatttttccacatatgccgcttttcttgtgtaattgtcttacttgggttcccaaactcagggtcttaatataagctctgagggaaaaaaaatccctctgtttttctgtgtctctgtcccccgggtgtgcctggcacagagacaggcagcattacctctgctgacctgaagtgaactcacggttttccccattcagtcctgcactattcgtctcatcccaactctaggctgccgagggatcttggctcctactcctgtcacctgatatgccacctgccactccaggcccagtgaatgagcttgttaacactgcctttctattctgggattcgcttggtcattcagaatggtgaaagaggccagcaatcgaggtgcacagggcctggcagcgtctggctttgcacactggacacacagcctatgacagttggtgaaagccgggcttttgtgacctatcgccagggtttgaagtcagccctccattgacatcagccctccagaagtgagggtagtttttttgaggctctttccaagtaa

SEQ ID NO: 100729 - DNA, 1044 bp, Homo sapiens
tgcaccctctgcctcccaggttcaagtgattctcccacctcagcctcccaaatagctgggactacaggcatccaccaccacacccagctaatttttgtattttcagtagagacggggttttgctatgttggccaggctggtctcctgacctcaagtgatctgcccgcctcagcctcccaaagtgctgggattacaggcgtgagccactgtgcccagctgaaagattctttacttaatatactattgattcattaacattgaactcatggccagcagcactatgactcatgcatggatgaagcgtacctaacacttttctccataagggacatcacagccttcttgcactgagaacactgggcagtgcttcagcattatgtaggtgccattttaaacagtgaagtcaccaacagaaagcccacaaatgggaaaagtatagcactaaatagacctgcgaaaggacacttgtttacagtatgagagctgcagtgagaaggtggagtgtcaccttgttccacctcagctggggttgtgtgtagcgggcacatgtctgcgagccccttaagtgttggttttgcaagtaaattcaagtgagtaggtgattttgcacatatagaattagtaagtaggatcagctgtatatgaagtacctgctcaggcctggccatggttagcactcagtaaggtcagctgttagcatcagaatcattaccgaagggagtgcatcatagcttctgtaccaggctccaaggacagagctagctccctgagctttatggctttgtcttcatcagcctgacacctttttaacttcttggcttctgtggatgtttgggtccgaggtagatgcagatccttgaggccctgaatgcccccactgaagggtttgtttgttccaagtctacaaaccattgaatggtttcaggttgtggtgccactgaatagtttcaaacagtgacatgattggattcctcaaatggctggggtggaagagggacaagaggtcggaaggccagggggcatctgtggtagtctcagggaggc

SEQ ID NO: 100730 - DNA, 1474 bp, Homo sapiens
gctggagtgcagtggcgcaatcctggctcactgcaacctttgcctcccgggttcaagcaattctcttgcctcagcctccctagtagctggaattacaggtctacaccaccacacccggctattttttgtatttttagtagagatgggttaccctgtgttggccaggctggtctcgaactcctgacctcagatgatccacccacctcggcctctcaaaacgttggaattacaggtgtgagcctccgcgcccggccagtgttgctatttcttaaggcacagtgagggaggtggctctccgactgaaacagtgggaaaggagagggtcacatggactgtcaacagagaagtggctttgagaaggcaatgtgtccctgatcctgacctagctgcttggaattctcttcccagctgcttctgccttgggagaaagaagcagaggaaaggagggaaggatttgaggctgggtgggtgggagtctttgagctgtttttatcatagcatacagatgagttgcccaatttagctgtgtggtttgacaagttacttgctggctgggagagggagtgggatcttaaccagccctcagcccttccactaatgagccttttccctagcttggcagtaccagcaaagggagttaagggagtctgcctttctctggggtcagcttcatccattcatgggggccttgagcccggccccactgtctttgctgtaaagcctgagccatggcttccaggttgtctgtggccccagggcacctgttcctcttgaggagtgtagaccgcctctcctttgccccctcaggcacctgggagccagcaggcatgaggcccgtgttaggcctcaggaccaagttcagcctggcctccaagacacatgcagggggctagcttcttgaggttgctgtgtcctccgcatccctcgggaaatggagtcacagccactcctgagtatttgaagctctgtttggccagcttataacctttacaataaaaaacaaaatgcaggccgggcacggtggctcacgcctgtaatcccagcactttgggaggccaaggtgggcggatcacgaggtcaagagttcaagaccagcctgaccaacatggtgaaaccccatctctactaaaaaaaaaaaaaaaaaaaaatacaaaaattagccaggcatggtggtgcatgcctgtaatcccagctactcaggaggctgaggcctgggaagtggaggatgcagtgagccaagatcgcaccactgcactccagcctgggcgacagaacaagactctgtctcaaaaaaaaaaaaaatgcagaaacaaattcattctgacctgataaatacagtttggaggataaaatcttggggtagaagacagaaataatgagataaaggaagcttctctagaagaagcaaggacttaggtgctgcgaggtagggaggctgggctagatacctggggctgggagcaggctgcacgga

SEQ ID NO: 100731 - DNA, 1018 bp, Homo sapiens
ctcacacctataatcccagcattttgggagactgaggcaggaggatcccttgagtccaggagttcgagactaacctggcaacatagtgagacctcatctctaccaaaagtaaaaaagtggttttttttttttgttcggtttttttttttttttttttttttttgagacggaatttcgctcttattgcctaggctggagtgcagtggcgtaatcttggctcactgcaacctccgcctcccaagtttaagcaattctcctgcctcagcctcctgatagctaggattacaggcgtgtaccaccatgcccagctgcatgttttatttttataagaaaatgccaatgtattttccatgacagtagtatcactttttctccacattctcaatagcatttgatgttgtcactttttagccattctgataggttatgtgatggtatctcatagtggcagatggatggtttctacagtcctttgtccacagctcctgtgatactgggccttgttttgtgagttgcctctgggctatcaccatcaccatgattgtagccccttgaaggcacagtttatctggctcatgggcccagaccagggtaggggcttgtttcagtcctcacagggcaacaggcagttggagttaaggtgctgagaaaggcactagatccaacgtcaccctcccagcaaacagctactgttggaaaagcactttctattgccaacagagttctcatcgtctgagaagcaagcagtgggcctttggtgttctgggctcctgctgtgggtcagcccctggctggggtcagggtgagattcagagatggttcaggttcctacccatggcaggtcctggctctgggaatctcagtggagaaagtggagaacagggagttggaccagtggagaacagggaggcagaccactgtacgggtttcacataacgagaaagtgttggggtgggaatggcaagatagggaaaggggttagctggaccctgaaggatgtgtgtttttttgtttgttc

SEQ ID NO: 100732 - DNA, 1115 bp, Homo sapiens
ctcaagactttgtctcgaatgagggtgggtagggcctgtgtgtgtctgtcttggtcattgcagtcttgaccctcgttctccctgctccagaaatccttgcggacggaatggctaagcccagagctagggccaagtcaggcagggcttctgcattggaaggggcttgagagggttgggggcttcaccatctcacctctcccctgcccttctctcatccatctgcaggttcatcatgcctagtggcgtataagaagaccccgccaccggtccctccacgcaccacttcaaagccgttcatctcagtcacagtccagagcagtactgagtctgcccaggacacctacctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaaacatgcagctctgaaaagtgaacaagggacgctgaccagctctgagtcccaccccgaggccgcccccaaaaggaaactgtcatcgataggaatacaagtaggggctccttttgcactctgtgtcctcagcccactccgtgcacctgcctgtgtgtaattacatctggtagaggcccactaggtctcctgggaaaaggtggtttgtctctctattttgggggatcagccccaagtggccaaaccgaattccacccatagccacgcctcgctggtatctgtccacacgtgctgctggtcagcagctgtgggcatgtgtttctgctcctccagtgggttgtcccagtgaatgtagttacactcagccagccatctcctgtccactgtttgcctgtccactgtctgtctgtccactccaccctttgccctgccagctgacccgtgggaggcgggactggcctaacagttctctaatccaaggtcagctcgggtgcggaggccatagccccgcttggcggcaggagcagcatggagcatagacgctgttgggccaggggcccaggacccagggcccttgagccatgggggttgctcgaggggaactttgcccagagccctctcgggcctt

SEQ ID NO: 100733 - DNA, 2376 bp, Homo sapiens
aggtaacctcagccaagtgtgaataacgtccagggacttcggtggctcctgtgggtggcagtttctgaatctagaactgccgtccagggtttgcccttagtgcaggcgcctctggcctgccctccaggtttctgccacagggttcagggagtgatctttgcctcaagacagccgccagcttcaactacaccagataacggctgtggctttgtgtgtgtgtgtgtgttttctttctctttcgtcgtccttttttttttttctctctgatgcgtgtgaaggagaggactagaaggaacggttcccacctctcggaggacaacggacccaaagcgatcgatgtgatggcaccctcctcagagtagggaaagccagtcatctccaccccatcccacctcccgcccacctgcccgcccgcccgcctgcccgcctccacgcgaatgagcagtgcccggcttaacctggtccggcctcgggcccacgtgcagtgtccgcatgcctcgtgtctgtctgtccacacgtccgtttgcgtcgtcccactaatgtgaatttcagcagcaagtgtggtgtttgttttttatttttgtctttgtctccgtgccgttgctgtcgttgtccttcaataaggttgactgcattcagccagtgccaaaagaggagcccagtcccgctaccaaattccagtccatcggggttcaggtagaggacgactggcggtaagtcggacagaggtggcggctgcttctcccctctcctctccctccctccgctctcacctctcctgctctccctaacccacttctccttgctggatttctaataaccaagctgggtttgggttgcgggtggtggcccaggcatgggaggctgggcaggggcgggcgggtggacagatgagcatttgctctgtgagaccagtcacccacgggggccatggctgggccaggacatggcgtcagctgccctgatgctggtggtcttcctggccccactgcagtaaacaggcaaccttatgaccttgtcctcgtgtgtgtgtgcgtgtgggcttgggcgggatggggcaagggctgagccaagaatgagatgggggctgtgggacccgcttcaggcgcatggtgagcagatgatgcatccgtttctctgtctcccgtgtgtccgggtcaaggcggcctctggtctctggccctcttggtgactcactccttcctgtccccaccccatccaccccctacccacagaagcagcgtcccctctcacagtatgtcctcccgacgggacacagactcggatacccaggatgccaatgactcaagctgtaagtcatctgagaggagcctcccggactgtacccctcaccccaactccatcagcatcgatgccggtccccggcaggcccccaagattgcccagatcaagcgcaacctctcctatggagacaacagcgaccctgccctagaggcgtcctcgctgcccccacccgacccctggctcgagacctcctccagctccccagcagagccggcacagccaggggcctgccgccgagacggctactggttcctaaagctactgcaggcagaaacagagcggctggaaggctggtgctgccagatggacaaggagaccaaagagaacaacctctctgaagaaggtgggtgccacatggatggtccttgggcaagggtagaaggtgttggcagctggtttcagctggtggccagcagcttccgaacttctgagtgggggtctcttaggttctcttcttgggctagtttttgagctcccttcttactttcttcgcattcttccatccatccacctatttaaccaaacctctttccagaaagggttgctggtgatagctgtttgttgtgcaggctgtgaggccacccacacctgggtttgaatcccagctcctcccttactagtgaagtaaccttggtcaggttactccgagcccccatttcctcatctgtaaaatggagctaatcctctgctcactatatgagcatgttgtaaggattgaatgtggtcgtgcatgtgaagggcctgatgacctgtcagacacagagaaaagtgggagcctaattatgccttcaacaacttttttttttttttttttgagacggagtcttgctccatcacccaggctggagtgcagtggctcgatatcagctcactgtaaacctctgcctcccaagttcaagcaattctcctgcctcagcctcctgagtagctgggactacaggcacgtgccaccacacctggctgatttttgtatttttagtagagacggggtttcaccatgttggccaggctggtctcgaactcctgacctcaggtgatccacctgcctctgcctcccagagtgctgggatt

SEQ ID NO: 100734 - DNA, 1036 bp, Homo sapiens
cctgtgggtcaaggtagcccccaggccagttctgaagccagtgaggctggactggtcctgacctcttcccgcctgtgtgcgaagctcttccgtcttccgtctcggggtgaaggtggggtgaactgtgacagaatcgcacgctggggcttgacatctagatgacgcgtccttgcctccttccagaaatgcctttggtgctgcagtggctctgctgagaggaccttatgaccctggtgtcgggcatgtgtggccagtaccctgggacactctgagacccccctcccacacccttggggctggcagcatcgaatgggtggccagactgagagttgcccagggccgtgtgtgtagctggaggcctgcagcctgctgccgggggtgagaatgtgtttgggactgagtttgggatactatttgggcctggtttggaacttgttcgggtctcgccccttctggagttgataccagggacttttgggcctctgtttggagccaggatgaggagtttcagccgagctctgagcagggcctggcgttgaggcctgcaggaggttagggcctcctggtcaggcacagggtcccctggtgctcagctcccccttggccctgatctgggacctttgctgagtgctgcggctgcctgcgctgggtgacctctggagaaggcctcaggaccaagctgggtccactcgctggggtcaggtggggtgggtccggccctcactcttccctaggcctattgggtgacccaggcagtccatgcccctctggactctctgctcagtcattcagcgctctttctgcccctcttaggccccaggcactgccatcagtgtccccatcatccaccagtagcaggggtcccggccctgcctgccctgcgtacacagggacatggaaagctgtggcccccatgctgttggtcctggggctgaactcgccctccacctgcctggggctgggaaacccctcattcccacctccaaccctgagctgctgggacgcctgcctcatcactgttggagcctccctgttc

SEQ ID NO: 100735 - DNA, 1034 bp, Homo sapiens
aaaagccacgtctgggttgccttaggtaagaaatgtaaaaccaatgggccttggcctctaggaaatgtatgggacagggaccttcagaagaggggagccccagggggaaatgggtgcgaccaggtgagcctggagagggggctctggtagtggctgctgagcttgaactccgcactaggcgtttttctcctgtatgcgtaagagccacattctgccctttctggggaagccactgggggcctgggctagaggaagagaccgcaccgtaaattgtgcctgcagcagccccttagacgagtgtttcccaagtctggtgctagatgtggttgggaaaatggaagcgggggagtgctgcctcctcctccacctgagagctgcataacaaagacctggagcccctcctctctcctggaggacggggtagtggtggagggaggctggtagccggtcagattttgcacgtaagcaagcttcacagataaagcctaagtgcaattagagtttgagaattaccgtgtcaagtttctgaactagtaagtatcagaatttaaaatgtgtagattctctaagacagtaattccacttctaggaatctgtcttttgaagtagctgtacaacaaagataaatgcttatagaagattgttctttgcagaactgttcattcgggaaaattgcaaacaactaaatacccctcaccaggagctggcccattatagcaactctgagacctctctaccgcaggctcttaaaatggggtaagttggtgcgcgctaatgtaggggcatgaccaaggtatatttattgacagcttacagtgtcccaacaaggagggactttggacatagttggtgagaactttagtgggaaaactttttccaagtgataagttattgtcatttttctctcccctactttcttttttctttttttttttttttttgagacagagtctcgttctgtcgcccaggctggagtgcagtgatgcgatctcagctcactgcaacctccacctcccagctgcaagcgattctcc

SEQ ID NO: 100736 - DNA, 1120 bp, Homo sapiens
taaagaaaacatttttcggccgggaatggtggctcatgcctgtaatcccaatactttgcgaggccgatgcgggcggatcacctgaggtcaggagttcaagaccagcctgaccaacatggtgaaaccccatctctcctaaaaatacaaagttagccagacgtggtggctcatgcctgtactctcagctactcaggaggctgaggcaggagaatcacttttgaacccgggaggcggaggttgcggtgagccaagatcatgccattacactccacctgggccacaagagcgaaactcggtctcaaaaaataaaaaaataaagaaaacatttttcatggacccatctccccgcaagatgttaacctgaatcatttttatcatatcacttaggtaaaacataaaactgggtatatatataaaaaaaaaaccacttctttttgcttttgttcttatacctaaccttaaaatcaaactgtttccaaagtagataaatgtaaaaaccgtgacattccacctgactgtgttaactgaaaatggtgggtggtgctttgctgactgcactgcaggatgtggtgtggcaaaggcacagactcagcagagtagatctggatggtcttaggccccgatgctcctactggtgatgaaaatggaaacccaaagccaaacatccttctagagaactggcgaacccctcaaggtgacacatccacaggtcccacctggagaaatgtaaatgtaaggaaaggaaactgggcatcccctggagggaggggacccgtggtggccacctgctctagagtcatgccgagagttaagagcagtggggaccacccagccctccttgatggaaactgaccatgaatcccatgtcagccccagctgcacacctgtctggtaactcctcccagttagttcattgccctcagctcatttggtcaattaccagctcctgtacaaataccccttaaatatttcagggttttggcttctttcctaccctcatctaaaccatcattatctgatcacaatcatttatcactccccaacttaaaacccttcaggccaggcatggtggttcgtgcctgtaattccagcactttgggaggctgaggcaggcagttcg

SEQ ID NO: 100737 - DNA, 1120 bp, Homo sapiens; identical to SEQ ID NO: 100736

SEQ ID NO: 100738 - DNA, 1120 bp, Homo sapiens; identical to SEQ ID NO: 100736

SEQ ID NO: 100739 - DNA, 1120 bp, Homo sapiens; identical to SEQ ID NO: 100736

SEQ ID NO: 100740 - DNA, 1030 bp, Homo sapiens
agaaggacctagagtgtgaaatttcagtcaagccaccgtttagaccacttaatggttttccatggtgctctggcctggttgtcagccctgtccacctctgagctcatcagctaccattcaccggttccttaagccaaccctttcctgcctcagttcagttgcattggaggaccatagaggtgaaggagggcagatgagaaccccacggccagggcctttccttggaattgtctagaacattcttagctttctgtatggctagctcttctaatccttatgtctcagccttccagaacccttagctatgggagtttctcttatctttataatgccccctttattcttgtttctgttgggggcttgttggtggttattcacctaatggttaatagtcagtctccatgactaggtgcactataagctccacagggtggagtgcatgtctgtttaattcacaaaggcatcccagcactgagaactgggcccaatataccaggcactcaaataatatttgaatgagcaagaagccttgaagagcagcaggaaggtgagaagctctaacttgacttttttttttttttttaagacggagtctcactctgttacccacgctggagtgcaatggcgtggtcatggctcactgcaacctctgcctcccgggttcaagcagttctcctgcctcagccccccaagtagctgggactacaggcgcgtgccaccacacccggctaatttttgtatttttagtagagacggggtttcactatgttggccaggctggtctcaaactcctgacctcgtgatctgcccacctcggcctcccaaaatgctgggattacaggcgtgagccaccacgctcgaccgactttttttttctttgagacaaggtctcacgctgtcacccaggctggagtacagtggcacagtcacagctcactgcagcctcaaactcctgggctcaattgatcctatcacctcagcctcgcaagtagccgagactacagacacgcaccaccatacccagctaatt

SEQ ID NO: 100741 - DNA, 1006 bp, Homo sapiens
tacagagcaggcgccgcgaagggaggggcggtgcagtgtcgcgcgccctcccgccgacgtgctcacgcagccaatcggcgaccgcgaagccatccgagtgaaacagcgaccggcgccttggcgcaagcgcgctactcgtggcggaaatgacgtcagcatccgccgggctcgcggtaaggtgtgaggggagggacaatcttggtagaacggtgacatgggcgccaggaggcgctgtggagaccgaggaggtaggggaaaaccgaggctggacgtcagcgtcgcccagtcggccacagctgcccctcgagcagcgagtggggcaggagcggctctacctttccttgcgacctactcgcctgctgagcccagaccttgctccagggtagctccaagctgccccacaggatttagcccgcttattttctcccctaaccctgcaagttctgtagggccttgttgaagatgttaactcttctgtaataactaaccatttcatcttgcccagcaccctcttttggcacacgagagccctgagaccccaaaagaggaaatgagattctgaggccgtatagcaaggtggacccaaccggggactcctgggcggcaaatacaaggattgggttaggtatcaggatatctgagtgttcacatacagcgtcctcaccatgtgctgcgtcagtggttcacaaagtgagcttccggatcagcagcggccgtatcgcctgggaactgggtagaggcgcaggttctcggcccccattccacgcctactgactcagaacccctggggatggggctccttccggtggccctccaggtggtgccaggctcactgtgctggtaagtccagagaccaaggcacatcccttctggacagtggatttttttttttttttttttttgagacggcacggtctctgctcactgcaacctccacctcccgggttcaagcgattctcgtgcctcagcctcccacgtagctgggatcacaggcgcccactaccac

SEQ ID NO: 100742 - DNA, 1037 bp, Homo sapiens
ggcactgggcggacagctgggcttggagctccccgaagggtggcctaaggatgaagccccctagttatgcggaattggcgaggagcggggagaggcgttgtcattcgcgggcagggtttgtgcctgaactgggaaagggagctgaattcgattcggcctccgccttttatgtgcagtagggttttgagtaggttacttgtttctttcgaattaagtagcacaaacattaacagtaacagacttctgctgagaatgctttctacgtgccaggtgctctgcaagcggaatctcgtttaactcagaataactctgaagtggggtactgtggtacattaaagccttttgcacatagtgaggctcgctaatcttgagctgctgttgcttgttgaatgtaaaggaccgaatactttgataagcatgagtcaagaggggagactgagaccacccgctgggtgagtgtgaggtgtgggggtggagaaacgccaccagatatgtgcgagaattggttgggacttcagaacgttcttactcgtcccattcggaggatgcttcgtaactctgctccatgatctggaaggggccatcacaaacagcttgattccaggtagcttgaaaagcgtattatatttgcagtcatttcttggttttctgggctgccgaagtggattttccttcctgaagttcctgtaaagggggatgggaggcacttcctgaaggtgcccttgttctgcccccagccctgcccagctcttgcaaaacctgcagtctctaatctgctgtgtcatttctttcttttcttgtataaggactggtttctggaatctagggcagatcagaaacctgagtcgtctgtgttcttccattaaacttaaatatagtggcacctgcctccagcatttatggttctaatccgtatgtgcggccagtagcacaattattatcacagtcatttcattacaggccatattatatatgcacctctagaattttgatttagagcacagattctggaagtgatcgcttaatgatgtctaaat

SEQ ID NO: 100743 - DNA, 1084 bp, Homo sapiens
ttatcagccattctgttacttcaaggggctttggagaactatattacacacacacacacacacacacacacacacacacacacgcacacacgcacacacgcacacacgcacacacacacacacacacacacacacacacacacactatatatagagtttcgctgttgcccaggctgtagtgcagtggaacaatttcggctcactgcaacctctccgcctctgggttcaagcagttctcctgcctccacctcctgagcagctgggattacaggcgcccaccacaatgccctgctagtttttgtatttttagtggagatggggtttcaccatgttggctaggctggtcttgaactcctgaccgcaagtgatccgcccacctcagcctcccaaagtgctgggattacaggtgtgagccaccacacccggccccgagttctgagtcttctaagctttcaatttatgtttggtacttgttctctgttgctccagattctgcctgatcaatgcaggagtcctgtacctctacttcagcaattacctacagattgatgaggaagaatatggtggcacgtgggagctcacgaaggaagggtttatgacctcttttgccttgttcatggtatgtgtagctgatagttttacaacaggtactgttcatttcatgaggtgtcactcacaggaggggaccccactgattgagttacactgtgtgagcagggtgctatttttctaaaggcttctgaggctcagggccatggcctgtgttgagccacatcccagaagatgtggtctgatatactgtacagtcccctgtaatgtgtaaatccagggcccatcgtcagcttctacatctgattctcaagcctggctagatattagaaactaggagggctgagcatggtggctcacgcctgtaatcccagcattttgggagggcaaggcaggaggatcacctgaggtcaggagttcaagaccagcctggccagcgtggtgaaatcccatctctactaaaaatacaaaaaattagttgggtgtagtggcgggcgcctgtaatcccagctactccggaggccgaggcatgaga

SEQ ID NO: 100744 - DNA, 1121 bp, Homo sapiens
tcatctggcatttttgttttgtggaatcggcctgtgttaagccaggtgacctatgaacagtgcttgtctcctcactaggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgtagagtttttaaactatcaatggcatttcaagtcttctgaaacagcatggctgtatgtgcgtggtccatagcacagtacatgcagcatctaataagagtttccattgtagaatgttttcacatacttgaataaatcaaatctttaattgagaacctgttgatgatacctgataaagcctttcccaccccacctgtagcttgggaaccagtaggagcactggagggggtgcctcccaccccatccctctttcttcctctccctgatcccttagcggatccagcagacctctttctgtttatggaggcagcagggaaatcaagggctggatttggtgtaggctgtggtctccgtcttggcattgtggagagagggcttagcaccttctgatgcccctgcccagcactgaggtgcctggcctcactgcagtgtgctagacttaagaggtgttattttttattcggccacaagatggcaaggccagtgtgctagggaatggtaagccacaaaatgaaatagagatctgagagctaggctgggtgccgtggctcacacctgtaatcccagcactttgggaggccaaggtgggtggatcacctgaggtcaggagttcgacaccagcctggccaatgtggtgaaaccccatgtct

SEQ ID NO: 100745 - DNA, 1372 bp, Homo sapiens
cgttgtatcgggcttgcactgtgtttgtgaaacaccttcatacttgtgtgtgtgtctttcttttcttttggtttagtcttgcatgcactgtaggttttggttacctgtttgggttcccaaagcctccattctgtcactgtctgaatggtgtgggcatagttaagaggctatactctggatttagggtttccccttgttctgcggtgactacaatcagctgagattccaaccagatctaaaggattaaagtggcctcacatatcgccactcacctagagcaaatgatacaaaatggggatggctatatcttgtcctgggtgtcatggtaaatgagtcggaaaagctaaacataaagactttgatgagactcctaggttagctgggcttaaccggggcttcatcttctagtccccttggttctctgttacagtaccatctgccagcatgactcggctcgcccgatcacgaacccactcaacctcgagtagcctcggctctggagaaagtcccttcagccggtctgtcaccagcaatcagtcagatggaactcaagaatcctgtgagtcccctgatgtcctggacagacaccagaccatggaggtgtcctgctaagcagatgctcctcccctggaccattgcaagtccatccttcaaatgaccactccataatataacatttcatccagtaaactggcctctactatctttaactcatgcatggccactgaacctctctctagtagcctggatttatcattctctctgcctgcccacccccttttttgtatagcccaagaaccacttccatgccatactgtaacattccaacatctttagctgatcagatctctccatatcctctcttgccagctttttcccgtgctcccccaactatgtatcagataagattctttgatcccgactctgtgtgtgcgagcacgcgtgtctgtgtttgtgtgtgcatagttctgtggttttagacacgctttcttgtagtgcttctgcaaaaaacaaaaaagggacttattttgcattctcaatggtgtttttaagggaattaggcagaacagatttctaggttgggtaggccactgcattctcttttgtttgcaaattggtcaacaaaatttgcaaagtgatttcaggagagagcagctttgaggaatgtggaaaatcataattgccgtctggaccattgattgattgtgaccagtagcagaagggtgcctgttacatagagaggctccttctgtccaaatgaatttctgtatactcttctataaataaaagggaggaatatattctgctggaagcccatgaaccatcgctgaggttctgatacaacatagagttttttccaaggagtgaatgt

SEQ ID NO: 100746 - DNA, 1038 bp, Homo sapiens
tacctgccaggcagaccatgtatgtcttgtctcaagtggctgtgtcatccttgcctgtgagccgctaccaaccgagcccacacccacagccctgtggctcactgggaggagcaggaggccctctcctagtccattcttatccttttcctatgaaatagctgatcttccagcccacttctgatccaaagcaagatgactgtttatagcagaggggaaaacaattgcctttgtctagttgaggaaagtaacatttgagatgttattgaagtatctgtcagcctcacctcctctctgggaccttaaaataaaattttatccctggcttagagtattctgtcagtgtctaccaggcagctgaggttgccacttggcactctggggtcactaacctgccttttcctgtgtccatcctgcttccagtcccgtatgtgcagctcagtcacctgagcaccgagtcaggtaccttcctctgtgctggccctgccccgccttccagtctctcctggctgcactggctgcctgcagcatgtccgcggtcttcctatgcagtgagagcccgatagaacgtggctcagtacgccccaagagatttagcctacaggtccagccctggtcccccaggaggaggaaaggatctggttgtaaggggcaggcctcctcttgtcatcctaaatccagggtcacagcagcagctgaaacttgataggcagggcccatcttccaccaccacctactgatccttgaattaacctccagacacaggaatccaagggcagccttggctctaaataggagggtcagagcctgtgcccagagaactctgcagatgatagcaccttttgaccccagcattgaaatgacagctaggggagtggctgctgcccaggacgataggcagggaggctatgccaggtaaggcccagtcccagccaagctggaaggaccttagagtcaagcagtggcagaacaggagtctgagttaaacacctgcttctctgtccctggcaacctgtacctcatccctgtgttgaggtcagc

SEQ ID NO: 100747 - DNA, 1001 bp, Homo sapiens
caaaaaaatacattaattaaacacttaggacttgagagtttcagtggtgttgctgttgggtgttgaggctgtctccttgtagcatcccaaagagtccttcagggttgagccaagagcttccttcctgctccataccacccaggatgccactgaaatggcgactcaagaaccaagtcatagggcctcttcccttctcaggtgtgaaggaaagatagtttcgcattccttgataaattttggtgtttatgaccagaaaataacctgagttgctatgactttacccaaaaagggcattgcttctgctttgtttttctagacgcagagacctggagatcgaaagacccatactgggccaaaatgataacaaatcaaaaacattaaagtaagttcctcagtttcctcagctgacttgccaaatatagactaatttggtgttcatagactttcatagactaatttggtgttcagtggaatttatgtgcctatttgctgagtgacacctcttactttgcctacctaggtgttctactttactggtggtaggggacaattcgcctgcagttgaggctgtggtaagtatgtcctcatgctgtgaagatgaatgagatcaaaatgtaataaaatgtgtaggccaggtgcagtggctcacgcctgtattcccaacactttgagaggctgaggcaggaggatcgcttgagcccaggagtttgagaccagcctgggcaacacagtgggaccctaactctacaatatatatttttttaattagctggcatggtgacagcctgtagtcccagctactctggaggctgaggtaggaggattgcttgagctcaggaggtcaaggctgcagtgagccatgattgtgccactgcactccagcctaggtgacagagtgagaccgtgcctcaaaaaaaaagtatgtaacacactgctgacacactagaaacagtcggtaaatactagtttttgttctttctgattgcacatatcagggtttg

SEQ ID NO: 100748 - DNA, 1033 bp, Homo sapiens
aagctccctcccctacccagcaattatgaacacgataactgccactttctgtgaagacttgtttcctcaccagttgaaaaacatggggcttgaacaagataatctctaagcttcttttagcactattatttcaaggtttttccccctgaaatttctatttctgtgaagcctttcccagacctcctaatggctctaaagatgtttggggaggcacgtgatgtcaaacattaacagatggcattctacttacaggaacaggtagcaggagatgctgtcttctctcatagctccacatgtcaacagctatgtggcaatgagttaaagattcacctttgcagggccacatgcctttcagactacattggaactgttacttgctaggatcaggtaaattctaaggcagcccttctttcctaaggtaaaataagaatttgcatgcaagccaataaacacagctcttctgggtggaacaggtacttacctgcccaaagtgatgagccaaaataatgtccacaacattggttgtcaggccagagagctgaaaagataaaaactctgtgttaagaatgtaagcatatgcaaaaatttatcaagctgcccaattaaaatgagtgcactttattatatatgttatctctttaaaaacaaatgaaaaacccttggccaggtgcgatggctcacgcctataatcccaggactttgggaggctgaggcgggcagatcatgaggtcaggagattgagaccatcctggctaacacggtgaaaccctgtctctactaaaaatacaaaaaattagccaggtgtggtggcaggtacctgtagtccctgctactcgggaggttgaggcaggagaatggcatgaacctgggagacagagcttgcagtgagccgagattgcgccactgcactccagcctgggcgacacagtgagactccgtctcaaaaaaaaaaaaaaaaaaccccacaattcagtgttatacatttcatgagatggtggtttcaaagaaacatagagatgagaaacaagtcaga

SEQ ID NO: 100749 - DNA, 1033 bp, Homo sapiens; identical to SEQ ID NO: 100748

SEQ ID NO: 100750 - DNA, 1033 bp, Homo sapiens; identical to SEQ ID NO: 100748

SEQ ID NO: 100751 - DNA, 1010 bp, Homo sapiens
caggcgcacaccaccacgcctggctaatttgtatatttttagtagagacagggtttcaccatgttggtcagcctggtctcaaactcctgacctcaggtgatccgctggcctcggcctcccacagtgctgggattacaggcatgagccaccacgcccagcctacttttctatagttcataacctgtgcatcactgataacctatgtgaagatttcaggacttctttcttcctcagtctttctggaactatatgatcctactccaggcatagccatgtctgtctccctcagtgcctcttctccattcttacccccaattcagtacttcatccctgatcagcagtacaggttcagcataaaaccaaggaagaaggccgaacaggaatcagcaacataatttgagttggaaatttttctgaaaatagactacagtatgcagatttacacagattgctgcatttattagactgtgagatgcatcattttgaaaagggaaaaattaggagaaaaatgtttaaaactcaagaacattctgtaaacaactcatttcctcccactccctgaaatgaagatagcaaaaactggaagaaagaggaaaaaaattgtttttgtctcttggaagtcatgggagtgattgttaagttagtccttatcagccataaatccagtgtaaatacagaaatacagacaggaataaagtagcaaacagccgtgaggtctaggtctcaggctttcaaagaaggaattgacattgtccttccagtcccctatttcatagcaggctttattattaccctgcaaaggagacttagtttttctgacttgtttctcatctctatgtttctttgaaaccaccatctcatgaaatgtataacactgaattgtggggttttttttttttttttttgagacggagtctcactgtgtcgcccaggctggagtgcagtggcgcaatctcggctcactgcaagctctgtctcccaggttcatgccattctcctgcctcaacctc

SEQ ID NO: 100752 - DNA, 1054 bp, Homo sapiens
ctgttttttttttttaaatatgtttcaggttagaaaattcagagttggaacttaactttgttgtgagctcttcaatgaattagtaagaattcttgctagagcctgtcaccagtgactttaagtggacttttctagatggtagtgtaagattctggccccagccatagacacacagagtctgcatacatgtgttttctttcatgctgctctggctttcatagatgccctgcatttgaggccacagttgagtgttaaagcttttgtagctgccttggcatgagaagtgatttaagcaggtatacaaagagggtagaagtggaagcagcagcccctcccttcactctggcaattttgccaagagacaaactcccgtgtggtgaatgtgaacagctcaggacattcacgccacctgtgctcttggggtataatcagtgtctgtttgtgagatagaggaataatgtccatgagaaatgacagcattatgggtgtaagattattttgtgcaataatcggaaaccaccaaatattaacaaagtaatttctactttgcagacattatttagaattaagaattgttttcaatatgtatctcaatatgagatgtcttatattcagcctttagggcagcttgaatcagacagattgttcagacacctcactttggtggaatggtggttaaaaagcagggaaagaaggtgataataggcattgactgagtagaggaaaattggggcgatatggagagcctgtgacttatgggtatttttattcttatagataaatcctgtttcaatgcattctttaactttgaggatatgcaagagatcacccagcactttgctgtctgtcatgtggatgccccaggccagcaggaaggtgcaccctctttcccaacagggtaaggccacgaaaagatcatctgggagacgtgcactcagtagagcaactggctgagctccagtgggagaagtggtgtgtgcttccctttgattttattaccgtctataggttatgcttattgaccaaccatcctcatattttctctccttgggct

SEQ ID NO: 100753 - DNA, 1039 bp, Homo sapiens
gaggcggaggtgggtggatcatgaggtcaggagatcgagaccatcctggctaacacagtgaaaccccgtctctactaaaaatacaaaaaattagctgggcgtggtggcaggtgcctgtagtcccagctacttgggaggctgagccaggagaatggcgtgaacccaggaggcggagcttgcagtgagccgagatcgcgccactgcactccagcctgggtgacggagcgagactctgtctcaaaaaaaaaaaaaaaaaaaaatctcttagttccaagggaaaggtgctgacccagcctgggccagatgcctccctgactccagtaagctatggccgtaagtttatgttccacaaacatggtagccaagatccacccctgtaacgtgtggatgacacagaaggacagctcccaggaaagaagggatcctaggcagatacacccataggtgtctggtgaaattatctactgaaattaattataaattatctgaacatgtgttcagaagctccaaaacctctgattttttacccagcaacttcttcatatcttccatttccttttttccccacaagtcttacctggctccttacccaatttgctgatttcctttccatagccaattgcaaatgtattctcaacagatccctgggctcgtaagtgagctttggagataacaaggtgtgttttgctccctatttatttttctggaagaattggaaagtaggaatattatgtatactctagcatctctctggtatgcatttattttattttattttattttttgagacgaagtcttgctctgtcaccaggctagaatgcagtagcacgatctcagctcactgtaatctctgcctcccaggttcaagtgattctccagccttagcctcctgagtagctgggattatgtgcgtgtgccaccatgcctggctgattttttatttttagtaaagacagggtttcatcatgttggccaggctgatcctcaaagtcctgacctcaagtgatccgaccacctaggcctcccaaagtgctgggat

SEQ ID NO: 100754 - DNA, 1049 bp, Homo sapiens
cactttcctgcaatattgagtatttgcagcctatccccatggcttcttgcatggtgagatagaagaagaatttgtagttcattaccctgcctacctctctccaacttgtctcctctctctgagctccccattctgctctccctatgtattagttctctattgctatagatcactctaaaacaaaattattatctctcatggtttctgtgggtcagaaacttgggagcaggcttggtagggtggttctgacttagagtctctcatgtggttgcagtcaggtgtccctggggctgtagctatccgaactcttgactggggctggaggattcatttgcaaggtaactcacacacatggctagcaggttggtgctggcaagttggttcctctccacatgggcctcgccagagggctgtttgagtgtcctgatgatttggcagctagcttcccctagaactagtagtttatagtgtcttgaagcacaaagtgtaatgcgttttatgatgcagcttcagaagtcacatattgttgcttcctccatattctattagttacacgagccatccctgatttatttgggtgggcgattatacatatgtgtgaatgaatatcaggagtcagggatcactgggctcgttgaaggccatcttggagctgactaccatacctttcacccactgctgtgattccccaaatgaggattagtaagcttagccttggttccctcctctttcattcccactgccattcctaattcaagtcctcatcctgcagtaataatcttcaatttttgtccccgcttaatccgtcttccagtctgttccaagcatagttttgagtatgttgtttctttatccgtcttcagtaactaaaacgtgtgctccatgagagcaaagactattgtattaattgtattaatctgttgctgcataaaaatattaccgcaaatgtagtagcctaaaacaacacatattcattgtctctcagtttctgtggttcaggagtctggtgtgggctgtgtaggtcctctgcaacatggcgatcaaggtgt

SEQ ID NO: 100755 - DNA, 1311 bp, Homo sapiens
tgatttttaaaaattcatttaccaaagaaagccctgaaacctggtaaatatccataatcaagctagctaagtttttgtgtgctattttcaagcactattaagaaagaaaggtggcggggggcaccttgagaattgaacttgtccaaggtcgcagaactggctacaacttgaaattccagactttttagccactaaaggtttatcagtatttcttctcagtgaattcatccttaaagacattaactagcaactctattatgattctatttatgtgcttagaacaggggtgggagaagacatacaaaaacatgattcatgtcttcaaggaggttatggtctgttggggaagagtaaagcactgttctctaatgttgaagtcagcgtatatataattgttaaattatatggtagggggactagctgtatcatgggagctggggaaagggggcaagaaggatcagtatgagatgtggtggtgagaccactttgggttttgactttctgggctttgacaggtggatagggtcagaattaatcaaaaggacaggaaaacattttgaatcggggctgataaaacagacaagatagcagtgcctgccatgtttaacggacagtaaaaaaattggcttggctggcttagagcagtggttctcaatctttagtgtgcaccagcattaccttgagagcttattaaaacccatattcctgggctcgaccttcagagtttctgattcattagttctggagtggaatccgagaatttgcagttctaacaagttcccagatgatgctgatgctgctggtctaaggatcacactttgagaaccacttgattagaaggttgagcagctagagtcagaaactgtcaaataacttgtttcaaaaaagtgcgtgtgagtcaggtgtgggggtatactgacataggagagttctggaaagatatataccaagctctaatggtcctcacttctgggagtaagatttagaggcttggggaatttacttttttacctttctatattatttttgcattgtgcacataatgcttttgtgttttaaaaatgaaagaaaaataagaatcttttttgaagatatatagtaaaatatttatggattaaaaaaagagcttgctaaagtaatctagtgtcatccaacaaacatttttagagtgtctgctatatgccagatgctgctagcttctggaaatacaaagcctttgctaaagcttgcaggctggtgatggtgattgagatgggcagatagcagctttacttggtatcacgtaagcttcctaagagcagggaccagggt

SEQ ID NO: 100756 - DNA, 1068 bp, Homo sapiens
tcaggttttgaaacaatccaaaaatcatttaggaccaagtctaaggaaacattttagtggccaagttggattccgattgtaaaggaatgatactaattttctagcatggctctgaaggtgattttaggtagaagagttttgaggctgggcgcaatggctcacgcctgtaatcctagcattttgggtgactgaggcgggtggattgcttgagcccagaagttgaagaccagcctgagaaataaggtgaaaccctgtctacaaaaaatacaaaaagttagctgggtgtggtggcgtgtgcctgtagtgctagctactcagaaggctgaggtgggaggattgtttgagcccaggaggttgaggctgcagtgagttctaattgcgccactgcactccagcctgagcgacagagtgagacactgtcttaaaaaaaattaaaaattgtaaaaaaatgaaaaaaaaagttttgagcattatttgcatcattgggatacatatgtcacttcacaagatgttcaatttgaaggaaataccactcattctctatgtcctgttgtctgtagtgtgcttcagtttttcatattgagttgacctaaatcctggattcatgacaagaaaggagtaagtactactattcattgttctatttgtttataatctgtattataaaattgcacataattaaaagctttcccttgtcttcatctatgttttgagtgtataaacaaaaagggagtgccgggtgcggtggctcacacctataatcccagcactttgggaggccaaggcgggcagattgcctgagctcaggagttcacgaccagcttgggaaacatggtgaaaccctgtctctactaaaaatacaaaaaattagccgggcgtggcggtgtgcacttgtagttccagataggagggtgaggcaggagaattgcttgaacccgggaggcggaggttgcagtgagccgagatcgtgcccttgtactccagcctgggcgacagagtgagactgtctcaaaaaaaaaaaagagggagggctgggcatggtggctcacacctgtaatcccagcactt

SEQ ID NO: 100757 - DNA, 1051 bp, Homo sapiens
caatcccaggactttgggaagctgaggcaggcgaatcgctggagccaaggaactggagaccagcctagacaacatggtaaaaccccatttccacagaaaatacaaaatttagctgggcatggtggtgctgcctatattcccagcaaatagggaggctgaggcgggggttatattgcttgagcccaggaggtggaggttgcagtgagctgagatcacaccactgcactccagcctaggtgacggagcgagagtctgtctaaataaatagataaaaatgagttgtctttcattttatctatacctaccagaaaaaaaagataaaatctttctacatacttaactccacacttttgggtgggcttgaggaccaacatgtaacagtacctagagctgagactaccttaatatacctttgtcagcatctcactatgaaaacgtatatttcctttattttatgacacgtaaatttgtgctgtctagcatcttctctttctgaagaattgaaacattttgcagacggactggaaactgatggaactctacaaaaatgttttgaagattcaaatgggtaagagcagttccccttctgtcctaaattatgattgaattaggactttaggccgggcgttggtggctcaggcctgtaatcccagcactttgggaggccgaggtgggcggattacgaggtcaggagatcaaggccatcctggctaacacggtgaaaccccatctctactaaaaataaaaataaaaaattagccaggcgtggtggcaggcgcctgtagtcccaactactcgggaggctgaggcaggagaatggcatgaacccggtatgcggagcttgcaatgagccaagatcgcgcccctgcactccagcctgggtgacagagagagactctgtctcacaaaaaaaaaaaaaaaaaaaaaagaattaggacttttgttgtaattagatagttgttcattcaccaacaaacatttattcagcatcttctctttttatttatttatttattttttgattcggagtcttgctctgtaccccaggctg

SEQ ID NO: 100758 - DNA, 1070 bp, Homo sapiens
ccctgatcagggagtatcggctgcgggtgcgcaaggcgtccaggagtgacctggggctgtggagagcgacccgtggccttgtgtttcaggtacggaggttccggactggacgggcgtcaggaagtcacagacttgtcctctgatgtggccccgcccgccgccgcactaatctcttcggcgtcgtacccgtcggcccagctcgacccgccgcagccccggccccgaccgtggacactgggggtccccgagggcgctgcgacctcctcccgggtgaaatgaaacccgagggcagtcccccttaccgaccccattagagacgtatctgccgtgccaggggtctaggctccagaaacaggggtgaggactgggtagagggctggggttcgaattgcccctgtgcccccaggctggctgtgtcacaagcttgggccaggctttttgcccctctgaacctcagttcccctgtctgcaaagtggagttaatggtgcttacggagttgtggaagggattaagtggaataacgatgcaagtaaagcgcttacatagcacaggtcctagcacagaataagcgtttaacagttgacagttgttgcttttctaagcctggatctgtgtgatacagtcgttattatccaagcctggatttgtgtgatattgtcataaggaccgtgggggattcagatccttgaccgagccctccttgttatcttttcctttttgtccctctgcatatattcatatctttttacttagcaccccccacagacagatttctgctgggagggaggggacgatgaagagatgcctaggtgacatccctgccttccaggcagttgttcctgacagtcactaggaatacaaatacagcctggctggggagacagacatgtaaacagattttatagccaatgctacgaaggccaaggggcataaccaccaactctgccaaagataagtgatgtgaaagcttcatatttgagccaggttgggaaggatgaataagtttaacaggtagaaggacagatatgtgcaaagattcagaagtagtacagggaataggactgggagg

SEQ ID NO: 100759 - DNA, 1051 bp, Homo sapiens
ttaaggagccctccaaatgattctgacgcataagaatatgccaactgctgatctgggctagccattagtagagcctggggagggactgggactggctaggccaagaacaggtggaaaacaccagccttatctggactcctgagattgggaaccaccaccaacaaaaaccaaccctatagtcgctcctcttggaagaggaagagaagttgaagggcctggagaaagcacacattgtttgtttccctgctcctgctcacctctctcacttgtcttggttttacaaaaggctgtgtggatggtgccagccagggagggggtgggagtcctggggaggcaggaggcagaagaccctgactgtttctcccttgggaacctcaccataggccagatagcgcctcttcaaactgaaagaaatcttaactccacaaagaaagcatcctaaatccccagttcctcctcctcccaaccccagggataccttgtagacagtgccaaaaaacagctccaacccccagcagctgggaagagagccagaagctgcccttcctcctcatcctggcccctccccagcccccgccaatactgtgaacccccttcccactcagcctggtttcctggtgagggtcctgcagtcatgggccctgggggacccccagggcaaggcccatgggagggaagggaccaagggcatccttgggccaactgtccacctctcttgtccactattctctcctttccacttctgtcttcaaaaggctccttcctaggatggatcgggtgctaggacaactgcagtccaatccaccagctctccctgcccctgtgtcttatttcagacatgagaataactgtacagtgtaaacttataaagcgtttttaatggttgtagattggaaataaagtatgtcatatgaacagctgctgtggacttggcctcctctctgatttttctaatgaggtgggtgggggccccagcggatctgaaacctaacttttccccactcccagctgcctgggaagtggggagcccagggaggccacagccagctgg

SEQ ID NO: 100760 - DNA, 1024 bp, Homo sapiens
gtgtaattcccataatcatgcaattaagttttactcttgagtttcctgacagccattggtaaaaagagaaacacatcaggatttataatttttatcatccaattatgggaagcaagcatgttggccccaggagacgaactcttctactaatttatagcatgtatcctttcatcaagggccactgagccagttggtgagtcaacgggtgaacctaagatgcaaggatgttttccaggtgactatttaaaaaaataaataatccaccaacgtgattgaccttggcgagatcatgtttctagtctatacctcagtttccccatctgtaaagtgaggataatgtcccaccccatgtaactgtggtgaggaccaactgcaacactgtgcctgcgagtctccttggaaaagtgtaaggttctacacaaatggaaagtgatctgatcacactcagtgtccccagcccagcctttcagtgccctggccctggggtgggggacaatactctcctcacccccttcactagtcttcatgaatagcaaggaggccataacataatttggtctaaaccccttcctttttaaaagaatgatggcaaaatgtgcataacattaaatttaccattttaaagatttctaagtgtctcgaagtacatttgcaatgtgtaactgccacctccagaactttttcatcatcctaaactgaaactctgtacccactaaacagtaactccccactccccctgtccccagtccctggtaacctctattctactttttttttttctctgtggattggcctattctaggtatctcttttaagtagaatcatatagtatttgtccttttgtgtccagccccctcattttttgagatgaggaatcaggcccagagaaggcagtggctcacccaaggtcacatcgcaaaccagaggcagagccaagaccagaacccaggtttcctgactcctaacaggtcttgcatccccagtagtgaatgagacactgctttgactttctgtaatcttggtt

SEQ ID NO: 100761 - DNA, 1055 bp, Homo sapiens
tgaggtcaggagttcaacgccagcctggccaacgtggtgaatccctgtctgtactaaaagtacaaaaaattagctgagcatggtggtgcgtgcctgtaatcccagctactcgggaggctgaggtgggagaatcgcttgagcccaggaggcggaggttgcaggagcagagattgcgccactgcactccagcctggatgacagagtgagacccaatctcaaaaaagaaatcgtttcccaccccacatctccttcagacctctcagggacaactctgggaggcagccttggcaggacatgggttagtgcgcccattttgctgtgaggaaactgaggtacaggtctcatcccagagcatgagaagtcactgagtttagatgagaacttgggtccaactctgtcctgtttgctgtgcaaatccgctgccctgctgggggcttttggtgggtccagaatacccagaatatgctgctggccaacccaggcataaaacaagtccattctagatcactgagccttgtgtattccagagggtgatctgaggtccccattcagcagaattctctgagggcatgttcagaatgtagattcctgggccccaccttgaatttgcatgtttaacaaactctcctggggttgaggggtgggtgcagtggtcacacctgtaatcccagcactttgggaggctgaggcgggtggatcacttgagctcaggagttcgagcctggccaatatggtgaaaccctgtctctactaaaaatgcaaaaattagccaggtgtggtggcacatgcctgtaatcccagctacttgggaggctgaggcaggagaatcacttgaacctggtggggagcagcggttgcagtgagccgagattgtgccattgcgctctagcctgggcaacggaatgagacttgtctcaaaaaaaataaaaaataaaaccagccctccccgggggatcttaggcactattggccacaccattggtgttcgtggccctgattattaggctatctttctttttttaagtttttttagatttattttttattttatttat

SEQ ID NO: 100762 - DNA, 1125 bp, Homo sapiens
aggctacctgggagacagagcgggcagagctcaagggccatacctcccaggtgagccccccacctgtcagacgcctctccccttactctcagccaagcctttagctgtcagatctgggagtagaataccaaggccatgctcctagaggaataagaatgccgttgcttcacctgtggcccagagagggcaagagacttgcctaaagtcacacagcaagggtatcagaaacggtggggaatgggagtcacagaggaagggaaggaaggtgggggattgcgccctgggctcacaggtgaggctggtgcacatccccactgcctgctgtcctcatttgctccttcatttcctcataagcactccctcagccccaactgcctggctctattttgctccctccacgcaaaatgggggcctcccctcccaactccccagcgtgcccccaaaggagccttaaccaggagccctgggggtttggtgtctgctgtgtgcctgagggtgacttgctgcctcctttggcctgaaaagtgagagggtgggcttcttcccactcagagagaatgctctgaccctgcagcttgggctccagcttcttccatccagcctgcccctgctgcaagctgccttcccaggcgtcagcagcctctgggaggcaggcactccgatggtctctgctggacagatgacaaaactggcacagaggagttaaatttatctcccaaggtcacccggctaataagtgtcagactggcccttgctcccccaaacctctaacccctggctccctgtgaccccaattccacctccttttttttttttttttttttttttgagacggcatctcactgtgtcactcaggctggagtgcagtggtgcaatcttggatcactgcaacctccgcctcccgggttcaagagattctcctgcctcagcctgcaaagcaactggaattatagatggcacaccaccatgcccagctaatttttgtatttttagtagagatggggctgcaccatgttggccaggctagtcttgaacttctgatctcaagtgatctgccggcctcagcctcccaaagcgctgggagtactggcgtgagccaccactcccggccccaattccaccttc

SEQ ID NO: 100763 - DNA, 1031 bp, Homo sapiens
tctaggcctgagcaagcatgggattgggtaggaggagagtgactgagccctgtcaaaagcagagtggtccatatatcacttagctggtgaggatatgggtttggggcattccatttggttccaggcttcttggcagccaaggccagaagggaaataaggaagtttgggacattctcatggcctgatccaaggaaacttataaactcatctgcataaattattttttcttctgtactaaattccactgggaatttaacaatttatgtaatttaatggaactactcatgtatgtagcaggaaggcagcagtctctatagccaggcagtttgggtttcaattgtggatccactctattctggctgtgagatcttggataagtcattttacctctctgattctcagttttctcacatgtaaaatgaaggtgcctcacagggttgttgaaaggattaaatacatgaaaagccatagcttaaggcatggtccacattgggtgaggatgaggaggaggaggaggatgattatgatgataatgacacatctctgggactcaggggacctgagttcaagtctcagttctaccagtgttcctgtgtgaccttggacagatttctaccttctggccacagcttccccatctgtaacgggagggttagagtgaatggtagttattgaattgctaggattctttgatcctcagggaattctgggtagttctgagccccttctaagcctgctgagcttctccttgctcttcataatgagcctgaagcaggaaaaggctcctacggactgggtggagtatccctgaaaccctgaaccttgcagagtcctatgtattttccagcctgagcacctttctgagcatctcttggaagacaactctgtagtcccaggaaggtcagcccatgactatgtgggaaggagaagctcacttgaagctgatggatcagactctctaagtgagcttcctggaagccatggcaaaaagagaaaaaactgagataacttagttgtcattttctaagaaa

SEQ ID NO: 100764 - DNA, 1058 bp, Homo sapiens
aaaaatttaaaaaattagctggacctgatgacacaagcctgtggttccagctacccaagaggttgaggtgggagaattgcttgagcctgggaaacggaggttgcagtgagccaagatcacgccagtgtactccagcctgggtgacagagcgagaccctgtctgaaaaaaaaaattaaaataaaaacaacaaaaaataaaagtgtataatttagtgatttttagtatattcatgatgttttgtagcgtcaccattatctaattccagaacatttccatggccccaaaaagtaacctcatgcctatgaacagtcactccccactccccctttccctcttgcccccagcaaccactcatccgctttctgtctctggatttgcctgttctggatgcttcatccaaatggagtctttggtgactggcctcttttacttagcatcaggttttcaaggtttatccatccatgttgaagaatgtagcaggacctcattcctctttatggctgagtaatcatccattgtgtgggtatatgaccacattagatttgtccatttatctgggttgttttggctactatgaataatgctgctgggaacattcatgtgcacgtttctgagattctgtgttagttctcttgtgtagatcccagggagtagaactgcaggatgtagacgtgactggggaaagacaaagatgggattcaaacccaggactccacatctctcaaacccgcactgactcttctggtgttgcccctatgctccttgccccacccttgctctcctaggaccctgttgtgtcttcagaaacctggaagaggctgcccactcctgtgactgcttccttccctggcacagccttctcatccggaattcctacctggtgggctaggaaggggctgatagttcaaagcccggttctgccttttttccagacttggcacttacttgcaagtgactgtaaccttgcggaaatgatataactgctctagcgcttagtttatttattttattattatttttgggggagacaagagtcttgctgtgtcactcaggctag

SEQ ID NO: 100765 - DNA, 1058 bp, Homo sapiens
gtggtgtgatctcagcaacctctgcctcctgggttccagcaattctcctacctcagcctcccaagtagctgggattacaggcatgcgccaccatgtccagctaattttcgtatttttagtagagatggggtttctctgtgttggccaggctggtctctaactcctgacctcaggtgatctacccacgtcggcctcccaaagtgctgggattacaggtgtgagccaccatgcctggtctggttgtggttttcttattgctgagaagaactcacacagcaagtataagttcttctgagcaatacatcagtaggactactagtagtagtaggctagtaggactggttggtagtagtagtagactagtagtctgggggcgagggtaggccaggatctcagcctcccagggtggataaaaatcaccaggagggcttgttcacaacatacattcccaggacccgtgaggagctgagaccggatacaaggaggtcaggtccagggaatctgggatctaaactctggtctaaagtgactcctgtgggaagccaaggacacaccaggagcacgcccccttcctcagatacagatgttgctggagaaaatgttctggctttgggtttcattcctaggtgacctgtgcaggttacctcccttctttgagcctcactttcctcatctgtagagtgggggtgacattcctaccctcctggggtttgtaggaggattcagccacacggagtccagaatgctgcctggccaggggatgctcttccttttttctttttttttttttttttgagatgaagtcttgctctgtcacccaggctggagtacagtagcgtgatcgctgctcactgcaacttccacctcccgggttcaagcaattctcctgcctcagccttccgagtagctgggattacaggcatgccaccatacccagctaatttttgtatttttttagtagagacggggtttcaccgtgttgaccggtctggtctcgaactcctgacctcaagtgatctgccggcctcggcctcccaaagggccagaattacaggcat

SEQ ID NO: 100766 - DNA, 1085 bp, Homo sapiens
gtggagctctgcttctcccgcctgtatttcatttcaacatttaaagttatatcttattttggctgggtgcggtggctcacacctgtaatcccagcactttgggaggccgaggcgggtggattacctgtcaggagttcaagaccagactgtctaacgaggcgaaaccccgtctctactaaaaatacaaaaattagccaagcgtggtgctgcatgcctgtaatcccagctactcgggaggctgaggtgggagaatcgtttgaaccccagaggcagaggttgcagtgagctgagattgcaccattgcactccagcctgggtaacaagagtgaaactccgtcacaaaaaaaaaaaaaaaaaaggaaaccaactatattgaaacacagttattaaagtatttttaaattacaacatagtaatatgtgtgcttattaactcataaattctggtgacagatctaactagcataatttcaaactactgatgagtgtaaataatattttgacatttttgcagcaactgttatatgatatgaaaatacctgtgatttttttttggtggcaaagtcacagatattactcatataatgatgatttgttcataggcccagaatagaaggaaatgctacattttacttagaggtcagtgaaaaggaagatgtgattttccaagttcatggactccctgagttctggttccaaggaaagatcttgaagttggtggttggactttgagtcctgcttggaggtctcaccccctccccctgcctgtttgcgtgtgcttgggcaccacccaccttccctgtgcttctctgaagttcttcatctgtagaacatggatgatggttcctgtctttccttactgggagtggggggttcagtgaggatctgtgagatgattcagatggaatgtctttgtaaactgtgaagccctctgctgctgtgcaagatcttgctattattagcagtagtgtgagctcatgtttggctgtccggcccagccgggaccaagaggctcttcctggacaattctcccaggattcttgggaatcagtccatcgaggggagcaggtttgcctttgagaggct

SEQ ID NO: 100767 - DNA, 1165 bp, Homo sapiens
ccttttttggggtccaagtgtgatgatctcatctggagccttgacagactcctgggggaccggcagaagggacggcagatggctgccctggcctcttgggtggggctggcatgccgcccctgtggccactgccggcccactccacagagcagcccttccggggctggggtgagtggcccgggcccgggcaggagacgagtggcccagagccagggtggcagatgggaggcagcccaggcctcggcctgagggagggaccatggtggccagggcagtatgggagcaggcgggccaggcggaggctcccgttcctctgtagtgtggttgctgcctcgcagagtgaaggttctgggcctctcagctcagctctgtcattcttctgggttggtctgcccgtcggagggcttgttgggcccctggaacctggggaggaggtggtacatttgggtaaggtttggaatctggcagggctgtggcctgggtgttgctgggctgggacttgagccccaccactggggtctgaagcacccatgggcattagcttcacagaatcaaggaattagattcaaacacaggagcgctgactagaagtagttttctgtaggggagtagaacagggggattctcctcccctctgagggcctgtgtattcattcagcacctctttattgagctgttctgtgtgtcccaggcactgtgctgggctctgtcctcctgacatcacatcctggtggtagagactgacattctgcaggcaaacagacaaataaaacgctgagtatcacaaataagcctatgatatatgccaagaaagaaacaagggattaagatggacgtaatgggcctggaggagcatggaaggcttctcagaggaggtggcatttcagtggagacttgaggcagaaggcaagccagcagggcagagatggggggcagggaaatccaggcagaggaaactgcaaggccaaaggctttgaggtgggacaggtgaggtggctgctggttgcctacgacccaagtggctgctgtgttgccagtgagaggaggcgtcgagggagatgaagatggagaagtggacggggcttaggccaggcagggcctgtatgctgtacgatgggatttgggttttcttttgtatgtgatgaaaagtcactggaggttttgt

SEQ ID NO: 100768 - DNA, 1046 bp, Homo sapiens
aaccgtcccagcccatgccagcccccacgggggccaaaaccgccttccaaagcatccgctaggctgacatctcgtaataggtcccctccattttatttttgtttttatttatttgtttatttttttgagatggagtctagctctgccacccagactggagtgcagtggcgcgacctcggctcactgcaacctccgcctcccgggttcaagcgattctcctgcctcagcctcccgagtagctgggattacaggcacgcgctaccacgcccggctaatttgtgtatttttagtagagacggggtttcatcatgttggtcaggctggtctcgaactcctgacctcgtgatccacccgcctcggcctcccaaagtgctgggattacaggcatgagccaccgcgcctagctacgggtcgcttccattttagccgtacagagcctgaaacccgggtcgggggcgcatggggagaaatatccgccggtcaaggtgcgcgagccaggcatgcacacagggcttcacggtccctatgccaggagagggaagccgaggcagggggagcccgagcgcgcccgggaggtgtgagctttgggtcccatcggcgccgcctagaccgtgagcttggcgcgtgcaccccaggcttcagtttacgcatctgtgcgatgggatcgcggctccggcgatgccggctaagggggcggagttcgcgcacgctcggcacggggcgaggggcgaggcgctgggcgtgcatggatgcgggttcctgcgaactgaggtccgcccggcctcggcccgggagtcccggctcccgccgctctcgcaggccctgcccggacgccgggcgcaggggcgcctccgccgggtgccttccccgagcgggcaggggaggaggcggcggagcggaggaggagggagcccgggccgcggctgcccgcgccagcctgaccctcgaaggggtcgctgttgcctcgcagatccctccctcgctccctgcctgcgtccctccctgccgctcccgccgcgtccgccttttgttcgcggaaccgcgcg

SEQ ID NO: 100769 - DNA, 1070 bp, Homo sapiens
ctgtgatgaccgcgataccggatccttcaccttcctccagcaatgacctcaccccatatttctttttttttttttttgagacagggtcttcctctgttgcccaggctggaatgcagtggtgcgatcatggctcaccacagcctcaacctcccgggcttaaacgatcctcccgtatcagcctctcaagtagctgggactacaggtgtactctaccatgtctggctaattttcgtattttttgtagagatgggggtctcactatgttgcctaggtaggtcttgaaatcctggactcaagcaatccaccttcgttggcctcccaaagtaggattacaggcatgagccacggtgcctggcccccatacttcctgagaagccattggctgtgtcctcctttgtcgtcctgccaccacgccctcaggtctactttggaccatcttgtcttcccagcatgtgcctggcaagcatggtcctccctcctctcagccagtcagcggttgccagagacccaccaaatacgttttaaatgcaggacaggcaggtcaagggggatgctctgcccaccactgccctgctcattcccctgtgggaagatggtggcacaccaggcagcccatcgtggaggatggagctgggagccactgggaccccgggagctttgtctcgccacacgccccactccccccatggaaggttgggaacatcaccttcagctgtggggagaaggagaagaggaatgtctcgccagtaccatagaagcctttgctgagtcggatagccgaggaggagaaggctccaaatatctggaaagtggaagttgtagtctgcagctggaagggagctaggggtcctctggcaaccctcattcttcaggtttagtaatacaggctcatcctagaggacacctgggaagctggggcagagctggggcatgggggctccacacccaagagcaggaatccttatgcatcctttcccttaatgctccccaaggaagaactcctgctgccttcctcctctgggccgtcagggccctcctttttcttaaatatacttattctgggccgagcg

SEQ ID NO: 100770 - DNA, 1046 bp, Homo sapiens
ttgctctgttgcccagcttggactcgaactttcctgggctcaagcgaccctcctgcctcagccccccaagtagctgggactaaagtcatgtgccaccacacccagcttactctgaacttttatgacagatgattgttttttgtttttaatgtagaaatgagacaagggtacaaattggaactagaaattgacattgtcattgacaaacatggctaaaaacaaaacatcaaatcctgcccccgtgaagagttccctgtcacctcaagtttgaggatagtcctctaagagtgacctaagcataagtgaaagacacctcccctcacccttctagccccctacaaggtgccaggttggggtaaagagttggagatgatggccaggagtggcctccaacacgctggtgagaggcctgattaggttttggggaagatctgagagctctggcctcttcgtgagtggaacataaagccgcctcttgttgggagatcctaccccagtgacagaggaatcccccaaactaggctgtgccctggctccgtggcggctccagacccgggtagtgcctttgtcccctgaatactcactcccccggtccagagggccttcccactgcccagcctggagaaggcctcccctgacctgctctctcagtatcctggagagctggccagaggccatcacaggcatcatcctcagagctcctcagacctgggactttgtttttgctggttcagtgcattttgtgtatttaagagcaaacactagccaggcgtggcggcgtgtgcctgtagtcccagctacttgggaggctgaggcaggaggattgctcgaacctgggaggcggaggttgcagtgagcctagatcacgccattgcactccagcctgggtgacagagtgagactccatctccaaaaaaaaaagcacaaacactgcactgcctgtgctgaaattagtgaccacccagtgggctccaggctccgctaggtaacttcgttttcccagcagtggagtgggcaccaccttggtggggcagtgcccctgtgcc

SEQ ID NO: 100771 - DNA, 1044 bp, Homo sapiens
tctcaaaaaaaaaaaaaaaggaagaaagaaaagaaaaagaatgaaagttcttgcaatgaaggacttgtactccagcctgggcaacagatcgagactccatctcaaaaaaaaaaaaaaaaaaaaaaaaaacaaagaatgaaagttagctgggtacagtggctgatgcatgttatcccagcaaggctgaggtaggaagatcacttaagaccagcctgagcaacatagcaagacctcatcttttaaaaaaaaaaaaaaaaaaaaaaaaaatgaaagttgcaagccaataaatggctttactaatctgcctcctcattttttagtggggtcaaaggtgttaatgaagaagccccggtgcatagccctcttgtctgccactatcccttttccttccttgtcctatatacttgtctctaataacgttaacataatctgatcctattaatatttacttcatgttttcctgcaggaagttggaaatctgtatgacatgttccacactcgcaactctttacaccgtagagcttatcaacacaaagttggcaacattattgatacaatgtaagaaacttgattgtcatttccctataaaattttccttgatacttggctagagtatcatactaggctcaactagacatttctagatgagttcaagtgaatattaagtgattaaattgaaaatggtttccttaaagaaaaaaaatctagcataaagttaatttagttggaggaaaaggagggaagtggataaaggggcagatggagggaagtggataaaggggcagatgaagggaagaagagctggcttaggccagacgtgaagcggcagtgctgagatcactcaggacctcggcacaggtagtcacttacacaccattctcatcaggagaatgggaggtaggacatgaatatttaaattctgagattaatgacaaaagttaactttaaggattaagattaatgtctatttgtatcctttcaaatatttatcaaaattagtaccaaatggtaaaaccaacaggaattttacctcttcctgaccca

SEQ ID NO: 100772 - DNA, 1035 bp, Homo sapiens
gggagatctttgtttttactggcaagtttgcagttaccccttttcaccactagatggtagtgcctaacagagcttataactgcacgtgttcaaaggctgatgaaaaaataaaattcaattttatgatgatatttattaaaatgtaattctgtctacatgatcttataatattcatttaggaactgtaaatgattatatcattaaatgcattaaatatgtttatgaaataagttttgtaaaaggtttgtagactactagtaaaatgaaaaatctgacaggtttttaaaaatgttcctaagattgtggttagaaactagagaattaatatgcaatagacctttatctcagaattacttggaattgaggataattttgttagtcagggctcccaatgggctagaatctttaacacatcatattgtgcttacttttcctagcatgaacaaggctcagttatgatgtttgagcaccttattaattctaatggaattaagcctgtcatggaacaatatggtctcatccctgaagaagatatttgctttataaaggaacaaattgtaggaccacttgaatcacctgtcgaagattcattggtaagtttatgtacagcttaattttaactgactggtgcttttcatctagccttttcatgattccttctgagttatacatttggctattttagaggctaaatgataaaatatgagttctatgtttctactgtttaatgcaaaaaataaaaggcttatatttttttctacctctcaactgaattagttagaagttacttcccaaaaatatatatacagaaattctttttagagacagggtcttactctgtcacacaggctggagtgcagtggcacaatctcagctcactgcaacttccacctcccaggctcaagcgatcctcctacctcagcctcctgagtagctgggaccacaaacgtgcactaccatgcccagctaatttttgtattttttgtagagatggggttttgtcacgttgcccaggttagtcttgaaatcctgagc

SEQ ID NO: 100773 - DNA, 1089 bp, Homo sapiens
attatgtattttcttgaaactggagcattgtgagggagtactgacaatggaaaatgaatataaataaagttaaagccttcatatgtatttcattcatgcttgagtcatacctggtgctcataaatcaatccaggattatgagggtagatgttgacttcagtttggttaaaaggaagtacagtttgagcattgagtagacatggagatgtggagtttttcaagtcttaaatttaccaagagagaggagggtcaaggacagaaggctgtgggaggcctatattgattcagcaggagagttccctatcttaacagcaaaggaaggagagagtttctaggaggggtatgtttgaattattgattgttccttccaatctaacttctgttagtgtagataatataaagtttattatgtctactatatactgcagggattattattaagcaaataatgatagacttgcttatcctattgtaattttagttccttgggggagaggaagaagctgcttagttatatccagcgattggttcaaatccacgttgatacaatgaaggtaagaggatctgagtttgttatgttttttgaatataaagtgatataactcaattatgtaaaattcattttgaagagaataggaggaaatctgcttctcagtgatagaattgtgagtagtggatcttttctaaactttctgcactttctaaaatgagcacagagtatttaaatcagaagaagaactaaaatatgtttaagcatacagaaaagcataagtagaccactacccaacttgtcaaatattaatattttgcctaatttgcttcaagtctgttatttttagagcaaaatattagaaactattgaagacctcctttgtacattcttttttttttaatgaaatgtggtcttgctctgtcatctaggctggagtacagtggtgcaatctcagctcactccaacctccgtctccctggctcaagtgatccttccatctcagccaccccagtagcttggactatgggtgcatgccaccacacctggctaatttttgtattttttataaagacggggtcttcctgtgttgctcaggc

SEQ ID NO: 100774 - DNA, 1027 bp, Homo sapiens
aacaaaacagacaaaggaacactatattgcagtgttccagaaggaacactatattgcacgtctctgtgccccacctcataactcaaattctgtaggactccttagagctgtattgttctgtataataacaactagcttcacgtttaaattaattagaagtaaattaagtaaaaaattcctcagttacactagccatatttcaagtacttagtagtcactatggctaacggctactgtgttggacagagcagatatagaacatttccatcatcgcagaaagttctactagacagtgctgccttacaggttgccagtgggattagccctacccaccactccatccagttgctcacagtagtaccaatgcaatcaacttgttaatggacctttgtactgtttttacctaatttcctattttaccctccctagaccccccaatccctgtgcccagagttcaccccaagattaattacttgcaagctcttatcctggaccctgctttctagggagaatccagcttagacaagcactcctagtaggccctcaattttatgaacaaccattgatttataaaggtttttttaacaagtaagaaacaggccaggcgtggtggctcaggcctttaatcccagcactttgggaggccgaggcgggcggatcacgaggtcaggagatcgagaccatcctggctaacatggtgaaaccctgtctctactaaaaatacaaaaacaaaaaagaaattagctgggcatggtggcgggcggctgtagtcccagctactcgggaggctgaggcgggagaatggcgtgaacccgggaggtggagcttgcagtgagccgagatcacgtcactgcactccagcctgggcaacagagtaagactccatttcaaaaaaaaaaagaagttagatagaaacattgtcacgttaaatatacatgtcaattgtaagaagcattaaatttcagaaatgttggaacacaggaataaaattctttcataatctagatatcctggcccatgacttctt

SEQ ID NO: 100775 - DNA, 1034 bp, Homo sapiens
atatatatataaatagggaattttttttaatgtttgctccttgagttttcaagatgaaataaggagaaaccccataactttttagctctcttttaaaaataaatgtctccttctgtgttctgtaatatgaggataaataatctacttttgatagcatgctttgagatatttgtattcttaatttaatattgaaggaaggggttggttcccatagtacctggccagagggttatataccatcctgtctctggcccactgtggtaattccacatccaggtaccaccgccattcagagttgtctcaccccttctcgtgccttttctctccttgagctttataaacagatttgtacctgagccccagtgctacactcatccttgctttccagccctaagccatctcagcctgatgtcacaacccaataaatggggcactttcttcttttgtaaactattatcattttggtttctgtgacattaacttaattatatatgatcgtattaactcatgtagttctcaaaataggcagctgcttctgaagccagtaaaataaaattcagttagttattaaaaactaaattcctattagtaaggtaacaccatgattatgtgtgatatactgtttttgagatcatagttatcagtcattctcaatatctaattgagtccctaagaatattttaaaccttttaaaaatcacataaatatcatctcatgcctcataattctaatatatttaatacatcagtaaaatagctgcttattacttcccacactttgttctcagtattgttagtgcatcatgagtttcctgctagtgtttgaccactgggtactcctgaagatgttttttagtactagggatgcttttcagtattagggatgcttttttcagtactagggatgtactagggagtactgagtactcctgaagatgtttttcagtactagggatgcttttttcagtgttagggatgcttttcagtactagggatgcttttttcagtgctagggatgcttttcagtactaggga

SEQ ID NO: 100776 - DNA, 1037 bp, Homo sapiens
cgtgagccaccgcgcctggcccattttttttttttttttttttttttttgagacagagtcttgttctgttgccaggctggagtgcagtggtgtaatcttggctcactgcaacctccacctgccatatttcaaagccactagtgtttccttagtgatcagaaaccattttcataattagattcaactagttttcagattaagtatatgtagtctctcacttttgaaagtaatttattggttgtatatatgaatttgaagaatgtccataatcaggtaggaccctctgatattgttagatggtcagagttaataaaaattagaaagttgtcaagttttctaagctgtaaacactaaatctatcttcaagtcaaaataaatccattgtgtaacttagtattacagcttataataattctctttgcagcaaagcagtgaataaggagtatgaagagtatgttctaactgttggtgattttgatgagaggatctttttgggagcagacgcagaagaggaaattggaacacctcgaaagttcactcgtgacaccccattagggaaactgacagcacaggctaatgtggagtataaccttcaacagcactttgaaaaagtaatataacctagcctggcctcaatcttgaatgatctttttctctctgtgtgtgattctactaacagcagaagcatctttcaagttaaatcttgagcttcttctactaattcatatttctcatgaaagccttaaaaggtaatttttaaaactggcatttagtatttttacctcatttcttactattcatattttatatccattttcccagcatgactgggtttattagtagagtatatgtcttttgacatgaagaggaagttttgctttcttacagttctttctttgcttcaacttaggctccgttacgttgctttaaattttagtttgctttcctacccgtgacacaaactatgtgtttttctgtaacttcagccataaaactctggacttgattgttaatggccaaggcttaactctgtattt

SEQ ID NO: 100777 - DNA, 1038 bp, Homo sapiens
aaggaagtagataggtgctctcgctccctccatagcagtaaactctatgtgatgaccactaattaataacctgtattcccctggtgatcctgggaacgaaagtgatttcatagtgaggactttttttttttaattaaatttaggcttgagggatggtgtttgttctttgttcatgtaagacagtgtcttgctttgtcacccgggctggagtacatgattgaggctaactgcagtctcgacatcctgggctcaagcaattctcccacctcagcctcccaagtacctggggctacaggcacatgccaccacacccagctaattttttaaatttttgtagagatggggtcttaactatgttgcctgggaaatctggctttttaataaagagtcttagtcatgaatagaatatttcctttcaatccattatttaaatgaattttaaaggtgccttttttctcctcctttttttttttagtttaatacaattttttagtaaaatgaagaaatggatggacatgtcaaatctaccacaagaatttcgtgaacgtatagaaaggctagagagaaattttgaggtgtctactgtaatattcaaaaaatatgagccaatttttttagatatatttcaaaatccatatgaagaaccaccaaagttaccacgaagccggaagcagaggtgagcccttaatccttatataattgacataaagattatgatacaaactaagagaatatacttttttgaaagtctgttttttatgaaaagtattcctgcaaagaacttaattattttctttttaaatccatgtacaattatccatatttggaaattcaggataatacttttacttatttttctttctgttgttgtttttttttttttttttttttttttgaggagtctcattctgttgcccaggctggagtgcagtgtcctgatctcggctcactgcaacctctgtctcccaggttcaagcaattctcctaccttagcctcctgagtagctgggatcacaggtgtgcaccaccccgtctggc

SEQ ID NO: 100778 - DNA, 1171 bp, Homo sapiens
gcgcctggcaagtattataatcttaagtgaccaccattgtatatgtggtccagtgttgaccaagatgttatgtggcatatgcctgtattagatttggagtgtaggtgaaagagtttttttcttttttttttttttaagagacaggatttaagagacaggatctcgctcagctgcctatgttggaatgtagtggcacaaacatagctcactgcagtcttgaactcctgagcttaagcgatactcttgcctcagccacccaagtagctgggactgcaggcaagcaccaccatgcctggctaatttttttattttcatttttagagtctacgttgccctggctagtcttaaactcctggcatcaagtgatactcgcacctcagcctcccgagttactgggattacaaacatgagccaccaagccaggcttttatctttagattaatattaatttagcatgttatagttgtaaaaacacagaactaagagtaaggagttttatacccattactgcaactaacagctttgtgaccttgggcaaatatcttcacttctctggccctttatctacataaggaaaattgagaccagataattctacatctcttgtttctagaattaaagcattttaacataatattatacctgttttgctgtttgtcttttgcttgccagggagaagttacacactggttggcatgttcattatatgttgcatgccgcaaaagcattattcccacggttggaaagggtatcatggaaggcaactgtgtttcacttaccagaatactacgttcagctaaattaaggtaaacctctttgatgtttttaaatgttatataagctctaaattttggaatcagttttctcttgttttgagatcatttgacttcatttaatttttattttatttatttatttatttatttatttttgagacgcagtctcactgtgccagccaggctggagtgcagtggcacagtcttggcttactgcaatctctgcctcctgggttcaagtgattctcatgcctcagcctcctgagtatctgggattacagacacacaccaccaagcccggctaattttttgtattttttttttttagtagagatggggtttcatcatgttggtcaggctgttctcgaactcctgacctcaaatgatctacccac

SEQ ID NO: 100779 - DNA, 1028 bp, Homo sapiens
tgcgcagccaagcgccgaggggcgggaaaggtgggtgtagctcagccaatccacccatcattttgaggcgggaaactgaagctcaggaaaggagcggcctaggtcccgcgccgctcagaccccaggcttcctgaccacacttccctctaccccgccaagcgccacaaaagtcatggtgctgcccttaaatcagtaagaacaaatataatggtaaagtgaaaatgaactgcatgccaagacatcactgcccagagctttaaatggaccctcagttccgtctgaaccccttctgtgatccccatttcacgcaagaggaagcggagccctagacgggttaagctacaggcccaaggtcacacggttagagatggagccagacccagggtctgagccgtttaacctccaccctctgcttcaccagggtggagctgccggtcgctgtgcagcagtttgatcaaagccaatgtgcacacgaagctgatctcagccctacgtttcctcctccgtcagagcatcgtcctgatgctttgcatcagtgtctggctctgaataaaacaaatgtcagttataattacttgatttttttccccatcattcttgcattttatcctcgcaacagccctgtgaacatggcatggcaatgagtattagactgctttccaggtgataatggcaaggctcagaaggttgtcttgcctaggattattctaatatagaaacccaggctgggcgtggcggctcacgcctataatcccagcactttgggaggccaaggcgggcggatcacttgaggccaggagttcgagactaacctgggcaacacggcgaaaccccatctctactaaaaaaatacaaaaactagctgggtgtggtggcgcctgcctgtaatctagctactcgggaggctgaggcaggagaattgcttaaacccaggaggcataggccgcagtgagtggagatcacaccactgcactccagcctgggtgacagcaagactctatctaaaaacagagaaagaaacccagacg

SEQ ID NO: 100780 - DNA, 1074 bp, Homo sapiens
cacctcaggtaatccgcccgcctcggcctcccaaagttctgggattacaggcgtgagccactgcgcccggccagaaactgccacaattttctaaagaggaaaaaaaaatcccttctaagctatcccctcccgacgagacccttcctgttcctttaaaatgggccgggcagcagaaagacgagtgagtgacagcagacaggccaatcagaagcggccccgtctcgggcccaccccgaggcctggcccaaccgcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggtgaggagttgcgcgtggctttggggagagggctgtcgcccgcgggaggttactagtcgccgctcgagagccggccaggcgggatccccttcccctgcgggacaggggcatgggcacaagctctggctggggcgctctcggatcgagggtccgaaggagggctgcgagctggtgggagtgcccgcgacctggcggggttggtgcctgggggaggggtgcagcgcggagctacgggtcgccccgaggctcagccgtggggaccgcggacgcgcttagcctaggtctggcctcattcatttcactcgcgcgggcttctgggccaggcggcctaaggttctggtcccggcgctgccccttactccgtgtgaggttttgggcagattgtccttctttgtgctgtagtttcccattcagtgaaaggggcaaagaaaaccctcacttctctctgggagcctggagcataagttctcaagtgacactctaggtgcaaacttgcagtc

SEQ ID NO: 100781 - DNA, 1176 bp, Homo sapiens
ttattgtactggggaactaatcctagggagagctgcttaaggaagaggtgcttgagctgaattctgaaagtaaaaattaagccaagttgaggtaaaaacatggaaaaatgctgagcaggaaagaacctggcttcttagaggacagagaagaagccagagagcaacagatagcgggaagcgcgagggaggagatctggttgagaggctggcaaggtgtgaggattcaggattgggtttgtccttagaggcagaggacttacagacatctttcagatgggaatagtaggataaggcctgtgctttagatgcttggaggctgctgggaggactgtccttccaccagttgaagagcaggctccctgccttcccaaggcttctcctcaggttaaacccctggattccctcgcccttccccatgtgatttggttcccagatcttggtgtgcatcatcattgggactgtgtatagcaccttggaagagtgtagagtgtactgaatggttgtttccccccaaggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaaggtaaggctgcttttgtcctggtggtcagggtggttcaggagaaccttcatcccctcactatattcctttggggtagttcaaaactaactcttgctcatttgaggataaccaaggttaatccaatataagaaatatttggccaggcgtggtgactcacgcctgtaatgccagcactttgggaggtctaggcaggtggatcacgaggtcaggagttcgagaccagcctggccagtgcagtgaaaccctgactctgctaaaaatagaaaaaattagctgggtgtggtggtgcatgcctgtaatcccagctactcaggaggctgaggcaggagaatcgtgtgaacccaggaggcagaggttgcagtgagctgagatcccgccattgcactccagcccaggcaacagtgtgagactcagtctcaaaaaaagaagtttatttcagtttgacagatctgtttttgtttttgttt

SEQ ID NO: 100782 - DNA, 1094 bp, Homo sapiens
ggatgcttcacaggcacgttggttgcctagtcatgttgcctaggagagcagtatgtctctctttgtcttttggagcattaagaaattctgggaaacgctgtgctttgtaggttgtattcaaatggatggccatggactccatctgtgtcatgatgcttcctgggtgcacagcagcctggcccactggctttccacccaaagcagctggcgtgttctgtgccatgactcctgggcttgggcctgcatacaaggggccaaggaaggagccctcccaaaactgcagaagatagtgctctcctcaaatgtctgtttgatatactttactctgcctaagcaccatttttgagaaagtatgaagtgactgagatggtcttcagatttagagtgagagatgtcacgaagctgtctgcagtggggttgacagtggttcgtgcatctcatttctgctgttacttgacatccagcatatttctgttttgttatggcaggaccttgttgctcgcctggatgaactcgggggcgtgtatctccagtttgaagaaggactggaaacaacagcgttatttgtggctgccacctacaagctcatggatcatgtggggactgagccatccattaaggaggtacctatctaacaattttcaggcatgaaacccaaaggggtcatcagctgtatctgctaaggatggcttttatcagagaggaatgttcagacagtaccttgggatgctgtcactcagtgtcctgggttagggattaagaatgagaaatagaaagatgtaatgcctgtcttcaggaaatgggttgctagtgaggtagacgtgtaaacaaaccatgcttgctttaaatggggtatgtacatgtcacgaggtagtatcaaggaagccacgtgtattactcctgtttcatctccctttcttcccagtacccttttctgcttgtcgcctgaatgctttccactctggtggctcattcagatccttctctgggctcacaattgcttctcctcccttcccccttatgctcagcaacggctaaatcttagctaatctttgctgatggacatagttcactgagaggcatgtgtgtctatc

SEQ ID NO: 100783 - DNA, 1526 bp, Homo sapiens
tgggttttaagtgagaattttcatttctttatgcattatgagttttgtgccaagtttctttaagtaaatagttatctgtcttggataattggaattaatttcatattttctccatgtggtcaaataagttattcatgtgtttgcattctttttgtgtctcttcctttgtcctaagtgtaggaggtctagaaatatactcccttttaatttctgttatgggtgaaattgcaagagtgtggggtcttagggtacagattgtttgctgattgtcctatacacagtaaagtagatgaattaatgatattgtacttatacaacttaaacattttcttcctttatttccaagctgctgctaaccaggtacttggctggagtaatttcgctgtcactgcttttgacaaaacaattctggtgaacagtcacccattttaacgtgtcaacagagtagtgatggaaaattgtaattggtccaattaaagaaaattctttcatgttgactgtgaataacactgtcaggaacaagagagcccttttgttggatggtagattttaaaaaacaaaactgattgaaggggaaaatgtttcctcctaagcaaataacctccagaattttaataatgccttttaggttccacttttttaaaaaattgcttttagttttctcctctaagcagcccattagttcttaatggagagttattttagtttctttttaatgtacattttagctataaagtttggtcttataaataaaaactttgcctcaatgtactacttacaagtaggttgggaggaaaggtagcttagctgggaggataatgagaatcaggaaagaacagattttcttgtagaaggactttggagacaaacagtcctacatttgaatgttggtcttgctaatgttgtggtaacttgcagaagttatttagcctcctttagcctcagtttcattttttgggaaacattgataatagcaatcttttatagtttttgtcaaaatttgagttaatgcatgtaaagcacctatcatgatgcctggcatatatagacattaacaaataattactattatatatatttcataatatagtttcatatctcagtagttatctggaagtaccctgcatttgtgtagtaagcattattatgatttttttttcagacagagtctttctctgtcgcccaggttggagtgcagtggcgcgatcttggctcactgcaacctccacctcctgggttcaagcaattctcgtgcctcagcctcttgagtagatgggattacaggcgcatgccaccatgcctgactaatttttgtatttttagtagagttggggtttttctctatgttagtcaggctggtctcgaactcctgacctcaagggatctacctgccttggtctccaaaagtgctgggattacaggcgtgagccactgcacctggcctgtataataagcacttattaaataactgacaaatcatgaatttcagtttataaaggaagatggaaaaaaaaacaaccacatcc

SEQ ID NO: 100784 - DNA, 1231 bp, Homo sapiens
ttttcctctacatttttgttgtcattgtgaaacatatgtgggatcacattgtaaacttctcaattttacattacactgtggaaagctaccaggagtttgaattttaggagtggtgggagtaacaaaggaaaagaaaacgttggaaacctaggggtgttcatcttagatacttttctccacatgccaatctgtgattaagcacgagggtcaggcatggtgactcatgccccagcctgcactttgggaggctgaggcaggtggatcacttgatctcaggaccctgtctctacaaaaaactgcaaaattatctggacgtgatggtgcatgcctgctgtcccaactaccagggaggctgaggtgggaggatcagttgagcctacgagttttgagactgtggtgagctgtgatcgtgccactatactccagcctgggtgacagtgagaacctgtctcaaaataaaaaaaaaataagaagcacgagattgcccaagtggggtgggaagtcaaaaaggtaaggagttggctagccttggacagtctccaggagacattttgtagctcctgtttgttatatccatgactttcctacctgagttcttgctaagcccattgtcattcttaacagggatgtttttgaactaaatttcatgaacgtcaaattttccagtggttattatgacttccttgtcgaagttgaaggtgacaaccggtatattgcaaataccgtagaggtaggtgtttttctttccttcccattgccatgttagtatatccaaggatatggccaaattgacacagtattaattgtctggtgcattgacttttctctacaaccaagctaatgtgtttatgtggagggagggctgcattcagtctttgctgtttgacagacttagtagctaaggcagtaaatcaagaacttggtcatagtgaattttcttttatttgtaagtttttcattttccattataatttagcattactgtcttacatgaaatttagttagtagaaaaaataaaaatcacccataattccactgagccttaaactcttaaagtgttttgtgtgataggctttggtgggtttagaaaagtgcttgatgccaaataggtgacaaaaagcaccaagtgacacatacgtaacactataatgaagctatttgggtaaaggataaaagaaaatcagtaatctttcataatgaactttgttgatgtttagctaactctagctgg

SEQ ID NO: 100785 - DNA, 1065 bp, Homo sapiens
gggttttgccatgttgcccaggctgctctcgaactcctgggctcaagcgatctgcccacctttgcctcccaaagtagtgggattataggcgtgaaccaccacctgcattgctttttcactgggctgagaactcctatgggtgaaaactaaatattattattattattattattattattcttttttttttgaaacagagtctcgctctgtcaccaggctggaatgcagtggcgcaatcccggctcactggaacctccgcctcctgggttcaagtgattttcctgcctcagcctcccgagtagctggggctacaggcacgcgccaccatgcccagctaatttttgtatatttagtagagacggggtttcactatgttggccaggatggtcttgatctcttgaccttgtgatccgcctgcctcggcctcccaaaatgctgggattacaggcgtgagccaccatgcccggcctaaatcttattttttcagtgcttggtttccatttaacattacttagaggaagaaaaggatagagtggtctaaagatgtttttccacattgcaggcccttcagaactctggcaattcatcttccagacttagcttttttttttcttttttctttttttgagatggaatcttgctgtcacccaggctggagtgcagtggcacgatcttggcttactgcaacctccgcctccacctcccgggttcaagtgattctcctgcctcagccttctgagtagctgagattacaggtacacgccaccatgcctggctaatttttttgtatttttagtagagacggggttttgccttgttggccaggctggtctcaaactcctgaccctcaggtgatctgcctcgcctcggcctcccaaagtgctgggattacagatgtgaaccactaggcccggccaagagttagcttttatttattgatttaataacagctttattgaggtataattctcataccataaagtttaccaattaaaagtatgtaattcaggctgggcatgagccaccacgcttgtaatcccagaactttgggaggctgaggtggga

SEQ ID NO: 100786 - DNA, 1037 bp, Homo sapiens
cttgtaggaatcacttgacaataaatgtaagggttgatttctggactcataattctatttcattaatctgtattgtccttatgccagtgccacgctgtcttgattactgtaacagcttggcattttgtaacatcaaatctggtgtttgtccaagtgtttctgtgattgttggaaaaattatctaagtacaaaatagcagaaatggctaatagctcttgttcatgcaatgataataagcccccattgaggccatttactctccttttcctccctagtgatggagtaagcattacaaaatcttctctcttcctccttattacattagaggtgtgtgtgtttgtgtgtgtgtgtgtgtgtgtgagtgtgagagagagagagagtcggctttgacctttgccgtatatgcaacttttctttgtaatttcagtaataatcacacttagagcctcagagcaggtcattgggtcctgtttgtcctcccaagaaatgctcgacattggtcagagtgcattaacggtggtttggtgtggaagtcctgtaatagccctcattgacattggactggctgtcaggggaagcatcggttttggacgctctcattagcattaattgcccctaatgcaccatcatttttgacagtaataagctaaacaggggtgttattactcccagcagaaagactgcatttcctggcgttaaaacattttttgagatgtatatggcatgtggtgcaggcaaagaaaggaatagcatgatccagtgtaaagcaggcttagctgcatttaaagtggagaaataagtccctttcctattataaaaacgaatcctgcattgttagttggaaggaagaagcagctaatcaacagggatcctacactgaactctttaaaagagggctttggaaaaagttacgatttttatttctaaatttgctttaaaagagtagcataaaaatgctttgcttttgagtgtttccagagacccatttatagtgagattttaggagcagaaggatttgttttaaactgttccctatt

SEQ ID NO: 100787 - DNA, 1014 bp, Homo sapiens
attaaatgaatgagttcttaagagaatgagttagagaaatagggaattacctagttaatcttgatgaagattgcagagtagttaactctgaagacagattatttttatagcatggagtattattgctaatcctcctacctctcccaaaattggagggctgctaagcccatcaagcctcctcctcagtcttcttgctatggaatgtttcctactccccatttggggccacccatgggcagacttgggtcacagttccttctgtgctttcataacactttgtacatccattaaagcagcaacctggtttattataattatggtttgtgtacgggacaggaaggatttcttgccatctctgtatattccctgaatggggaaagtgctctcagcaggtgtcaaatcaaagctctgtggctacttctttgcctgagccttccattccagtttgttttccagtggaaatgatgtcagtacttgtcgggttgtgttttttgcaagaaagcttgctctggttctgagccttgcgtgagttgtaacgctgttaactcagcagagagcccaaagagccaaagtgaggctcctagctcccttcttgggggtgtctattcaacctgatgggccatcgtccctcctcctccactgccataatttcacccagttgcctagactcaatgacaggcaatgatcctaaatatagttctgctatgaattcataggtggctgtgaattcaaaagtagatggtaatatccttacagcttctggtaataaacctttacagtttttttttttaaagcaaaacaacacccctattcaacatgataattgaggctgttgtcataaaatagttattacagaggcaggaaagaaggccgttagaaggaattacttgataggtatctttatttttaatttttcttctttgcccttgatttgaggttgtcacacctcgatatggtatttcagaaaactgccagagctatccttcaattatttgcccagcccgttatctctat

SEQ ID NO: 100788 - DNA, 1027 bp, Homo sapiens
ttttgagcaaagcagcttcatctctctcatcttttatttccttatctgaaaagcagtaccttacagaattgtgaggattaaatgagatagtctttacaaagccagtgcctttcacatggtaagcactcaataaatcctagctatcattagaacccaattcttgctgatttgaatgaaaggtactgcttaaggatttttccccttatttattttaaaggacacatgaaaagatttactttttttcttttcctttttcttcttctttttttttttttgatgtttaccatccatccaaagccagaaaaagacattttaggcctcggaatgggagaggttggaaatattactgggctgggtcagtgttattatcatccttgaagactcttgttctaggattttttcatgcctttactcaccttaaagaatagaaaactttatatctgcatgtgaattcctgaacacccaccaattgacctggcaactgtcttctctattttcctctagctcagagtcaagatctccactgaagttggcatcacaaatgttgatctttccaccgtggataaggatcagagcattgcacccaaaactacccggtaggtgagatgccacctgatcactcagggagctgaggctcaagagctgagaggagtatgcctaggcactgagccctgcaggcatcagttctgtgtcagcagccatccagcttacatcctaaattaaagagtctgtagttccactggtcctgcaccggggattctgcgaattatctaagtggatttggagattgtatataccagtgtttagtccatgcacaaactatttattaaccagtcctcaacgaggtaaagcgcttacctcaggatgttagtctgagtcagtcagctatgtcactaagcatattatttagttcagatgataatttttaaaataataagaccttctcaatgaaggaagcaaggtattaatttacattctggtgcgatctccttatcatcacagtcctgaatttgcttttagtgaccta

SEQ ID NO: 100789 - DNA, 1054 bp, Homo sapiens
ctgaaagtacccttctttcttttgtgtctcctacctgccttgtctcgattttgctcacgtgtgctgctggcatcaatcctgtaattatttctccttgcggttctgccagcccggctctcctgtgtgcctgcagaggccacacgtgagctcctctggtgcctgactttgttggagttgagagccttaggtccttgaagtgaaagcccagaggtacaagcatctgtacacagcatttccccagatcctgctggaagtttattctgcacttttctcagtccaggctttatcagtccaatttgcccccaggttgcagacagttctccacatctgtctgtccacaacagaagtgttactatgggagagggtggttgaggcaatgaagtgaagtatatattttctgcctgttctcagagatatactgatcctctctgaagactaactctatatgcctctttcagggtgacatacccagccaaagccaagggcacattcatcgcagacagccaccagaacttcgccttgttcttccagctggtagatgtgaacactggtgctgaactcactcctcaccaggtcaggaagacacctagacagttctcttaacctgaaatgtgaatggatactagagtttacaatgtggtctataacatggactagagagaattccacgttcctgctttcaggttttgaccgaaccctgacagtccatcaggttctcccacatgacactctcacccttctactggttgtagtcctttacctgggatacacccttctttctaaaaagttagctggtattgaggagaggtacttaaggcagatttgcacttaattaaggtcattccttcctccctccctccctcagatggactcttgctctgtcacccaggatggagtgcagtggtgtgatctcagctcactgcaacctctgcctcctaggttcaagcgattctcctacctcagcctcccaagtagctgggatacaggcatgcattaccatgcccagctaatttttgtatttttagcagagacagggtttcaccatgttggccag

SEQ ID NO: 100790 - DNA, 1330 bp, Homo sapiens
cacacagatatgccacatctggaagttaatttttctgccttaaagttgaagaaatcaaagcacaaggaagttaagtaacttgctcagctaataagtagtggaagcaaatctgtcttccaagccgaggctctctccatgacactgggctgctctgcttgattagaactctgccttaccatcaatacccaagcctcctctactaaatctttagctggaggcacaaggaaattgaaaatgggcctcttacagttccacctcatttcctttcttttcaccctctggtgaagcagttaattgggcagcaaagtgaccaaaaggctggcgggaaaaagaaattgcagcaatagcaaagggcttaaatcatctgcaaactgggcagtcagcctccaactagtcgagaattggctggacccgtaagttaaatttccttccttgtaccagcaaaaagttatctctgagctgggaactagggtggcatggccactccttctactctctggggcaggtctggcagatcccagagctctcactgtgacaaagcgctaataaccgtctgctgcccggtggattcaatgttaggcccagggagaatcttgaaattatcagatgaaagattgtattattcttccatctagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggtatgtgcctgaatgtaccccgacccaggtgagagtggctgtgccccaggcactggtggctctttttcaggggcatggggctcttcaccttcgccttgcctgtgcctcctataaataagcttgggaggtgaggcactgtgtgcagtctccataaatagtcctggggtcatgcacggggcttggcaacatggtacgtgcttaataaatattaagtgagtgaaggaagtataaactttgtgagtgctagtatctgtgaatttctataaacattatacaggaaggccgttttcatattatagcaggcactattggggttacgtagatgtgaaagttaaggccctggcctttgagatatggcatagctcatgggagggatgagatctgaattctgataacaattcaggatgatgtagaaaagtgaattgtacaatgtgcaaaatgctaattaactaataaccaacatttgtgtagcatgttgttgtttacatagtgccttcctg

SEQ ID NO: 100791 - DNA, 1063 bp, Homo sapiens
agcagaggccaaattgcaggctttgaatggtggttgactcactttgcaagacaaaggggcagctgcgttttctcgtgtggtattcaagacttcttttcttctcctggacttcaggctgtttttgtacaagagcgcatactcatttctttctctctttttcaaatgtgactaaatcacacttcccagggacaccaagctgtttctgattgcaactgtaacagcctgtgtaccagctgggatttttgtattaagcagctctatggggctactataccagcagaaaattagaagtcttgctctaaaaagcattttcagcaaatacttgttttgttcttaaagtttttactgcctcaatttgtcagctaatggatcagaagtgattgggactgcctggagcttttttcagttatggtcttagatgtgagtcagagaatattatctattgagtttcacccacttctctgcccctgtgcttttacagactgtccttatttttctaggctgatgtggtcatcaagttccctgaggaagaagctccctcgactgtcttgtcccagaaccttttcactccaaaacaggaaattcaggtatatcccaaagggcctatccactaaacgtgggagaagagagggcaacaaagccctggacagtggctctgctccctttaacttgttttgtgatgttttatagtttgatcctcacaccctgtggattaggcagggtaaatggcagccccatccttgaactgagaaaacaggtttaaagagtccggtgactaacccccagaaagcagagagttgaagatgaaatcagaacctgagtctggttttcctgacatccggcaggttcaaccctcagaccacagcttattagctatgagcgcagatggttctagcgtttatcctccctgctcctgtgtaaatcagggctgatggggcgacaggtgggaaaactcacctgggagaacagggctctacttccttaggcaagtccttggataagcaagcctggtcctgtcctgcacgcaggactgttgtgagaatcaaagttgataacagatgag

SEQ ID NO: 100792 - DNA, 1172 bp, Homo sapiens
aattataaacaaacatgaatgcatatcctcaaagctcagagaattttgagaaaacactcattagatcttacttttggaaagttgcctgtgttcctaattgttgcttttaacaaaagaattactgtttaaatctagataaatctagaagccttgctacaggttttcagaaaccagacctagggtatgggcacctgtccttacatttcagtgatgagaatttcaaatgacatggaacccacggcaagagcgtgaatgccaccagctgccggtgggtttatcttaccaattcttagagaacttagtgggggtgtcagttaccttataaatgcagtttctgacctttcagcttcatggtctcacctgttttaaaatagtagggtttgtcatcattaaaaatgatgttcaggtttgagttacacgagcccatttgagagcaggtgctgaatgcctttctaaagaaaaagggaacaagtttccccgagggcttataatagggtggttgtcacttggaagaattgcctgtccttctaggatgcatgaactttgaagccttggggctgttgatgggattagcattggcatggcttgtgttgcttcccttttaagttctaatgcctttttaatttatttctccccatcattcagtggatccggattggtgccaatgtctccaacttcacttttgctcctagcacgattatatttcacctgggacatgctggtaagtgccccaggctgctaattacctgtaacgtcctctgacatttagcctgcccacgcaaaagccctgttaagtagacccacaacctattacctataatgacttaatagcattacatttccctcttcctcctggccttttaggacagttaatacgaagataaacctgtttggtccatcacttagaacagctgtcattatattgggctttgttgtactgtgccactgttggcagaccatttaccctcagttaataaccctgtttatttccagagattactcacttatcgtatctttacattgagcaatcttcctggatgaagagcattaatgcagtttccaaaggttatctttccccacgctatcgatcttcacatttgctgccggctctgtctgtgtagtaatagaaaacagtcctttccacagtcagacatgctatcctgcatcgttct

SEQ ID NO: 100793 - DNA, 1036 bp, Homo sapiens
ccaggctgaagtacagtggtgtgatcaagctcactgcatccttgacctcccaggctcaagcgatcttcctacctcagcctcctaagtagctaggactacagacatggaccattacgcctgactaattttttgaattttaatagacacgaggtctcactgtgttgcccagggtggtctcgaactcctgagcaatcctcctgcctcagcctcccaaaatgttgggattacaggtgtgagccactgtgcctggccacacacttggccacagctgagaggcgaatatattgagttagctactttttggcatcagagcaaaggaataaaacaagctggtataggagtacagaccttttcatgatccaacagttgctatgtctaactttcctcaaccgcagggcatcattatgtttcatttaattggatgtcatgacacctcttcttgcagctatgctgggactcatgtatgtctactggactcagctcaacatgttccagaccttgaagtacctggccatcctgggcagtgtgacgtttctggctggcaatcggatgctggcccagcaggcagtcaagaggtaaggccagacatgagccagggatctagagtagggttagaaatactcagctctgccggcctagctctttgaagggtaggtggcaaaatgatttgtgttcttaggggcaagtctgacaccctaatctagcccagtacagaagccagaagcactttgaagtcagaaaagagccttagtggtcagctttgaatgtattacaaccattgtaattgatgccccaatacaatagaatgagagaggaaaattattagctttatgaagatgaaaatgcattcatagatgtggcagaagattaatttgttagctgtgtaaaaattctctgctgctacagagaatcctgccctgccctccccaccctcaacatgtccccgagagctgctcctctgtaaccctcacagctccaggagcttgtcccggaagcacgaggtctgtgttatttcccacagaagctgcagcaggtt

SEQ ID NO: 100794 - DNA, 1020 bp, Homo sapiens
gctgcttttcaacttgctagatgaggttgtgactggaccagggcaaaagcttcctgagttagcccagctgatgggataactttgcagtgagcagctttggcctggctttgactgtataagacttcattctcccttatatcccgtggggtacttacttatttatagacaagcctctctctctgtttccaggacagctgagatgaggataagacaaatccaaaattcattaaatgacggtcccatggcaaatcctggcacaccttgtcactgtttctagacttttctgtaacaccgatctctagttgggctaaacattgtggtctggggagactgtaatttatgaaggactgatggccacagatcaaagccagcatcagaatccaggttcctagcactcagggtatgttaaaagggctgctccccatgtgactaaaatgtgaagtgagattccactcattctccttctgcatatcagtcctaggatgggagggaagtggagggaaggagaaggagagtctgatgcttcactgatctgctccgctagaccagggtctggcaaaagttttctgtaaagagccagacagtattttaggcttaactggccatatggtctcttggcaccaactactcaactctgtcactgtcatgtgaaagcagccatagactgtataaacaaatgggtgtggctgtgttccaacaaaactttattcaccaagacaggtggtgggctggatttggcctgagtggcacagtttgctgacccctgccctagaccaacaaagggaggggaggtatttgaattttcaagtcatgttctcctttatcctttgccttggaaatggctttccctgccaaagccacaaaaccatctaatttctaatcctctgaaaataggagagatcaacaaaagcatagtatttggagcctttccatggatgtgtgagcataagctgggtcacctagtcctcaacacagaagggaactgcatttgtttgtttgtttgtttgtttgtttgtttgt

SEQ ID NO: 100795 - DNA, 1910 bp, Homo sapiens
cattgatttgagcagacataatgtgggacgtaagttctagccgcagtcaagagttgtgggccactacccttcggctgttcttatttcatactcatgccatcctttctgcatgaacatttctgaatgcccacatattagtgtacctaagaacctctgaatactggcaaggaattaggggtgcacaccccagccctcaagattaattccatgcctgtgcatgtcttttggaactgctttattaatgggtttggagtctgccattctgcaagactggatcattatcaccttagtcctcacccctgggaagagctgccactgaaggatggtgtgtgtgtgtcagcaaccctgcctctgcttgctggagcctgctgggatcagttactcactgcagtcacctcctcagcttcacagtctgtctagattgtcattttcattcattgtgcttccccatccctccttagagtctagggaaaggcagcggaggggaaacaaagagtacaggagataggttcttatcccctttaacactttctgtgagctgagtcccatttttgagaatctttctgtgttaggttagatgctgagtgtgacttggcaagaacacggccacacggcaggaatgtgcaggtttctgtaatgaatggtcaggatgtcatgttctaagctacagaagggccaagtgttggttggcagagctggagtctgggagattgatgatgagcattatttaaactttgctctttgttcatctaattgaaatttacactgtgtttttggccttgcactgtgagaggtgtgcctggaattacctcatctccttatgttgtcacataccactttcttagttattattgagtttgttttgttatttgtatttaagttgtcatcagcttaattatgaactagctgtctcacattcttttgtaaaatgagatggggcatacataaatagacttgggagataaatgattattcccttataaatgggatcttagagcgggagagtaccttagtctctctgttgtcaccagttaggaactgtaactgtgaactgaaaccttcagtaattctgtgtttgtctccattttctttcagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaacaaaggcctgattgagagcttattctcatacttttgggtggtggggtccttgggtatatgacatgaggacttagttggaaatgctgttgatgccagcatatttctccaggcctttcttggtccttcttgccccttgctcctaacagaactgagaactgcctggaaaggccagcttccttttttcttctccagcagtgagcaccagctgtctgcataggagccctgttggtatctgaaggccccatttggacctctaggggtccaaggggataggtttttatcccctttaacattttctgtgagctgagtcccatttttgagaatctttctgtgttaggttagatactgagtgtgacttggcaagaacacagctaaacaacaggaatgtgcaggtggactgcagctaggacctctgctcaaggctcttgtcttggggccaggcatggaggctcacgtccgtaatcccagcactttggaaggccgaggcagggggatcac

SEQ ID NO: 100796 - DNA, 1780 bp, Homo sapiens
tcaaaacccttcagtggctttacattttactcaatcaaattggaggtatcagggtccgcccccactcctctctgatcatacctccttccaccctccctcctgatcacttctctgcctgtactggcctcatttccccaccctggggcctccacacttgcttttttccctgcctggaacgtgtttccctcagatacacaaatggctccctctctcacttcttatctcttccactccattcccgtctctgttcttcagagagagccttctcatcacaaaataaaatgatgcccttaagttttttccaaaatgcttatcactacctggcatatcacatctcgacgtgttcattgtctgcttccatcctgagcatgtagaggctccaagaaagcaggggtttgtctgttttgctcattcttcagtgcttggtattcaagaaatatttgttgaatggatgactacatgaataaataaacaacaaaacctgaaacgtagcagcctttagtaaatgtatgttgatttgagatttttgttgaagtgcttccctttgcatttatttatttttctcaactttatgtttggaaaacatcagatacacagaaaagttgaaagaatggttcattgactgaccatatgttcccaacttagattcaagagttgttaacatttcacaattcctgtatatattcttgggtgtgtgtgtgtgtgttcaagttaaaagtcagttacaggctgggtgaggtggctcacacctgcaatcccagcactttgggaggctgaggcgggcagatcacctgaggtcaggagttcaagaccagcgtggccaacgtggtgaaaccctgtctctactaaaaatacaaaaatcatccaggtgtgttggcccacacctgtaatcccagctactcgggaggccaaggcaagagaatcacttgaacccaggaggccgaagttgcagtgatcatgccattgcactccagcctgggcgacagagtgagactccatctcataaataaataaataaataaataaataaatgtcagttacagaaatatgacactgaccctttgcatttacaagttggttctaaagagtggtgagtcagaagagacgtcaggcagcaagcgacttgggccatggcctctgacctagacttctcacctccggaggtgcccgagcccactttcctggagaacctgctacggtacggactcttcctgggagccatcttccagctcatctgtgtgctggccatcatcgtacccattcccaagtcccacgaggcggtgagtttttccctgggagcctcagctcctctgagtgccaggctgggttctgagtactaacagtaggtgccaccacaactgagatcagcagggtctacattgggcctttttgatttagtgtgcctctgaatttccacctggtgggttgaaccacatagctaatactttatttgttcatgtacccattaaggagatttttatttagtgcctactacatttcagactctgctgaagatgtagtgtctgcacctgaggagcatctagtccttgggaggaaggcagataacaaaaacatacctccatgtgctcccatgagaagtacagagtccagtgaggctatataacaagggggagagagacctgatcttaccctgggctgtgggccctgccgaggaggcagtgtttgagctgagactgaaggaatgagcaggcttctgccaggtgaaagtgggcaaggggcgaggacaacattccagggagagggcactgcacgtgcaagg

SEQ ID NO: 100797 - DNA, 1088 bp, Homo sapiens
ttaagtttgaaataatagcaaaatgttccgtgtgggaaaggaaaggcgagcaagaagttgggaatagagacctgacaattattttattaacagagcattatgatgcctgtaaacccagcacgtgggaggctgaggtgggcggatcacttgaggtcaggagttcaagaccagcctggccaacatggtgaaaccctgtctctactaaaaatgcaaaaactagccaggcgtggtagtgtgtacttataatcccagttgctagagaggctgaggcaggagaatcccttgaacccgggagatggaggttgcagtgagctgagattgtgccactgcactccagcctgggcgacagagcgagactccatctcaaaaaaaaaaaaaaggaaaccaaacaaatacagcattattacttgaaacccaagaatgagttgctgagttttgcaagggaaatgaagatccaggaaagacgtgaacttggagcatacccaacctgttgaagtagtttccgtgcaatgtagatagactgagaaggtgcgggtgctgtcctagaacccaagagcaggagcgccgcagggcctccggaagtggtgggaactgggacttactgctcctcactggcatgccctctgcctcccttcctgtctccctcctgtcttttgcttttctaactaggaccctgcttctctgcttgctggccctgtggtgagatgcagcacagccactaaacacaaccatgccttcctgctggtctcagttccagcatccccagggaaggaactgtggctgacccagcttgggacagctgtggccagtggaggggaggggagggttctgtggagtgacctctgagtgaggatgggaaggtccattcccacagggggactgctaggcagacaaagctggggtctccctttctctccctctctcaagtgacaggcagagcagtgggcaggagaccaggagagtgtggcctccctgaagtccaccgagtggttcatggagagcacatgtgacaccagttccctggagaggattggggaaagccagcctagtctgacaccaccactgtgttccagctgccgtccttcaga

SEQ ID NO: 100798 - DNA, 1027 bp, Homo sapiens
aggagggcaagccacagtgggtctgccccatagccagctcctcgcccacattttgtccagtccctggcacgaggtgatcggccagtcactgggtgcagctggcacttcctgggtgctttccacgtagttttgcctcctcacatcagccctgtaaggcgggtgtggctatttccatttcacaggtgagtaaaccaagacacagaaaggggaagtgagtttcacacaaggtcagttggctggaaagggaaggatcccaggttctacctgggcgtctgagaccccacaagctgctccctccccgtggggcttcctttattcttcactgagagccacgatgctccggggcagtcccacatccgtgtgggtggtaggtcccgggaatgacagtttccatctcttgtgtttctgtggcatgcttctttgctttcagatgtgatctccttttgctggcgtcaggcttgatccatctaagcaggactctcctttttatcacctcacaggaggctgaaccgtctgagcccagaagtgctgaggtgacgaggaagcccaaggctgctgttccttctgtgaacaagaggcccaagaaagagactaagaagaagcggtagaagaggaggcctgaggagctgggcgggcagggagagggtcttggggacagccctcctgggaatctacattgtgttcccccgcattccaggctcagggtctgaggaggctgtgacgccctatgaccgcagagatctagacagtcgtaacagtccccaggctccagctgggcaatccaccacttcctcttccttctgcttctgtgacggtttagagtcaagggggctgaaacacactgtgagcatagactgtattaggtttgttcagaagccgggtcagctcacagagtcacattttcttgcttagtcatgtgtccctccttgagttgccccctccttgtgggtttacactacatttgggagtcattgtctaatgctgacaagcacaccctctcccattatttgtgcactacagatctcct

SEQ ID NO: 100799 - DNA, 1051 bp, Homo sapiens
tggcggtgcatgcctgtaatcccagctacccaggaggctaaggcaggaaaatagctggaacccaggaggtggaggttgcagtgagccgagatcatgccactgcactccagcctaggtgacagatcgagacactgtctcaaaaaaaaaaaaaaaaaaaaaaggggacattaggcattagggaaaaactaaggaactccatagcaaatatggactttagttaataataatgtatcaatattggttcgttaattgtaacatactatactatcatggatattaataatcagggattccctagcaagcccacttgagaaaaaaaaaacttaatataacaataataataagggaaattgagtgtggggtatgtgccatgttctagagcaaaggactgaattttcggacagggaggaagttaagacacttgtctgtaaacatttccttctaaacccagggaaacttaggaccagagaatagaagtgacttgcccaaactcaaactgcaagtttatgacagagcctggactaagatcaagctttctcaatgtcacaagaattcagtaacagcctactgtatacaaggcaccagcctaggtcctcatcatggtgaaggctggtggggaggttcaaagatttgtccatgggtcaacacctccccaaggccaggtctccagggacacagactctgccctttgaaggctccaagccagaagaggaaacagaccctgaaacactatgagcaggagggccagagagcgacacactttggtatccaggagacccagccccactgcctgcaaccctgcaacctccctgtgccccactgagctgctcagtaaaatggaactaaggatggtgccaactgtcagtgatgctgagaggtacaacaaggaggtgaaatgtgagaccctgtgcattgtggacacccaataaacagtgattctttttatttttaagtgtgttctgagtgctacaggagttcgggggtggggagcatttgtcagtttgccttgataggggattctcggagagtttaccaaacgagggacatttag

SEQ ID NO: 100800 - DNA, 1042 bp, Homo sapiens
aatgtgtggggctgtgctcagtggttaatgccgtttgaaggtcaccactcaggcgccacctgctcaggtgctgctgtcaccatctcttccctgacgggggcacatttgttatgattaatgaatcaatacaatattgatacattattattatttaaaaaaatttcagaggcagcgtctcactctgttagccaggctggagtgcagtggtaccatcacggctcactgcagccttgacctcctgggctcaagcgatcctcctgcctcagcctcccaagtagctgggatacaggtgcacaccacgcctagctaattttttgttgttgttttttgtggagacaggggtctcactgtatacccaggctaatcttgaactcctagactcaagtgatcctcccacttcagcctcgatgctgggattacaaggcatgagccattgcacctggtctgatacattattataattgaagtccatgctttagtcagacttcctaagtctttccctaatgtcttttttctgccccaggatcatgtctcctctttgctctgatagtttttcagatttttcttttctgcctttgacacccatgttttggacgcccctcccggtgctggccgctgggggagaacaagctcatctgctcctggctcctgactcccatggggttggggatgcttctctagtgtcttgggtttcccaccttcggccagtttggcctcacttcctggaacacggatatatgcccatgcacacactcctgtgtgagccaggccttctgcatcagctgggtccccgctgctcctcagcacagaggcctcctgactgccccctccctgtcccctaatgtgaccgccactccatgtctccccaggccctgctctgctcaccaccctccgtggctcccaccacctccaggacagaagccacgcctggcactcagggatcctcaggttcccctaccacccttcccacctcacttccccgactccagcccaaccgccatgctgtgcttcgcaaacaccacctgcttctgcatggagttgc

SEQ ID NO: 100801 - DNA, 1009 bp, Homo sapiens
gacaagtaaaggttctgcaagcacagatgcagcttcccacctgaagccactgccgacttcaagggcctggctcagcggctgaggttctcaggaggatgtggccagcacaatggttccattattgagcgtttgaagcactctttatttttaactacccctctgggcttttgctaggctgtaacccctgccaggaaggctcagcccctgtccctggctacctcgccttgttcttcaaagtccagagtaaacgccaccttctccacaacatgcttcctgacacgccctgatggaggcacgtgctaagtccgttctgagtgtgtctgtccccaccctgagggcagtgaccaaggcctggcccatgcccagcacggagcaggcactgcccagttggccaggcagcacacactgacttgggacctacagacaagagttcaagttccagctcttcccttcagtgactatgtgaacctgccttctctgggcctcagtttactcatcagtaaaacgagggtaacaaccctggcaagttccaggattgtgcagttgggagttgctggtctggcctggtagataagtgactctttgtgcaaattattttgcttaaaacattctttgttggtaaagcagcaactcattgcttaattcctgcaaatcatcgttaatggacagcaagcatttattgactaccaactgtatatatggccccaggccagtcttagaacaccaacaggaaccacttcccaacccaaaagcacccagcagatgatagatgctattgacgtcaacattgctgagatggtgagtgctggttgtatagtcctctgtctccagaaacctcctcttccctccttccctcaacctgggtgggccaaagccacaactgagggcagggtggagggggtagggtgaggcctggccctccacgactggcagtgaacccacgagccagagttgtcccatgacatgggatcagaggtgctgcccacagcacacctagtgccctggtgac

SEQ ID NO: 100802 - DNA, 1029 bp, Homo sapiens
ccattgtgctggccacatcctcctgagaacctcagccgctgagccaggcccttgaagtcggcagtggcttcaggtgggaagctgcatctgtgcttgcagaacctttacttgtctaagttgcctcctctctgataagagcatgtagggtatgaatgagaaagagatttcacatgtgctgagcgggcatcacctcatttcatccttacatgcgtcttctgggggctgtgatatctttagcccactctgcaggttggcatactgaggcttcttacattatctgcaaagtggcagagttgagacttgaacctgggtctggtccaaaatctgtgcttttaagctctctgtcatcccagttctcgaaaagcccagaattttctgttgaactcctggggatgagtttagtgatgtgctcgtacatattgaataaccagctctctggaagaaaaaagaggcttgattggtagcgtattccgatgtccaaggggtaaatactcccactgtggctgacatggagctatcagtgtgacattcttgaatatggagttgggaagagatgagcacagttggttcttgcaagtaggtaagggccagctccagcgtgtcactgggtaaatgtccctgcctcccccccgagcccagtatggccagtaaaggcctttagacatgtctaaggaatggaagagggctgagaaacctgctcctccagctgggggcccgccctgagccctgggaagctgcggttaatctttaagccagccttgcaaacaagtgcggccatttcaccagcccaggctggcttctgctgttgactggctgtggcacctcaagcagcccctttcccctctagcctcagtttatcaccgcaagagctaccattcatctagcacaacctgaccatcctcacactggtcagttccaaccttcccaggaatcttctgtggccatgttcactccggttttacaggtgagggggctgggctgggaagctgatcgacttgtccaccccacagcagaggggcagctagccta

SEQ ID NO: 100803 - DNA, 1486 bp, Homo sapiens
aggggaagtgacttgaccaaggccctatagttggaagctggaatgaaagcccagacctcagagaccacagtctggctgtccctgcatccctccagtgatggggcagtggaggttcgcaagacaggactgcacacacagcagtgtcggaaaagactgctctgctgagggattgaatgaaagccacgaggcctttttggtgatgtggtgatgtggtctttccacccaaggaaatgatttacagtgtgtcacctctctcagctgactgcctgcctaggccctcccgcgtgcccctgggcctttgctcctaaactgtgtccctcccagagtgccctctcctccaggtgctgcttatctgcccttgccccgccaggcttagcttaggcccctctcttctaggaggaaggcccgtggctctctctccctgtcccctagctcttgttggagcatgacttatccacagctcagcctggttcctgcttttgcttctctgattgtgaccaggggggtggggtggagggatgtctggctcccccaagccccaggaaccagagaggagatggctcagtgacctgttgagggaccttctgcccatctccgtggtcctcagctgaccccattttctcaaacctccccatgtataagcatttgtgacccctgtattgagcacctgctgcgtaccaggaacttggaactcgggctgagcagtattgtgctggggttagcagggagtgggagctgtgggagtcatggaggcttctagaaggtggcagggcctgagctgaggacgagcaagagttcacttggcaaagaaggggagagggagctcttttttcccttcccaggggccctgaggtggtggggtgtggtcagcctggttggatacttgctggggagctgggaacaggtccttggcctcccagaagtttgaatctggagggtgagcaaagttgcaaacaagttgccagttgagttactatataatcacagatatgataaggactcagggagagaggcctagggtacacaggaatcttgaagagggcatgtaggggttgaccaggcatggagttagggaaagggcttgccaggcagcaggaagtgcatgtgcaaaggccctgaggtatgtgccaagacgtgctgtcatggagaatcagtgggggaagctgtgaggctggagcgtgcacaatgaaggggagtgggtaagaggtagaatgagggggtgtatcagcagggctggaccatgctggggccttgtgggccctggggaggagtttggccttcattgtcacacagggggctgatcggtgtcccctgtgtgaacagccccaagctggaggccagaggtacagagctgaccaatagaaatagatctgatgatagacctagatctgtaggctggactccaaaattttatggaggcctagatcaggtctcaagaggagcgggtatttgaggctgggctttggaagtggagtaggagttcact

SEQ ID NO: 100804 - DNA, 1020 bp, Homo sapiens
agctggactctctgttatccaccggtgatatctgggccttgtgatgggtgctgggaaccctgaggatgtacttgggacatagcttatattctgggggagccagagagactccagtcatttccctatggcacgatggggtaggggccatatgaactatggcaacccagcacaatgccaggagagcttcccggaggaggtgatacctggcctggatcttaaaggatgagcaggagctcatgagaaaaaaaagaagggtgagggtgggccgggaagaagggaccgtgtgcaaaaatgtctgggggtaggaagtagccaggcggtgtggatagccatggaggtggggagcagcaggccaggtacaagggggttagaaggtggcttggctgatcaggcagagcctcaaaccctcacagggcactcaggcttgggcctgggggtgatgagagcagagcaggttgaggccagactcttgctgcaggtgtggaggacagagaaggatcagaccggcctcagaggctcaattacttttgccaagtaaaggcagcccacagggttcaagacagggatctaaaacctctccctggggcaaaaggtaggggctgacctggggccttggagggagtgggtcagggaagacttcctgggggaggaggtaccctgacttaccggaaggatgggagggacctctgaggggagatagagcttgacaaagggcctgaaggtgccctgtgagcagctcctcttggaggtctgaggagccatggagtcttgacttgggtcagttggctggtgccaatgggtagagggcctgggggcctgctcctcgggcagtgaggaagggctactggatgagagtaatgtatcccacattctgggtagtgtctgggtcagggtcagtgtggcttcagtgaggtggccctggtggccgcactgagaacagatgggcctggagagaagcaggcactggcaggggaaatggccaggtctgggatggacaggggagtggtggggggcagggtg

SEQ ID NO: 100805 - DNA, 1106 bp, Homo sapiens
ttggggtctcttatcaggccactctcagctctcattctttgtaatggctgcactgctgtccacttgaggactggagcccctttatttaaccagcccctctctgaggaacacgtaggttgttaatggctttctgtggagagttttaagcggaggaggcccagttgtctgtgaggtttacagagccgcctctggctgcggggggagggtggactggaggggcccacactgctgtgtccaggcctaggatcacagggccctggcctgaaggactggagatagacagggtggaggggaggaatgcgcttgaggaagattcaggaactaccccggggctccccaagggcagagccccacacagggcttggcacgtggcaggtgctctgcgaatacctggagaatgactggggtgggatgtgcaggggttgtcgctgagtcagtgatggggatgggggtgggggggagatgcaggcttagcgggaggtactaggccacttggggacctgctgagctcaaggcactgggaacgccgagggaaaagttcttatagcagcaactcggcacctctcgagggagcgagccatagtgcaggccccctgtctgctgaggagtccagagcccacggtgaggagtggcttcccgaaggaaaggggccacctttccctgggaacctcaggcagccccattgtggggcccccactgcttccccttgacccccgcaagggtctatctctaccttggaggctgcaagtggcggaagagatgaggggggttggcccctctccaaggagcaactcatggtgactcggcagttgggccccagaaccaggaagtgcaaggatagagctctgtgccagggaggagggtggtctctcatgaggtcccacggcatggaagcagccctccgagactaactcccaccctcactgagtcatcgagtgaagagccgtgtagctttcgagaccagcccagccgacatggtggaaccccgtgtctactaaaaataccagaattagccgggagtggtggcactcacctgtaatcccagctactcaggaggctgaggcagtagaattgcttgaacctgggaggcgaagggtgcagtgagc

SEQ ID NO: 100806 - DNA, 1031 bp, Homo sapiens
gtagctgggactacaggcgcgtgccaccatgcccggctaatttttttttttttttcaagtagagcccgggtttccgcgtgttggcccggcaggtctcaaactcctgatctcaagtgatccgcccgcttcggcctcccaaagtgctgggattacaggcgtgagccaccgcgcccggccctgctgcctctccttgggcctcgttttccctatctgtggaatgggtgggagggaggccggccaaggggccccggcagccctgcctgttccagtgtcttctctctctcctgccaggaccatgggtagcaacaagagcaagcccaaggatgccagccagcggcgccgcagcctggagcccgccgagaacgtgcacggcgctggcgggggcgctttccccgcctcgcagacccccagcaagccagcctcggccgacggccaccgcggccccagcgcggccttcgcccccgcggccgccgagcccaagctgttcggaggcttcaactcctcggacaccgtcacctccccgcagagggcgggcccgctggccggtcagtgcgcgggcggcgcggggtcctcgcccacctggggccacggcggggaggcggcggggctgtgtgcccggggtcgccccctctgcgcaggcccttcctctcgccaggggtagcgcccctgggtgacttgggtgtccggggggtgggggggcggccgtacacactgtgaagcgtccgcgccgccgccgctggctttggggtggagcaagcgcaaaagacacggggtgtggttaatgggttctaattggacgcttaagcccaagaagaagaagggcggcgcgggaccgggcctgttgctgccttggcgcccagtcctttttcgttgcctgggtccgcccagagatgagtcgggacgcgcggcccacgtgcggcggaggggcagctgggtcgctcggggaacggggcaccggatggccccggttgggcccgcgccaggatgcgcccctgcgccctctgctggcgctctgcggtcaccgcagcccc

SEQ ID NO: 100807 - DNA, 1052 bp, Homo sapiens
cctctcctcactccctgtggaccccgtccctgtccccttggttgctttggatgtgaggcctctgtggctgccccctcgtcccctgtccccagcaccgcctggctctcccgctctctcccctgctctttctgccactctccgcctctcaccacccccatctctgcctcttctctcctgttgggctctcgctctctcctccctcctctgtgtctctggacccccgctccagccagacctggttcacattcagatggctgcaaaggtacttccgcccctccccgctcccgcccaggcccaggggacccgaccacgccgggagctcttcctgccccatccccatcacaccccccactccttctcctcactttcgcatagaagtgccctgggcattggggctctgccacctcaccccctctgacagggctcactgtgtgactttgggcaagtcccagccccctctggcctcagtttccccctgcagatgggtaggctggaggaggaggcctgtagttttcagccgaggagccctttaggtgtgacccgtgatttgggacagaggcaagccttgctctagtttgcagggttggggcctggatggtcactgggtcccagcagggcccctgcttgcctccacccaggtctcaccagctcccaggagcgggcttccaaatctcagagcatggggacactttgtaggtctcacttgactttctctcagccaggaatctcttctattacaaccttacttgcccgcagagacagggggttccctccctccctcccaaggcagctctcggcatcttgagatgtcttggtacatctgaaaggaagtgaatttcttcctgtcccgggactcctcccctatggatttgagcctcagatgaccaaggccagtcctgccctggtccaagacaaagtccatctgatccagctttggcaaaaaggcgtctgcgccagggaggggaggagttccaggccagctggacctggcatgctgtggggactcacgctggccccaccacctccctgggcctccctcagccactagagcc

SEQ ID NO: 100808 - DNA, 1056 bp, Homo sapiens
ggtggcctactactccagtgagccagcctcggagggcggagggcgggcgggcaaagcctcagctgcagactctggggaggggccttggagcctagaagggtggggacttctgttatcctgcttctctccccacttccccctcccccctcccttcctctctcctcccttttccctcctttccttgtctccttcttcttcctcttctttcccccagcccccctcctccctgtccccctctctccctgctccacgcagtgtcccactgcccgcctttctctgcagctggctggtatggagggggctgccctgaggagccccagagtaagctggaagggaggggacagaggctggtgtcatttgtctctgtagccctaggaccggtctgaaccggttgctgggagaggaggagggggcggccagatcgattgcagcaaagagggaagagagcggcagagggagctcgcggggcttgcgtgctgggtgagggctcgggcgtgggcgcagtgctgtagcccacccacctgggcatccgaagctgactgcagtgtcgggcctgtgggtgcctgtgtgcccgtgtgtctgtggcacacatggcctctgtgcacaggtgttggtccactccccaccccgagcctcctcctcctctcagcttggcctcctgacttcctctgggatcacccgccactctctgtctcttcggccaccgctgtgtagctcattctgaacccctttccctcagatcagaactctccaggggctgtcttggaatcttgggataaagacccccaccggcccctgagtggtctaatcctaactgcctccccacctccgcctggtgccacccttccccacctgctccctgcgcccctttgtcctccgcttctccagccctgcagctgttctttcctcagagcctttgctctggctgtgcccctgcctggagggctcttccctacttaacccctcaccgtcctgcacatccaagctcagttgctgcttcctccaggaagccttccaggccactcctgctgttgcgcgaacagctctccagtcaca

SEQ ID NO: 100809 - DNA, 1035 bp, Homo sapiens
ctgcctcccaggctcaaaccattctcctgcctcagcctcccgagtatccagtattacaggcacgcaccactaccacctagctaatttttgtatttttagtggagacagggtttcaccatgttggccaggctggtcttgaactcctgacctcaaatgatccacccgcctcggccccctaaagtgctgggattacaggcgtgagccaccacgcccagcctggacattcttaataatcacagtcccgacaacagctactggttcttgagcatttaatcctagtaacagtgccatgaggagcaccctgtcattgtacccattgtacagatggggagactgaggctcagaaagggcccaggctttgactgggtttgtcacatggctgtggaggccacagctgacactggcgcccaggtgggcagatcctggatccctgtgtggtaggagttggggggctccactgagtcagcctgcatccctcctcaacagggacctggaacggtaccaccagggtggccatcaaaaccctgaagcctggcacgatgtctccagaggccttcctgcaggaggcccaggtcatgaagaagctgaggcatgagaagctggtgcagttgtatgctgtggtttcagaggagcccatttacatcgtcacggagtacatgagcaagggtgagtcctgggcggccggggcagggggcaggggcactccggacagggcagggagcatgagcctcatttcctctcatgtctagaatgggcatcttcaaaggtggaatgcagtagagccaaattctctgttgcctgggccggagtgtggtggtgcaatcatagctcacttcagcctcaaccttccaggctcaagcagttctcccacctcagccacccaagtagctgggaccacaggtgtgtgtcaccaggcccagctaattttttattttttgtagagatgggaccctatgttgcccaggctggtctcgaactcttgggctcaaggagtcctcccacttccacctcccaaagtgctgggattacaggtgt

SEQ ID NO: 100810 - DNA, 1050 bp, Homo sapiens
ggatcctgctgactgagctcaccacaaagggacgggtgccctaccctggtaagaaggtcctcatggcctgtctgtggtccctgaatccctctgccctggtggccttgggcaagtcatgactcctgctgggcctgtttccccacccgtaaaacaaagaagttgagcgtctgatgttaggctctctcgatggtccatgctctcagcttcggggacaggacttatctatggtcactcccaacctgtcctaggcaggaagccctcgctgccctccccatcagcttcccccaccccactttcctcaccggagccgggctccccatgcctcgctctgcccacagggatggtgaaccgcgaggtgctggaccaggtggagcggggctaccggatgccctgcccgccggagtgtcccgagtccctgcacgacctcatgtgccagtgctggcggaaggagcctgaggagcggcccaccttcgagtacctgcaggccttcctggaggactacttcacgtccaccgagccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctagggtggcctgagagggcggtgggtatgcgagaccagcacggtgactctgtccagctcccgctgtggccgcacgcctctccctgcactccctcctggagctctgtgggtctctggaagaggaaccaggagaagggctggggccggggctgagggtgcccttttccagcctcagcctactccgctcactgaactccttccccacttctgtgccacccccggtctatgtcgagagctggccaaagagcctttccaaagaggagcgatgggcccctggccccgcctgcctgccaccctgccccttgccatccattctggaaacacctgtaggcagagg

SEQ ID NO: 100811 - DNA, 1913 bp, Homo sapiens
cttggaacccggtgctccctctgtcatcctcaggaaccaacaattcgtcggaggcatcatggaaagactgggacagcccaggaaacaaggggtctgaggatgcattcgagatggcagattcccactgccgctgcccgctcagcccagctgttgggaacagcatggaggcagatgtggggctgagctggggaatcagggtaaaaggtgcaggtgtggagagagaggcttcaatcggcttgtgggtgatgtttgaccttcagagccagccggctatgaaagggagcgagcccctcggctctggaggcaatcaagcagacatagaagagccaagagtccaggaggccctggtcctggcctccttccccgtactttgtcccgtggcatttcaattcctggccctgttctcctccccaagtcggcaccctttaactcatgaggagggaaaagagtgcctaagcgggggtgaaagaggacgtgttacccactgccatgcaccaggactggctgtgtaaccttgggtggcccctgctgtctctctgggctgcagagtctgccccacatgtggccatggcctctgcaactgctcagctctggtccaggccctgtggcaggacacacatggtgagcctagccctgggacatcaggagactgggctctggctctgttcggcctttgggtgtgtggtggattctccctgggcctcagtgtgcccatctgtaaaggggcagctgacagtttgtggcatcttgccaagggtccctgtgtgtgtgtatgtgtgtgcatgtgtgcgtgtctccatgtgcgtccatatttaacatgtaaaaatgtcccccccgctccgtcccccaaacatgttgtacatttcaccatggccccctcatcatagcaataacattcccactgccaggggttcttgagccagccaggccctgccagtggggaaggaggccaagcagtgcctgcctatgaaatttcaacttttcctttcatacgtctttattacccaagtcttctcccgtccattccagtcaaatctgggctcactcaccccagcgagctctcaaatccctctccaactgcctaaggccctttgtgtaaggtgtcttaatactgtcctttttttttttttaacagtgttttgtagatttcagatgactatgcagaggcctgggggacccctggctctgggccgggcctggggctccgaaattccaaggcccagacttgcggggggtgggggggtatccagaattggttgtaaatactttgcatattgtctgattaaacacaaacagacctcagaatctgatcaacagtttattgaacatctactgtgtgctggaaagcgagatggggcggaatgcgagaacaaactaccccttgaggggtctttgggcagcactagtagctggagggcttcaggccaaggcaggggtgacatcagattggagacagctacggcagaatgtggctgtttgtgaacatctgcacctgtgttagggggtgagcacctgggagaaggacaaggcacatcacaggacttccctgagcatgacaagttcaggactcaaatgtccgtggtggatggtagcagtgacattggggagtgggtggggctgtcaagcctgcctagaggagatcacaaatacacgacgagaataccgttgtgtgtgctcttcgtgtgtttcctaggagtgcagggcaggggtgctgggtcgatccacaaaagtcctgaaaacgctgaagaaaaatccaaagacccttcccctcctccctccttccccaccaccgaagcacacagtcttgaaggttgatttgcaaccgtctatacaaacacatttattttacacaaatatacatcagatcacacacctgtgcaccggagtcaactctggccacgacattgcttaat

SEQ ID NO: 100812 - DNA, 1115 bp, Homo sapiens
ctcttcccaaaacactcgtctcggagcagctgctcccgcctgtgtgtgtgtgtgtgtgtgtgtgagagagagagagagagagaatgtgcatgtgtgtgtgtgtgtgtgtgtgtgtgtgtgtgtgtggagggtcacagcagcccctccctggccccctttctgcagggcttggcttttgtgttcattctgagtcccttgcacttgtccctcagttcaatcaacacctctacatctctcctgtgtactgggctgtgtgtgtgtgtgtgtgtgtctccacttctccctccttcccacctgttctcgccagtctctaaggcactctgaaatctgccctggctgtatgtgtgtgggttcacagggcgaggtctgtgcacgtgaaccagtatgtgacaagctgtcagggcatcatctctgccactgtacctaatccttcactctcaccctggggtaatttcctttgtactttcctttggtccacacatgcagaacagctcttgtgagttgtgcacacaggtgtgtgtgtgtgtgtgcgcgcgcgcgcgtgtgtgtgtggtgtagggggagagacagagagacagatctcctcttccctttgctctctctggctgcatcttgacctttgcacacctgcccggatccatctctctctccacttctcctaaacctctccttgtctctttctgcatcatctctgaggctttgctttccctctgcagatgagagagggtgctctgtccatccatccatctatccatctgtctgtctgtccaagagttatttgtgggcccttttctacctccccacccctttcctgggcctgcactcttgtcacccgcccccctgcaccctcctgcggggccatttcagcgcccaccctcttcacctctccatctccatccctccccgcttgtgggttctggaccgggacctgagaacaaagctgcctcctgggccccacacccatcacccggccccaaacccttcaaggcccgttgggcttggcatcctgtttggctccttccctcatcagggggcctcatgcagcctcactccacttccagcaggtcacccctgccgggccattcccctgccactctcttatgcccccctctagc

SEQ ID NO: 100813 - DNA, 1077 bp, Homo sapiens
aggctggctctcaccctgggcatgtgccggcctgtccgtctccatgccagctctggccgcctcctcctgcccctggcatccccccattcccttctgccaactccctttgctccacacataagctgccaacatcggggtctctagccaggatctccgagccgagcccagacctgtccactcatcacggtccatctcttccgctgcagagcaacccccagcccccttcaagcccctaccccatccctcccctccacatcctgagctgtcttgctgtccgtacctccttctaactcactccagctgcgatttgtgcctgacctcccgcatggctctcaccagcacctcgcctacctccctgcagacatgaccttgtcctcatcttcctcaacttttctggcatctgactgtagacacattggtcccctaagcctgccctgcttccagaggactccttctccgagccttggccttctaacatactgttgttccttgtcctcttctcccttcccaccacgcctggtgactgtccccactctggggctcagctccccctttgtagggaccaccccacctccatcccctgagttccagccctccctgcatacaaccttccggacattccatgggcacctcacgatggactcacacacccctctttgccaaagcctggggtgtcccgcctcatatgcccactacctggcagcacccagctcagaccctgggctggtccgcttcccctccccgcccacgtccggtccatgtggtcccccaatgggtctcgccccgtcccttccccagcaccttgccttgggattcatgtcccctcctgggctgtgctctagtcccctccttggagtctctgtcacctgtcacctcctgcagtgcagcagcccgtgcagtgctctggcctgcacttggctcacagcaggcaaatttggtcgtgcctttggtagatgctccctgacccagcacccacagggggcggacttagggatacggaggcagatccgcggccctggtccctggtctggtggggagactccagtggagtgtgctgggccgcgggccgtaggctca

SEQ ID NO: 100814 - DNA, 1032 bp, Homo sapiens
ttcctcactgtttcaataaccacacaaatactgatgattccagggtctctatctcttgcctaacttttatcctgagcctctgattagccatttcctggaggtttctaccccgaggtccctcaggcacctactgctccacctggaccaagtggactcagcgtcatcccctacacatgctccttctctgtctggggtccttgtgctggtaaagaagactgccatgtgccctaccatggagggcaccccacatcactcttaattctgtgttgtttacttccactagtacttctcattggggtggtcatttgccaagcccttcttgtgtcccctcaatcactgtttgtttcttggttctctgtcttctctattctgaattctgtggccattcttgataacttcaatgccaacatggatggcgtagccaacactgtgatctggacctcccaggtgcccaaaatattgtcctttgttcaactgcagctatgtcacatctttggtcttgccatacaatgacagtgccaactctgaaatctcaattttgagccatcccactccccagcattcatctgctgccattccacctcatttgcttgagcacgtctttgatcaaaacaagactttggaagtcaatccccaactattctttctttagcccctctaattagccttccatccccactttgctgctggcattgctcttggcaggatcaacagtgacctccatcttgtcctatccagcggtcactcctcaggcctcgtcttctttgtcccatcagcagtgcctgatgaggttgatcacttcttcagtctcaaaacattcactcgtcttggccttcacgatacgacactcttgtacttttccttctcagtctctgttgctggatcctgttgcttccccaacctctaaatggcccccttctcttttgtacccacaccctctcctgatctctatcagctcactgggttgaaacaccatctatttgctgacgacttcctaactccagctctccctgaactcgactccactgccca

SEQ ID NO: 100815 - DNA, 1088 bp, Homo sapiens
ttttttcactcagtgttacatttttacaatatactcctattgctacacatagcttgcttttgcctttaatagctatgttgtattcattcccatgaatgtaccacattttatcttctgtaagctccatggacatttaattgcttctttttctttcctccatcatgagcagtgctgcagaaaccacattgcatgttcctttgtggtgggatatctctgggagtgattgggaaatggaatgttgggtcttaatatgtccacagttttagttttagcagatactaccactgtcctccatgatttctgtaccatttaagcttccagccagagggtatgagagggctgtaatccccacacccataggcggttgttttaaatatttgccaatctcatgggtgaaaaattgaatcctttttaaaatttgtattttcctgtttgcttgtgagattttcatatgtatattgagcatttgtattttctcttttctgaattgcctgttattttttctcattttaagcattaggttgtctttatcccactggcttgtggagttttgtaatataatctggatattgatcttttgtagatatgtgacaaatattttcttccagcttgtcattgcctttaactctttgtagaatcttttgttagaagttattagttttgacataatccaatttatcaatcttttcctttgatccttttttatacagataccatgtttagtccttccctactcctaagatttaaatatattatttcttcttttctaataattttataattttgtttttatttggttctttatgcatctggaatatattttgattatcatattgatatatgatctaacctttctccaaacgggcagccaattattgcagtatgaggggttgactagttcttcctttcccctctgacctgaagtaaaactccctgatattctgagtcaggtgtgtctgaagcccctgtttttcccaacaatccatttattcctttcagtacaagactgttttctttgctgtcccaccttttggtatctgtgaagtcaaatgccatgtttcgttgtgcttccttctcagctctcttag

SEQ ID NO: 100816 - DNA, 1021 bp, Homo sapiens
atttctgagctggctctggactgagatgacctaaggatagatgtgatagaagcagtccagaaggctatcacctagagtcctcccacctgtctgagtcagaggcaggagcaaagggcgagggtgggcaaggaaggaaaatgtgcatagctggcatcaagtaggaaagtgtatgtacctgtaccggttgggagctcaccaaagaagggtgagcatctcaacagggatagatgaagaaccagagatgcactcaaagaaggacaaggccagaaacgagttcgtgacattttaggaatgggtacaggaagagagtcctgctgaggagactgagaaggaggggccagaggagaagaccaaaaacatggggttcctagaagccagaggacagtttccaaaaggacagagtggccactggtgggccacatgcacagaggtcagtggaggctcaggcatctcctagacctggcctttggggacttttgtcacagcaactttggggcacggggcagaagctcctcttggtgtggggggaatgaactgggtctggctgagaaaggagggagggggagttggagcaggcagtgggtccaggaaggagctaattcttccaggagacatgggagggaggaagcagtacaagcccagttggaagggcagggcggggcagtgagaggggccctggagctctgggattaagtgtagaggtgaagggattagcagtgttggtgaaaagggacaaaagtaaattatgtacattttagcaagtaacctgatctccatgttctttgggaggccttttctctgccctctgggtactgactccagctctaattagcacgggtttgtctgcctcgtggctagggccatgtctttctcattttcttgtacctttcagcacctagcaacaggcagccagctaggtaggggcagaataattattttctgcttgaaatccagtgtctgaaatagagattcagaaatttttctttgtatcaaaaagactttgtgacaatatccagggagc

SEQ ID NO: 100817 - DNA, 2978 bp, Homo sapiens
gttgaaagaaagtatattaagacaatcaagtgtttaatcaaaggatcttttgcattaaaaaataaacttgaagtctcttgggtgcagaactgtcaaggatcttagcttagagccaaagaagacatggaagtgtctatgaggcaggaaagacagacaaagcccttcagtaattccatattgtttatgggcccaatcccttggcttggtcatcaaggccctgcacaacccttgaagataaggggcttagtctttgttccttgaccaagcacagaatttacctgaccaggcctggcatagtacctgctggttggctgacctggtggctagatgaataggtggttcaatcaattgctaagagtccctaagtaattgggtggcccagtctttcctagaaggaaaggaactctgtttgcctcccaaatctcttggcaactctgaagtgacagagattattttccagcctccagactagtattgtgaacaaagatatgcgagaagaaccttataaaagactgcccagcctggcatcctcgctgtggcagcagctcacatgtggtttaggagtagccccaccaggtggtagacaccctgtaaggtctggatgtaggtggactcctgggtcacttgtaagccaaggggattccctcttcttccctccctctacctttcccaccccctaaccctgcatatgggacttccccagctttcccgcttttatgaattcctccccataggctggcaggcaggtgagcttgcaggagtgcagatcgtgaactactgtttcacagagagttgaccgaagctctgctgagaggtttcttgacttgcccaagagttcacagctaggccaggctggcccttgattcctgaactctgatcacatcttagatggtcctctgccttgctcattttcccatttccatctcctcttcccctcctagatcatgagtgtcctctttagacagtctgagaactccctgcagccgggccccactgccacacacacccatatgagcccatcaccgggatttaagtcctttcatcctattccctcagaccattccagggaaaaactgtcctcagtccaacccccagactccagctacaatactgtgggggttagactactattcacagatggggtgggccatttggggggctgctttttggtggttggcttttggttttgtttgtttttacttactggccaaataggatccagttcttctttccaccctcagagccatttttatgaacgccatatggttccattttgtactgacaggaactggggaccacaggcacatagcacacaccacagctactgtgactaatagccctggcagctgtgccctcctaacagtctgggtgtgcagtatgagtgatgtccaaaaccagcaagattggattgggcctcccgatccctggtcgtgatgacaccactgcacctctagtcctgtctctccggtcccttgatctttcctatatccatctccttcttttaattcagatcatctcttgctgaacagttgcaccagatgtctctctgctttcaatcttgtctctttcaacccatcaaccaaatggccaccattggccatctttaccagcttaggtcatgttctgtggctcttggcttaacttcgtccttccctattgcctagaggatggcattctctctgttaatggagcagagcatttcacagcctggttccctacccctaggtgttcctgctctgcttctgcaggtgcccagccagaggagcccacctgtcctcccggaagagatggcccctttcacttgagattccaggagattgcccagggagaaggtgtggagggaggggttttgagaaggaatatgaagcctccagtggtgagcagtaccagcaagacaaccaagaagaggcagttgggttggtcagttaggaggtcttgtcatccatcttggggttggcagagcaatagagacagacatcacatcaccatgggaagagaagagaataagaggaagaagtggagatgagaggaacaggtcacctcttccaactatgaagggaaagaggtggatgagtggaagtgacccgtttggactggtctttttttatgtagctaatatttggcctgtgcttttctggatcaggccctgatgagcattttgtcaacaatatctccctgaaaccttaagagaacatcctagggttgacgtggttttgcccactatacagaagagcttcaaaagatgaaggcactttcccaagatggggggcagagctgggatttgtgtcccattctgttgcccttcagagcctcactttcaccactgtccttgtcttccctgtagtcatgaggggaagaaggaggtggagggctgcctgcagttagggagctggggcaaaggcaccagggaggctcccggtgctcagataggactggaagtctgggacacatcatttttcagagggggaagaggccagggaagagagaggctatttttaatagccaaatagatatgagcccattaaaaaccaggaggaaaggaataaaatgtttaataaaatctttaagtatctgagtggaggacctctctaagctgaaaagcaaggaaatgacaccaagaagagaaaggccaacagcgaacagggataagtgatggcctgtgtcccaagtggcctggagtggacggcactagatggacagataggggcttagccttggatagcaagcatgcaacgacccacccacccaaacctgggaggcttagcactcggcaggtgacctcatctgttctcaagccatcactgggaggtactcaataaatatttgctggggtgaaataactgaaatgggaaattagatcaaagaggaaaaataccagcattaagctattgatgatacaagaagtgtccaggtgccgtggctcacgcctataatcccagcactttgggaggccaaggcgggtggatcacctgaggcca

SEQ ID NO: 100818 - DNA, 1551 bp, Homo sapiens
tttttcattcaaaacttgccaaagatttgtctattttagaggtattttcaaagaaccaaacttttatcgatcatatctgctgggtaattttcttacctgattcttttatgcttttatctctgaattcttcttttctgtgtttctggatagatttcgtggttctgcaaagtcttgacaagctgaggagtcatacctggaaaggatggtttgttcaacaaacattgagaccctgtactaggcttgctggggatttcaggggcaagactcagacctgactcttcaggagctcatgattgtagcctagtgggaagacttaacaaaatagacaattgcaaattccaaaaacaaaacaaacaaaaaaaaggcttttgtgtccctactctcctgtggcgacacctggatgataaatgaagccaagattattgcttattttgctctccctcggaaagcagctttctgttttaggtcaagcccgcttaagagtcacaaacaggcctccctctgaaagatttgtggccctttccagcagggagcctgcagcccaccccttcccaaagtgactgccaaatcagcattctgtcaccccacagtgcttcctaccttgccaggcaaccaccccctcttcctgaactgccttttaggaaaatgaaaagtagataccttttctggaaaagagtaggggcagcaggccttagaaaaacacacaattacattggtcactgtggctcagtgtgaaacggttgcccacatggtacctagtgaccacaagacaccataaggcctaggtctgggcttctttaggaactggttcttaccctgctgtgggccccagtttccagagaggtaaaatgtggtctttggagcagacagtttttctagtcctaatatcctgggagttctttctcccaagatctagggtcttcctggacccatttgaggatgttagctgggctctgagtaggtggcagtgcactttcaggatggcatgggctttatgctttagtcagtgtaccatgtgagcccaggtatttcctctgtcaggaagcttccctggatttcttctccctggggatctacttgactggagcgtttcactcagccttctgttgagtgctactgctagtgttacgcagacttccccttctgtagcgactgagttcatgggctcctcttgtctcccaagggggcctgcattgtcagtcatttggctggtatttggcagaatcccatgcaggaataggccttgagactacagggtggacagttcctgccattagggagccctccaggctaatgggaaagggcacaacattgagcagataatgccagcgatacacaaccgtggactgtgtcagctgctagaagagaaggtctaagaggggacccaatgtaggcctggaaggattgactttcaggtggagacctgaagaacaaatataaaggtttgagcagtgaagtaatgaatgagatgttattattattttaccatctaatcaagcatctctgcttacagataaagagactgggatgaaagtaaaatgaaggaccacc

SEQ ID NO: 100819 - DNA, 5582 bp, Homo sapiens
gcccatccagcgtaggctggagaggcgggcgcgggcgcagcttgtccacgagtcagggcagctggagcttttccaactgtgctgagagctgcatggcggcaagctgattggacccacaacttaggtatacctcacttctcgcaatgggctgtgtccctggaggatttcgaaaagcgaatcctacccagtaaatgcagcattccaggaacaccttgaaggaaatatgcgattcctttggcaaaggattcctttagcagggaattcttcctgcaaagggagcttttagggtaaatgattttatgggcaaagcgctttcttctgatttatctctttttacaccaagcgcttttgcctcttttttattttttttattattatttttttttttgtaaagcaattgtccttttttggaagtgctttttttccccttctatttttctctcgaggggctttttcctctaatttttttctttaaagcgtttttgcccgatccatttttttccgttagctcccttgtctaatttttttctgcagtgcgtttttaatctaatgcatttttttctgccaagtgcttttctccgatttatttttcctgcaatgcgcgtttttctgttttcctgtgaactactttttctctaattcgttgtagggttttttttttttgcgaagtaatttttattttttctgagaagtgcctttttctaacttattttttgttccacccccgcaagcgctatatgtttttttaaataaaatttctccgcaatgcgcaattttttaaggtggaaaattttcactctgcgagctgtaaagtctttcaacacagtagtgccccgcctccctcctggggtcgagtccgggtgtagcgggtttttcttaccgcgtaggtcgctaaatgcctgggtgatcgtccgcagcggtcgcccgccgcgccccgagtctttgttccctggcaggcgcgggcgcactagggagggtcagcgcgaggaggacggcgcagggaatgggcagggggcgcgcggtgccggcagcggcacttgggcaggcaaggatcgcggcaatcggaataggacgggtccgggaagcggcaatcgcgacgcagtcttgcgggttctaggggcgcgagttgggaaccctctcccacccgaaaccccgtcagacttacctgcagcagcacgcggaagatgtaccagccgatgatgagcagttcagccgaggccgccgccactgccgccatggttccaagaatggtaggtgggtggtcgagaaagagggtttgccgagatccgctggtctcggagtccgctgttgggcgcactgccgcagccgcggtggccgcgccttaagtacccgcccgccacctaagtgcgcatgcgcgccttggggggtgtttatgaggaggggtggctgggggcgctcctcattcgccaggagaggaaaaaaataatccatctgctctttccataccgacccccgcctcctgagttccatcttagcccccttccagaagattccgccgtgcttgcttttggattttgctttaaaatggaggggtaccacgactctgggtagagtacagggcgagaatgggggtgcaggtctcttagtgtggcgcccttctccccagtccctggcctgcaaatttgagctcagtctccggtgccactccaaagcctaccttggggatggatggaaaaccgaaattagggaggggtcatctgccccatagagcaaaaaacgtggtgcccctttcagaagctttggcataataggcccgtgctcggcgctcttttcctgatactgaatgagttttaagcccaggtcctctgcttcatgagggtgcctgagcgcgtaacccgtctgattctttacatctctcttacggtagcgaggagatgagaatctgcggtggaggtcgctactgtagggagctgagccagagcactgcgctttgggcgcaaaagcagtagtcacccggtatctgtaggagggatacaggaaggattggcgcccttcgtatgcacggaaggaatgagctctacggagaagtggttggaatatgcttggggatagttttctgctggacaggtcgtttcgacctcagtcttccgctcccctcccccaagccctggtaggtcggccttagccagtggggttctttgtacccgttgcgctgtgcggctggatcaccgaacggggttacgctaccgctaccggagggttgtggctaccgcagccccgtttccaagtgaggcgggtcccttttagaccgccagtcttgtgggtccctcgcacagcgcggattttcgggcgggaagaccggaatgcggtttgtgagtgtggtccccgcgcaccggtagccagccgaaagcacctctttccagcaagctgcctggcccagggaccaactggcatttgcccctatgtggatagaaaattaattttcattaaaagctcccagaggtcaggttctatacagtgccagcagcagatggaggtgtaatgatccaaacgagttcagtttggacaaagtagcatagtgactttttttctacattgactttcggagaagttggcagattctggcaaagtgacgctgggctgtttgaaaaaggcaagcttagcctaggctgccatcttaaaatatttcgaggctgtagctgcctcaggatcctttgcctgtggtctggtggccggcagtgccccgctaacagctttaactctgcacttagtgcctgagcacctatggctgtgagagatgctagatacagaaccctgtccttaccacgtgggggcacagcagggagcccttggtcgtcctttggcaaccactgggcggtattgtgaggtctgggccccttgaggacgggctgcagccccaggaggcgatacatgatctctgctgggcagggcccaggcaaagccagcccactgtgtgaaaccgtgccaaagagccctctccccgatcccccaggagaagccccggggagacatcccaggaagcttcccgaattagtgacttggagaggagtagaactttcacgggtgggcagggaggaaagggcatttcacatttgctgttgttaaccatgatccattttcccaaataagtatacattctgttcctgttttttttttttttttctttttttttttttttttttgtctgtctgtctgttctttgtctgtttgtctgttgtgttgacttttctcttcaggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcacctaacggcctgccctgttagctttccaaggaagcagaagacgggaggggaggcattgacataggtcataaagcattggagtttcaaatcccgcagcctcgcgggtgtcacattcctgacggcgcctttttggcctgtgatgttttatccttacaatgtgaataatggcactgaccggtgcttttattgtaaagtcctatagtcgtgggtggtcttgtggttgtgtgtgttctgtccccatctaggtcctggctggccgcatgaccacccctctcgcctcattactgtgaggagtctgggtccatcctggtcagctgccccaatgtgacctggggcagataaaatgccagtctcattgtcacctctgtgacccctccttgtcagggtctccttccttcccagaatgttactgactcctcagtccctcttctggtttccctttatttctcttctacccttttccttttttggggagtacctgtccaagacagggctcatttttgcacttatctcgaatttgaagagattgctgacgcccgagagcctcgctttttcatccttctttccttgttcagcaggctagacagaaacatgtcttgactgttagttgtccacaaatcttcagtattttctccacttcatttttaagaaaggaagcaacagatagatgttgctctttcacctgggtgtctgggctcaagctttcccgcccagcctcacttcctttgcccttcctcctgcctttctcaactgtcccaaggagggggcctcattgtgtctcccgtgcatgctctgcagcattgaagtatggtgtgttcacgtagttctagcagtccccagctgagtgagtgggagagtacctgtgtgtttcgtaacggccttgatccccttgatagatgtttggatattttttggtgtgccctgtgtgtgtgtgtgtacaaatacatgtgtatattccttttaaagaagctttatcgaacgtggtctgattttgaggtttagcaatagctagctatatatggtaggtgccgctacagtttttatttagcatggggattgcagagtgaccagcacactggactccgaggtggttcagacaagacagaggggagcagtggccatcatcctcccgccaggagcttcttcgttcctgcgcatatagactgtacattatgaagaatacccaggaagactttgtgactgtcacttgctgctttttctgcgcttcagtaacaagtgttggcaaacgagactttctcctggcccctgcctgctggagatcagcatgcctgtcctttcagtctgatccatccatctctctcttgcctgaggggaaagagagatgggccaggcagagaacagaactggaggcagtccatctagggaatgggactgtgaggccatacttgtgaaacgtctggactgctattctagagcttttatttggtgtgttcgttgcacagctgtttgaaatgtttaataaagctttataaactttactttgtggttttatgtggctgcagtccatttgggtcgtggtgttggatttcggagttggtggggggcagggggaagcatggaggggctgagtctttggcgccagagtaccttagcctgaaaatttgatctgctttctggagagcagatggtggggatgggggagggggagcagggggcaggacaggcggtgaacaggagggagtctgaaagttttcagagatgagacatttgcgtttctcagctcccatggcttcttgcctgaaattgtttccctccataggagatttgagtaaccgatcccttgacaaacaacttaagacagctggagctctaatcatcaaggatttttatggtgctgcttttgaagtaaaaatagtgaaaccccttatggcatttcaagtggaaaaataaataagactggctgtccaa

SEQ ID NO: 100820 - DNA, 2178 bp, Homo sapiens
gaaaggaagcatgggggatgggggacagttgttttttccttcccctttccaaatctcctttagtttccttccaggcctccgtgtcccatttcatcgccgaatgttgggagactggggtctgtcctcggaaagaaacagcctttctgtttataggtttggatcgtctatccctttcagggaactggtgtgttggggacggcttctctgccctgcctgacatggtccagtcatcccgtcagccttctggacggcaacaccaaagctgggaccaaaaaaaagttccagcttaagtgctaatgccaagtgttagatcttgtttgcttgtttgttttaaatcagagactaattaatgtcaagcaaatctgttaaaagatttgatcacgggaagcctggtcggtttccagtgaccaggtcaattccatatctgaaattagtcttgttagagttgctgccaaaaacagtttaacctttaatctgtaatatgttgtttcaaagaggaatctgggttagactgtctttttttgttgttgttctcctatctttgaaacacatgcattccatttcaagcctgtccctgtgcgatataccaagaaccacgcgttgcctgcctctctgacttcctgctctggaaatgctcaggaatctggatcctgctggggcatgcatgggccctgtgggagggcaagtcggggaggggaggataaacaggatcactcccagggaagatggtgacaacgtgtctctggggcatatagaggaagtcagaggttaccggggggaaaagagattgttgtttgactagtgttttgtgtatgtgcatgagtgcacacgtttaaatctctgagggggggtgggggcggtgggggggggaagttaactgcaaattcagaatctccctttggggtgttggctcctgaggagatacacatttcaaaatagatatctagtaaatggctcacagcaaacctgctccccgatccaacagtaatccgttgcccaagctcaaggaacttgcccctgcccttccctgacagcagacatcccttccttcagtgacaattcaaatattccacagataaaggtaacagtgtcacatagcaccctgcacccctaaaagtcatggtacctaaacacctctggacttaacttcagttcgttaggctaagaaactaacatcctggagtattagtctcaagggtctctcacctgttgctggagtcccacagagctattcccaattccttcccaaccgatctgctctgtccttggccttgtgggggcaaagtcttctgggagcaatgatggtttaggcaaaggggacgttcagcactgtgactaagggctgtgcagtaaaacactagtcattttcaattcttcgcattgctctctatcagaataaaatgtttaatggtatagtttgtggaaaaaattttataaacaaggtgtgtttggaccatctaggcattgcatggcattgcactggatggaaagtgaatgcactgtcttctctggtgggttaagtttgctgccagaacatgaagttttgtgggtggaggatgcaaatggggagtggacattgcacattgaagcccacacgtgcaggtgcaggccaccagggcagcccttgcctggaaatctgtcatctcaccttgccacactcacagccctgctgatggacggatggaggaaaagggctttgccaagatgatatggaaagctctggggctaccaggagcctcttgtcctctaagtgggggcacaagaggtgctgtgtccagagcagccagctcttaccatgctgctttggcctacctccctgaaatctgctaccttgtcacttgggctgaggttagagcatcaagaagggcagtggggctatgggcatacccctcaaaagctccgaagggagggtcagccttcatggagaacacatgttggtatgttcatgattctgtgggtttagtgtggaaaaccacagaaactcccagttttgaggcctgccaagatatggggttcagaagggaggaggtgtgggcattgcctgctgatgagtcacactggggcgagaggagacctgcctcaccttcaggctatggtagcagctatagccacccagcctaagaaagatgaagtctcagattgcacatcctcttcaagtcctgatgagtcctgattgcc

SEQ ID NO: 100821 - DNA, 1415 bp, Homo sapiens
tatactgtttgtgtgtgttccaattttattacaacctttttttaaaaaatagaatcagggcctccctgtgttgtccaggctggtcttgaactcttggacttgagctatcctcctgcctcagtctcctaaagtgctgggattacaagcgtgagccactgtggctggccccagttttattacaatcttgatagtactagttcataatttattttttccactaatctactaggtatattaaatactagttcaaggttgctttattaagcattattttcttcttgtgtgagtttatcatttgtattattatgtgcctcataaggtagtcattgtaatttcgtaattgagtttttctgttatatgggttttttggttgttgttgttgtgtgtataagaaacattactgaaaatctgaaaactggtgctcagatacatccttcattctgtgaaggcctcatcccagtagccctaagaatatgattctaatcatgaagtcattttatataggctctttttgcatgtcagtttagtacattttgaagttactttttgttggaagtgtgactctaacagataaggaggaccagaacagatacagagctattctcattgataacatttcagactgtttttctctttcatctcatgagtgatttttttccttaagttcacttcctccctctgcgttcttctcatcatctctttcttctggcccattcttctcacacttacaaaacacattctatttatatgcctccttacacacactttttactaaactgtagacttagaggcaaggaccagcacctagcagagcatctcaactgtagttaatgtctaatacatggttgtttaatgattgaatgaactgggacatgcctttgtatatgccctggttgtttccccttctggaaagctcttgttctactatcttgttagcttgttggcctacatctctgtgctttcatgtcagacttcaagaaaattgggttcacaactgatacttcagttgcttaatcattttcctcttctttattatcatatcttgccactcttgctacaaaacctatattctttgctttttaactttttattttgaattttaaacttagaaaaaattataaaaatagtagagtttccgtatattcctcatccagcttcccctaaagctaacatctcatataaccattatgtaaagatcaaaactagggaattaacattcgtgtaatactagtaactaaactgcacacttaattcacatgccatcagagatgtctggtcatttttctgttccaggtttctatccaggatcccacataatgtttgtcatatttccttagtcttccgttatctttcatgttgaagagtactggtcagctattttgtagaatgtccaaaacctacattcttgaacttgt

SEQ ID NO: 100822 - DNA, 1215 bp, Homo sapiens
cccaacaacttggtgacaaaatcggggtcaggcagtgctgtgtccttgattatgcgtcctcttttccatgtgcaaaacatgtatttttcatcattttgtatggagagctttctaaaacatgaacattcttgcctttctcagtaggacacactgtgatctcaggagcatcattatgaatacatgttagttgtgcctgaattctctcatgaccttttgaaatctggaaagcttttacttctgcactgtggaatagtagggattttgagttcttgtgcctactttgtgtagtttacattcttttccttggtgtcagctgtcactccttagtgttattgtttgtttgatatgatatctaacctctaaggccttttttgcccattcttttaatggtgttttgaaaagttgaggttgttggaagaatgaagcattcgtattcttggtcatttttggatgaactgcaaaactttttagagctctgttgctagattccgaagtctgtgagatactagaaatcattttagcctgagtagtctatattttccatgttgcttttcctctagcatctctttgccccccccactgccatcctgggaactagagaacatctgagcaattactgttgtccactaatcatgagtctttcaagtgaaactaccactcacaaataggggcttaacctggccttctgtggggtgctcctttctttcatgatgcttatctttctggaaggtagccatttacctgtctgattgccttaaccctgtatcttttagtcagccttatatccatatacacacacccacaggcccgtgaaatctaattatatcgatcacctgagaccctgtatgtttgttcttcaccagtttatgcctctgctcacttcttgtcttgtgcctgactcttggctctctgtcataccctacctctgctttcgtctcctctccaacacacacaccagtttctttaggcttgatatgtacatgtgctctgtggctcccaacccagagtctattattaagggctctgcatggttgggatgggagctgccatatacagtgtgcctcatatggtgtgccctaccctagctggacctttaagacccaacctttggccctagcccattatctggcccatctgatcctcctgtgaaaggacagtttgagcaaaaccttgcttgagaagcttacagactttccagttctgcaactctgacag

SEQ ID NO: 100823 - DNA, 1031 bp, Homo sapiens
aaatgtgggcatcgtgccttttgttgagcgccctggcctggagagaatgaagaaagcatcccctcatggcctgaggacaatgcagctgaccctcagcacctggtaacttgtaggaagctttagaatctataaacttgatgtgcttctgcaaaacagttgcagatggtctgaagtgatgattaaatatcactgccactttgcccagatctgctatggccattctctccatgtctggttttacattacagtgggtaattaagggggcacaaccatttctagttacttccaggccatctttttcaattggcttatggggaaattacagttgctgtcagttgtgtaagtgactgcattgagcagcgattgtgaatggctactttttgtgttcaaaataatactaatacaaaacacccaaacttaaaaagaactgttcctaatgaaagggaataattgcctgcctctgctgtctctgctggatctccactgggagttctgccatcagacttgtcagagttggttggcagggactttttctcctgagttagcacatagagatatgaacgggcagagataacacaaattagcaaagatacaagcatatctgcagaggaacagatttccttccgaccagaagtgccgttggtgggcaccaccctaattttcagtgcatctcttagtgctgatgacaggacttttcagcaaattttttaaaaaatggcttaagcaccaccggacctgggcagtttttataagattttagagtttcaaagggctgctaagcttgccaatgtaaagtcactgaatattgtctccctggctgctcactggggatccttacacctcactcagcatgatgaacttggagacagaaattcgtaagcttcagccccattttttttgactgaagatttctttttccattcccacaaaacttgcaaggacacagaaggctcagtgggggaaaaagatggcatgtgcctctggctgacatgacttgtgccagtggttgcgtggggattccataatgaaga

SEQ ID NO: 100824 - DNA, 1030 bp, Homo sapiens
tgaattaaataaattattttttaaactaaaaaaaaggtggtggtaaattattgttttgaaaaacagaaaaatagttttcatttaagctggattaaggcccagacattgactacgagaatcttagaggtctaaatagtccagccaggagggtctgttgacagcagcatgacatataatttggactctgttgggacactttcagtgaatgtgtctttttctttttcactttagtgagtatatatatgctaatatatatagagccaaaaatctgtctttcattgatttaagtgccagctatgaacaaggcactcttaggtgctgagatatttgttagaagcaagggtcaaatcctaggatccctactcttgaagacctagctcatgatttagtagaggaaatagagacttattcacacatacattgtgtgctgggagagatctgatacagtgccgaggaagctcacaagttttactggagtatgtggaggactctcaagggaggtgacatttgagtgggggcttaagactgagtagcacttctctagctgcagtgaagggggatggaaggtgatctgccattttttgtagcactgtttgcacgtactctattctaaggcatccgttaataactgatggtgattcactcctgggtccctgcctgaatcttcttggattccattattgatttttcctatagcaaggcttccagaccctctgctatcccgctcatatattcccctgttggtagtgtctcttttaatgcacagtagctaactcacgactgtggagctagggtgaattgggttttatacttctaaaaagtgcacccttaatatgcattagctttaaaaataattaaagctggttatcctgttgactcattgaataactctgtgagagatcttgttgactttaaggtaccctgtgagtgttataaacccttaatcaacagtaacaatatcaaagcagcacaaccagttgggcatgacttggtctgcctgatccctgctagcttctggtggtacccccct

SEQ ID NO: 100825 - DNA, 1037 bp, Homo sapiens
gtgtgtagcacatcctccctcccttccctcctcaccagcttctgctcaatctgttagccctgcagcagcagttaattggcaggtataattcccatgtagggcaaggctggtactggaggattaggatagtagctgtcatgggtaagtggtttctagcctgggagacagaaatgtaatgtgggaccaacccgtctgttaagggacagggaaaaagagatcgctttgtaaaaatgacacatggaaggctacaagtccaggagttattttctcactgccactgaagtcccatttgatgaaaaacaagtgatgtttgcccctgtaaagtcacgtgaacttgtaaaatattattgtcctttttgtgctacatcatcagcattcatctttctgaaatctccctctggtttctgacgttgagctattggagatactgctgtggctgatgactaagactgataattcagttttcccccagtgttggagagaaattaaaggagggaaggccaaaccccggagaggctaggacttcggaaatcccatgagagctgtgttaacactaatgtggtttttctccagagtggggcaagatgttagctaagaaaagaaaaagtagcagatattgagcttacttgaaagtgatttaaccctttcctagaaatgttttgattattttagttaaattctagtggtatgttgggtacattgtgcctgttgctgataataaccataacagcttgcattcatgtagtttacaaagtagttttatgtacatcctttctttaggtcatctctatgaccttgagagataacaggtaacaatttcattcatccccttccttcccctcccctcccctcctcccttcctccattcctcagatcttcactgagtacctgctgtgtgccagacactggagagtctacttatgccagagaacaagtagacatgggctagcaatgggagtctttgcactggtttggggttggagagattatctgggcagatcctgccagatccttacgtagatcatgtgagggatttg

SEQ ID NO: 100826 - DNA, 1050 bp, Homo sapiens
caaggtagaaggaaacagacactttaaaagagatataataggagaagaaacagtaaataccaagttgggggctattgagggtgtcacagaaaagatagtagttgagctgggccttgaagattcatttttattaggcggaaaagaacacaggaaggcatgccaggcaatatgaggagcatgaacaaaggcacagaggtgtcagcgggcacagagtcttcatggcaacctagagaggccagcgtggtcaactatgttgtccctgtgctgtggatgagaaggcagagtggggagaatgtggttactgggcctagggccacagccctctttgatagtaggagtagctattaatagatcagggcccagcttatccagcattagagtcctatcaggttttgtactgatctccaccatacaggagcactgtgtgtgtgtgtgtgtgtgtgtgtgtgtgtgtgtgtgtaattacacaagtaatgcatgaatagattgtcattctgaaaataccagtggtacatgagtagagtgaaaaatgaaagttttccttcactactctgatccctttccattcctctgcctagaggaaccttgtgaacagttaattatgcaaatgtatttgtttctacttaaatcatactgtgcatattctgcaccttgattttttgggtcatctaacagatctgtccaggtggtacatgcatatctaccttgtgtttttttaattggtgcatagtatttcatggtttggaaataccatgacttatttaattattttctattaatggacatttgattattttaaaatcggcttttatgaaaaatgctatagtgaacctacttgtacatgtgtctttgtgtgcatatatttccataggatagatacctaaattttgaattcccagattgaagggtatgtacattttaatgatagctactgccaattttctcactgtatttttaaattctccccccagcagcagcatctcttttcttgtgttcttgcccacaatgcatgtgatcagtctttaacatctttgccatttgttttgttgt

SEQ ID NO: 100827 - DNA, 2112 bp, Homo sapiens
ctctgttccttttaggagatggacggtgtcttgtttgtctctagtgcctaccacagtacttgccttgctgtaggtgttcagtaaacatgagagagctcatgtagtccctgtcgtctttattacatccccattgcttgaacctaaggatacattatgaggaagctatgctgcgggtaatgatactggaaatttaagaaattcagtttacttctttgaacaccagtatttccttcgcccgcttggtagatacacgtctctcaatttggagcagagtttctgcaggttatgttcaccatctacatcttaggtaccttagtgttacagttcattaactgggtttaagacaatgtgattttatttaaaaaaatcggtagtgttttccattcagacaaaatgtatatactattttagttttaaaatctgagcatatgaaaattgaaattgtgcataaagaacttttttttttcatgtcgaaaagcagttaggaaactacattgtgttttaaccttgagttcttgaattctcactggtgcagtgtctttcgtaattctctagatcagcgaggtgaaattaagatgaaaattgctagagtgtattcggatgaaactttccggttgagatcagaaacattcaaatttattttcccatatatccaattgtcattttgatcgcatacccaaaaatgcctctcttcatttgactgcatttgagattcagttgacagttctccttatgcaccctccaatttgcactgcctgatctttctcctaaacaccacattgactagagtgtgctgtttccctagaaagtcctttaatagttcttctcttcatttttgcagggacagaattacttagtttactgattttcaacctttttggtctcaggatctccttgtactcttaaattattgaatatcccaaagtgcttagaaaattctggcaaatacaagaatagacaagcacacatttcattagccatcagggcagtgatgtcatcatgtcatggagcccttcagaaaactccattgtacactcctgaaagaatgagagtgaaaaaggcaaatggtgtcttagatttattataaaatagttttgatcttataattccctgaaaggatctccagccaccccgctaccccatcctggggtcctaggactacactttgagaactgctgatttacttggatggagggagcatcatgttcccccagcagtgattgcatttaggacttaccaatttctgtggctttcccagtgtttttgaactttgctggtcatttgctgatattcacccttgtggttgaaggagaatatcctgctggtctgaagcaaatgcacatgggcagcctaggaaaatattctctgtcatattagatggaatcgatgaccccatctcagcctgggttactgttttaatatgttgctctattgctttcccgtcacctctaactttatcctttcccccagctgtgagtcatctattgctgaaggtatgcctaattcctaaagacagttctctgcaaatagtagtgtgtgctttaaatgagtaggctcatgagtaggctgtgcttggtcaggcaaaacagaagacgactgttataacaaacttgagggtacatagattcattgagtacttgtatgtgccagctattattaggcactgtatatatattatctcttttaatcctcactataggaagataaggaaatcagggtctagcaataagttagttaatattctgtgtcttccttgatcaggttgggacaccacgctctgtgttccagtgacacttctcttggtagtaccaggcatgcttataattaatggtttgtaatagattatttatatttaatggaggccagaaactgggattattttatctgttatatcctcagtgcctaacacagtgactggcacctagtatgtgcctagtaaatatttgtcaattcactgttcatggccacacctctagtaaatagcatggctgggagtatgacccaggtcagtctcattcccaagtccagcatttctcacggtatcttgttactcacataacactggacccagtatatttttgtaatatttccctgcttgcagttttattctct

SEQ ID NO: 100828 - DNA, 1038 bp, Homo sapiens
aggaggaagagggagggcatttttggatacagaaaatcttatcttctttggtaaggggaataactggcccttgatctgaagtgggaagtaagagaaaccctttttggatgggtagtaggataactatgttcagggcaacagagtgaattgccacaccaaggggtaatggtggctaatctataggactggtggaaagatcgtttagtgctacaaaatgcttcgggagcctctgaaaggcagcttgtgactgcaagagtaagggaaccctgtaatgagatctgaatccaagattgatttttgtaatgaggaaatcgatttcccaaggaaattgtgtgacagtatgatgtttggatgagtgtacttcttggttggtctgttgtagacactttgacagattgccttgttgtctagattgttgctgtttgctcctcattgctgatagtgcccctttccttctaatgatgtcttgttttccctcctaggttcatggaatccgagctggacctaaatgacatcattcaggagatgcacgtggtggccaccatgccagacctgtaccaccttctggtggagctgaatgctgtacagtcgcttctcggcttgctcggacacgataatacagatatcctttcagatctgacctcagtaggagagctgacatggtggggaagtgctgttactctttctcctgtctctctttgtagatgtgtgctataaaatctgatgttctgtttccattctaattatcttctgtcttgaaacacacaatgctttttactcatttgaaaacctggtttttctctattaacaaatcttgcaaatcttgggcaatccttaaaattgtcctatttgctcttattagtactagaattcatcgtgatatatctgttcatacattaacagctttacttttcaggatctggattggaaggccccttatgggggcaaagccagacagatttgaatgtgtaaatctaggcatctttctgctgactgatggtccagtggagttgagactagagatagtgaaccatggta

SEQ ID NO: 100829 - DNA, 2004 bp, Homo sapiens
aaaaaaaaagactgagtacacagtaaatagcatttaatatttgttgagtgcatgttggacctaaacagacaatctaggtttgactctcaaccgcatttttgtgtgaaagacggtgcccttccacaacttgtattcttttttgcacagatagagttaataacttttgtctttcagtgttatttttatttttatttgtttttagagacagggtcttgctttgtcaccctgactgaagtgcagtggcataatcatagctcactacagcctcaaactcctaggcctaagtgatcctactccttagcctcctgaggagggactacaggtgcataccaccatgcctagctaattttttttttatttaattttttggagatggatcttgcaatgttgcccaggctggactcaatctcctggcctcaagtgattttgcctcagcctctggagtagctttccatgttactgagaggatcaaaggagtgtataagtgctgagcacagttcttgatacatagtaggtacttggtaaatgttacttgtcactgaatctgattcgtgacttccaaaaccattttatactttatcttggctatcaggtgtgcagtagctttattgcaaaggcttttgatgtgcctgtggacagggttatgttcattaaaccaaattctcttctagtagttgttctgtttgaatccagatttccaaaggtaagagacaaatgtagttagtctgcttgagtgatattcacagggaatctgctgttgcttcatgttattttcatctttctggtaatctctctcctgagagcgtgtctgactaagttcttgcctggctgataattctcatagaaataaatcagtgagtaattttaatgcaggcttcttgaagggcagtcttaagacatttctgatgcttcatgtaatgttagatagcatcaagaattgatctgttagctcccagatttatgactttgttcaccagggtttgctgtggggttctgggttgtataagaaccctagttagcttgctgctgagtgagctcagtgtatggtctcatgaaattcattcagtagagctgctgtgagtgctcatgatgtaccaggcactgtgctaggcccttaggaaccataagctgtgctggttgctcaagcagcatcagtcagtaagtatatattgggtattgtcttggtctatttgggctgctataacaaaataccgtaaactgggtggcttataaacaacaaaaatttatttctcacagttctggagactgggaagttcaagaccaaggcaccagcagttttggtgtctggtgagggtctgcttccaggtttgtagatagctgttttctcactgcgtcctcacatggtggaaggagtgagggagctcgctgtgtctctttttaggacactaatcccaagggccccacctccaagtaccatcacattggggataggcttcaacatatgaatctgtggggggatataaacattccatctttggcaggtaactgccatatgcctagctctattctgggcactaatggtgttcacagactcagtgactacgagttctggttgttacttcacatttcagttcacctacagaagggtagatttcagaatctgatcagaccttagagaggacttagctcagtaccttgtttgtttctacttagtgacaagtgtgaagtccagatgttggacagctaacttgaagttaagacaggcactccaggtctgtgattttcagtccggtgttcctccagtgcacctcaggtcttcctgtgggatttacgacattgctgacagagtcgcatggtcacctgttaccctgtatattattagtacagaaatgacttattttctttctggaaacaccactctcattcttttttctattcctgctaactcaaaataatagtagctgcttttggaagatactgacattttgctgattcaccagcctggctcctgccggggagaagactgacacaaaaaacgctgct

SEQ ID NO: 100830 - DNA, 1038 bp, Homo sapiens
gggtaaatatcacctttaagagtgaaggagtaagacacagaaagcatagttaattattcgtgatggtcagctggtcagttagagatgagtaaagcaaaccttcaagtaatttttctttcagcaaaagacctgcatgtaatacccagaacatcagtcatcagctagcaagtcctgtcattcttgttcttatattctgcatcttttattttttcttttaagtgaaactgccctgattctgacctttgttgaatcttctggattctgttgtatgtagtagctttggaataggtctttctccttcaggcctggctcccacaactacccacacatgctgtccacatggtggctcctgtgtgccacccccgtccctcatgctcaccgtgctttagtgcgtcctgcacacagcttttagcttattctttccaaatactattttcttcagctagttacaattttctctcccttttccacttccttcccctctcctccaatcctttcttctcttcaaatgcctttgtacattccagtctctctgcttttattcctttggttttgctttctagtctccctgtcctcatatttttagttgcctgttttctgagcagtcttcttctagcaagtcataactaattccccagctccatctgattgctccttttcaggacgcctgcagttcatattgtctgtgtgtattcttcatttgttacatgttggttatgtcctgtggtgtatggtttttaaaattgttttagattatctatctttctcattttacagatgaggaaactgaggcccagaatgaagaatggattggcctttatcatgttcagtactttagtcatcatgggcattcaataaatgcagtttgctggagcaaggtgtctgtttctctctctctctctctctctcccccgttgtgtgtgtgtgcacccgtgtgtgtatgtgtgtgtgtgtgtctgtgtgtgtgtgtgagagagagagagagggagttttaaggtgagggaaaggaaacttataagtttagttctgccacccagt

SEQ ID NO: 100831 - DNA, 1200 bp, Homo sapiens
taaatttttccctttgttttcaaccaattatatcatgtcctgatctctgaagactccttggtgaacatcagccacctcttctcagaaattattactgccttcaaaggtgaactgtacaaggtagttaagattatactgagtttcaagaatttaaattatgagatgaggttgagggtgttggcctatttctcactggaagtgacttcccaggcgatctatttaaaattttgaaatctgtgaaaattcagtgaacctgtggactaagcagccaggaaggcagcataaggcaagagactgagtgagtcagttaacatttaatgaacacctgctgtgggtagaaccttgttgaagagatgttaataaaactggagtctattaaaggtagatggtgataaagcaattgatgaggaaacggaagggaatcaaggattaagaaaaatactggtaccgtttcagtatgtgtgttatacccttaacatttttcacatgtgtccatagctgtggtcgatttgcttcaggaattaacagatatagacaccctccatgagagtgaagagggagcagaagtgctcatcgatgctctggtaagttgcacatcctctggggttttgcaggtttgtataagttgttggcattgccaccaccatcgtctcggagagtggccaccaggtggaactccacggcaaggctggagtgtggtgaggctggagtgaataaggagagtaaaaaagtagagatgtggctggggcagtgctttatgctttgggactgtgtcaggtagaggcctcgcccttattaagtctctgctgtgggcagggccatttctcattcttctcaccacatcctctcacatgggcattattgctattatttccatttacagccatgaagctgtgacttaggccaaacaaatggcccatggtcacacagccaggatttgaacctgtggtctcctagactctatgttttctgcccctttcttccctcctctcttttgttgctactgacctttttacaaagagctttcacaaatgtttttctcatctggactttctaatcccaagtgccagtgagaacaggtattattattattacttattttacagataggtcatcagagaggaattggagaatgtcgaaaataagaacaaactttatagctcattgaggccagaatggcattccctgcctgtagacgac

SEQ ID NO: 100832 - DNA, 1056 bp, Homo sapiens
atgggaggcagtttggaactgcttatatgctattgaaatggccctcaggcaggcaaggatcctaactttttgtgagaaggaggcacttgtttgtaactaaagtaatgctctaagtaatggccttgctctgcttcagaatgtcacaagcatccagaaagtctggggtgtatcaggtcagatttgtcctccactgtcttggcagggctaaaggagaaggttctgcctaagatatcatatgctgcatggttttctccgtttctgacactctagtcttctccaatcctacttattcagccgtttgttcccattaaatctgtaaccttgatttacataacatattggcccaaggatgctcagctagcccagctgctaccatcagtatgagcacatttgcctagcagaggtcagtaaactctaactccctccaaaccccatccctcttgcctttcagtcttgcatccagcaagtagttaattcaggcattgtcatttgcaacttccttttgacctcctctcttgagtctaaatatcctttggttttagaactagacttgtttctcatttaatttcctttacatctctctaaactccgtttcttctttcctcagtattcaacacattttttattctccaaagccttgagacattttgggaacaaccagtggaggagaggaaagtagagcaccgagttttaaggggatggcgtagatgtcagggacctgagttgttgggggagtagccacacgttagggacgcaaccttgaaatacacaaaataattcaatagtttttttgtctctgttatgtcgggacagatttttccaagttacttgagacttaatactgattcagggatcttcattaaactagaatgtcttctgccagagtctttttttttttttaattggtaacataggaagggaaattgacttttgagtgtttggcttggatgccgttacccttatgatcataatgaaggggcccatttgatagtttagcaagctattgactcttgccacataggcactgcattgatgtaatcctcggggcacaaatag

SEQ ID NO: 100833 - DNA, 1047 bp, Homo sapiens
atggtgttgcccaaaccacatgggaaccacgtgagagagcctgtgagcattgggccttggcatctttgaagccacctcctcttgccaagctgcttctcagctggcactgcttttaggttctgaagcattgcagagctcagcgttggggagttatcgggcctcatcattttggtttcctgattagattcttccttcatgccaatttctcagtcagaacttatattttaatttaaaaatgatgaagttatcagtctggtttttaaaaacttactttggttaaattggaaactcttagtagtgtcttacagcaaaaggtggagatttcctgtggaaccaagaattctcagtagcaagaaactcagctggtcggtgcctgttatgtatacaccagttcccttagtacagccacttcatgaggaagatattaatttggccagtctcatagctggtaactgttagagctcagattctaatgcagatatttctggttatggttgtcagaaaaacttgtggtacctactgtgtgttaggtactttcatattatgtttttaaattctcatagtaactctccaaataagtgggattttttttctatttcttttttctttttttcatgtcagtgcccttaatcaaaaaagtgctattttttattttcattttacagatgaggaaactgagactgagaatgtttcttgggtcatagattcccattgtcagcttacagcattcttagtgtctcagtaattctgtttttacagcaccgctatgccaaaaagtacctaatagtctcatttattaagtagttatgtccaaaccatttaatatatatttatgtccttacaatttattagccatttgagaagataatacacacaaattgaaagaaaaaatatttttatttcattcttaaatatcatagttacttcctaatggtatgtgtgccttttggtactgctcaaatccttaaaccttaggatcagattgaacgctacgaccatcattctgatttcacatcgattttcacagttatttttgtcagagcagct

SEQ ID NO: 100834 - DNA, 1049 bp, Homo sapiens
gttgtttctcatcctggataatgatttcaggggtgttcacttcatttagttttatatgtcctttatggagtttttctgtatctgtgttatatttcacgataaaaagattttgttttttattgggttttggtttttaaaaaaatctgcttgcctggaactgtcaattactgatggacccagtggtcagtagagtgttttggcttttttttttgcatgtatttaatatatgtgaatcatttagtttctctaaaatggaaactgatgagaattttgtttggtgagcttctgtttcctcagtcgtagagttatgacccacaggttttaggaattgttggatggaggctcatgaaaagacattctcttatagctctgtgctttgtgctgtttttgcttgacaggtgtttaaaagacacaatcccagcacggctgaggagcaggagatgatggagaatctgtttgattccctctgctcctgtctaatgcttagttccaatcgtgagcgcttcctgaagggcgagggtcttcagctgatgaatctcatgctcaggtatgtttcgaatgccctagttctcccaccttttttgcctgacttttcactgttagcctgaattcaagagcatgtagctatgatcatttattctgttgggtttcctagactttaccctgaagagtaaagtcttcaggcatggggggatgtgtttgtataggtatgtggtctttcctaaagttagagtagatgaataaaaagtatattgtgttctgtttgtgccctactgtggtggttgctaatacgtccactccattgaaggacattggtgtttttcctctccttcccatagtgtgttagttttggggaaatctagccattacttctaaacttggactaattttctgtatatatcacatagacctatctatgccatatgtttgtatttttattgaaagcagcgtatcattcatatttttcactcctcattcagtaatgagttgtacatgtgctgtatgcctagcttaggaaatatgaaaacgtgcaagacagttctagaaac

SEQ ID NO: 100835 - DNA, 1019 bp, Homo sapiens
aacttcaagtatactgaaagttctgttgaactaagatatttctttggaaaggtttttcataaatgtgatatatatttgttaaatagaatttagaatactaacatataaaactgctattaaaacattgacaaggtactatgttaagtactgggcatacacagaaatacctaagacagaatttctgtctccacaaagttaggaaaacagttctgtgagctaaacacagcctgtctttgggtgtatattttcttctagtctttttttctataatttttaacaactttttaagcctgccacacataggattttctgtattgctacatttcagacataagatgctgtttcccatgctgtgaataatcttcatgagagttttcagtaactgcatcatggcctctaagggactgtagcttacttagtattcttctgttgttggcattgaggatatttccaatgttttgccgttataacaaattctacagtgaccatttttgtgtttaaaatgatgttaggattatccaggtacagtaagtcctcacttaacatcatcagtaacattcttggaaaccataactttaagcgaaatgatgtataatgaaaccagtttttctgatcattgttataacggtgttatttgaggatctgacctcctatatcccgttttacttaaagttgccatttccaagtctatctatgatgttaagtgatgacttactgtgtatatttctaaaatatattatctttaaaaggcttctggggggctggaggcacagtagacctcttcatttgtccagtgtgtaccagaccttgcattgaccaaaagtcttcctttgaggaattgcttttaaaaacaatttttaaaaaaatgcagagaggagcatgagaaattactcagaggccttttgtgtttagctgatttttgctagctttactctcttgagtcttttgtttatctcccttacccttctaattgcttgtccttttgttgaaatgacccaccttctctcaagtaaatagca

SEQ ID NO: 100836 - DNA, 1092 bp, Homo sapiens
ccaagtagctgggactacaggcgcccgccactacgcccggctaattttttgtatttttagtagagacggggtttcaccgttttagccgggatggtctcgatctcctgacctcgtgatccgcacgccttggcctcccaaagtgctgggattacaggcgtgagccaccgcgcccggcccataactgtgttttttaatccagcgtgaaagtttgtctttcagtagatgaatttaactatttgattttatagtaattacgtttagcccttttcctgtttgttttatggtttccttggttgttttattgttttgtcttatctttttttcacttccattattttccttcttctttggagatttggaaaatactattctttctattagtgattacctttagttttttagaaatgtggctttatttctttgtctatgaacgtttgaaattgtttctagtcccctcaagatctggcctctgcctcatcctcctactgccatctctttcattctttcctttctgcacatttacattccactctctaaaccaaactattttagatcccttgacacattttgttattattattattttgatgactcacttttgatgtttaggcttaaacttctctaagcagccattttcttccatgtctcttcccccacgtctgtcctcacatccccacccctaagttttgaaggttgggtgctagcatcctttgctgcctctgtcagagcactttctgcaccatgcatggtaagttgtacggctgtgtcttcaattgtactgtaatacttttcagagtagagacagagtcttcttcctctgtatctccagtatctagcaaaagatacacctttggttttctgtgtttggtttcttaattttctaaattaatgagaaacattttgctgtttaggatcattggcccacggaatttttggcaaaccgtgttcatagacccaaaggaagaggagttaaaaagcctgttgccgagaactcagtctcttgcctgaacatatttagttctgttttccctgtcaaatttttcagtgcatggaaagcacaaaacggggccatagtgtgttgtaatcctgatc

SEQ ID NO: 100837 - DNA, 1779 bp, Homo sapiens
gctgttaaaaagaaagaaaaatgaataatgaaatgtctataatctcaacaccccgaaataatctcttataattttagtctctttctttccagtcacttttaatgtacatttttcatgtgtaattgtggtaatgcttcataaagaattttgagtattgccttttgtgtttatcattctgactgtaagaatttgtccaccctattgtagacgtcttctcctaattgttaacaagtatgtaatatttccatttagatgtataatgtgtacggcagcaaatacccttttttttttttaagctctataatttccccatgaaataccttatctgaaacctcttttgttcacagggaaaagaagatctcccggagcagtgccctgaaagtgctggaccatgccatgattggccccgaaggcacagacaactgccataagtttgttgacattcttggcttacgaaccatctttcccctctttatgaaatctcccaggaagatcaagaaagtgggaaccactgagaaggaacatgaaggtagggttcactggaggagtcagcctaatttaggtgcattaggagaaatagggaaatgtgaactactttgaaaaattctgacgtgtttgggggatagaggggaagagtgctacctttttcttactattttcttatttttcatgaatgaaaaagagaccccaggtcactgatagcctttgttgcaccagttctctgcttgtttgaatcctggtcattccatttccttctggactgttaataagtctgtgtgtgagggttttgttttcttcactataatttgtagcgaggtgtctctctgatggaagacccttttgaaaagagtaatgaggtggcaacacatgtcacctccagagtggtgctttcatgtatttctgtactaaagtatgattcagccaacatcaggaattgccgaaataaactatttatagcccagattccccttttatgtttctcctccctgatggtgcacgctcccagcaaaatgctgccatgaattgtgacgctgtaaccagagtagttactgctaggccagtctcttcctgctgttgtctagtggcctgctgcagccctctccccagtaaatagccacagtgcaatctggaaggccagggatttatgagcattgacagttctgctggaggctggcagacacttgcaccagggaatttacatggttggatggttattttaaagtgtggggagcgggtggagaggagtggggaggtagtgtgttgagagaggagcagaagctgagctgactggctcatttggctgttttctcagaagcaatgttcgtcccatggtttaggaggcttttttttttgtcagtgcttggtggaattggcatgggtatctgcaggatcttttgcattcctcatcctcatagacgaaagtttgagaactcccgcctctctcttttccagttgacttggcttagtctctcccaacttggagtggctaaagggaaggtggtgtgacctaccttcagtggttatcttcagtgatatcttctctatcaaatcaactctccagagacaacaggaaatctggctggagcaaaagaggaactggccttgcaaatactgtggcctagagacctgagaacaagtagagacttcagtttaactcattttgaccaaacactagctataaatatgttaaccccgtgctagattttccccactgaaaattcagcaaaatgagtccctgggagagggaatggagggggtcctggaggtctaggagataaa

SEQ ID NO: 100838 - DNA, 1045 bp, Homo sapiens
aaccactgtgtccggcctggtccttagttttgatgtctctttctcagggaagcatgtcatgaacccgtagactaggatagaatcttctgttcagtggactcttggtctcaggactctgccttcatagcccttgaaattatggaaccaatggccttgtcccctctagatcccattgcctggtcccgtggtgcttggcatgtgatagatgcacagtaaatgtttcttgactgtgtgaatgaacaaccatttccctgaaaggctcattgaggacaaacatgggtttggggctttcctcagaaacctacaaggttgaagtcaatacagttgatttcagttcagattgatggttgtcagtcagtcatacacctagagtgaagggtctttcatccagcttgtttggatgctaaaatgagtgggttgctagccctaagttttaactctgtcacattggcttggagattatggcagaacccccactttagagccacacccttaagagctttgctgtacactgaccttccctataggcaaggccaccctgtgacaagcacctaggggtagcccagctcctaggtggaacactgaggcctgggaatcagctcgccagtccagaagctctagagagctaccccacactcttccctttctttcttgtgaagcttcagcgcttgtcactgttgtccacaagagcaccaggatggctaactagtagaaaggagaggtttgttgatgatacaagtttgtaaactagaaagagacagtctgtggcgtgtactaaaggtgatctgtcttcaaaaaacgaaagggcaggttgggttttaggcctcacaaggtctgtattagacaaaagagtcatacacattcagcaggttttgggggaaagctacacatatttatgaggggagtcaagtgcatgcgcaatgggtaaacatatgtaacacattccatgttcactctggggcagggttttagcattaaaatgaggtaggatttggctctttatatcaaaaggtgaactgtaagacacaaagtttgtgtatagtct

SEQ ID NO: 100839 - DNA, 2395 bp, Homo sapiens
aaaaaaaacggagtaggggctctggattctgttgcccagctagtgttgagagctactggccagaattctcacagtacaagccttggtaagcagcccttttactttctctctgtgccactagaagatttttgaatggtgggtctttgggggaagacttgttcaacacagctttattgctttatctgagtatgaataaaataaactcatgcagaaaatttttaaattgtgaaaaaagatgaaaggaaagtaaaaatcacccccaatcctactagccagagttaattactgaaaacatcatggacaccatccattcaaacactatgttagggactctgtgagtgtgtgtgtgtgtgtgtgtgtgtgtgtgtaattttgtataaagggaatcatgatggatatactgtttttactcactgcatcttgggcattttttagcaagggtgggcattttaatacagttaggagctagactatatttttagaaggcagggtaaatttcaggtgaaatgattaggatgtggaggtaatagcagtttggagaggtgagctgggcttagatggtgacattggctcctcctttttttttttttttttctgagatggagttgcacagttgttgcccaggctggagtacgatggcgccatctcagctcactgcaacctccgcctcctgggttcaagcgattctcctgcctcagcctcccaagtagctgggattacaggcatgcgccaccatgccctgctaatttttgtatttttggtagagacggggtttcaccatgttggtcaggctgctctcgaactcctgacttcaggtgatctgcccccctcggcctcccaaagtgctgggattacaggcatgagccaccatgcctggcccacattggctcttctaagtgttgtgaatgtgttgggacttcagggtagtaagacagtgagttgtagactgaagactaatgcatctaggttcatttgggttatagcataagaaggggaagtgaagatgcctttcaaatggtatttttttaaaatgtgtgaatacttgaatgtgttagacatgttggcatctaacagaagatataatgtgaaagggagtaaactgaaaataaacttgtatacatttcactgctcataaagaatacaattacgtgtgtgaggtgtttgttagtgtctaccttcctggactcttgtaatattggatgtgatttttatacgcagcagcctgcaggttgctggggaaatgctctgtgtatttaatcatcttgcagtcttacttgtttgttttttttatggtaagaaaatgttgttggcttgcttttgtagccagattgattttgcttgtgggtgtccagatgctgatgagctgtaattagcataagaaggaggttgaaaagatgttgaacattgtttccaggtagccaaacaaaggatccccaaacagaaattattctcaagtatcaggttcaagagaagcagcccttttctcttttaggagcagtctattaaaggatgtgtgtgttaggctgggtaggtcaccactacggatggggctgtagaaacttgctgggagctggtcctgggggtgattttctgacgctgaacatctccctttgtgagagtagtaaatttaaatcacttgggtagtctagtagaaagtagccctgggctgggttcagaagacttgggtttgtgtttctgccataattgttgtgcttaggttctgtgacttgagtgtcgtttgttctctgaacctcagtttcctcacctttaaaatggagacaatgtttcacagcatgtgagaactggataagataatatacgagaaagtgatttatatactataaaattatgcacatatatgacatggtagtgttgtggtgtgtattacattcattgtttttcccgtctcttctacatttcttatactttttctaagtaacactttccttccttgtccctggctccaaagcagaaagaaaagtatggtaatttggtccctgtttgctgcagggttatcataaaatacattaagcatgtcattttgataatcacaaaaaaaaaaaagcctacaactttcttaaatgtattgattactaataaatcatgtctatgttaagtatgcctgctggctcacaaacttctggaataacaatgtttgctagcctagttaactgggtgattttcctgatgatgtgtcatctggtctgaggctactgtagatattgatgatggcgatagtgtgatagtgtctcacattactgagtatttgctgtgttccagggtatacatgatgtcattatccctaacatcaactccatgtgggttatcgttagcctgctttattactgagagaacagccccaaataagttaagtactttttcaaattgtgcagac

SEQ ID NO: 100840 - DNA, 1041 bp, Homo sapiens
tcatgttgctttgcacccagtaggtgcttagacaatgcttgtggagcctcatcacaactgaaagatgagactactgagttaattttggcaatatttcacattaaatgggtttcagtggacctatttcaatggaaaaggcattcaaaatttcaaacaacagacataaaaactgctttctggaaaaatagcctttgggtatctcatcattcatattccaagtgcacactttttcttgcctccttctcaacattttcttaagataattttcaaacatacagaaaagttggatgagctgtatggcaaatactcatgtacctgccacccagattctacaattaacatttttctgtatttccctcaccacatgtttatccatgtctgtgtcagtcatccatccatgttatttttgatgcagaaagtaagttgcagacagcattacatttcatccttagacactttagcatgaatataaattaactgagtgtcgtatgtataatacgtatttttaaataaaagtaaaatgcatggctcttgagtgcaccatttgagtgatgataaatacaaaccatgttaagatacagaacgttcccaccaccccagagcattctctcatgccccttcctgggcagatccctccctgtgcctcacagaggtaaccactattctgagtttttaccatagattaggttaacctcatgtagaacctcctatcaatggactcattcagtgtatattctttttgggttaggctttcactcagcatactgtttttgagattcaccataggttgttacatccattggtaatttgttcctttttactgctgggtagtattccagtgtgtggatttatttttccattcttcctattgacaggccattatgaacagggctgctataaacattttttgtacaagttttattgtggtaatatgttttcatgatctcttgggtaaatatctaggaatggaattgccaggtcattgggtagctattcacatctcttttgataactaagatcttataattgaactgagagagg

SEQ ID NO: 100841 - DNA, 1310 bp, Homo sapiens
agagaactgttcaaagttacagagaagatttttctcaaagtatggactagaaacccttgtctcctaactctagcgttctctacagcagacttccctttttcccctgagaaagaaggaaatcaggattctttccagaagatcattaactctttctgttgttgcttggggagaattaactgttagatatacccgggtgcaggagattgtgcttgatgcctgtgcttctgtagtatctggatctgagcctgcttctcctccagtgtacatccctgcagctgttccaggatggtctttgtggaacgtagacctggtcatgcagcttatctccatcaaccatcatgcagggcctgtgggagaaagtccagactctgtagttgagtgtgcaggcctcttgcttctcttgcctcaccttccaccttattgcccatcccctgcagcccaccccatgccatgttccttcatatctctgggcctctaaatctcttgtgtttggtctggaatgcgtttccccctttgttgccctgataaattccatactgtttcttcatgatttggttcatccagaccctctcagggagtcagttacacctttttatacatacgtacctcttcaagctaacttaccacggtggtttgttatgatatcacattcagcattcgttgaactcagcacaggactagacactgaaggtacagatacgactgagacgcgggcctggcctttgagtttaccatctattgagattcctgtaacaggatagtttcagtacaacacagtaagctctcacatgtgttgcagagaacgagagctcatctccgcacatccttacaagcattaggtgtttgaaagcttcaccacatgaaactatctcatgactttacttgcattactagtgaggttgaatgcttttttttttaaaaatatgcctattgggtatattttaactcttgaggaaaacaatcaagttgtattatggtggaactaactaggtcacctcctagctgtgagaccctggaaggcaaatttcttttgccaactgagtctctagttccttgtctgtaaaatggggagactaataaaatgtgtttcataggattgttgtgagaattaaatgagataacatgtgtaaagcacacacaggcacatagtaggtttgcaatcgatgtggcctcttggagttcctggcccctagcccagtgcctgccacctatgcactattcagtgtttgtgaagaatagggatgtatgtaccccgtgtatgtgtaaaaggggctatatatagatgctcacacagatccatctgtcttgag

SEQ ID NO: 100842 - DNA, 1294 bp, Homo sapiens
gacacctgctggatgttttttctggaggggctgtgcttactatggtgttatcccaccctctgtgtttttcacctccttccgttttgttctccaccatctctggccactgtagctttccatctgtattccttaatcagggtaagttttcctatcactgtttaatgtccaatttgtattcgctcccctacaagacacttctcaagtcttcagtcacattataaaatgacgcctggcttacttttttccaagtctacaggagacctcattttccttgtgatcttgttttgctgcatcactccatccttttcagtcttttcttaaagatacacttgaggcttttgaacttcactggtggaaggactgattttagtatagccctccccaccttcccgtgttgggatcatccagctaaggctaccgtgttgcactgggaattacaccagcattttccctcggggcatgcctcaggccagagtgagagactagggctgtggggatgtggggagacagtgaccttgttatctgtcctgtttctctttgccacttcttatccacctcttccctttcataaaatgtggcaagattaccttttctactagactgctgcacctctatctagaagaccagtcagtcactgaccaacctatcactgcgcttttaattcattccatcgtccaaaaatgtcagagttaccaaaggttgtttaacttaacctgagggaatgagggaaaacatgaagcttgaggggttggatcaccttggctagtatcattcatgaacaccagcagataggtagctgtgcttttcattcttgtgatttccctatgatccctaaactgagtaagtcctcagaagtttgcggattgattgaattgattaactggggctttcttcttttatacagtgatactactgcaagataaaaggcagagactctaaattctgaggctgcactttagatattagcatgttccaccacaattctttcattccaattcaccccaacccctttgttctttaattaaactttccgtttccatcttttctaccctatacagtaacttggacgtgaaggacactcagtggttgttaaattgtgggaataatgtactccttctctttatctgaatgataattagaaacaacttgaaattccctggacttttgtaaggaaaaagccatgagacagttagaactccagccctgacagaatccccgatgttatctgctagggaggttttgaggggtggcaaagagaagacctgggagtcaggggacctaggatttaagagca

SEQ ID NO: 100843 - DNA, 1103 bp, Homo sapiens
gagtggggagaggtcatctaaggctagagtcaccctaaactctaggggggctagttttgtggctgagcattcgtgctgaacctaaaaaggtagggatatctagggcatttccagcctggagtgaaacagcaaaggagcagcagtgggaagccaagtgaagggggagagaagagggtaccttccacgagtggagggtgtgagaggaagagcgtgggctttatagccaggctttatcctggttctccgactgtgggcaaacagttgaactgccctatccttattttctttctggatggtgtttgttttgtgtttaaggtgtatgtcccagtttgtgtactttgagaagttatgtatgtagggatatggtgtcggtgaatgtattatgcatgaaagctgcttgcacagggcctggcacacagaaggtggtcagagaagctttagctttcttttctctacaaggactgtttgtgtccccctgccccgcccccgcacatgtgtacatacccactgtcctgattccctgctgctgcaaggttttgcatgacttgactcttccctgcttctccaacctcttctcctgccactaggcccctcctgccacacagcctttgtttccttctttacatttgccactcccttctgccctgagcctcctctctgctatcaggtctcagtaaaatgtcgcctcctcagagaggctttcagtgattaccatttgtaagagagccctatctccctagctgcttcagaacctgtaattatttcatttatttgtttactctctgtctctgggactgtaatctctcttgttcatcgttttctcaggacagcgtgcctcacattcagtaaatgaaagaccactgctcattaggtgaaattaatatctgtctgtgagtattaaggaagatacggcgagtcaccctgcgctttccacattattccttaacactaatttttaaccctgatttttgttttctctgtgattagacctgccaccaaaaatatttaagtacagttctgtggattctgtggcataactatagcaatatttcataaggaaaaatactacttcgaagaatcaacaggactgatagataattcta

SEQ ID NO: 100844 - DNA, 1025 bp, Homo sapiens
cacttttctctctctttactaccaacacttacattcaggctaccatcatttgttttcttccattagtgcagcacccgcctaactaactagtctgcctatctgtaggtttgggccctccagttcattttctacacagcaaccagagatttttctaaaatgtaaattcatgtatgcacttctccacccaaacacagtaaacagtggccttgcatcgccctcgggatgcagtctaacctcctgcgccggcctcatggtgcctcgcccagtttggcccctgctggctgctctagatacatccctcaccctcgtgatgtacaaaagccattctgtaccactcacgcttcctgaccttgtgctttctcaaaccttctagacattggcccattgctccgaactctgcccagaatacctctctgtgccatcttttccacatccctttcatgaagctggctaatgtattactctgtatccttcagaattttggcaaacaaattagtcaataaacatgtattgagtgtctgtcatatactaagcattctgcttagcgtttccctgacagtttctgcagaaaatcttccctgagaccacctggagcccctcctgtgtgccccaagtgcacccttgcactgcagcctcaggctgaagatcagggatgctggagccagactgtgtagacataaatcctggctctgactcctaccagctgggtgattacaatcaagttacttaaactctctgcttcagtttcttcatcagtgaaaggatgagaataacagtacctatcatgtaggattgtggggcggattaagtaaatgcagtatatgtaaatcacttggaatatttcctggcacagggaagtatgccctaagtggtagctattattacaagtattttgggcctgcatgcttatctgtctctccctctaaactaactctcagtcttcacaaatagggactaatcttacttactttctccttttctccagtagggttgtcgttttcagccttgtattattgcatcgctat

SEQ ID NO: 100845 - DNA, 1034 bp, Homo sapiens
cagagaataaaggtgatgccgtcttctttttaaaacagaccaaaacttgagaagatagaggactgcccacactttctcactttcttgttttccataatcattctgcttattttatttccttttaaacactgagtacacatttatatttggcttccctgaatccattcagcagtaaatattccatgccacagagttgtaacaggctagataaggtgctattctgacaacagtcaacttcactgcatgctggtttctatggcacttctaaaactgtcagggcagaaacttcatcttcagaagccaatctctgtttcatctctgtgcatgttcaatgcagcaatgatgatgcctttcttggagatgagctatagtcgtatctcagatctacatttgaaaatttcactttcaaatcatgtggccatatggctaaaagtagaatgtcgcattgaacattgtcagagtcttgaagttctgaggaaagagaagaaagtggagtttggcattgctctcttgagtttgtcctttctaaatgacaatatagagaaactagaaggtgcagtgtgtacctgcctggttaaaagaagatcagatgatggagaaaagtatgaaaatggaaaaaatcaccaggggtacttctgacctaattagagaaacttaattttgctaagctccattcttgagcctccctatcactctaatatttaatgtcttcctttgttctccagacagctccgaaatctatacccacacaaacatggtagcatgaaaagagcatggactagggtttgagtcccagttctgccacccactagccttgaggagcttgttctgcctgagccagcttcctcatctaaaatgggggtaagaatccctgcctctcaatattattattattattattattattattattattattattattattattattatttgagacggagttttgctctgtgccccaggctgagtgcagtggcgtgatcttggctccctgcaacttctgcctccaaggttcaagtgattctcctgcc

SEQ ID NO: 100846 - DNA, 1071 bp, Homo sapiens
gaagcctgctctatgcccagctcagctgggtggcaaggccacaagggtgtgtgtgctccaggttcaggaaggcctgtggccaccttgcctcccagctgggaagcagagtaagagctctcccggggaaagggctggagagggaggatttaatgaggtcccagcccaaccgcctgtaaatctcagctggcttctaaaatcaggagacataaaatccccataagaagaaaacccagataatcaggatggaaaagccctccagaaacagagaagcctggctgtgtccagggccctctcctccccagggaggcacccgagggttctctttgtttctttctgggtagcccttggcccctgacaggtgcctgcggcaggaggaatggaggtgtgagttcatgaaggttgcttcaccttgggacaggcaaacaaacgcagatgggctttcttcctaagaagccaagaagaaggcattttgtaagaaagcttagggaactgcagcatgccttggtgggaggtgtctgcctcagcgtgcagtaggagcttaagtcctccctcaaaaggaatggaagagatcagctctgatggaccccctaccctaagccaggccccgtgccaggcttcccaggatgccacagatcaggcccctgccctcagggagcctgcagtccccaggagagacacacatgccagagactgctataggaacaatggctgggattgaacctggactgccatgtacagttgttcagaatgtgcactgttcatatggccatgaatcatagtgctgcccagggttatgcagggcaaactgcatgttggagctatggaaggaggtgcaggttctagaagatcctaggagaaagataggctcgtgtctgcctggagagtcaggggaggttaccaggagaaggggacttgcttggacctgaaggctgactgaggtttgcacagtcagaggggactcagaacagaaaagggcataccagagaggggtctcccaagcccagccttttagctgccatcaccatttccacagggtccctgtaccacatgcaccattatttacttaatatt

SEQ ID NO: 100847 - DNA, 1067 bp, Homo sapiens
tctcaacctgctctctcaatcagtaccctcacgtcctcagcttcctcccacacaggcggactcagaagtaaggaaagcacctttcagaatctctgaggctgtttccaaggaaaaagatgggtggggggaggcggggagaagaagtagtggagaagagtcagaagttccttcatgaaataaaacatgttgcgttacctgggcgtaggtgtgggggagggataggcctcagcgcaccccacctcttgttagccttccttctcattgtctcatggaccccaccgggtgcactcaagtgtttcaccccaaaccctgccccagttccctggagggaatcgaactgtgccacagctcacaggtgaccttgggcgctctcttcccctgcctgtgcctcagcctccccatctactaggtaaagggtttgaaccaatcaatccccaagcatcgttccacctcctcaacatctataatttgataatataatgttggaaagtatatggggagacaggcatgtacattggcacaaggtctttggaggtcagttgggcagttatcgaccaaatttgaatgcacacacttttgatcagtaattctgcctcttaagtatttcatactcacacatgggcacaaagatgtacacgcctaggcagttcactgcaacattgttccgaatttttaaaaatattttcacaaatattgaatgcctagtatgtgccaggctttatgcttgatactcttccttaatatccaacgaatggaagcaaaagataggaaataacctaatcatggtgctgagctcttcatccagaagagactgaaatgccccccacaacacagaaattctactgagctatactgaagagtgatacctcaaatgtcatgaggccaggcatggtggctcatgcctgtaatctcgacatgttgggaggctgaggcaggaggattactggagcacagcagattgaggctgcggtgagctatgattgtgccactgcactccaaagtcatgaaatattactgttaactattccttaaagtaagtagaaaattagaggccaggtgcagtggct

SEQ ID NO: 100848 - DNA, 1401 bp, Homo sapiens
agggtccaactgccgacttcagcagcgtgctggaggaccataatattaaggcttgctcagggcccccgagcaggacagggagccctgccctgggcctgcctcaaccctgggctgggcctgtgagctgagcaaagcctttaagaaagggtacactctgtcgtttttcttctttgtgaaaactcctgctttctactctggaactcaacctctttctttgccaagagcttgtttgctgtcaatattgttctgctcagactaattactggtttctgtatgtcgatggatatgaaactgttacctgtatttcggttgggctttgggaccatcctactggtcctgtcttaggaactcaagtgggttttttctactatttgaagtgacttgatattgttatcagtttcttctcaaatagcctggtaaacagcctcctggttggggctgtagcattccccgccttccctctctgtaccctctactcactcctttccatctctccacagcgtcttcctccacttgatgaaggtggacccagactccacctggttcctcctgaacgagctttactgccccgtgcagttcacacctccccaccccagcctccaccctgtgcagctgcacggggccagcgggcagcagaacccctacacgaccaacgtgctccagctgctcaaggagctgcagtgaccctgctcccccaccacagaggccaccgatccctcccctactgccagccagaagctgggctgaccccaccccggccataggcggtggcagcggcagcagagaaggtgaattagttagccaatcgatttataaattgatcgatcacacaactgcttagaaatggattgaaggaaagtagctgactattatttatgtttcataccttgtgttgtcaagtgacattgtctggtggctctaagggtttaaccccttagcctaccatctctatagccccagctccctcacaggccacacacacacacacacaagaggtcagttcccctccatctgcatacacctccctgtcttcaaataatgagatggaactaatttgttttacctaacctgatctttgggaaacaaacggaaataaagacacttcttggatgaaaagtatgatcaaaagctcactttgaagttttttatttaaactgggtggtttttttaaaatgagtttatattcttgaatggttaatatagaaccatggtataaaatccaaatccaagcagtacaaaacagaaaacaatgaagagtaaatctccccctccccatttcccagccgtcaggtttctctctccaaaggcaaccactcgtaacaatgttttggttacttttcaagcaggaggttaattttttttaacattttactatgggtaatagtgtaaattcccatgtcc

SEQ ID NO: 100849 - DNA, 1050 bp, Homo sapiens
aacagttcaggcaggaggtgggcaagcctacctaggctgctatgaagatgtctttatcttcaagggtacataccttccagggaggggcaggaaacaatgtggcccgagagtgcagccagctgggggaaaggtccgagtcagccctcatagtgctcagcacagaatgccactttgaaatctgtgcccaatacactgtcgtgggatctaggcttgcagggttcctggaggcaggagaactggccagatggaaagggctgcttttaaatctcgccccagtgggatgtaaaccctcctagattctggcttatttttgaattgtctataacagattggacctctcagcgccatatccttttaaatatgcacaaagcaatggaatcattcctctgcatttatgatactttatcttgtggcacttcagaggtatggttagcatcatttgcttctactggtgtttacggttttaagtcctgcccatgttgcatttaaatatttttgatatgggtctctgtgtgagtatgcatgttggcgttagatcgatagatgaatggttttgaacaggtaaacatagttaagtcaaacgagcatgtatagctgcaaaggtaattggtagtatttatttggagagtaaatcgttgcttcaagtcataatcctccatttccaacatttagaaataaaaaacgacctccgtgcaggggaagatagctaaattgaatagcaagaaaggacaggcttgaaatactggttaaccaatgaactgagacccattagagtaaattaccaagtatagaaacatagccccactgcttgctggctaggacgcatcaacaccctgagcatccatttgtttaaaaggaaacacacagcctcctttgcagcatcagcatgcacagagtgatgggagaagagatggccagagaggaggagagtgtggaggctgtgctgccagagagggaacaacgggaacaccaaaataacttagtgagtatgcctgctttcccacaagtgagcttactttcccactgcatttaaccatgcccacatagaga

SEQ ID NO: 100850 - DNA, 1078 bp, Homo sapiens
actggggatttcacctcaaaaggatctttttcatgttaattgtgccaccactgtttgcagaagtcaggaccgggtttgaaggttcatttacagactgacttccctgctctctttctagcagtaggatcccatcccatcaaagaaccagctggtgccttcaaaccctggacgaacacagaccggcacaggctcattcatttcatccctgtcagagccccaactcctctctttacccacacatgagcctattatatttgaacggatgaggagccacagaggtgatccattagttcagctgagcttgaaattagtagctcatccccttaaatggtgtgggcagtttggctgagcttggactgcaaagctgttcccccttggattgcacccagcatggaaatgaggacacacctaatattttttccttttgacacttgattaatagttgacaaatccaaacccaagtagttagctttcctattatccatcttttgacaggcattgctggttttctttttgagtcccattgttctaaaaatacactcagatctggagctgttcactgtgcatatataggcctgatttcatggtgtcaaagataagagacatctggcaggcagattacaaacaaagtgggttgctgggtttcagaactgaaggcagggacctctgggctacttaaatctacttaaattcagtgctgccaattctgtcccttcttccttggtgttgtcatgtcactgataacctgccagggtcaaccatcttaccacccggtaggaaagccaagcgtggggtgtgtgtgcacagtgcatgccgtgccaggttgggagcagaatgttctcgatgacagatcgagcctggtcgcagcaccgcctgcacaaagtgggttttggtcatcagaggctgtggtcgaccacagggtagtcatttcctcattctgcaggctctgtcatccctctcgaacacctcagaggcgtggaagtaaatgttgtctcagtactgagtaaataaagtagccagggagatgatctctatttgtcttattgtatagatgtattttaaaagatttttattgggt

SEQ ID NO: 100851 - DNA, 1452 bp, Homo sapiens
ctcaagggatgttaggaagattcaagaaatgatctatgtgaactgctttaagctcttctcttttttttttttttaacaaaaatgggagggaaatcaagatattaatcatattattcatccaacccaagattcctttgaattattccccatgtaatctgtatttatgggtagaagcagccatgccttgggagcagagacctccaaattcataactgtcagaatcacaaaccatgggcaaggaattaacagcagtaattctattttttttttcccccaagcagagacctagatgaaatcgaattaccaagcattctttagctctcttgctgccttggcaatgttcactcaccaggttggaggctgtttctgcaggttttacgtaccctgggaagcaagtgtggtgactttcttcgcagccggttctgcaaagatgtcctgccaaagctggctggctccctagtcacccaggcccccatcagtgccagggctggaccagtttactcgcacacgctggccttcaagttgcagctggctgtcttacagggcctgggccccctctgtgagagactggacctaggtgggtaccaggcagttccacctgaacacacacacttagcatctgtctcacccctgccatcatgccctctgctcagtcgtgcccccctcccctcccctctgtgtacctccttccgtcttattttggcctcatttgtccatttatcttgatgtgttctttggcgggatggagtagagagcccagagcatcttgcctagctgttgcagtttctccagacacagttggtcactgcttgtcccaaatgaagtgtaagggctgatgcttgttttgtttttcttttctgcaggtgagggtgacctgaataaagtggctgatgcctgcttgatttacctcagtgtcaaacagcccgtgaaattacaagaggctgccaggaggtacgtctgcctgatcacccgcatccctttacgtttgttctaaattacagatgatttgctaatggcaagcagagttgaggcatctctgctcttttctctgtcaccctgccaggttaagataattctttaactgtgccagcactagagatggtatttttactagatgtgtttctctttgccagtaaccttttcctctgctgcaaagtcagcaacaattccagagggtcaagaagcagaaagacggtgtgctagagaggactcagcaccctcctggttggaggggaatctgcttctaggcctggagaccaggtgcctggcacttcttcatgccttggcttcttcaacagcaaagtgaaagtgctgggttcctgatatggcatatgtcgactccacggcaggtcttagatgggcatcggtgccatgaaccctcacaagtgcaaagcaaaattgtttgtgtgcaggcaggtgcacatgtgcctttttctaataggaaccattcat

SEQ ID NO: 100852 - DNA, 1036 bp, Homo sapiens
tgttttcaagcctataccatctgctgaaatcgtgtctctttcaggtcttggatgtgctggatctgtgtgtggttgttcttcagtcccacaaaaaccagctgcttcccttggctcatcaggcctggccctcgctcgttcaccgactcacacgggacgcccccctggcagtgcttagagccttcaaggtactgcaccagcatcccccatggtctgttgtgagggtagagttagtaggcacagagctcaccggggccttttggattggttctcttcacccgattgcaatgtcacatactgtgaagaaagtatagaaacataagaaaagcacaaagaagaaagtaacagtctccttttgaacttgaagcagatgaactagtagatgaaaaggccaggcagtaagctcagcactcctccacaaaggagtttgtctccttacaaccactttgcaaggtaggtatattgtctttacttttggcagaggaagaaagaagctcagagaagttaaggaattttctcacaatcgaacagctagtaagtgatacaaacccagagcattgagttcacaccatatttgcactgcacaggagtcaaggcgaaggggctgaggttctagcagtgggcatcctctgcccagctgagtgatgctgacaaaacccaggaccacccattttcgtgttgggcttaggaacacctagcccacctttctcatagtgttgtcagggataaaatgggactgtttggtgaaatgctttgaaaagctaacagtcctatatatatgtaaggtattattctccctggcttagtttggcttacattagcacggatattttagcttatttatatcctttcttgttctaaaaagcccttaaggcaacctgcagagatacataccacagcgagctgccataaattagaagaaggtgcgcaagatgaggcagagagaaaagatctgtagggacacaaaatgaagctggtaatgcaccagataccgttggccaaagtagtttgatcttctgtaaattcttcagcatatact

SEQ ID NO: 100853 - DNA, 2124 bp, Homo sapiens
caccactgcactccagcctgggtgacagaggaagactgtctcaaaaaaaaaaataaataaataaaaattcaggtgggaaggcccagaaggaagaaggggcatgggtctttggagaatggaaaagaggcctttgtagagagtgttgcaagatgaagttggaaagaagggcaaggacaaatcctggtagggccttgaggagcaagagaaggagtttggattttattttgcagctacttggaagcctgtgtagtgggctagtcactggggagtcagccatgaataagacccacttaggcctgccctcgtggagcccctcataggactgactggttgcttatgcagactaagactggcttccatgggccaaatatatcccacctgtactgctttagcgacctatgctatgtttcaatttgaaatttttaaaatgtaggttaagaaaagccctgtgaaatatatctctcaagaggtatctgaatttgggccttcaaaattgaattgtcttagattgctgatgtcttcggtcatctctgaaggaggagtgtcaagactcctgtgtagctttgtagtgcttttaaaaaaaaaaaaatgaggtggagggagagggtctcccttgcagaaaggaaaattgaatggttaagactgactctggggcttccttggaacagaagcaaacttagagctagcttttatgaaagttttgaaataacccagaatacactcactttttgaacaggaagtagtactcaggtggagttggtatagtcactcataaatcagagtagtaccttttgctgtcatttctgtttgtcatagaattatctaactgacgtccactcttttaagatgggtgtggaaatgtgttctcagagaacttctgaaaggccttagaagaacccagtaagagctttaggaaattgagttatcattaacatagtgtgtcacatgcagtgactaaaaaagcattaggtgccacggtaagggcaagaagcatcagttaattactgcttaatcccaactgctggttagctgattattcataacaagaaaaaaatagggtagctttgaaaataagtatttatgtcacatacttcacaacttggagaatgtgctgctgcattctttttatggctgcatagtattccatcacgcgtctgcaccatagtgtatttaaccagtcctttcttggtagacattttggtcatttccagtctttggccaccacaaaaaatgctgcattgaatatctttgtaggtcattttggacatgtctcagtatattaataggatgaatttctgaaaaaaatgctggtttaaagggtattacgtttaaatttttgagagagtatcaaattgctctctaagaggttgtaccaatttaaactccatcagcaatgtacgagagtgccagttttgccacgccatcacccacactgtgtattaccaagcttttgatctttgctaatccaataggagaaaaatagcaccttattatagttttaatttgcattaaacgtgagattgagcttcttttcatatgtttaaaagccatttgtgagcaaagacattttaatgtctgtcaccagccttgaatctagaaataatctttgcagcatatctagtcttagcagtgtaaatgctgggtccaggttttaactatttgggaaccagtgccttagagtgcactaagtagctgatagacaactggggatgcagtttgaagaatgtcataatggatccctgggtgtaggaacctccggctcacacctcacacatttgctctctgatactgccagttgcctggccctgtcatctcccatctgctgctgctcttgctctgtgcagatgctctttgatgaaaaggagattagcaggtgctaaaggttatcagagtttttttcccagctgtctgcaaaaggagggcactggaccagagcagtgattttcaggctgtgggatttgttgttgttgttgttttattctttaagtattaagagccttttttgaaatgaagcctttggggaaccctgatatacaaaaataattgaaattagagctgagttgtttgaaggaatagagaccctggaacccatgcctgtagcccaccgtctcttggtgccctccc

SEQ ID NO: 100854 - DNA, 1054 bp, Homo sapiens
tcccagcactttgggaggccaaggcaggcggatcaagaggtcaggagatcgagaccatccttgctaacatggtgaaaccccgtctctactaaaaaataaaaaaaaaaaaattagccagacgtggtggcgggcgcctgtagtcccagctacttgggaagctgaggcaggagaatggcctgaacctgggaagcggagcttgcagtgagccaagatcgcgccactgcactccagcctgggtgacagagtgagactctgtctcaaaaaaaaaaaaaaaaaaaaaggaatggcaaaattttggacttcaattataaggaaaggaatccttcaactggatagtcaatctttcaatgagaaaataataagctgtatagcttgggtcccttttatttaaagagcatatttccagtatttatctcagtactgctaatagcctctgagaaggtggaatggtcactggcctcattttgtcagttgaaaaagccaagaccttgtaagaaacattctcatggaaggtaactggggcagggacagtgcactgccctgtagctaatgccatttccagtgtttgtttattcatgcatgagcattcacgttcagcataaatgttcctttttcattcattcattcaagagtgcctgccatatgtcagacactgtgctaagtaatgaagatagagcagagaaaaagacgaataaactcatggaacttccctgccactgcaagagagatgataaacaagtaaacaaatcattagacaagctcacggcagattctgataaacaccgtgaaggaaataaacacctcagtgtaacagacacaggctcctataagttcagtggtcagggagggcctctctgaggaagcaacactaaagccaaaacctgaaggatgagaaaggcccatcaacacatagggggctatcacatttatttttaagaacattcaggccgggtgccgtggctcacacctgtaatctcaacactttgggaggctgaggtgggcggattgcttgagcccaggagttcaagaccagcctgggcaacctagtatggcc

SEQ ID NO: 100855 - DNA, 1070 bp, Homo sapiens
tgcaataaagttctgagacattttgcagatcaaaaagtagtggtgggcaacaaagccctcgctgacatcttgtcagaaagcctgcattcccttgccacatctcttcctcgcctaatgaactcccaagatgaccagggcaaattctctactctttccttgttacttggttatctgaaactcttgggcccaaaaataaactttgtcctcaactctgtggcccatctccagcggctttccaaagcactcatccaagttctagagctagacgtggctgacatcaagattgttgaggaacggcgttggaactctgatgatctgaatgcttctccaaagacctcagccacacagccttggaaccgcatccagaggagatatttccgcttcttcactgatgagagaatcttcatgctcttgaggcaggtttgtcagctacttggttattatgggaatctttatttgcttgtggatcactttatggaactttaccatcaatctgtggtttaccggaagcaagctgccatgatccttaatgaactggttacaggggctgctgggctggaggttgaggatcttcacgaaaaacatattaaaacaaacccagaagaactgagagagattgtgacatctatacttgaagaatacacaagtcaagaaaattggtatttggttacctgtcttgaaactgaggaaatgggagaggagctgatgatggagcacccaggcctccaagccatcacgtctggtgaacacacctgccaagttacatcttttctagccttctcaaagccaagtcccactatttgctccatgaacagtaacatctggcaaatatgcattcagttggaaggaattggccagtttgcatatgcactaggaaaagacttctgtttgctcttgatgtcagccctttatccagtactggagaaggctggagaccaaaccctactcattagtcaggtggctaccagcaccatgatggacgtttgccgtgcttgtggctacgactccctgcagcacctgatcaatcaaaattcagactatttagtgaatgggatctctttaaatctgcg

SEQ ID NO: 100856 - DNA, 1045 bp, Homo sapiens
tttgaacttgacatttttactgaacagtttccttcctccagcctgcaggatgtttcctcaatgaggggaaggctgctgcacaatggcagtttttgatactcctgaggaggcctttggtgtcttacgtccagtctgtgttcagctcacaaagacccagacagtggagaatgtggagcatctgcagacacgactacaagctgtgagtgacagtgcccttcaggaacttcagcagtacatcctcttccctctgcgatttaccctgaagaccccaggtcccaaaagagagcgtttgatccaaagtgtggtggaatgcctcacatttgtcctttcttcaacatgtgtgaaagaacaggagcttctccaggaactcttttcagaactctctgcttgtctgtattcacccagctcccaaaaacctgcggctgtgtccgaggagttgaaattggctgtgatccagggacttagcacattaatgcactcagcttatggggacatcattctgactttttatgagccctccattctgccacgtttaggatttgctgtatctttactgttaggccttgcagaacaggagaaatcaaagcaaattaaaattgctgccttaaaatgtttacaggttctactcttgcagtgtgattgtcaggaccatccaaggtcattggatgaacttgaacaaaagcagctgggggatttgtttgcctcttttttacctggaatctcaactgcactgaccaggcttatcacaggagactttaaacaaggtcacagcattgtcgtatcttccctaaagatcttttacaagacagtgagcttcattatggctgatgaacagctcaaaagaatctcaaaggtccaagcaaaacctgcagttgagcacagagtagcagagctgatggtttacagggaagcagattgggtaaaaaagactggcgacaagttgactatccttattaaaaagataattgagtgtgtttctgttcacccacactggaaggtgagactggaactggtagaacttgtggaggaccttcttttgaagtgc

SEQ ID NO: 100857 - DNA, 1767 bp, Homo sapiens
caggccgctccctgccgggcctcactgccgccaccatgtcctccttctctgagtcggcgctggagaagaagctctcggagctgagcaactctcagcagagcgtgcagaccctgtccctttggctcatccaccaccgcaagcacgcgggacccatcgtctccgtgtggcaccgcgagctccgcaaaggtaaacaccaaatccccaccccctggacggtccccggattgtcctctcgcccacatacaacctaggcccctctaagcctcttcattgagccttgctttccaggcctgatcgagcttctgagatgggagacaaagttagccccatttctcgaagaaggaaactgaggcccgggaaggtttaaggtacttgcctgagggtccacggactgggactcaggtgtccagacttctagttcatcaagccattttcccttcagtttccccctgacatttgtggctgttattatctcggctgcattcactgccgtactggccctagcatgtcgggcccagtgctgggtatttggagtaaaagccagtgggctccggagtcagactctgcagatcgagtcctggctcagctatttgccagctgaataatactgggagagtttcttcatctccctgtgtctccgttttctcatctgtaagagggaggcaaggatagctaccccttacaaagcctttacttcataccagtcactatactaagacctttgtgtgtatcctcgcactcagtccttagaacagccctgtgaagtaggtagtctctcccatcttaggttaaggggccacccagaccttacctctcctctcctctcctctctcatgcagttgtcattgatttcaggccctgctcaggttctgacagacaattcattgaactcattctgttatgtgccaggcactggcttggacacttgcagcatgttgcctctgccaactgcctagaatttaagcctgactttgccgccttactgaccccagcaacttaacctgtctgtgccttaattttcttatctacagaatggataactgaaatttactatgtctttattacatgcgaagtgcagtactgatatctttacatacattgccattaaaaaaaattctcggagccctatgaagtaggaactttgcagaagaggaaaaactgagactcatctcgtggtgaggagtaaacgggataatccaaatgaacatttagcatggggtgaggcacagtgtaggcattcagcagattatggtgagatgagacttttgattactcactgtgaggcatggtctttaccttcaagttgcttacagtctggtggggaaagatggacacctacactcccggatgagtttcataatggaagactgaagaaatgaagctcagagctgctccagacaccctatatgtggtaggcctttatagcgaagtggctttacaagtgttctatactatctgtgagttggggacaccacagatgtcctgctctacaggtgaggaaactgaagtggctaagtggtattttcaaggctttcgaactgaacaggctcagactacaacaggctggcaaacaccaaaatcttcatgatttttttcaggagacccagttctagccctttagcagggactgcccccaaatatcgcgtactgtactgagatagggatcccctcagcccttcgggcagttccgggaagaggtagagcctggagtttatggggccttcttcatgtaccccactgtgccattcagaaattatttgaagagtg

SEQ ID NO: 100858 - DNA, 1208 bp, Homo sapiens
attcaggtgttccaatagccacacgtggctagtggctaacttactggacagtgcagagttaaaaaaagatgctcttccaagcatcaatacctagcttccgaatatccaggcttatttcatgaactgaaaatgcccccacactgaaagaaaaggattctgtgccctaatgttcagattgattagccctgtaggttctacctagggtgaagtcattttccgtagctgagatgctcacagactgtctctgagttgccttcaaaatatatgagatttataaaaattaactttttttcttgcttaaatacttctattcctgatgtgttgtctttccattttctaggaataatttttaatttatcccatttgagctctgttctaagtagaacgtctccccttctttatggactagttttggtgtaaagtgctcctaaatgaatgtttttaatggtgttttgtatcttggcctgaatgtaggtaatgggcttttattgcagaattactttaagactttctgtagatgtcaaaaccagccaaacaagtgaaaagttttgattaaccagttgtttaaattttactcaacaactagtttgaccagtttggaatggacatgggtagtgagtgaaaggacctatttctgtcgtataggaaggacatctgaacaagtgagttgtcccccaggattgggatggaggggtgtgcatgttgtgtgtattgtgactgtgtgtgctcaagagctctagggttttgtcatatcaccttgacacacatggtgcttatgttgactgttgaggatgttgaatatggagggatacagtttatcctaaataaatccccattgttaagttctggggtgatgaaaattaattggcattgtaaacagtgaaaaccttgggtctcaagccccttagataccttgtttgtctactgagaagtatatatcaggtcttgaatgtccacactgacattttacaatatggattctaggttttttttttttcaacataaagtgtatggaattttaaagcttcacttaatgaaatttgctttgttgaagttctgttttgctttcgaatctgctaacttgcatgggattataggtgtagtagtttcacttacatcaactttgcagagcaaggtttgctttaacaaaaaagcacgttttgccataatcatacctttgtagcaacagtagatattgtaactactga

SEQ ID NO: 100859 - DNA, 2248 bp, Homo sapiens
acatatctacttgaccccccaggtagataatacttgtcttaatgtttttttaggagcagcccagggcaaaagaattgtgaattgagaatttctttggtgtaagttaaattcttttcttttctttttttcagccaaatcaaatagaaagcttacttttctgtatttagcgaatgatgtcatccaaaacagtaaaaggaaaggacctgaattcactagagaatttgaatctgtccttgtggatgctttttctcatgttgccaggtatgttgtctgttttttggatttgtttttaaattcattgcctttcccacctttttgttctttccttttctgtgatagcctttgtaaattgacaacttcctactttacagagagttgtggaggccgaattgtggttttatgttttgttgagccctcaagaactatcgagacatgtaaacattctgatacatttgagagattcagcctagcattatctttcttctagatatattcattttcattttttgaatttatttcttggttatggtattttccttggtttggttgagttgtctcatcagcttatgatcaaaaaacaaagctaactagtaagggaaccttttagtaacataacttaatagcaagaaattaattgccaaatgccttcctttttatttccttctggatttctagatgtctagtttactaaaaatagtaggcattactgtaactgcaataatagtaattattagtgtagaaagtaggtgtttgctctggctatattgtattaagcctggtgctgttgtgttttgtggcagagaggagtggcactcatacaactaataccatagaaagcatacattggattaaaagttttataaattactttacttcatgtaaaaacaaaagctttctgtgggcttaaattaggtgcccaggaaaagcaaagaaaaactatcgttcattagaatattatgtttataagtaaatatataaacagatatttgcaaaaggaattgggaaacatgaatgggagactagtaggttaaacataaattgttactaggtctaaaatatagtgaaaggccttaaatgagaaatgaagtcctgctttcattgcaggatttgaaaagtttgaaggaataaaattagaaatccaagagaaagaaatgacacctagctttctagagatgaaaaagatggtttttgtggataagttacataactggctcaccttttgatcaacatgggcgcaagtagcaaaatgtgttattaacttgaaaaaaatactgaatcttcataacagagtaagcttagaacagactactagaggagctatctgaaatagacagattttcttgctttgatgagatttagttcacagttgcttagaaattgatggtagctctgcctcagacactatgtgagtgaccttggatgtgttacttaactttttgagcccaaatttcctaactggctaaagggggaggataccactccccctcataagagttgtgagggtaaagacagacaatatgtttaaaagtatgtagtacaatgcctgttccacatttgctcattcattggatcatttgttttttcctatattccaggcacctagtaaagtgtctggcacagagctgctgagttatgtagcttgaaggaataccatttatatagcctccatgtaagtggtgtcccaggagctgggcaacattatggtctgccctgacacagtaggcgttcagtaaatatttgttaaatgagttaattaatgttaactcattatggaagagatttggtctagggagttggctggaatgatttcttgtagggatagtaaacataacagtgttattaaaaaattccagcctgggcagcatagtgagaccctgtgtctacaaaaaattttttaaaaattagccaggcatggtggtgtgcacctgtagtcctagctacttgggaggctgaggcagggggattgcttgagcccaggagttcaaagctgtagtgagctataatcataccactgcactccaggtttagcaacagagcatgaccctgtctctaaattacaaacagacaaacgatctgtaatctttagctgtcctgaaaccaaaaagtaaatagaaaggggtggaaaagggggtgggcaacaccagggttaaaaattccttttttcttgggaacaccttaaaaactagccaggttttaggtgtcttggcagattcagtggcagtgtgaggaagataaacctggtccttct

SEQ ID NO: 100860 - DNA, 1062 bp, Homo sapiens
tcttttaagattctgcttgggtattacattcaggatacccatgtttccaatctcctttcttataccccattattgggacagaaagtccaacagttctgcttcaaccgtgatgcagctcgtccacagtaggagtagcctaattaacatatactttctgtgtgctttttctgtggtcagttgatgaacaaagatagttgacccattactgttgactaaattgatgagggatatttttatgataaaagacacctccacacccaaaacaaacaaacagtaaaaaaaactctcaagtcagagaaagctgccaagttcataggatagatttgatttgaatagcagtttaattaaccagactgcaaacttgcttttcatacaagtgccttgttttcttcccagtgaggagacagctgtccatgtcatttttcattcaacatgtattggagtgccttctatgtgccaagtatggatccagacacggggggagcagcagtgaacaaggcaggcaaagacaattaaatgagcaagatactttcagagcaggacaatatggacatagtaaaatggagtgatgttctagagtaggatctcacaggtagtgtggttcaggaaggcctctaaggaaatgacatttgcggtaatcatgcgaagcgggagcagctattaagaaaaacttaaggcagagatcatcttggccttctaagagaaacagaatgaaggctggtgtggttagaatatagtgcacaaagggaaaagtgatatccagatgaggtccgagaggtggacatgcagcagtcacatacaccctgtaagtcttggaagttaggatttttttctcatgggatgtcattgaagagttttaaccaggggaatgatatattccaatatattccaacatacatttttaaaacatccctctttaaaaatggcttagtgtagagggatggattgtaaaggccaagggaggggcggggacatgagtttggaggatattgctgtgatgcaggctagaggtgacattgcctaggactcagaagcaatgggaagatactaatagcttccatt

SEQ ID NO: 100861 - DNA, 1075 bp, Homo sapiens
attgagtgcttccttcgtgggaggatccccacctctccagtgtaaaactgataggatttataggcgttgagtgggagctggtagtaagtgaaaagagaaatcaaagacgatttctaggtttttgatgtaaggaatgactgatggtgccctttactgaagtgaagattggggaaaagatttggtggaggaaatcacgagttttgttttggccaggccgagtgtgaggtggctagtgaatattccaaggagtgatgccaaataggcaggtggataaaatagtctgaagctcagtagagacttgatttctggagacataaatttgagagttacccacatgatatttacttattgttgtgggccccaagaccactcccaggtttggtgattccctagaatgactcacagggctcatcatgtagtcatagtcatggcagtgattcattacagctaaaggatccaaagcagcagcagcagcagagggtgatgtgcatgcagtacccgcagcagactggagcgctctgggtataagcttccgagtcctctctcagtgttattccacaaacacgcttaattcctctagcactgagttgtgatgtgtatgatgtgtaacctaccaggaaagctcattaaagactctgtgcccagagtttttattggattggtcatgtagacaccctctgccaaaattctaagctcccagaaataaatcaggtgttcatttttttttttttttttttgagacggagtctcactctgtcgcccaggctggagtgcagtggcttggtcttggctcactgcaagctccgcctctcgggttcatgccattctcctgcctcagcctcccaagtagctgggactacaggcgcccgccatgatgcccggctaattttttgtattttttagtagagacggagtttcaccatgttagccaggatggtcttgatctcctgaccttgtgatctgcccgccttggcctctcaaagtgctgggattacaggcgtcagccaccgcgccaggctcaggtgttcattaagaaccgtattgcttgcacaaacaatttaggcccagtaaacca

SEQ ID NO: 100862 - DNA, 1035 bp, Homo sapiens
gattgtgtttatacatgtagaggtgttggtgtgttagaattgatgagttgcagtgaatttatttcctgttttaaacatctggttttttaaaatcatttttctatctttaagagttctgatccacttttaatttccagcagaatgtctggcattttaattaacgtcttcttaaaaagcaagctatcacaactgataagatggagttttgataattttctgtctgtaaaaattggccattgacttttggtcctatttgatttcaattatggcatgatccctcccactgcacgaagaatgtagtttgtggtcaagttttgggtatccaggtattacaatatgtaccttatttggttttaaatgtgtaaatcatttagtcagttgttgatttcttttttttttaagtaggtctgtcctaattaaaagcaaaaaatcttaagcttatatatatcttttcatcttttctgggcagagaggcagatgaaggctgtaaaaaacctttagaaagattgctgaacatctggcaagaacgaagtgtgtatggcggcgagttcatacagcagctgaagctgtctatggaggactccaagagccctccccccaaaggtagaaacatcaccacatgtttacagctcttggtctttgcctactttcgaatcaaatatgaaaagctgcagtggggtttgctgtgaaccaccagcgattttatgattcttcagagagacagatgatcatgaatgatggtgagaatttatgtagtgctcacagcgtgtaagcctggttctagtattcatgctattcatcctctcacaccctgacttttgctctctgttctccttggcttgcttctgtctttcagagactttccttgcacaaggaaaggaacaacaaagttgttcagagttgtggtgaactaggaagtagcctggactaagattttgtccttgctctgccattaactacaataggaccttggataagtttcttagctttttaagaacttgatttaattaaatgtagatgtgcttttgaaacata

SEQ ID NO: 100863 - DNA, 1068 bp, Homo sapiens
ctgacatcttccctggcttgtctgggcccatgtggtcattccctccttgttctctggtactttatacatgcatctgctatagaacctagtcatgattagcatgtgtgacagtatccttcactgagtaacccttttgtgtacccttcatgatcctttccaggtctggaattatttgcattttgcagtgggtaactttcctgtgaaaccaaaggttagaggctttctgtgaatgacataagtgctttcagactgcaggtcattgttgttttacttggtgttgctagaagataattttaggatcactcaggtgattggtagcttctgaaaagcaagatgtttcctgctttggattctggtgtttttattgtgtcctttggaggtcttcagtacagctttggggaattactcagcattctttactctgccttagagttcattggtaaacagtgctggtttttaagaacacctttgggcaagtaggagagccttgaaagaggatgtttgaagctaatgttgaatttcaatttaatgtacatttgctggacacatactttgaataaacagatatgctagatgctataggaaagagggagaaaagagtgaggaataggtttgcactctgggaatgtgtggaatttgtggcagtgatagtattgggaatagcttcagtgggtttctgatttttttttgaaagtctagacagacattaacaataatagaggcagtttcctctaggtagaggataatgctaatctaaagataatttctctttctctattctataaagatgaaaacacacatcaaaagatttcaacatgtgtgttagtcccagctgactcactctgtcttcactctctggacctgagttatcagaatattttaccacagtcctttcaaatgttgatgagttctcgagaagtttatttccaaatttgagtagtccttttatattccagctttgattcatgggtaattctttgtcttcaggcaacttcatggagtttacctctgaaataaaaatttttctatggaactttgacagttcttacaacattagagaatgcatga

SEQ ID NO: 100864 - DNA, 1591 bp, Homo sapiens
cgagccaccacacctggccacaacacacagttgttaacatctgatatttatacctttattctatactggaaatgatacatcatttgaaattaagcaacatgaaccaaactccattgttttgaattgccaaaaacatgttcttttagaattaaaaaataataataattattcagaatttcattcatgttctgccatggacttagataaactaattttgtggattttcttagagtccgtgacattgacttacatgtaagctctggggctaagaacagttttttttaagaaatggcaggaatgactgtttttagaatttgcctccacctcatttaactccaactaattttctttaaaccccatgtcttaatgggtagtgttgtttgtgttttcatcttacagactgaggaactaatcaaagctttgcaggatctggaaaatgccgcatcaggggatgctactgtccgacagaaaattgcttctctgccccaggaagtgcaagatgtttctctattggaaaaaataacaggtgagaaggtagagtttgggtgaaaggtgaggagagagggacataactgtaatgcagtaaccctaggccatacttaacgtctgcaggtatagactactttccatgttgtattggttgctctaccatcttgggatttgcaaacataactcacatggtgaacaaagaaacttttgaaatagtcaaagcttgaatagtgattctaggaattattgcagaaatgctggtgtgccacaacctgtggctctctaaataaggtctgttaaaaacatagtacaaattgtgtgcgtgtggggtgggtgggggagattaggtattattctgtctgttagactcataaccctcttactaaaagaaaaaaaattatgattcagggctgtgtgatttgtgccctgctctctgacaagccccgtagatgatagtgcgttcagtgccaggaatttcaggtgtctgttagacatgtcattttgccctagtcgtgacctccctagttaaacagggaggggcagttgacacgattcctgctttccttatgggaaattgaaaggaaggaatgaagcatgaactaatattgacagtaggctttgcaccggtacttctgttctttgtgatagtctttggaggtgactaaatgtgtgtctccatattgcataggaggacattgaggctttgagaagataggtgtcttgtccaaggtcacacaagtagtggatcttgggattctaatctaggctgcaaagcctatgttcctccccttacaaaagctcagacctttcattccattgtcttccaaaggccaccattttcccactccagtcccttgacttggctgcttctctaacttcttccatatctatctaaaggaaatcaaggtcactgatgaaatatttccctcaacaaatatttgaggcccacctatatcccctcaagtgaagtgtcaagaaggaaaataaagcagggcagtgggagcggaaaatgattgcaggcggtattaatggtattttaaaggtgtttggggaaagcctttctgatgagatgaccttgagcagagacccgaaaaattaggaa

SEQ ID NO: 100865 - DNA, 1129 bp, Homo sapiens
ttgcttaatcaactcattgtttgtccacaggtgctggcttattctcagactctgtatattgggagagaaaccgttaacctcccccagaaatgtttgtagtcatacctgtgtgatttgtatattttctctattttttggtctcatttgtacttagacaaagaggcagctgaacgtctttcaaaaacagtagatgaagcatgtctgttactagcagaatataacgggcgcctggcagcagaactggaggaccgtcgccagctggctcggatgttggtggagtatacccagaatcagaaagatgttttgtcggagaaggagaaaaaactagaggtgagtgcattgaaggcagacccagactgcccacgtttcccttcctgtagcccacattaggaggtttttattatgctttaattaacaacatttttatcgtttaaaaattcatgatgtgaattctgaacatccatcagatactgtaattatttgagcccagttaaaaattgaagtcatgttcttatatgtccaggacagaacaaactggattgtaggaaacaaacagtgaactcttaatcacagccttaggatcttaatattgctttcgtttgaactcatgtttttaaaaaaattacgaattgaggtacaaaaaggatagcaaatcagtgaaaaccaaagaatatgtttggtagtatttgggaagtgctgaaaaatgtttctttcaagtcatttggaggtttatttctttttttttttgagacgcagtctcgctccgtcgcccaggctggagtgcagcggtgcgatctcggctcactgcaagctctgcctcccaggttcacgccattctcctgcctcagcctcccaagtagctggaactacaggcgtccaccaccacgcctggctaattttttgtatttttagtagggacggggtttcaccatgttagccaggatagtcttgatctcctgacctcatgatctgcccacctcagcctcccaaagtgctgggattacaggtgtgagccaccgcgcccagccgtttggaggtttatttctgactttatccatgctgcggccaagaagttgtctgcctccaagatctatctgtaattagctcttaaatgtcacagtagtattta

SEQ ID NO: 100866 - DNA, 1831 bp, Homo sapiens
gacatagcgtgagtgggttggatagggttcctgtcttgtcagcgtgaataaagcatgatacagacatgttctgttagcatgatcagtgcatgtggaagagtgtgtgtgtgagaaagaaacctatttgtacaagtattaaggaaagaaaaaaggtcaggaacctgcagttttcccttcttaactgtgatttttttttttttttttttgagacagactcttgctctgttgcccagggctagagtgcagtagagcaatctgagctcactgcctcccgggttcaagcgattctcgtgcctcagcctcccgagtagctgggactacaggcgcatgccaccacacccagctaatttttgtatttttagtagagatggggttttgccatgttgggcaggctggtctcgaactcctgatctcaggtgatccacctgccttggcctcccaaagtgttggaattacaggcatgcgcctccatgcctggccttaactgtgaattttattcagatcatggtgtctgactgtcagcgatctagaactgaaagcagatagtcctgtgttgacccacatgccacatggtgcacacacacaaagatgatatgccacacagggaagagctcttgagaaatttgttccaagctgcagatttattgttttagttgaggtgaaattcatataacgtaaattaaccatgcacttcaaagtgcacacattttggtggcatttagtacgttcacagtattgtatcaagttccaaaacataattgtgtctggcttctttcggcacgatgttttcaagattcatcccatgttgtagcatatatcagtacttcatctcttttatggtagaacactaatctgttgtatggatgtgacacagtttataacctgtctatggacatttgagttgttgccaccttttggctcttatgaatagtgttgctataaacagtcatgtggaggtttttgtgtggccatatcttttcatttctcttggttatgtataaatctaggagtggaattgctgggtcatatggtaattctatgtaacattttgaggaaccatcagactgttttccacagcagctacatcattttacatccccactagcaatgtgcgtgggttccagtttctccacatcctcatcaacatttgttattgtctctttattttcgacaacctacatgtgcaggtttatctcattgtgattttgatttgcattttgctaattactaacgatactgatcatctttcagtatgcttgtcggctgtttatctttggagaaatgtgtgttcaattcctttgcccattttcaaattgggttatttgctttttttgagttgtaaaagttctttatatattgtggataatatacctttatcacataaatgatttgcaactattttctcctataagttgtcttttcactttctaggtaatatcctttgatgtgcaaaagttttttatttttatgagttccaatttatctatttttgtggttgttgctcatgcttttggtgtcacatgtaataatctgttgccaatcccaggtcatgacaatttttttctgtgttttcttctagaagttttataattttatgtcttaaatttacgttcttaatctgttttgagttagtttttgtatgtggtgtgatgtagggggggaccaacttcattcttttgcctgtagatatccatttgtcccagcaccatttgttgaagagactactcttttcctccacctgaatgcccagcacccttgtcaaaaatcaattggccacagatgtattggtttatttctggattctcaattctattccattaatgtatatgtc

SEQ ID NO: 100867 - DNA, 1587 bp, Homo sapiens
attgaatagctcgtctcgggcaggggaagcggggagttggggatattaattgggggttttaattctattatcatgtcagctgacattatgactatataatgtagttagagacaatttttatcttgcttatagtaaaggttcagcctgccaattgtaaatcattctaatttggcaggcttatttttgacattggaaagggcagaaagcgatttgccccagtagtgtaataggagttatagaccagaggctgaaacccaaactatataaaaaggaattcagtggagggggctttgtaatctccattaatttgtgttgctacttccaggatcaccaaaaattacatgtaattttacatgttaaacacattgaaacataacctatgtttataaagcataacgggcttcccttccagaagctctcctgcttgtcatgaagtgagaacaatgaaaagtcatagcagatactcagtttaactctgtgtagaacctagtagtgtttgagctgttattcagatttgaattcagactgtgtgttgtttgcttatggacactgcctgtcgttctgtcactgttaaattaatgagtctataaggtttttcttccagaggccataggtgacatcactaaaattgcaagataaattgtaatctttgctgctgctgcactccccaacctctcccccaccccccgtggtgtgctgctttctagatgagcgtgttttggagcaggcccatctgggacactctatgctttcaccaaggaagtgcgatctgagcagccacaatccagccaaaagaggatcgtagatatttgctctgatcaactagatgaaaatatagcagaatggatttagcccactgctctgttttatccaactgagtctctgaccagcaattggtgcataattattacagcaaaagttaagaaatgaaactgtagcaattatgtaaatgaatgtgttggcctcttaatacctgttactagtggacttcctgtgaggaagttagttttttgttttgatgaaatgctttcgttttttaaatcttaattctgctgtccacatcctcccaaagtgtgcttacttcatttgtttaatttaaatgaactttcctccttgtatgtatgaggtgacttggtgggtggggtgggtggtttttgtttttgtgttttttctttcttagggcatctgtaggcctcaaaggacctttcctttaggtcatattcctcagaaagtcttcaatcttcccttgtttttgtttgtttgtttttcttaaagaatattttcaaagcttaaatttgtatattaatttaggactatttagaagtataggctgtcgttggcggcagcagtatattctgaaatgtctcatagatatatatttttgaataaagatggtgttgttgaacaacattgtgtgattttttttttaaactaccctgttactgaaaacagtgcctttctttgtaagcagtgggtgattagtaatcaccaatagagaatgtgctgtcggcacagaatcttgtcccttgggagtttttgtgtctgttagcggcacataaatactcagcatttacgtagtattttctg

SEQ ID NO: 100868 - DNA, 1073 bp, Homo sapiens
ctagcatgttgtcagttggcggtcaacaaatgctccaggaacacagggctttaccagagaaaggctccaggttgaggttgagcaggtacttggtgccacactcgggccccaagatcccattgtagctgacggtgcgggcacagagcaggaggcggcagacgtactcctcagcggtgttgttggtgatgtgggcaaagacgtcaaagtcactgcccatgttcatgctctggcccacacggatccgcatggccatccctgtctcctccttctcggccagtttgttcaggtggttcgcccttgtgaaggcctccctctcctctgaggaccctgtaggggttgagaagagagcctcaatcacagctggaatagatcacaggaagggggctgcaacagggcgagctgtcttcgcagaggcctgatgactcagggcagccatgaaggagccccttctctacatttctgggccagaaggacacagcatttcattaattttccactagtgaactcctatacatccctcaagactcaaccccaaatgacccctcctccaggaagccctctctgaccactccttcccctgtgttgttttctgtttcaaacttaccttcttgagctgctcgagggctaaggctgtgttttacttatccagtgcctacaacagtgcttggtgcatactaggcacgaatacagtgcaatctttcttaccttcaagcaattacacagggattacttctacctaaaatcctttccctccctgtctctgattgctcccttccttatattccatttgcctctctcctgtgctcctttgatttttttctcccagtgttgttgggtgcatatctatttattctatgaaactatcagctctagacctttcaggggatggggagagcatcatttcattctgtgttatccctttcagctagagtatggccaggcaaccctggaaagtcagtgagggtcaggccaaggcaggaactatggtttcttagtcccctctgtatgctttgctatgcttagtatttgcttagaaattagataccatattgaattggctgttcgatgtgctc

SEQ ID NO: 100869 - DNA, 1045 bp, Homo sapiens
tcacagggcatgcaactgtttaaacatttgccaattgccttccagaaaatttcaccaccagcaaggtttgagaaacactgttttcccattgggggaaacatttattttttaaataaacgagccaatatattttaaaaaagagagtttggttggtgccagatgtagcttcactctcaaccctgccgtctgctgggggtgagatctcaagggagctatgtggcttttttgaacctcagtttcctcatctgctaaaccaggccttcctagccgagctcttaagagactggctgagatgaggcaagatgaacagtgatgaatatggggtctttctgtggggagggtggacagggatgatcataggagtcaggcttcctcatccactgatctaggcagtgaaaactggcttctaagtatgaccttatgacttcagtgatgtcgcaagcaggttccagtccctgtgcctccccttcccgctcccaggaacccatccagcctcaggaactgcccccagccatcgagccttggctacttaagggacctgggcccaatccacagctgggacagtcctggcccactgcactgggaatctaggatgggggccttggccagagccctgccgtccatactgctggcattgctgcttacgtccaccccagaggctctgggtgccaaccccggcttggtcgccaggatcaccgacaagggactgcagtatggtaagaagccacatctgctggctggacttggcaaacccacgctccaggctgctctgggtacagtggggacagggagtggggacacagaccggaccctctccctggggcagtgccaccttctgggtcaggtggctctggctcctattctggccttactgcccaccagctgagtgccctgggcatgttatttgtggtagtgaggtcctccaccagccaacagaacacagctttgcgtgcaagtagttgatttgggaaatgattccaggaaacactgtagggaatcggtactgagatgaggaagggagggcagccaggagagagtgtgcaat

SEQ ID NO: 100870 - DNA, 1052 bp, Homo sapiens
gctgccaccatcttccctgaatctgtttcccccctacctggatgtattgagagagaggagggttagcaggaactgcaaacccaaagggatatgtctacggaccttctcaggatgccaccgggggtcattagattcatgggttctgatgcagactgcaaaaccgtgagcaattgcatcccttcctcaaggttctatttccccctttgtggaaagggagcaagaacactgctgaccccttcagtgtggcccatatggcatgaagaaagtaacgtgcttagcatggtcataagatcgatgcctggggcacagcaggtgcttacctggagcagatcctgctggtctagtccccactgtggagaggggaggcgcaaggtccctggtgaggctgggtccaggcccagggctgacacctccttccatgtctctcccttcagcctgaacatccacagctgtgagctgcttcactctgcgctgaggcctgtccctggccagggcctgagtctcagcatctccgactcctccatccgggtccagggcaggtggaaggtgcgcaagtcattcttgtaagttggctctgctcccaggccctggagctcttggccttggccttcgccccatccttcttaggtccaaggtgttcctagcttatcagaaaggccacgtgatggacagatggagtccaagcccggaggtggcctggggattgagtcctggctcttggatgagtgtctttctgtctctgagtctctacttcctcatctcccaaaggggacgggcctgcttccttgatggagtcatgggagggctaagtgcggtaatatcatgtctccttggtttgcttcccacagaagcagactttagggcaagaattccagtgcaatactttatcttggaagcgatctgaggaaacccacaggggagtggggaagtgaggaagggaagggaagggaaggaagtcagcctggtgggcaagtgaagctctgtctagctggggaactcagggacagtggagaacacgcctctgagttactccagccccacgctgtcacccc

SEQ ID NO: 100871 - DNA, 1129 bp, Homo sapiens
taattccagctactcaggaggctgaggcaggagaatcacttgaacctgggaggcggaggttgtggtgagctgaaactgcactactgcactccagcctgggtaatacagtaagactctgtcaaaaaaaaaaaaaagagtgggatagtccctgagaaagggataggtatagggctgtggaaccacagagcacggagagtgttctcccaggtagagggcttgggaagcggacatggaggaagagatagtctattccagaagaggaagtaggagagggactggtggagacagtgagcagcacatgccaggagcagcaggagggtgggcagaggcatagcaaaggcccaggcacatttgaaggtgattgtagagttcgatctgcagccatgggagtggcccccagtcctctgaacagcgcgacccctgtcatccagtgttgtggatcctatgtgctgctacttggactttttaaattactctggattcagagagcacagccacacagtttcatcacttactggctgtgtgaccctgggcaagtcacttcacctctctgagctgaaggtttcctcatctgaaaactgggggtaatgatagcatctccttcttaggattgctgtgaggattcaatgagataaacctcaaattagcacatgcctggcacctccaagggctccatagaaaggtggggtattactgtcttaccgtgtaattgaatggtggcattataacgctatttttcaggaggcttgtgaaaaaaataacttctcattaaaaaaataattttagactttaaaaaagttgcaaaagtagcacaaagaattcctgaatacctttcaccaagattacaaatatacacataaagaaaaaaacagggccgggcgcagtggctcacgcatgtaattccaacactttgggaggccaaagcgggtggatcacgaggtcaggagatcaagaccatcctgcctaacacggtgaaaccccgcctctactaaaaatacaaagaaaaaaaaaaaagttagccaggcatggtggcacgcgcctgtagtcccagctacttgggaggctgaggcaggagaattgcttgaacctgggaggcggaggttgcagtgagccgagatcatgccactgc

SEQ ID NO: 100872 - DNA, 1489 bp, Homo sapiens
tgtattcctgtggattactctagctggtcatttgccccgattgtgaactgcttgaaagaaaaacgaaacttctaagatgtttgtcctttcatgtcctttctgttaggattttttatttggtgtgcgtgaatgaggagcttcgccctgcttgaatgggacccctctcagtggtgtcagcttggggaggaggagatggccctggagactaaatacttgtatgctttcttaccctcttaggtctcagccttagatccaaggacagtccaaggaagtcctaagaccatggagttggtgatctgggatctgggtttgctgatatttctcaccgtggtgagttgatgccaagagccagaacccacagccagaggctcagctggtccgtgtttatgcagatgggaacctcaaatcactggtctcacttgtcctttgtttcagaatctcttggtggtgtttgtgggcacgagaggggcagagaatggagagtgaggctaccacatgaagcgtcaccagagctgctccctgctgcctgctcagagcaccccggatccactgttcaatctgcacaagattcggggtccagacatgggagacttcagctgcctcagaggaccgtggacagggaaggccagcctcgcatccctctgtccatgcctggaatgactttaataaccaagagttttatttttgaatttgtagctgtcgttcactttttacccacccattcaataaaccttacagaattgctccatgtgcttcttaaatcagtgacaacctgtgagcctgccaggctggctttggagaaggtaggccataggccagatctgattttcactcttccttggctcagaggatattgtttgaggtatacatttggaactaggaggtgaacaagtgctggtagttggttcacatttaggcatttaggacccatgataattcagggcattgcagaatagtcagggtagattatggagtgagacaggtctgatgtcattcaggaaggctggagtgtcctggatgacgcggctcataagtaaatgcctacttgtgagatcaactgtcccagtttgcctgagattgagggacttcccagaaagtgggtttttcattgctaaacccagggagatcttgagcaaactgggacaagttggtcagcatgtgtgggatgtaaaaatccatggtgtcagcttgagaggacaggttatggggtaacagtgggagtagggtgaacatggagcagctgccattgatggaactgaggggtactcttaagttcaggctttggagattagggtaaagtcacttattgcaaggcctaggcatggtgccttgtgcctgtattactagcactttgggaggccaaggtgggatgatttcttgaggccaggagatcaaaaccagcctaggcagcagaccccgtctccacaaaaaattagccaggcacggtagcgcactcctgtagtcccagctactcaggaggctgaggcag

SEQ ID NO: 100873 - DNA, 2312 bp, Homo sapiens
tgtgtgtgtgtgtgtatgtgtaacttggggacaggatagggtagcatctttacatctttacatgtcattggcctggaatagggggtcctgaagggtttgtcgtaagaaagagaaagtgctcattgctgcaaggggagcacagccgggttctgagaggcaaaacacttccctcacttcccacccaagagtttcgcctgttctctcgaccctctgaggtgtgcattggtgtcactcactggccaccattccagctcttaattcctctgccttttgtgctggcctttggggctcccctgaggatgactggttctcaggttgcccctggaggaatgggtggagttgtaagatcaggaataaagctagagagggaggaccaaggggaagtcactgatgcagccgccgtctagcccatcccaccccgattgagaggtcgctttttcctgttgaacatgttggatagtggaatgtgttataagaagtgatatgtgtggcttcttgtcattgcaggattgtcagctgacctctgtcctgtgtgcccagtggccccaggtgacgtgtcttcaagaagaggctgagctgcggtgcttgtaaggtatgaatcctgggtgcttctctagagaatgcactggtgttcaggctgcaaggacgaaggctttgaggtcactagaggggaggcagaggctgcttcccattgcttgctcttccactgaggcccacagggacatgtgacaccctcttttcctcgaactctgcgactccactgtgtgaatcacggtggggcttacagagctccccttgggctctgagtcatcctagtgtggattggcatagtttgttgaagtgggaggagtactgcattttggaggcaggcagttagctagtggttttctctggacttggtggcgatccttgttatgaagtgatttatggatttttttttttttttttttgaggcagggtctcattctgtcacccaggctggagtgcagtggtgcaatgatggctcactgcagcctcgacctgggctcaagtgatcctccacctcagcttcctgagtagctgggaccacaggtacgtgctgctgcacccagctaatttttagaaattttttgtagaggcggagtctcaccatgttgcttgggctcgttttgaattcctgggctcaagcaatccttccaccttggcttcccaaagtgctgggattatggatagtaagtccaggcctggccgacgtgtggatagtatcacacaatccctgacttcctaatccagtgaattctcaacatttcacccagagttgatcttccatctcattctcttatgagggaagcatttgagtagtggttctcaaactgtggtcccagaaccaggtaccatcagtattacttgggaacttgtaagaagtgcaagttcttagccctgtcccaacctactacatcagaagttttggatctggagccagcaatctggcttaacatggtctccaggtgattcgtattcatgctaaagtttgggaaatcaaaccatgttagaaatctttgggaatcagaagcagctgctgcaattctaggctgcaaatctggtcactgacttgtttccaggtctcttagtttgggcccttcctaagctgctgtcagtgcctcccctctcaactcactcactgccctattttgtccctgtattcgaaagtgatcgtgggctgcctttgccctggtcattgatagtgcagggagaggaatcaatgaaagcgcttccccgtgtttgaagggtccactcctatcccttccaaactctggagctttcgtacatgcctttattctcaccagtgatgttacctcctggtacctggttgtcgtgccagacccctgtttacctcattagggatggcaccaggttcaacaggccggagaagagacctggagccagtgaaggaaacagggtttatctggggaacttgagggcagtcagcagtctagtggtggggggctggatgggggcacctcatccacttgtaaaatgcatgcagattatatagcaccttcccccagtaacctccacatggcaaccctcgtttcctaagaagctattgttacatgcatctaccatacactggtgctgtatggttcattgagtgtcccttgtgcctagcatgggactcagaggctcctgtcaaaggacagtgaagcagggacctgccacactgagtttatgtctctgagctagttttggagccacagtagtggttaccccttcctagagctccccccagaagctctctctgcctccccatcacactccttcccacctctcag

SEQ ID NO: 100874 - DNA, 1496 bp, Homo sapiens
gctggagtgcaatggcgtgatcctgactcactgcaacctccgcttcccgggttcaaatgattctcctgcctcatcctcccgagtagctgggattacaggtgcctgccaccatgcctggctaatgtttttttgtatctttagtagagatggggtttcaccatgttggacaggctggtctcaagctcctgacctcagatgatccacctgcctcagcctcccaaagtgctgggattacaggcgtgagccactgcacccggccagcccagtctttgagaagagccccaggattctcaatatttctgcccatgtttgccttcctttctgcttctggcagggagtggtaagtgatctctgggagtcagaagcagcatctgtaatcttaggctgtaagtctgctcattgccctgtcagctgttctgttccaggtgagaccattgcccggaatgccagcattggcctcctttctgggcttgccctctgccctttctgcccctgcattcgaaagtgatcatgagctgcccgtgccctggtcattggtagtgcagggagaggaactgccgagagcacttccccgtgtttggagggtccactcctgtctcttccaaaccctggagctttcccacacctcctccctcccaccacgtcttagatggctcctggtgcctggcatcatctagtgggttgtgttgctcttctccctggcccagggcagttattgtgagacatgagggaagggtgtggggtgatgggtttggcctcatggagcagaagggctgggtgtggagctgagatagggctgccctgctccttcctcccggaagctttctctgcctccacacctctccttccacgtccttatccagcccctgcaccaagctgaacctgtggaaattgttgcctgacttgtttcctggctctctttgctgtggtctcaagggcagtgtctgaattttgttccctactttgttatgtctgccagatggtcagtattctgacagtgtgggacaaaggaaaaacggcagcctgggcaaccccgcctctataagaactaaaaaattagccaggcatggcggtgcatgcccctgtagtcctagcttctcaggaggctgaggcaggaggctctcttgagcccgggaggacaaggctgcagtgagccatgaccatgccactgcactcagcctgggcaacagagtgagaccctgtctcaagaaagaaaaacgagaaagggagagtccctccactgtaaggagatcgggttcattacattttggggtgttggagaaaaatactgagtcagcacctgtgtgggattggtgggagcagatttggtgttttccaccccttcacaggattctgaggtaactcatttctgttggccttggccttgtatggggaggatttccctccagccttgtatggggaggatttcccttgtatggggaggattttccctccagcttgtgggaaaggaatcaaggaccagagacaggcagggg

SEQ ID NO: 100875 - DNA, 1845 bp, Homo sapiens
acctcctccccgacaaaaggggaaactgaggccccgaggggagtgggaagagccggctggacgtcaggcccagccgctggtgcagtggtccgtcccctctgccggggtgggcccctcgggtttcgcgtgtcctcgggaaagagactggcgggtgagccgcgccctcggccttcgctgggctaagccgaccccatgcagacgtcaaacccccctaggtcggcacagcctctctgcggggaggcttagtgcccccttgagaaacggcttggcaacgctgtgcccggggccttgcacgcgggctgagggggctagagacctcgcgacttttactcccccgaccccgatctccgactcctgactttggaagcccccaaagctgcttttcggttgcctacaaagtgtcggtcattgtgccacgtccttggaaccgtgaactcattttctcctcaataacctttaaaaagtagctgtaaaacctccattttacagaccagttggctgaggtttaaatggaggacgctcccagggccccagaggggcgaattccagactcctttgccaggaccttgtactaagccccttccctacgcttttccctgcctaggcctcgtgggctgtgcggctatcctggagacagatgacagctctcccttggatggctttgctggttccgcaccagccagcgcccccatttttcctgcagcaccctgatctgcactccctgaggggctcccactgtccgcggtgtgaggatgtccctgggtaagtggtgctggtcatgagcactttgggggacccttcaaattcccttctgggggaccccagcggagggcatggtcatgaattccgagaactgtatggcaaagccgggtgcagaggagagcctggctaagttctttcattctcctgagcttgactttctgtaatgtagggaaactgcgaaagctctgtaagtggggagatcttgcacgtttttcttgcttttgaacccatgatgtctggctacttgtagatactcaatatttgtgggatgaatgaacaatttaagccttttttttttttaaccagaaattggtcttctgtgactttcttgatgggggcagatgagatctttgtactgcattaagtggatagcgctcaggtcctttgggcttggcgctttggcaatctccaggcagctcactttggcctctgttcctggatcccctttgctcttttctgcgcctgcattcgtaagtgatcacgggctgcccgtgtcctggtcattggtagtgcaggcagaggaaatgcgggaaaggttgctgtgtttggagggtccacatcttcaccctcctgtcccaggagctttcctacactcctccttctcaaagctgcacacacctggggcctccaggggattgggggctgccgtgtgtgttatatcatgattagagctttcacttcctgctccctgctgttgggaaccaggctgtgtgtgttgcttaaattccccttgatgaccagcagagtcactgccactcagccatggcacactgctgtaaacctggttttgatctcctttcaatcttttgctgattaactacacattgatcagtgttggccaccctcaccctgccatagaccatccgctgtcttcctctgtagagttaactattttctcttttatgaggaaatagtgtgtttgcttaggagtgtttactgtctggtaactactgtgctaagccctttcctgttgcctgccatccctgctgcgagcagggacaagctgggtgctcactcatggcatcttatctgttgcagatagtccactgtgtgcagaggcatgggagttgtcatgttgggaac

SEQ ID NO: 100876 - DNA, 1778 bp, Homo sapiens
tgctctggtcatcaataacgcagggagaggaattgctgaaagccgtttcccgtgtttggagggttcacacctgtccctttcaaatgctggcgctttcacacactccttctctcctgccagcaccttctggtctcaggagcattgcaggatgttgtgtgagtgagtgatgggagacactttagtatggcttttttcagcttagcctcctgttatcagagagcagtctctttcagtgtcaaggtttgagtactagatggtggagaaagcctgtgtgaattatttttaatgaataagtgtgatgatgggtggcatacagtcactgccttaagattttcaaagagaagcagccttttggaggtggtgggcctgggcaggtctttcaaggagtgggatgtgatgggcagtagaaaggtattccagggaggggtagcaacatgagaaggtctttcaaggattgggatgtgatgggcagtagaaaggtattccagggaggggtagcagcatgagaaggtctttgagtctgggatgagcaagagtgtctagtcccaccagggagacagatgtgtaggcaagtaatgacagcatggagggatggctgctggggtgatccttggctcccagcacggcgaggtggacatctatgggaggggccctgagaggtctcttgagctgtctttctgccagttgcacatctgctcagttgcctgttaagactcttaagacagttttgctggactcttaagtttttattttgatattctttgggagcattgagattcctttttgagatgagtttggtatgaaagaaactggcaactcatacctgattgattaactgggggcattcccattgacatcagcttgaagaaagacgacagaacactggagaccaagtacttacagccttctgctctgtggcccctcctcactccagggatgctgccttgggtctggaaactgttagaggaaaccccaagaggtgcaggcactgagcctctcaggacaatgacctggggtcccagctcccctggaggggcctcctcatggtaagtgaatgccaagaggttaagttggcctgtgtttccgaggtggaaattccaggtcgctggcttcatttgtcttctcttttagattgtttgggggttgatcacagaccaagagtgacgagtgatgtcaccctgtgactcatggctggaccttcttgcccctattgtctcagcacaacattattcgacttttccctcagcgtgggtgggcagaggaaaagccctgtggctctggggacttgggatccagagttgaagacccttcagctggctctgccctgccagtgccacagagtgccatggcccaggaagacaggttttcttccatctaggccaggccatccagtggccatcctccgtgtcctcccgcctcctcctggtgtgacttctgaaaaccaagaatttgttcctgttgactttttctgtgctatggaccattgtcctctcacccactcaataaatcttgaaacatgccctgctgcttgttctttcatttttgtgtgtttggtttttttttaatcagtatctccgtgtgccagcaagactgggtgtagagagtgggtcacaagggcaggtcttctggttctcactcattaagactttccccttgacacatacccaaggcttgacctagggaatgtgagatgggacgtgggatttggaccggggttgaacaataatcccaagtgcatctaggggtgggggggttcaggcttaggagagaaggggaac

SEQ ID NO: 100877 - DNA, 1034 bp, Homo sapiens
cctatatgcatatacacacccttttcttttctttctttcttttttttagacagagtcttgctctgttgcccaggctggaatgcagtggcatgatcttggctcactgcaacttccgcctcctgagctcaagcagtcctcccacctcagcctctcaagtagctgggactaccacgcttggctaatttttgaattttttttgtagagatggggtttctccatgttgcccaggctggtctcaaactcctgggctgaagcagtccacccactatggtctgccatagtggtgggattacagatgcgagccactgtgccaggcctacatacccttttcttcctgtctctggctgcattagctttaagcattcccttcaagatacctctgtccctgacccctacccaccttgagtccttccaatttgctctttaggaacatcgtagtgaaacttatcagttatttttctgagttgtagttctatccctacttctagattatgagaagctttagggcagggactatgttttcttcatctctgtattccttccagtgctttgacatacagactcacaaagcttttactcagtggaatgtttgggtccttttatgtcatagatagatcatgttgcgaacagattcttctctatttccatttttgtaaaagatgtttggtagttcccagcttatagagttttgttctttttgcttaggagtgagtattctagttatgttcagcaatttgtccagcagttgaacacacacattgagttcttaccaattgcaaggcactctgtaactaaccatgtgcaatcaacattgtttgatttttaatgtctgattctatcacaatcggacgcaatcatgtctgtagggaaagtctttttattactgttagacctttgcatgtgttccctacttcattgtccaaaaaagtgtttagttgtcatccactaaatgccactgccttgttggtatttggtaaatacaagcagatgggattgccattggtaatgtttggtcctgttcaccaggagagagg

SEQ ID NO: 100878 - DNA, 1031 bp, Homo sapiens
tgatctgctatgtttgagaaactcaattagatatctagaggcccctcgacttatgatgggattacttcccaataaacctatcaaagttgagaagatcgtaagccaaaaatgcatttaatatacctactgaacagaatagcttagcctcatctaccttaaacatgctcagaacatttacattagcgtacagttgagcaaaattgtctagcacaaagcctattttataataaagtgttgaatatttcatgtaattgattgaatattgtactgaaagtgaaaaacaatggttatgtggataatcagagtacggtttttactgaacgcatatcactttcacaccctggtacagttgaaaataataagttgaggatagtgagtacttggtgtgtgaaatgcacttagctatataaactgggaatacaaagataaataagacacggcccctgtcctcaaggagtctaatcaaagttataataaaataatagtgtagtatctgaagcagctctgtcaaatagaattttctgcaatcatggaactaaatcttacttgctctaatatggtagccactggccacatgtgacttgtaagcatttaaaatgactagtgtaaccaaggaagtgatgtttgactcaaatagtttaaacttaaaactattaaaattaaaagtttttaaaatttaaatagttacatgaaatagctgctgtattggacagaggtctgttttatgcctcagagaaggtctcaggcataaaagatgagaactgtggtggtgctggtagggggcagacagggtattcaaacgttctttgggtagcttaccaaaaactaccattttccatgttttgggagagatgcaggcagaacctgtctttgtttcctgtaattcaggtgtttgataggatctctaatagcatctggtacataggtgaataccttccttttttgccagctttattgatgtttgccttatggggtcaatgggactgcaacagcaatatgaatcatgaggttatatggatgaatttggtgca

SEQ ID NO: 100879 - DNA, 1656 bp, Homo sapiens
tgcctgtaatcccagctactcaggacgctgaggcaggagaattgcttgaatcgcggaggttgctgtgagccaagatcacaccattgtactccagcctgggcaacaagagcaaaacttcgtctcaaaaaagaaaaaaaatgtattttccattgtgacccagaacatatgcatatattacaaaggaaacaagtttcacagaaacattgcttgcctttattatgtgtgatgcctttatcatacatcctataccatctaattaaaacaagtattatccataacatttatttcatgacccatagtttgaaaaacattgatagtttcatgacccacagtttgaaaaacattgatagaggcaagatgtttgcagcattctttatcatgccaatagtctatacatctgttttatttatttctgttaatttccaatagtataatttgacatgcatttctgttttgtcttttcaggtgccatttggattgtactttagtggcacgatgtactctgagtggaggtcactgcatttggtgattcagaatgatcaaggccataccagtgtgctgcacagctatccagagagcgttggacgagaggtggcaaatgctgtagtccgtcctcttgggcaggtgttaggtaccccttcagtggctggtagtgagaatttgttaaaaactgacaaagaagtaagtgtttctaaatttcattctcttatatgaaaatgtacatttgttcttgaagaatttgtttaatgttaacttttttgttcttttttctttgaaaagagctgtagtagaataacgtcaactttttaatggatttctccccaacgtagtatgacttctcaattttgatcttgtttgagttgagggctgggactcggagtttgtggaggttataaggagtgagttgtactgttttgctgctgggactttttactagttatggtcaattctccacttgagctgaaggccaagacaaagacttgaatgtcaaacacttcccccaaagatctaggcttagtcttctgatttccatttagagtgtgtttggaaggcctcatccctacctctggatggcccctgactgaagactcatgtcaagttttcaggctatgtgtatgctgtgcttaagctctcccctgtccccatccctacctactccttcctggcttccaggtttaagagtgctgcagagaagccaagcccttctggcctaagcctaggtgattggaattggggttgtgtttgctgtttctttttttttgacagagttttgctttgtcactcatgctggtgtgcagtggcaccacggctcactgcagcctcagtctctctgggctcaaatgattcttccaccccagtgagtccccagtagctggaactacagacacatgccaccacgccaggctaatttaaaaaatttttttatagagatgatgttcttactatgttgcccaggttgggtgtttactgtttctaaagataggggctcttggaatggcttgccctgaagctggccctttgttcttgggttcagcggcccaggctgaagttaaaaagttgccattgggaagtcatgaaggggccctgagaatggagtgatagaggagcttgctagtataaattctggctaagatgcaggattaaaactttgtccct

SEQ ID NO: 100880 - DNA, 1069 bp, Homo sapiens
ctcttatgtggctaaatcttgctacaccctgctccaaatttgtcacagcttcactgtgctgttataggcttctttaacacttactgcagttaaaccatgtatttcctacccttaacctttgtagttgcttttgagcttaacaaatttaatacatatatttatcttgttagatttaactttggttttaagctgttgaagcctttttgaatcctgaatttctgtccaacaagttggccatcctttttagctttgtggtatctacagatgatcagcatacactgtttttctttttttttttcccctaagttagaatcttggcagagcctttggcatgccactgagcacctttttccaaaatgatcttggcatgttaatctactgttactctgtcatgtgatgtcttgaccagttgtaaatctagccattctaccatcctctgggccatatgtctccatcttgtccacaaggagatcctgggtctgtctagatttcttgctaacacccagatacccgtttgccggagaactctgttaatggtatggagagaatagcttaaaatttctagttggaagaccagggttcaagttttcagctccaccttttataaaccagtgacttatgccaaattgcttaatcttgctaagcttctgttttcttatgtgtacagtaaggatagtttaccctgtctacacagagttattgtgatggctagatgatatttatgaaagtgctttgtaaactgcaaggactacactgttgtcagccctctaaatagtaaccctattaataaaggaatgaagctcatttggcatggcttgatcttattgagcaggctgggtcttggtgatcatgcttctcttttgtgagtgttcactgattgcttagtaatttgtctcaaagttttgtctggaattcacttaaactttccagtttacaatgtctggaatacagtttcctcccttttttgcaaattggggtttctcatagatggagacatatagctcagatgatggtagaatggctggatttataattggtcaagataccacatgacagaatagtattagac

SEQ ID NO: 100881 - DNA, 1113 bp, Homo sapiens
ttgtaaagtaagagtaaacagttgatctttcttcctgttgtttgtgcatttgcataatctggagatggaatgtgactgactttatatgattttctaaatgctacacatacttaaacattaagtggagaaaaaactctaaaatgttctattttgcatatctaatctctatggaaatttgaaatgacctgtatttactttttagttcacagagcaaataataataatatctaaagggtaaaaaccagcataggcttgatattcaaaaataagtaatttattttcttcttaaagcttttgcttgggaaattgtatgtttgatatgtgaaaaatgcattatctaaaataaatctgatatttacgttgagacgaatatactgtcaatttagaggtttttggcaataaaagagattgacattttaaatcagtctactgagataggaacgtgtaataattctatatggatattttcttttgtctaggtaaaatggaccatggaagtaatttgctatggactgacccttccattggatggagagactgtaaaatattgcgttgatgtatatacagactggattatggctttagtgttgccaaaagattctattccattgccagttattaaagagcctaatcaatatgttcaaactatactaaaacacctacagaatctttttgtaccaaggtaagctatacctgtctatctggcccattatcagggtcatagtaaaatattcataaacgttactatagtataggagctgatttcattgttagtcctctgaacagtgacttcatgtgttcagttaaagattgtattaatgtgaatgttaggagagatgggcttatgtaatgtttactaggagtttttaacaggtatgtgttctttaaaggtttttagctttgcttctaaaatctcatacctgttagatattaaaatactgtaacatctttcccttctactcaaaaaaatatacttttgcctatcacaattcttgtttccatttaggctaaacacaactaagggagatgcatctaccttaataggcatctttcctatgagagagtgaagacacttgaaatgattatgggcaaattgttagtaagccaaaagat

SEQ ID NO: 100882 - DNA, 1050 bp, Homo sapiens
atcgcttgaatctgggaggcggaggttgcagtgagccgagattgcaccactgcactcagcctgggtgacagagcgagactctgtctcaaacaaaacaaaacaaaacaaaaaaaacaggaaacggttgggagtacttagaatattgtttataagcaggttcttctaaaatggtgtaatagttttaatactttcttgttatcttatttaggagcctactaggctttttcttcgtgcctgggatagtctcatgagtagtattgtcactgtgtctctttcctctttgtaagcctactacctttcagtgctcagttaatttgtattgatgaaaaaaaattaatggcatttgagttaattaggcttgtgcctttacttttctcttttgagaaacatgactaccttataaatggttttgctatttggtaattaccttgttttctcaaaagtatgtgtgcataagtgttagtaaattctgagagggtactcaactgagaattagagttctcttcctggctaatgttttaggaaaattagctgaatattttcaatggtaagtattggtgttatgatctcatctcccattatttgaagttttagttgtttatttgattctgatagttcacaaaactgtcatctaagtttacttaattagttgtttttataaaaactgacattcaaaatggagggaactgcctttgccattttgctagagattatgtcagaatgaatgtaacatttctcttttgcccatcagtttgatttttttttttaagattgagtgaagagtaaatcatcttttaaagttggttaaggttttaattgctcacatatactatactgtactttagaaaaacatattattgttctgaagcagggttagcaaagagtcagatagcattttaggctttgcaggtcatatagtgttataattagtcagttctgctggtgtggcatgaaagcagccatagacaatatataaatgaatgatcattactgtgttccaatacaacttcatttacaatatagatagtaggccagatttgtaaactctat

SEQ ID NO: 100883 - DNA, 1988 bp, Homo sapiens
aggaggaaggagcctcagtacctgaggaacaggtatttcctttcctgtcattgggcaaatacctggaaatggtaggtagacctaagttaccatgtaggaggcatgcactcttggaagggtgtcagtcccagggccattagtggtatttttatttcttattctgggcttcctcttatattacttgattaggtttggggctatgctatagttttttattcttcttcaagtaagccagagcaatagacacaagcttgagccttagggctttacatggactagatccacctttactagatccacctttagctgaatgtggaacatctccccgctcctggaggtgcttggctcttcctaggcaattttctcatcattttgctttaggtctgacttctttagggaaaacttagtggtgtcatttgcttgcaactctagggtaagtgtcgttttctgcatcatagcccagaatctgagaatctctcttctaaggttgggttgacagttctaagggaactcacttcattttctggaatttcttgaggaaactccccagtctgattcaggtatgtttctatcagttctttgtgacaaatgacaatatgtagaaacttggcctcaagacttttttcagtaatattagatacttctcttgggtttcccataagagatctggaggccagcttaccacttgctaatacaatgggtttcctactattctcaaaattctcagtggtctactttggaaagtgagggtaagggctgggacctggacctctatcttcatcttcagtcctagccaaaatactttgatctgttttatagatcattcttctttataagatttcccttggaaaaaatggtcctgcggtgagttttaaaactgttgttccggggtatcctgggaaacttggagcctccatctttggctaagtgtctttttctaaaattagagcagcagtagcaggtatttatttctgaagcaatgcctgcatacctcattaattttggggacctattaggctattccttctggcttgtaggcccttctctaacagaccttagcttcagagggactatgagcactgtaaaatcacatgcagaattcttgcaaatatgtgtttaaaaaaattaaaaaagaataccaaggccattctgcttcaatgtgagcagcaagggtggcggtgggtatttacttgttcattcaacaaaaacctattgagtgtctgctattatgtgttaggcacatgttagacatagaaaatccagaagtgaagtttatgttctagtattcccgccttcctcccagaagctttcgagttctcataggagtggtaggtttagattccagagtgcttaactttacgacgagtaagaagtagctttaaactgaagacggtatgcctagccctctctgctgataatattagggagcttcattggaccactgcttgctacatccataagtcacctgtcctgaagctgttgctgtctctcctccaggcttgtcagtgatatctgtctgtcttcttcagacaggaacagggttccagtcagattcgactatgcttacaggtcctgagagccattcagaaactggcccgtgagtcatctctcatggcccgagaaacttgggaagtcttactgttgtttcttctgcagattaacgacatacttctggccccaccaactgttcaaggtttgtttatttttttttttctaatttatttctgagctccaaatacagttcatctttaaactcagtgagcggtagactcattggggatttaaattttggcatgatggtttacaaacaaaggttaacagttcttagaatggaaactctcaggcacaatataactttagccctgatgaagttattttaccttcagtcatgattttgctaatgtagggagggactcagtgaattatgcatgtttgatagtgatgggagcagtagcttgtttaataggataggccaggcgtagtggcta

SEQ ID NO: 100884 - DNA, 1028 bp, Homo sapiens
cttacaacttttcctgtgagtcccaactttgccttctggagctatgcggtgtaaagaccactgctgtttttccacctggttccagggcttagaacaggggaacagccccattttcatggttaaggctctgtccttcccaacaccagtccttttgctccattatttgtctctctgtctctctcccttgaagggtggctttcaaatacttggagcattgtatggcaaagtttggaggtaaaaagacatgggtgtttgttgtgattccttcacttactggctgcatgaagtcggagaagttacttaaactttctgaatctaagttttctcatcttcaaaatgggtataattagcagttggtattaggtattacagatacctaccctgcagaattaatgtgaggattatatgaggtcatttgtatgaactatttggcatagaaactgactcatagtagtcagtcatcataggcagtcatccttttccttctcccctgtgtccctctgtcccccttgctggaggattaaggccttcaataagaactgaacagggcaacttgaaatctttcaaagtaaaaattttttgatgtgtctgtgattttgggtacaggaactcctaagaattgcttctcatttttactattaaatgattatttgaaagtcaaaacttaatattgcacttattttaattttttgaccagttctcccaaatcagtgtcttaaagattctgctttaaaaataagtttgccaaagatgtgttttctttttgttggtaaggtggcattgctgagaatctagcagagaagttgattggtgttctctttgaggtgtggttactagcttgtactcggtgcttcccaacacctccttattggaaaacagccaaggagatggtggctaactggaggcatcacccagcagtggtggagcagtggagcaaggtcatttgtgcactcacttccaggtaggttattgtcattgccctgccttccttcacctgtctgaccttaggcagctttctggcattcatg

SEQ ID NO: 100885 - DNA, 1045 bp, Homo sapiens
ctgtagggggaagaaaaaacagaaaagaaataatagaaaagccaaattctgtattatatatctgtatgtggatacagatatatacaaatgtactctgctgatcaaaaattcagttgaaaaatgcttcttgtaccatctgttaaactgacaatgccactgtaaattaattgtaacctattttcaaagaagatttcagagagccctttttaaaaatattaagacatagttgctaaacaaaagcacttattggattcaagtagctatttaatgacaccaatatttgatctttgtgtccagggtcccatgagcctacgtggcatattgcaaatataataaaaccctccttttctctccccagccattacaacacaagctagcatggagtttcgacggaaagggtcacaaatgtccacagacaccatggtttccaatcctatgtttgatgcaagtgaatttcctgataactatgaagcaggaagagctgaggcttgtgggacactgtgtaggattttttgtagcaagaagactggagaagagattctgccagcttatttatccaggtcttggaatttttgtttgttttttcatttatatagttttgatagtgaagccattgttggttggccgactgaaccgatgagtgatgttggtctgaaatacctacagatgtctgtaagtgatcgacatttgcctgaaatctttcattttacctgtctcatcagatttggtaaagacccttaagaccctttttgttttagaagtgctatttatgtcatcttatttgaatctttttaatatggagagatttcgaaggaccacaattatttgttaacaaatttttagcacagtattcccatgtaggcagtccagaaataagtcagctgtaaatcctgcctccaaggagcttattttctgggcaaagccccaaacaaagccgtgtacacatgtaacaatgatccagcaggaattaggatattgatgggagaggcacagataatgtgctgtgggcattcaggggaagaagcagcgcacatttatttactgt

SEQ ID NO: 100886 - DNA, 1920 bp, Homo sapiens
ctaggtgaccatcaggaccaattagtatctctgaattttaattatagactcctgggaaggaggatctaattaatctgcctgtctctggtctagtcagctacagttgtgaaggtgggtcacataagggtgttggagctcacccacttgttgtgggggcatgtttctcaggaactctgggctggggagatatcctaaatggtactttggtagtaggggagaaggctatcaccatgaactttctgactgagccataagactgaatgggtggtagtaggacaaaccaaaacaacagattcatgagagggcaagttattagtttagttttgaatcgattgaatttgaagtgcctatgggatatttatcaacaaatatttattaagtcctactttgtgccagatattgtgcacagaagtaccataataatcactagacatccagatatccagtaagcttttgggtaatagatctggagttcagttgagaggtgtgggttagaatgatttgattatatttagtgacttaagaagtgtttaaaatcaggttagtaaaagagagagctttgagaactaaggttgtcagactgaggaacaccatctttagggggcaggtagagtaagaggacctgtaaaagaaaatggtcatagaaatcagggaagagcaaggagagaagggagtagttagagggctgaatgctttcaaaaggcagaatgagttaagacttagtcatgtctcttggatttggcaatcgagagcccattggttatttgctagtatggttttagttgagttctagggagagagatagattgaaatgggttgagcagtaaccagtaggtgatgaagttgtttctgaagagttttgcagagaagagaaactcacctcacaatagaagagtataacagtgcagctgctgttgaataacgggagattgaatgcttagtaagttgattagaggttgggggtggagttaaaaactaagctatattcaggtatattcctaaaaggaatcttattcaggtgaccttcatgatgaatacagatgatcgaatgcaggtttctttctttcattgtccccccaaaaataatggggaagggacaaaaatgtaaacacacctttttccctaggaattactaaatgttgcaacatttttctcttacggaatttaactcagcagttcccccagtttattgaaaagtactgcagcctgttgttttgttttgttctggttgccttatttgcaggcccctagaactttgagttgcaaggcttaaggtttgagaaggtgcaacagacatgaatttttttttttcttcattaagaaagatgatttgggtcttagtgtatatgattcagaattgttctaattccagtaatatcctttaaagggtaaaattccagtaattccagtaataacttttaaagggtaaaattctaataaattccagtaattccaataatgtcctttctttaaagggtaaaaatagtgatgagtggaaatagactttcagttaactatgtagcaaataataattatgaaaacttttgatcagcagtttgtttaaaatttttttcttgctttcctagattttacatgcttttaattcaaggtttgcagataaatgattatgtgtgccatcctgtcttggccagcgttattctaaactctcctcctttgttctgctgtgacttgaaagggattgatgttgtggttccttactttatttcagctcttgaaaccattttgcctgacaggtaagctatcattctctgctattatatcaactgtctgatttggcctggtctgttggtgcttcctccccagtttcctaatgtatcctgtccagttgtcttcatagtccaagagaactcaggcgacattaaatgagtgtagtgtgtccaaacccacctcatccctgaa

SEQ ID NO: 100887 - DNA, 1046 bp, Homo sapiens
ccaacagaattgcgaagatcctccattaatatcctgctttctttgttgcccctccctcatcattttggcacagtcaaatctgaggtaatgttttgttaaagtttttttatatcctatattctgttttttgtactaatttaagtcaaatcgaatgttaaaaatgaaacaggagctttttttatttttcaattcaagttatttcatcaagttatttcaagtgaattaacaaagttgacttgtgattttttttttttgttctgtcagtttttctaccagttttcaagcagttataggctaaggacatctattaacatattgttagtgacagattcagcacagtggctaatattagactgaaagcctttctcattatactgatccgttcctccatctagctgttcccacatgggcatcataagctgcaacagctgatgttaaatattatttgttttttccataggtggtcctggaaggaaagtttagtaacgatgacagctcttcttatgataaaccaataacttttctgtccctgaagttgagacttgtgaatatattaataggtgccttgcaaactgaaacggaccccaacaacacccaaatgatattaggtttgtattcacacgttattttgtaagtgaaaccaaagtactgttgactacaggcctgctgaggaggcggcagtcggtaatgggagcctaaacctaatgtagctctacttactctgaatcagaggcacaagttagttttttaatgtaaaaaaatttaaagcagtgagatgagggaagtaaagtgttacagttgtcttggttggtcatttatttgtgcttttgcttttctttctcttctcccttctctcctttctccactctttgcctctccttcccatccctctcttctttcctcctttcttcctgctctccttcctcctgcctctttctcttcctcccgcctcgtcctcttcctcctgcctcttcctcttcttcttgcctcttcctcttactcctgcccattacttacaggtctcatcagtctgcactttcgtccta

SEQ ID NO: 100888 - DNA, 1051 bp, Homo sapiens
ttggctcagaagttttctttttaaaaataatgtatattttgaggtttgcttttcagtgcctcttcagctgtacatcaggttcccgagatattctgtatgagagaaactacagctaaatccagtctttattcctgaacagtgtctgcttaaaactgttacttgttttgctgtggtggcaaacttggttgaataacctaggaaaagccctagccagcaagcaactagtttaactttttcttacccatcaattctttctaacccctctagacctaagtttgcaggtccctcaaagcaccaatgcttccaaatcaaaaatgcttctcagagacttccagtgctctctgctttgtcttcaagatatatcatccctatacttggagtataggcaagacaatggaggggttaatagggtatactggggtaagttgggtagatgtagtaagctgagtagatgtaagatgggtgatcaaattattattacggaaattacattcgtgtctcagtagatggtgaataataatttactgatctgaatataatgaactgtgtttatatggggaaaaatgagggaagtctaacagataggtttattagcccctatacatacgggagttaaaactaaccctagtattgtttgtgttttctgatataactgtatttgaaagttgccgtttgtttattcatgcctttttgttttttgttttgttttgttttgctttggttttgagacagagtctcgctctgactcccaggcttgagtgcagtggcgcaatctctgctcgctgcaaactccgcctcccaggttcctgccattcttctgcctcagcctcccgagtagctgggactacaggcgcctgccactgcgcccggctaatttttttgtattttttaatagagatggggtttcactgtgttagccaggatggtctcgatctcctgacctcgtgatccgcctgcctcggcctcccaaagtgccgggattacaggtgtgagccagcgcgcctggccttattcatgctttttaagcttatatttctgttctgaggttttg

SEQ ID NO: 100889 - DNA, 1148 bp, Homo sapiens
aacaaatctttttgatttagctgtatagcttttgggtagtatattagatttggggtagtatattaggttttataattgatagtaatgggtgatcagtaaacatttctgaattctctaccatgtgtggtggtagagaaccaaataagatgtggactctgcctcagagctcacagtgtagtggcagagatgtccaataagccagttattgcagtgtggcaaggagggtaatgggggatggattagatagcagcccagaggagagcatgtcttcatgttaaaacctgtgtaccccctactgtagctcactagattctttagccctgaaacatttttattttctgccctgccaagtaaaacatttgccagccaagcatcctatacaaggttgtcccctaccttgggcagttgttttatggattctgtgagtttgtgggtacctttatgtttttctacacaagtactaacagtgtattaaatctgtgagcacttatccagctagattggagtgatatctagattcttagatgtgagtttaatcctttaatcatctggagagttcatgagccatgttcatgaggttcatgaggcatgtcatgagccatgttcatgagttcatgaattcatgaggcatgtttctatggtttaagtttgcaacaagtatccttgaacatgtcagatatacataaagccattatgtggatatttgacacatttaaatattatattcgtgaagaagttatttaaattatcttattcactgtgtatgtagatttaggtattctataggttgaaaattatttttcatgctttctgaaacacatttaagctaaataaatttttcagtactggctgggcgcagtggctcactcctgtaatcccagcactttgggaggccaaggtgggcggatcacctgaggtcaggagttcgagaccagcctggccaacgtggtgaaaccccatctctactaaaaatacaaaaattagctgggggtgggggtgggtgcctgtaatcccagttactctggaggccaaggtaggagactctcttgaacctgggaggcagaggttgcagtgagccaagattgcgccactgtactccagcctgggcaacagagcgagactccatctcaaaaaaaaaaaaaaaaaac

SEQ ID NO: 100890 - DNA, 1006 bp, Homo sapiens
gccaccattttggaaaacagcttggctgttccttaaaaaggtaagcatacacctacatatgacccaataattccactcctaggagataagagaacatttatcgatataaataccttgtacatgaatgtttatagcagctgtatttataatatccagaagctggaaacaacccaatgtccattaataagtaactagataaattgtggtatatccatgcagtggactactattcagcaatagaaatgaatgaacaattgatacacccaaaagtgtagctaagtctgaaaataactatgctgagtgaaagaaaccagaccaaaaaaagtacatattgtatgatctttatatgactttatttatttaaactctagaaaatgcaagctaatctatcgtgacagcagatcagcagttgcttagggagaggggcaaagaggagtgggaggaaggattacaaaggtgcatgaagagatttggaggtgatagatacatccgctgtcgattgtggtgatagttcacaggtgcatacttatgtcagaattgaccagttgtatacttgaaatattgggcaatttatgacaattatgcctctgagcagctgcacagaactttctgcagagcctagtgcatcactgtgaggttgggttaggggtttaaaaatgtgcccatgttctttcagtctctgggaatgatgaacaggtatacccaatgggtttgggttttagggcatgaaaaactatgctaatgaaatactgtttgagcacttgaaaaatgccactattttttgtggagtattacaatacatctgaaataatctgttcctgtatataaataatataaaaaagcaaggcttcctgtagtgtatgacattgtcaaataggtcaagcttcagtgcaaatgctttgaaattggtacagtaattcctggctgattgtttttgttctccaaatgaatatgctcaggtaaaagtgatggttgactcaggagaccggaagcgagccatcagttc

SEQ ID NO: 100891 - DNA, 1492 bp, Homo sapiens
tcaataatgagaaaatatggcttttaaacaccaggagatcaataatgagaaaatatggctttggttttctaaaatgggatagagacggttgtcacaaagcatatggaatatgagcttgctgtgttccatgcaagattctaagatatcagataggttgctggtaagggagtaggtcactaagatcaaattataccagcctaactgcattttctgttccggatattgaccagactggaaaggcagattaaatgtctctgaaataaagacatacaggtatgcatctggggtaatgggctttttaatcttggaggggagagtctggacagcatgccatggcattcaccacaaggagtaaatctgacctgtcaagaagcatggctgtggtcaattaaaattcagaagagtggaaggggacacattgatgcacaaggtaaactgaagattttgctttgggaattaactgttatcttttccattctccatagcattatgcagttgctcggcgcatttccttcacctagtggtcctgcctctccttgtagtcttgtgaatgagaccactttgattaaatactccaggctgccaaccataaacaagcatagtttccggtactttgtcttggataacagtgtcatcctggcaatgctggaacaacctcttggaaatgagcagagtaagtttatagtactttgagccttctctactgcttaatcagtgttaccagtaccatgaagctgtttccaggatcagggaaggacagcctacagattctaagtaggtcagaaagatttctagctgtgggacaatagcacctgaaaaataggggggcaaaaaaatagaatatacatattacatagagtcttttaaaggctcttgatgtgcatctgaactagctctgtagttttataaaaggtggtgttttagtgggttccattgtgttgtttatctttgtcactttttcttcccccttgaacttcggatcctgcccctctgctcccctccctctcactcctcatgttctgtatcaattgttggtgctacctacacaggctagaaacttgaggagttatctttacctgccccttcctgttactcacttatataattagtttctaagtttccatcttcccagggacccttgaatttttcctttcctctgtattttcccaatacatccaagtgcaggtccttattatttctcacctagattattacagctgtttcctacctactctgattccctcaacccctaaaccccttgccagttctaacatgtgttttccctactttcatcctacttgctgccaccatagtattcatcttcaaccacaaatgaccatgccagtgccctactgaaaatccttcagtgattttccattaacacaacatgcactgttttcctcctttccctccccctcagttataagccatctcacaatatgtgattatcactgcgacccaaactatccacaagtacattttttttttctga

SEQ ID NO: 100892 - DNA, 1819 bp, Homo sapiens
aacttctgttgtgttgtggtgagatgcggtgacattaatgtgaaatggaatggtgccttttattattgtctaacttcagaactgctactcccaagtcttttctacaggcatctcatccttctctaccctagacatggagcttgcttggctttctttcctagcctgtgcctgttcatgattcctccagcctcctactccaagccatctgctgaggagtctgcaaaatcccagtgtccccttcaggcttcctggcctttttccagctttttaaagactctcctactttcattccaaataatttcattgcataggaagtgtaccaaaaatacaagcaattggaattgtatagatttacaaggacattttaatagtttattgtaataataagaaattatagagaagtttgaaggcgtttgactcccatatctgagacggaagaataaaaaaaaggatctgggtcactcgggaagtccatcctgagtgttttttttaacacccccatcatgtccctgaacttctgctgagatggaacagtgcctgcctgtggtgggcagtggtacacaaaggcatgggcagatataacactaacactgcaaacacccagtctgtctttctacacttaagttgttcccaacattgggaggttaagagtatttactaggacagtgtttcccacaaatgtgtacatgtaccattggaggtatgtgagatgatcttagttgatacattagtgaacattattttatgtatttttaagcatgtgctttaaaattatataattagtacatgccaaaattcatgattttccatttagagatgcacaagagtggttgatacaaagtaatagtacttacagtacacgggtatgggtacggcagaaaccacagaagtggtacacaaaagatcaaagcttaggaaacactgttgggcctttgattatgagaagctctgcagttgataacaagtttattttaaatggttgttgtctgaaattaaaacttttatatacatattttattctagatgattttttcccctctgtcactgtgctggtccggggaatgtctggaagacttgcttgggcacaacagctttgtcttttacccagaggagcaaaagcaaatcagaaggtattcatcagaagttacagggaagtgtgtgtgtgttttgtaatttaaaggttaggtaacattccaacagaagacacagatcaaataaatatttttgatccctagccagattctcagtcagtgggttcatatcagaatcatctaggaacctagaattccagatgtactcaattactctttaaagacatgttcaaggcaggtgtcttttcaaaaagctttccaggtgattctgacatctacttaggagtaattgctgttgtggacaatggccccagttttttccatgtaattttacaaatgtaataaaagtcagatatataccatacgtgaaaaaaatttggtgggacttttgatttgtccgcaacaggacttagtttgaaattgttttatatgatttgttcttatataataattggtaatatattgtataaattttattttttttataaagagtcagggtcttgttctgttgcccagactggagtgcagtggtgtaatcatagctcactgcagcctcaagctcctgggctccagtgatcctcttgcctcatcctcctgagtagctgagactgtaggcacatgccatggcacccagctcatttttaaaattttttgtagagatagggtcttgctttgttgcccaggctgatcccaaacttctgtcttcaagtgatcttcccacctcagct

SEQ ID NO: 100893 - DNA, 1028 bp, Homo sapiens
tgaaggttcagagacatttagagaggaaaggagggaaattgaagaagtttatgaaaattttaatcctggttcttggcagtgtaataggggatcccagacagttcttaagaattgccaggcagtgcagctgaggttaagtagcattatctatagtgaagttatttaactcactctgctgactttcttcaaaagtccttgggatctggaagcataagtaaagaatttgactggtgtggagattgacaggtgtggaaatttggaaggaggttcaacacagccatttaatgtgcttaaggagagggtatttagctgttagatgtgggggcttcagtttagttgggaagcagataaagccagaaggatgctaatggagtgggaaagcagggggagggattgagtgccccaccgcaatagtagagcacgagctcaggaagtgaagggataggagttgcacaagggggcttatgattggagagggaatttcagacttacagccctggaaagcagggcacatatcaggttcaagtttgttttcatggatggccaaaattgtgaaggttgaggagcttgtagaattctgagccaggttgttagaaggatcgttactcacccgggaatggaactttaaacaaggattgatcagaaggaaaggtgggagaagtctctaagagtacagtcatgtcatccatacagatgaggaattaaacacagggagcacgtcagggtgaagatggacagtgatctgcaagcgaggggtgagagtgacaactctgccccctttcttgcctatttgaagggaaccagagactgaatgttttcatttacagtgaaaacatgaaggagcaattgttgaaggtatagggaagtttttttggcatttgttttaaccttggaccatgtttgcttaatggcatactctacattgaactgaatcacaatgttgatcactgaaaattatcttcattttctttgttgcttgtagctttattttcattttaaaattaagattgacttagctaggtgcagtg

SEQ ID NO: 100894 - DNA, 2370 bp, Homo sapiens
tgtcttccaaagtagctgtaccattttgcatttcaccagtaaggaatgagaaaaaaagtacattaaaagtaagttctagaaagcacaatattatagagaaaactggatccaaaaattatatacacaatataatctcagttgtctttaatttaaaaagaggcaaataaaagaactaaaaggaagtatgttaaatagtttctttagtttaggattatggttgtgtttattcctaccattctatattttttaattttatttttattaaaccatgagcaagtattgtttttataattataacaatgaaagaaaataggtaataattgctcctttcttcttttggtggcaggaacctgcaaatagtcgtctacctcctcaccttattgcacttgattccacgatacctggattttttgatgacattgggtatctggatctcttgccatgtcgtccttttgacacagtttttattttctatatgaagccaggtcagaaaacgaaccaagaggtaagagttacgaattttttttttttggtatgtttttgtgctataaatacacgtctaaagaaaaaaattgaggcaaaattaatatggagagtttatttgggccagagttgaggactgcagcctgggaagtgctggaaagtgcttccaagaacaaaggagaggctcaagtttttaaagataaaaaggatgagtcaggagagtaggcaattacaaaagttgtttttcaggacttctcattggtttacagaaataacattgattaatgagtggatataaattattgaactgtaggatatgagctatggtgtccagcactgttagattagctaatgaactgttggtggtgacacacagtctagagtccatatagcacgcagcttcaaagtgattacttagctcaagcgggagtgagatgtgactgctatcaaaaaagtgcctttctaggcatgataatttgagggagactcacattccttaaaaagtttcattttcatatacaaaattttacatggtatgcacttgtctatggtaagaagtattttgtacttgatgcctaaagacttgctatgaaccagtttgaaaacagaattaatgaaaactatgatgcttagagtcctgagtcttttgacccttaaggaatgtgatttaaataggagctgtaggatatctttcttccccttaaggaattcagattcacaagacaaaagaaactgaaataacgaaggttagtcataaaagttaaagtaaggctcaagaagaataaaacaatagcaacaaatatttatggaacatcttccctgtggctcagcatcccaggatatagaagtgagtaacagtttcctttttgagaagcagctcaccttcctagtaatttcagaagcaaatcatttcagttgaggaatgcatagtgtgcagtgggagaaataacacctgaaataaaggagaaaaacagaaggactggccgggtgtggtggctcacgcctgtaatcccagcactttgggaggccgaggcggatggatcacccaaggtcaggagttcaagacaagcctggccaacatggtggaaccctgtctctactgaaaatacaaaaattagccagcgtggtggcaggcacctgtagtcccagctgcttgggaggctgaggcaggagaactgcttgaacccgggaagcagaggttgcagtgagccaagattgcaccattgcactccagcctgggcgaagaagtgagactccatctcaaaaacaaaacaaaacagaaggactaagtaaaacatacctggatacgtggaacaaagagactaagagaaggacgaagaaaaatgtaagataggtgagaatggaaaactgagagcaaaatggcaggagacttgaagtgctttttggaaaggaataattgaaatatggaataggcaggaagttactgactgtaactaggaaagagccgaaggaagacttgtaaaatgtcgtattcagatgtgtagggcactgtgactacatgatcctggaattttactgtagtcattttaagacaatcagctaatcaaattagcatgcctaaagaaatttaccaaagtttccaaatgtttacactagaagcactgtttcaaatgatttgtgagctcctagaaaagaacactgatttatgagaaagttttttttttttgttattgagtcaataaagttaagaagtgtctgttgttaggtaccagggttatagtgccgaacaaaatctacaagatttctggccccctaaaactactgcatagaagggaaggcagatgattaaataagcaaacaaccattgtaaagggtgttaatagggtcattaaagcatgttataggagccatagcaggaaaacctaa

SEQ ID NO: 100895 - DNA, 1031 bp, Homo sapiens
gcctcctgagcaggtaggactacaaatacatggccctcaagcctagaaatgttttcattttttgtagagatggtgtctcgctatgttttccaggctggtcttgaactcctagcctcagtcgatcctcccaccttggcttcttgaagacaggcatgcgccactgtacccagcctggttttgtatttttaacaagactataaatcacagtaaagggggaaaaaaaaaaacaagactaacaaacaagaaacaactgacatttgaaacactgtgagttttaccttgttgagatccttcaccatcatcacaacaattaatagaccaactggtagaaacatgcccagtccaaccagggtgtctgcccacatctactgaccagccaagggaaagcaaaaattctaggaaatgtggctgaacagttctggaagactccacattctttaaaatctgaaatacataccaatcatcagctataatgaaggaaacaaaataatatatcaaaataaatcttcataaaaattggttagttttgaagcttctgacaaatcatgtccaagctcagaataaatttgaggatatatcactatagagaaaaatgcattctccagagttagacagatttggattggctgagccttgggcaagtttcttaaccccactgcctcagtttcttaatccataaagtagagataataataatggttgtgaagtaatgcaagaaaagccctgagctctcttcctggcaaaacaattactgaaccaggcatgtttactaaaagacactatgtccctgccttcacagagtttactgtctggttaatgagaaacattacataggtatgcaattatttaactataaatcttgataaatgctataaaatctactaaaattcaataaacattaggtgtaattaataaatgagtatgaaaatatccttttcttaggccaaagaagagaattccaggaaaaatgaagtgtccagaaagttctctcctcttcactaagcactaaatgtaatgcgtggggtttctac

SEQ ID NO: 100896 - DNA, 1017 bp, Homo sapiens
tgctgcagaataggggtggatagagtggctattgggatagtaaccacagcatctactacatcaaatacaaagtgcctgcccggagcccacaccaggagtcagaaaactaaagccctgtttttgtaaataaagttttattggaactcggtcacactctagattatacattgtctatgacagctttcatgctacaatgacagaatcgagtagttgtggcaaagaccctgtggcttacaaagcctaaaatgttatctgtctggtcctttacagaaaaagtttgctaacctcttgtctaaagcttcctatttgccataccttcaccagaattaggtatcttccaattttttcggtgagaaatttttaatttttaataatggttgagcatatcttatcatatttttatttattccctgagaagtacttgtccatttcccctttccaatttttggtccgattgttggtcttttatgtattgctagtaggacactgagttcattttaattgagaactatatagctctcatgaatgtttcttttgttaattcagtcttcctggcttagagcagatactattactaaaactggctgtacatttttatacagtgtcactgaccattgaggaaggtggaacataggccaacttgaggagccatagagagagaccagggatagaaatgccttaaaagcaagagtccagagataacgcacatgtgcactctctctcttctctctcttcttctctctctctgtctcttcctccctcctcctcctcttcctcctcctcttttcctcctcctcctcccttcttcttcttcttcttcttcctcttcccccctctctctctctctctgtctctctctctctctctctgcctgcctgcctgcctgcctgtctctctggcccaactcccttctgagggactgggatggtcttccttttgattatttatttactggatccaaaggactgctcccttaatctgcttcatacacttgaattaaaagccctgctaatcaga

SEQ ID NO: 100897 - DNA, 1050 bp, Homo sapiens
tcccatttcaactgatattttgctttctttaatctaattaatcaatacataggcttattttccagttcatttctttctctaattacgagtgatccctcacctacttttctattcccatatgagagcctttgcatggaaccacctagaatcctacaactggaagtatctcatgatagcatatggccattcttctaacactgagcaagagaaacttcagcagcctagaaaagatggtggtccaagactttttaagaattgggagtaattattacttcttagtctgaactcacagttttattttgcccagaacctttgctctttgcaaattaagcctgtttgttcatgcctgaccgagtaggtggtctggcagtaggtgggaaacttcaccttcttctttgagatcatttgtaggatgggatactatacatcacgatttcagtcttatttccagactaatgacttttgttgtgccctaccttggtagctgcctaacctttgtacttggacccttgatttctcactctaggcccctccctgtcttactctctggggccggctgtgttcctggaaggttggaccttccatggtttaggtttgaattataacagctgttgggcttcccgtcaaggttctggtttactacttataattccagaagccagaacctgtccgtcctctttggggacatacctgcctggtttctctggcccagcctgttagtaccagacaagtcctcccagagctagagcctcgtccttattctatagctcctgcaattgggtctttgtctcctgttgtgaaacatctcctatgccaactgtgcccactccaactcagcttcctcctatttctgatatttggggatttttttggatggggtggaggataactttctgtgtacttatctccaaccagattgctcttaatcacagagactagatcttctgtagcttctggatgtcccagtgcctatttggcacaatgctacatgattgaatatataatctaaataattcagagagtaataatggcatttattatattctacat

SEQ ID NO: 100898 - DNA, 1046 bp, Homo sapiens
tttgataaccttgtacattgtatacaaacttctttctttgatcttttttgtttttatttctagttgtctacaactctttcgtttcataattccttatttattaagctgcaatcaatatgttaaaaaaagacacgctgatgaacttcaagcaaatagagtgtacctcagtgaagtgctactatttgcagtagtttccacaccagtactgatctctgtcatcagctctgagaggggaaagttttctggaagaaaataatagcattacaattaatatctccctcattttcccaaacagataataggaaatctaattttctaatcgctttacataagtgagtggcaaatatatggactgtgctgtcctgaaatatcatcttaattattctctacaaattaaaaaattctctctcaagacattttttagctaatttcatctaaagcaaagagtttttagaaaatatgttctgtgatctttgagggcttggttgaaaagtaactatcacactttcccacaaactctgggctggatgggattttaggcaagtatatatttctaatgctctaatgttgcttatgtaaaaatcatgagaaacttacccagagtgcaactcttaaggacaaattaagctttatactaaaacgagacagtaggacatgtgggtggagagagggtaagtgaagtgcttccccttcccctttccaaaggtcctgggatgactgagaccaactggcaacaaaccactgactgtgatgccaacatgaatagccaaaagctttgtatctactggtctcatcgaatcttcacaactatgaaaaaagtaccaggatttaacagaggagtaatctaaggcttaaagaaactgagtagtggagctggggtacaaaccaaggcttgctgaactccaggactagctcctggccacaccaggcttatgtgcccactccctgtagacatttagcaagtcactgtcatatattgccattttatttatggacaaagtcctcatacagtacctatatcatcatagcgttccacccagactaca

SEQ ID NO: 100899 - DNA, 1593 bp, Homo sapiens
ggtcttcatatgtggccgaagagttaaattttctttttctttatcatttttataaaccaaaaagaagtaaaaataaggaaatggtgataattaatagcttccacatgtaggaaatggtatggctcttgttaaaaagggagcatgtttcgttctttttaaatctgtccttaatctagtaagtgtaagtaaaacctcactaacttctagtattaaaatattgaagatagctgtttgtaatccaggacagaaaataggtttttagaatagattttgattctccttttccttgtcattgtgtgtttcttctgacagttttatcttagcactatgtctatctctctggggatgggaagtttgcaaattgaatgaaatagttttgagtatgcggagaatagttcacctgaatacttacagttcacctacgtaagtgactagtttctaacgtttattttaaaactctctattttcaaggctttctggtgaggcagactgtaattaacatttgtagaagaaagagactggaaagtgactcctacagtcccccccatgtccgccggaaacagaaaatcaccgacattgtcaacaagtaccggaacaagcagctggagccagagttttatacttcacttttccaggaggttggactcaagaactgcagttcttagaccactgaatttctaagactgttgaactccagtttgggaactataacacagcagaacagtttgataggtgatcactgtaaaaataaaaacaaatcactcccaagagcttactgtttaatcaccagaatagaagaaacacattataacccatttgatagaagactttgggctatctagtgaaatgggctcccagacacaatcacactcctgctgataatgatgatatacattttagccataaactttcttttaaaagtgacaattttagttaaacataagccttttgaggagaaaggcttttatgcatctcagttaaacacgtgcattggtagtatcaacaaatttgcaatatagaagttgaagatagttttttacctcactttttaggaggttgtattcaaaattaaaatctcagaatcttacaggacatttaaagactcatgttgatagcatggaggagaaggaaagaagtcacagccttctactcagttgtaggtcttcttgtcatccagctgtcacactgacaaaaagaaaagatgatacatgttttttgctcagataagaagcctgacattaaaagatgtcatatttttttctccacatttcaaaaagttgtccttctcatcactgcacagatctgtctgaaagcctcagtttctgagtgacccaggaacagatcagaaatggagcatggccttgtcctttaatggggatgcaaataaagtttgtggggttaaaagttataagacagcagtgataccccactctctccattattgtccagcggggtgacataatgacaggttaaatatttgtgattcattgattaaatattatttaaagaaatgtaaattcacaataagggttgaaaattatttggtttcatccattgtctcttatttcaggaccaagcagcaaactgcagtag

SEQ ID NO: 100900 - DNA, 1012 bp, Homo sapiens
caccagcccagtgcgccctgccgccgcgcttgggaggccaagctttaaacatctctggttcctagtttctgattattcggggatgggggggatgggaggggacagggattcacgatccatcgcgtctgcgtttctgttgtcctttcttttccacaacaccctggttttggggggaggcggggtgcatttgcgggcagggttctctgtccttccaagtggggccccgacactttggttccagtcatcgagggggttgggaagggagggagagggggcgcagctcgcaggcgtggcaacttgaccttgggggaatatttcacatccatccagagctcggaatctacagcgtccagccatttccagcaagagcgcttcccattccggagacgtttcaaccctgcagcgggaaaggctgactgggaaatccattttgggtgggcaatttccttcaacgaagccggaaggcgagaagccgcggcggggccagcttgcctgccggttttcaggaatctaaactctcatcttgtgcaatttatcaggtgtggaactgttctactgtgcgtgtggtgtgctcgtggtgaataagatgaaatgtatatcagaaaaaaatctatctctaatttagagtgcggtacataattatatccgcaaataaagaagagacaaaggcttgcgcggcccggtgtcgggtttgtgtgttcgtaccagccgggatcccctggcgctgggaggcgtgggaactggctcccgccggctgaaaccggagatggtgagcagctgtggttaaagggtccggggagggctctagggagtacaaagattagttggcggcgaggaggctcctcaggtgtgaggaggaagctgaagacggagagtgctgtagcggccccctcagctgccaggtcgaggtttgttcgaatctctcccctgggggcgggtccatctgagaatttggtggaagctctcaacttccaacctcaaaacagagagggacagggggagcttttatgta

SEQ ID NO: 100901 - DNA, 1047 bp, Homo sapiens
tcagactcctgggcttaagtggatcctcccacctcagccttctaagaagctaggactacaggtgaacgccagcatgcctaagtcatttttacaattttttgtagagatggggtctcaccaagttgtccaggctggtctcgaactcctggcctcaagtgaacctcccacctcagcctcccaaagcactgggatgacaggcttgagccaccatgcttggctgttaataagtgtcgaagtagccaaaagagcttaggccccagcatcttagttcctgtatggcaaaggggcagcctgcaggtcactcctcagtccagaagtcgctggttgagtcgcctgcctttagaactgaaacaaagagtaagtgtacatcctgttcctggatctgtcatccctagaattccaaaacaaaggaacttactgccttgagacatgttttaggcaggataaaccagactagcctcttgttttttgttttttgttttttcctttttaaatcagctttcattaagctgttgattacttatcctttcagaaaaaaaatgatactttggaaaaatgcaagtcagtgccatttgatgctgggtgtagcatagtgcttatcagtgatgtcagagttgcctttggctcaacaggaagcttgcttttgcagtgatgggctcccagctggaggctcgctcaaggttctgctctcaccgttgcatcctctacatctcattcccaggctgtcgattatgtgaggacagtacatgagtgtatgctttatagagcagatcctgagataggcttactagatacaccttattggatcaccaagatcttgtgtagaaggggcctttaccatcttcttccaacacagcatcccagatcagcctcagttgaatcagtgtgtgccttttccattttgcttctcttggtttttcaggtctttgagatttgagttgttgtttactgaaatccggaaccatgttgtctttgttatgtattcatccatatttagtttttatcatgcttgacatgttagcaggacatagttttctttataccaga

SEQ ID NO: 100902 - DNA, 1051 bp, Homo sapiens
agataaagctgttattaaaaaagataaaaagaaagcacaggtcgatagatgggccctcaaaagggaggcatggcttttggggataatggaaatgttttgtgtcttaattgtagtgatggttactggaatgtataaattagttagactttatcaaaatgtatgtaaatttatcctcaagtttattttttaaatgtattataaaagtataaaaattctaatcatgttaaggaaataagttgaccattcagattacggttttgtctggctgtttggaaacattgggctggcgttttgtagagacacaaatgaaaaatgaaagttttgattttttttttttttagctttttgtgtagaagtttttctgttttgtactgagagcttacatttctgcatccacatttcgttctgatatttgagttaagggactatattaggagttgtttctttcctaggtacccaaaggacattcaggaaatgctggttcagaacgttttcctcactggcggcaacacgatgtatcctggcatgaaagccagaatggagaaggaactgttggagatgagacccttccggtcttcttttcaggtactgattgttcgagtagtcaattattttgaaaatagcattacctgttttctgattgcaaaagtaataatcatgcagaaatatccactgttaacatttttgtggcttttcttctggtcttaagtccatgcttaatttttaaagcaaaatgggaatcatgttttatatactgttttgtggtttctttaaattggaagatgaagacatgcgtagaattctaagagtgtgaaagagtgtacatcaaaaataagtcattctcctacccagtccgggcccctgtagacattgtggggcatgggatacattggagcgttccagacagaaggactagcatgagcaagggcacaggggccagaagcttgttgagggagtgagaagtggctgagtgttgctggagcacatggctgataaagaggagaggaggtgggtaacgtagagaggtcagcagagcccacactgcagagcc

SEQ ID NO: 100903 - DNA, 1081 bp, Homo sapiens
aatagctgggattaccggaatctgccaccatgcctggctaatttttgcattttttagtagagatggggttatgccatgttggccaggttggtcttgaactcctgacctcaagtgatctgcctgcctcagcctccctaagtgctgggaatacaggtgtgagccaccacacccagctccttagtcatcttatgaaagaccctatctctgtatgcagtctcatgctgaaatactgggggttaggacttcaacataggaatttgggagtggtgggactcagttcagcttataacactgtctaatgggagaagcaggattaatattcaatgccacaacgatgtacaaaatgacaactgtggtccctggggttatgagagctactaccagggggtttggctgagtgggctctaggaaaccttccctgagaaagtgatggttgagctgagacctgaaagaggttgggggctaagcagagggagggaacagcaggccaggtgtagggacaagatatgctgcagggctgggaataccccagtaggcacatgaagaccaaaggcattaagcggcacaggttgctgaggggggacttctgggcactatgttggagatggtggcaacttaccccaggtaaaaatcaccagagcactcttttaaaaatacagatcccaggcctcatccaggtctgctgaatcagaatggccaaggggaagggcccgagaatctgcattccctcacaatttttcttattttgaaaaatatcaaatctagagaaatggaaagaaaagtacaaggaacacctgaacccccttcacctagactcaccagttgttaacattttggctcatttttgctttctctctctccctccctcactctctcctcaccaagcatctcctaaaaataggggcctaggccaggtgtggtggctcacacctatcatcccagcactttgggaggccgatgcaggaggattgcttgagcccaggagttcaagaccagcctgggcaacatagggagatcctgtctgtataaaattatttttaaattagccagctgtgggccaggcatagtggctcatacttgt

SEQ ID NO: 100904 - DNA, 1059 bp, Homo sapiens
gtttcaacttcctgcagctcagaagaggggtccccacccgagagcgccgggaccctgtcccgcgctgcctcccaagccggatggggttgagcgcgcccaccccagtcccaggagctcaggccccgccttgggggaggagccgagaggcggcgcggaggctcgcggccgagcagagccagctctgtcgccgctggagcagctgcggctcggggacccacagacacagccggggtcgggagccgcccggggcagggctcgggagagcgggtgagttccccggcggcgccaccaccctccttgcgctctgcggcttcgcagggcgggggatgaggatggggcggggaggtggtcccagcctgctatcacctagctgggggccggggcgctttggccaagggacgatagcttgagataaatgggagtgtggggactctggaaagacgggtaccgagagcgctaggtccgggagtcgggctggaatgggggcgttctccccggcctcgcaattccttgacgaggccaggggagggggcgcattggcaggttgttggctgcggccgtcgtagaccgatcttggggcggggaggtggggtcctcggtctgttctggactcatggggccgccgtctgccgggggtgcaatgccgggcggcgggagccacagcggacaccaaacaacccccccccgcgcactctcccggccgggcatggtggtgccgccccctcgcgtggcggggcttggtcctggcgggcagcggcagggcgcagagagcgctcctgcccgggcgggaaagatccccaaggcaggcgcctccacctgcagacccgccccgcctcaggatccggctgacagcaccagccagcccggggagaccccgcgagtggtagttccccgggaggggcgcgcccggcctctcccagggccccgtgcgccggcggctgggtcccccgcgccaggagcgctcccctctgggcgactccggctcatcgattccggcccagaggagcgcccccgggcgccgaggatgggcggagacgtgcagccgcccctgagaggtcg

SEQ ID NO: 100905 - DNA, 1036 bp, Homo sapiens
gctgtggatcccactcttcatattaccatgcctaagcctcactctgccctccagaggcctggaacaaagccgatccttttttgttgccttttgttaacacctggtctgctcccaatatggcccagccagttcagacagaggtcagtaggtctgttattgttccactgctggacatgatgacatgattcttctcctgggaaagctcaagatgcatgagttgtttcatcactctttgttcttgttaaatgtgtggtttttgaatcctgcctcctctaccttcagcctccccaacacacacaaagtcctgctaaatggggttatagtcaatgggcttcaggggacagtgacaagtcagagatctgaatgaaggagcacagctgggagaattggagttacggagttgacctgtggggatctgagtttcacgactgatttaaaaccaggagatctgtctatgatggcaatgcccaaagtctagaaggttcatcctagcaggagtaggacagtcagtccacaaaaatcccatgggaatgagattaggggagacaacattgatttctaattcaggtatttggagcaccaagggccccagaagtctctttgctcatgagttaaagcatctttatgctggaaaaaaaaaatgacgctattattcaaagaagtgtgttgtgggagggcgggggtgtacatcctttaggagagaaagtaggtcccgagtgagatcccaggagtaggaaagccagcactgtttgttttgttttcttctttccctcatgctcaatggtacaggaaacacaaggagaaaaggacccatcgccttcctccaggctgctgccaatattgtgtagagaagaatagctgaagaacatgaaaacaaatcttcacatttccttttaacagtgtgaactttgaaacactttctgactcatattttaaaatctcttaaatttgaattcaccttccttcatgttgtttttctcgaggcactaggcttgagtccaaaaatgtgtcaaccgactgctcccccagaattaag

SEQ ID NO: 100906 - DNA, 1054 bp, Homo sapiens
ttcatttacatattatctatggctgctttcacattacaatggcagagttgagttgtaacagcgaccatgtagcctgcaaaggttaaaatatttactttctggccctttatagaaatactttatgggctcttgcactaaaatgtttcctcatctagtgatgtatattaaacctatgttttcttctagggttttttggccttatttaaataaataggtagtatttctggacttcattttagtatagagtactaaatgaaaatctgtctatattttgtttccaaagcatcagcaattgtcccaacatcccttccttccctacaagtttgtgaggccacccttgtactctagagcctcatctgtaatgaagggtaactctccaacctgtctattctgttccagcaacctattttggtgccagttacatactgctttcatccttgtaggtttatattgtggcttaatatgtgataaaacaagtttttcctcagattactcttttttttcaaaatgttcctggttattttcagctgttcacataatatttaggactgtttggtcaagttttccctccaaacctcaaaaatagatttctccaaagctttgcagggacatggatggagctggaggccattgtccttagcaaactaacacaaggacagaaaaccaaatacagcatgttctcacttacaagtgggagctaaatgctgaaaacacatggacacatagaggggaacaacacacactgggtccctattggagggtggattgtgggaggagggaggagatcaggaaaaataactaatgggtactaggcttaatacctgggggatgaaataatctgtacagcaaactcccatgacacaagttgacctatgtaacacacctgcacttgtacccctgaacttaaaagtttttaaaaaattaaaataattaattaatttggaccaaagtgatatgtttatcatactgagtttttctaagcgggcaaatagcacatgtctctgttaagcatgtattctttcttgtcttttaggaaagctgtagggttttttgt

SEQ ID NO: 100907 - DNA, 1011 bp, Homo sapiens
taagaatacttttatgtgactgactgatagaaggccgccattgagtaaacagagatagagaaaatgggagtagttatggcaatgtggggagcagaagaattagaaagaaaaaggaagagatgttaatcttgcctctggcttattgtaactgaggctactggcagatgatagtaacagccaaactgaccgtgtccactgtctatcctttatttccatgaatctgcacggtgacccactcccctcccttccctgcatcattctctccactttacagatgaggaatctgagtccaaaagaggttaagttacttgcccaaggtcacaaaatagagattaaaatttagttttgtctgactccatattcttaaccttcaaggtccactgcatctctgcagagcttcccaagctttccactgaaggcctctttatattctattgcacctatgtcatccacattttgaaagattttattactgagcacactgcatttgtgaactaataatttcttccatctggctgatgattatttttctactcctgtttctgttacaacatcaatccagactttaatcccaattattgaaggttcaacataatattataaaatcacataaatcactgttgtgtctatgcagctaataggctaataaaattaaatcagcatatgcgccattgcccagtgctgaattctgaatgccacatggttttagagtcaatgccacctaaacactaggcattctcaacccaaagtccggggttcccagagagaggcagtgtttggtccaccccatacatctcagacattccagggacatcaatagccaattacagtgttcgagcaacatgatgtgcccagggttatcacatcgagttgctagaattcggatctaaagcaaagcaaagtctagaatgtgtggtagattataacaatggcccccaatgaatcatgcctttcagtacccaagcgcttgtatagactcttcccacactgactctgagcttggccacgtga

SEQ ID NO: 100908 - DNA, 1081 bp, Homo sapiens
agatagacacagacctgctccccgcagccttgttgagagccacacttctgcccatgccaggagccagctgtgtgaccatccaggggtggagggggaaaaccaggcaatttcgttcctggaatcaaccaaatcatgttttcctcttggatggaagtgtcaaaggcagaagggtgtgggagggggacaaggtcagtatttaccaaagtgtatctgattttaaaaattcctttagtctgtaaaactcctagagggagggaggtaactgaattcacttctttttgtggatcgtatcaaggtcactgggttttactggctggtgctgggaaaatgaagctaagtgaggagcttccattggaatgcttttccagggagagaggccagttaatttaaaaaaaacagtcgctagttaacagcgacagagcccagcaccctggggtctttgtgaatatccagactgtttcagcccagcccatctcagccaaccctccttagactgagctgtcagagcaagcaattaggggccagcctgcctccacctcccacccccttccacctccatcagtcatgtgtgcagagtcagtgctcgggatcccgggcccagcttttgcctttttggggatgcttggtgagacagatttgccagtcagcccttttgagttcccgcctcacccaggggctcccagcctgcacttgcaggagtggtgatgccccaagtctgcgaatccagggtgcacgtggtcaatatcccctcctgcattcaggagagccatggtagggctagagttgggtcttgcccagccctgcagtttcatagtcccagccttcctggtgctggggagggaggactgtgaatggctgttctcccctcactgctgagtctcccaggaccccctttggagatgcccatggcatgggcactgcccacaggctcagccagaacctcttggtgtacccgataagctgcaggttatcccttgctctgtgcgccttttatttgtccttaaactacctccttagagctctgaaggggtctcctagttccagattttaatttggggaacagatctgggttctttttaac

SEQ ID NO: 100909 - DNA, 1835 bp, Homo sapiens
caactacggggcattaggaagcaattattattgctaattactttcatgcatcttttgctgtaaaaagcagataaacacgagagtggcaaagtgagagccctgccgctttttctttcttgtcttttttttttttttttttttttgagacagattctcttttgcccaggctggagtgaagtggtgggatctcagttcactgcaacctccgtcccccgggttcaagtgactctcctgcctcagcctcccaagtagctgggattaccggtgcccgccaccacgcccggctaatttttgtatttttagtagagacggggtttctccatgttggccaagctggtctcgaactcctgacctcaggtgatccacccgcctcggcctcccaaagtgctaggattacaggcgtgagccaccgcacccggccccctgccgctttttctactgccagagactggaggggaaactggggcaaggggtttgttttccataggctgggtctgtgccagattgcagtggtctcctaaaatgcagatacatttgcattagatcggcttctgtattcatagtgggttttggtcctactgtctgactcttagtatggcatggtcatgggtgcaatggaggtcttgtctgcttgccagcctcgataaagctgcagcagggtgctggggatcaaggaggaagaaggcagcctgcaggtgggtgtggcacatagagtgtcgtggcagacaccttggtctggagccatggtcaggttgcttgctgactggcagtgcccagctccctggctatctgcctgtgccagggacatggcagataaagccccagccatgttaagacttgttagggctggtacctgagtgtgtctgagtgtgggtgaagataccagtgcattgtcaggttgacatgtccaagccccgactctcaccaatgttcttaatgttctttccctgactggtggggtttcagtggtagtggatacagtgacctagtgccttgcctttgagggagtggttgtgggctgcagctaggctcttaccagccctgaggtgctttgggtggactgagggttttttgatgcagcagacattttccttgcgggttcagtgaaaagattaaaaagatggaaaaggcagacttgtgtaggtatgcatccccaaagctcatgtccagtagaacttgagcacttggaacctgaaaaatgtaaagaactggtctgtatagtgagagctgtggattgttctagtcttttgcccagccccaaattttagtgatagcaaaagggcactggaactagaggccagagggaaactattaaactcacgtgctggcgtgaggaggggatggagccaggagctcagactctccctcatctcacgggcattttgtaatactgacatttccagatagaacctgctgccctagtctagctacccacagttccctccgagatgctgtatttggaacctgggcagttttaactgagaaaggtggtacattacctttaaatccaatgagtattggctgggcacagtggctcaagcctgtaatcccagcactttgggaggctgaggcaggcagatcacgaggtcaggagttcgagaccagcctggccaacatcgtgaaaccccgtctctactaaaaatacaaaaattagctggacgtggtggtgcgtgcctgtaatcccagctacttgggaggctgaggcaggagaattgcttgaacctgggaggtggaggttgtagtgagctgagatcacaccactggactccagctctgggcgacagagcaagactccctctcggaaaaaaaaaaaaaaaaaaatccaatgagtattt

SEQ ID NO: 100910 - DNA, 1065 bp, Homo sapiens
tgaaatgagttgggtttgagacagtgctgaatttgaggtcccaaagacaatctcttttgtttaaaaaaaaaaaaaaaagccaggccatggtatcatgtgcctgtagtcccagctactcaggaggctgaggcaggaggatcatttgagcccaggagtttgaggctgtagtacactatgactacgctgtgaatggctactgcactccagcctgggcaacacggggagaccctgtctctttaaaaaaaaaaaaaaaaaaagtaatgctttctgtttgccaggcactgttctaggtgatcccaaggaaggtgcgattatcatcttcattttacagctgatagaactgaggcatagagaagttaagtggccccgaagtcatgcagctagagaatgaaggagcctgtactcaaattgaggcacagaatgtctgaaccactgttaaccaccacactccctgtggagggttcaggagcctgtgctcaggtggggagaggtgacagcagatctggtggctagctaagagctactactatttatgggcatgcattgtggacaagggagtggctgtgtcaccttgaccacatcctttgaaatctagtacctgtgacagcgaggaccatgaaggtgtaggtctcaggctgctttcaggatgaaatgagaagctgttctgcatccgtgttctgatagcaaaggtacctaatggtgatatgattgagcactttgaatgggtcagtttctgtgctaaacccttgacctgaattacctcatttaaccctcccaacactgggaggaggctacaattaagaaaagaccaggcacagagaagttaagtaacttgcctgagatcacacagttagcatgggacagagctgggctcaagcccaagtctgtctagttccagctctgaagctcaagtgttttttttttgttgtttgttattattttttttaagacagagtcttgctctgtcacccacgctggagtgcagtggcatgatcttagctcactgcaacctccacctcctggattcaagtgactctcctgactcagcctcccgagtagctggga

SEQ ID NO: 100911 - DNA, 1034 bp, Homo sapiens
ctccagatatggctggagaagtgcaggaacagtggggtcctggtcagcaggccggccattatgcccctgaccagctggatgcgtcctcctcacgtctcctgttgtaactgacttgcactgagttgcaaattgcaaatgggtgttgaccctggaagggactcttgaaagtcaccactctcacgactttctagtccttagagagtgggtgggctccatgcagcacagactgggagagtgccatgactgtgggcacttgatgtgcaagggctgcctgccttccagacatgccattgtccttcgcacattattgcctccaggagtgggagcagtggccaaatacacatcaggtgtatttctggacccacaggctgcagcaagagcaccggatacctaggagttgcatcctggcttggaaagcaggactcggccggttagtggatgagtccaggtcattgctcagctcagtgaagagagtgtcccttcagtctagccccaggtctacttcagctatgcagggattggttgcatgagggctgggacacaggaatgggggatggggatggggatttgaaggaagacttccctactgattgcttctacagtaggactatggacttttcctctgtaaaagacaagtacttttggctgggcatggtggctcatgcctgtaatctctgcactttgggaggccaaggtgggtggatcacttaagctcagaagttggagaccatcctgggcaacatggtgggattctgtgtctacaaaaattagccaggtgtggtggcgtgtgcctgtagtcccagctacttggaaggctgaggtgggaggattgcttgtgcttcagaggcggaggttgcagtgagccgagatcacaccactgcactccagcctgggcgacagggtgaaactgcatctccagaaacaaaaaaatagacgaatatttttaagagtcctgctttagtaagaaaggagtggatgctgggtgtaggggaagtcaggggaagaaaaaaacctccatcaaccctacgcaccct

SEQ ID NO: 100912 - DNA, 1037 bp, Homo sapiens
ctggctttgtttattttttgtttttgagacaaagagtcttgcccaggccggaatgcagtggacgatctcggctcactgccaagttccgcctcctgcgtttacgtcattctcctgcctcagcctcccgagtagctgggactacaggcgcccgccaccacgcccagctaacttttttttgtatttttagtagagatggggtttcactatgttagccgggatggtctcaatctcctgaccttgtgatccggccaccttggcctcccaaagtgctgggatgataggcatgagccaccgtgcccagccagatcctggctttcttatatggcctttagtagctgtctcccaaagggtgaaactctttcactcagaattactatcaatcccttctgtcagaatccatttgataaagaaaaaagaaatctctgaaaacttacttggctctggtgggatcacatgcccaccctgaatgaatccctgcatccaagggaataggatactctggccagtgtggaccacatgcctgcccctattgtggttggagagagtatgataatgaaagctttctggggtacaggtgggtgtgagttctgctagcagaggagggaggcggggaagggacaccgtacaggcaagggcacatggccactaatcagctctaaaatgttttgagccatggtgttttgtgaaaatggcagcacagccccatgactgtgggtcctccactgttagtgaggaagactacttcagcagccacaaggacaagcttgagggcaggaaggccactgatgttgccactcaaacagtagcaaggagcagggcattagcaattcatagggcctagggtctgatctggagtccagcagtagctcccctctgtgataatccctttatctggtttccttacctttaagatgggggtgctggcctaaatagttttcttacctttaaaatggggatgctggcctaaatatttagaagccctattttttatttttaattaattttttgagatggagtctcgcccagtcatggaatct

SEQ ID NO: 100913 - DNA, 1946 bp, Homo sapiens
caagtttaattgggaatatgaggttgtttctgctgaagacatcagttaatactctgacttcctctgagacagtgacaggattttggtatggttactacttaccaagtgcacatccagacactcagttttattagcgctcacgaaacagatgtgtgctcagctacaagagaccaaagtgcaaactagaattcattcagaactgttcatttatggctagcaataattctccagtacagatggacacagttgacatatacactttgtccctgttggcacatccacatgggaagccaaattgtaatcaggaagtacagagccaagacaggttacagaaatgtcatacagcccctgatgaggggtgaattctccctgctccacaggatgcccttggaatgacccgagtaggtgtggccaccagcatctgtgtctctttctttctcctggacggtgctgggtgaaagttgctgtgttctatctatctgtctgtctgtctgtctgtctgtctatctatcagacagggtcttcctatattgttcaggctggtcacgaacccctgagctcaagcagttctcctgcctcggcctcccaaagtgctgggattacaggtgtgagcagccaaaaggtgccaagttcttatactcatggagttcttttgactagactgtgctgataattcctcttctattaatgtgttctttctccaaacagataggcaacagcagccttcttaatttagccagattgccttacttggagttttatgtggctcccaatattttagtcacaagtgaactgactgtctctgggtttcttcctcaagtgactaacacattcactatgtatgaatgttagcaagtttgactttcaggagatgaaatgataggtttactattgctttctcaccactgagggacagtttgagctgtgatgaagtgtccggactctggagctagacttcagggttcaaacccaagcttcaccatttgtgtgctgtgtgacctcacttctccattctgagcttcttttctttatctgtgatgtaggactacaggagcacctacctcataggactgttatgaggaccagatgagatcatccatgcagagcatttagcaagatacctgacatgtagtaaatgctcaagtacaagggaaattactgtttactcaagtatttaaattttggccttttcttgactattctttgtctcccaactgtacttacaagataacataaatgaaacagcaaatgaaaaaaaaaaaagcaacaagaagttaagaaatgtttatgaaattaaaatggtaagaagaagggtgtaagttactgatataaagcaaagcagagtttaagtacagttgagatcttataagatgttgaagatgaatcgagacaaaaaggaaaacaagttacctctacgccatcctttttccctttcaaacaaaaagtaaaagtagctttaaaaacagaaattggaggctcggtgtggtggcttacggctgtaatcctataggctttgggaggctgaggcgggtggatcacttgagacaaggagttcgagaccaacctggcaaacatggtgaaaccccatctctactaaaaatataaaaaattagccgggcgtggtggcacatgtttgtaatcccagctacttgggaggctgaggcaggagaactcttgaacccgggaggtgggggttgcagtgagccaagattgcaccactgcactcctgcctgggcaacagagcgagactccatctcaaaaaacaaaacaaaacaaaacaatgttggaactaaagcatcaagagattgttaaagatcactgcctcttccccagcaccattatgaggccacctgttcccttgtctgccttctttaggctgctgtatagacaatagtgactctatcttggatgcaagtctgccatgttcacttctgtttagacccagt

SEQ ID NO: 100914 - DNA, 1050 bp, Homo sapiens
tctcgcctcactgcagcctccccccgcctgggttcaagcaattctgctgccttagcgtcctgagtagctagtattacaggcactttccactgcgcccagctaatttttgtatttttagtagagacagggtttcaccatgttggccaggctggtcttgaactcctgacctcatgatccacccccggccctggcctcccaaagtgctgggattgcaggcgtgagccacctcacccggcctataatttcttataagtgaaaatgtaaagggcgtatgcattatgtattttgataagtgttaacacgattgcagttgtattcgctcatactgagaggaacagtacctgagggttagaaatacattttgatagttctacttaaaattcactttcctttgaaaacagctcatttcacaatgtttaaatatcgttgtttaggtcttttgagacaatgtatggctatttgcaaggtgtgttattctttttcagcttaggaatcatattttatacttgatagaaaattatcagacagtggtgattgttggtgaaacaggatgtgggaagagcacacagattcctcaggtgagtacatatttaataagtgtctttacacttcgatttggctggaagaattttgtaacttgagagctctctttactatcatttacatttttaaggtctcctttcaggaaatgttcacttcaactagatattttttattaaacttttagggcttataatttctttggtgagtactaaagtaacagtttgtcttcgatttattataattccaaaatagtaatggaatggccatcttctgaaagttacaatggagatttattcaaagatgtgaaatatagagtttttatccttaaatagttacagttgaaggggtggggtaaaatgaattttgctgtagttgtaaataaaaattggctgttatagtattatgcagtgctatggaagaaccctttcttactaggaaaaatcctatgtgatgtggataggagtagaaagaaggatcaagaaaggccttgtaaaggaattggcattt

SEQ ID NO: 100915 - DNA, 1039 bp, Homo sapiens
ctttgagaggctgaggcgggcaaattgcttgaggtcaggagtttaagaccagcctggccaacatggcgaaaccccatctccactaaaaatacaaaaattagctgggcctggtggcgcttgcctgtaatcccagctacttaggaggttgaggcaggaggattgcttgaacttgggaggtggaggttgcagtgagccgagattgtgccactgccctccagcctgggtgacagagtgagactctgtctcaataataataataataaaaattgcaaaagttattatgcttgttctctaataacttgtctcttttcatttttcattgtgttcacatactatttaaaatataaatgacctttagattttccatagtatgtgcgctgtgcagtaatttctatgtctctattttcagcatgatctttcttcccaaaggttgcagggagagtagctgaagaaaggggtgcagtgctgggccacgaggtgggctactgcatccgctttgatgactgcaccgaccagctggccacgagaattaaggtaaagtgctcaagctgcttttcctagtggaaataaggaagaaggttattttgggagaattaaaaacatgtagtccttgctgctgtacaggacattgataccatggcagaaagtgaagaaaagtatcctgacattcagagactttagtcagctaggagacagagagctcttccttttttcttttttttttttttttttgagacagagtctctctctgtcacccaggctggagtgcggtggcacgatctctgcttgctgcaagctccgcctcctgggttcacgccattctccttcctcagcctcccgagtagctgggactacaggcgaccgtcaccacacccggctaagttttttttttttttttttttttgtatttttagtagagacggggtttcactgtgttagccaggatggtctcaatctcctgactcgtgatccacctgcctcagcctcccaaagtgctgggattacaggcgtgagccactgtgcccggccgacacagggc

SEQ ID NO: 100916 - DNA, 1064 bp, Homo sapiens
cttgcctgcctgcatggtcacttagctcttctcagtctcagcttctctttgtaccttagggtcacattccccaagagaggatctttggtggcgtttccttcccccatcattggctggagccctcaagacaggtctccttgtgggctgcaagtggtggtcaagtaccattaaataggatgtggacacctgtttggcagaaactgccaagagacacttctcccaacagggtactgcacgagtgttggggaagtacatgattgatggcctaccccatacaaagcctcgcactcactactgtagggcgtgtaaagatggagaagacactatccctgccatcaagtggcctaaaaccagtaacaatggggccggaaacacacctactgttcacagaaggaaaagtttcctatcaaatgatcatatctgtgttttccagatagagttacccaccaacctcatctaacctgtactgaacttgagtcacacctttgacctaatttttgcttaaatgaaatacagaggataggaataatataaataatactaaagctacatgttaactcagatgctatgctgaatgcagttttgaaatctaacctttattatttttattaaaactttagtaaagacactgtcattgaaatgtgattccccacaattacagttagaaaaatgtgaatttaaaaaatgtattttgcaacccataatctgtattgcacatatataatcttgctactcacctgtctttggcaagttttatattattttttctttccatgaatcgctacgaacctttttttctaagagaaatgaagaattaatttttttctttttagaaattccgggatttctttaatcaaaatgaaaccagtgatccagcaagggatacatgtgtgatccttacagtggaagggagaacatttccggtggatatcttttatctacaaaggtttgatgatgcttgaattctggatgatggtgtttagaaaactcagcctctgatgtagaatgtcagaactgcatttgctcacaactctaaaggatggggaggagcatgttttgtgtcc

SEQ ID NO: 100917 - DNA, 1047 bp, Homo sapiens
cttgtctgtcttgtttatcctacatcccagcaccttgaacagtgcttggcaaagtgcacaccctcagaaagtaatcatgatatgaatgaataaatgactatacctgcgcaagatggagggtgatttactttggttatgccaaagggaaaaactaacaaatgctaggctctgatcactttatatattaattgtatatagtcccttcagtagccctaggggaggtggtaaatcttattatgtagatgaggaaacaggttcaggaggttgagtaacttgtccagggtcacatgattagggagaattcaaacccagggcaccccctgacttggaaactcacagtctttctagtatattaaactgcctctcacagattctgcaatgttggaaatgttaaatcttttaggatttttacgagtttgttaaaagcaaaaagaataaaatgagttttattcttctttctgtggggaacgtaggtgatagtggccaccaatgtggcagaaacctctatcacaatcagcggcattgtgtatgtgatcgactgtggctttgtgaaactccgagcctacaatcccaggacagctattgaatgcttggtggtggtgccagtctcccaggcatcagctaatcagcgagcaggacgtggtggtcgtagtcgctcgggaaaatgttatcgcctttatacaggttagtgtggctttccctaagggtttttgactttcttatagtcagcctgggcaacagagtgtagcaaatgtttactcctaatggtagaacttaacataaaatacaggccttcctcacaaggccctgtgtaatcagatccccactgctttcctcactctaaatatggtgtttctttgttactagtccccattggccaaagctggcctgtgagtgactgcttatttgctatcctgttctaacctaacatctgggcacaggcctgtgtagccatttgtccctagggtgtgggctgtgtgtcctggagcctgtctttcttgcctttctttcttgacttaatgtgctgtttttgtattccaagatccc

SEQ ID NO: 100918 - DNA, 1012 bp, Homo sapiens
atttcctatcctcagaggaagcctttgacaagttgcctcagtctacggttcctgagatgcagcgtagtaatttggcacctgtcatcctgcagctgaaagcactaggaattgacaatgtcctcaggttccacttcatgtcggtaagtcctgcctgctgtctggggccatagggaggctagggagctcacagggggatgtcaggacattgtcgtagggcatgccatctttcctttttttccctactcaggtcatgtgttgtgtgtctgctttgcaaccaggccctgtgcaggacgtaggggaaaacagccagacaaggtagcctcaattcctattcttacatagttcctgttcttgtctgctggggaatagagacaagtaagtgggtaattacagagcagtgtgcccagggctctgagagacaaaggaagggcctcccaggtgaaacctgaaacccaaatagaatctcaccaggttaggagtggagagttccaggacagctagtctttgtagaggcctagatgcaggagtaccatgattgggggatccttcctgcagctttagatagagctgcaggaagacccttgtgcctgattgcttcctgagatgatttctaggagtagaatgactgggtcaaagggccgttgtcctgtttagggtcctgttacatggccagattgctttaccaatgtcaactctagcagtgcctgaatgcccaccttgtggtacttccattgtgccatgttatcttctttgggtttgctgatttgattggccagagagaggaaatcacctttattataattatttttaaatttttcataagatagatttttataaaaacatttattagtcagtttttatttcttctgagttgttaagctatttatctgttagaatttgtgtcagttagtgattttcaagagtcctttgaatattaaagacattaatttttataatatttcttacaaatattttctatttatattttactgttttttttttaatgtgtgga

SEQ ID NO: 100919 - DNA, 1025 bp, Homo sapiens
gcggccagcagagccgagtgctgctgaggccatcaggaagatgccttgcgtttggtgctacccagttgttaggttcttgggaagagtggtctcttcggagtagtgggaacaggtgaggctcttgtggattgaggagagggtacaagcaggagaaggctgcagggggatttccttataattaagtccttgaatagaagtctttagaagtatcagttttttaaaaaattgggtattcaagagctcagtggagatcttttcttcttttaaggtaatggcactctagtgtcaaatggagtttggtgtagtgcatgaatcatcttttggatactttcttctttttagcatacattatcttttattctctcagcaactgtgtgccttccaacacaatggtacctgccttctgatttcttttgttgttcttatggcaggtctggacaaagactgtcgcctaactgaaccgcttggcatgagaattgcagagtttcctttgaatcccatgtttgccaaaatgctgcttgaatcaggtgggtagagcctgatagcttgaattgattttattttgactgtcagaggtgttgtttgcctgaattctgagcaccctggggaagagggtacaatatggtaaagaagtatatatatatctgtaacataacatttattgttttaaccattttatgtgtgtagttctgtgatacaaagtacgttcacattgttgtgcaaccatcagcaccatccatttctagaactttttccatcttttccattgaaactccatacttggtaaacacaaattccttattctctcctctgccccgcccctggcaaccaccactactttctgtctctatgaatttgactgctctgagaaccctcagaagtgcaatcacacagtatttgtccttgtgactctcttgtttctgttagcataatgtcttccaggttcatccatgttgtagtatgtgttaaaattttcttcatttttaaggcggaatagtattttattgtatatctataccatgttt

SEQ ID NO: 100920 - DNA, 1091 bp, Homo sapiens
tgtatgtggctcagaagtctacgcttttaaggaagtgacacacccgcctcagcagtcagcctgaaagcctagtgtgccaggtactcagccacatcctcagcaccattagtacttggtaacatttcctgagtgcttataagtggctagacagtgcactgagtgttccatgtgtttattaatttaatgctcacaacaacgctgtgaaacgtgtgctcttttccccatcttataggtgagaaaagcgtggctaagaggtaaaatgtaacttgctgaagttacacagtgagggtatgatggagtcagaacctgagcccaggcggttccatttaagtcttcttttgtctttatactaagagcaagtgattaaacaatgacggagtcttggcttttactctaagggaacagtgtaatgaagggagagattcatatggatagacaaagtactaagattatcagtcctcttcgaagttaaagtagtagatactttagtaatcatagaagacgtgctggcagatgtggaaggaatgccgggaagaaggaatccagagagggctagcttgggaagtctttcagcttccttgaggtgtggtgggagtccggtcaagctttggggtctggttgaattagaaaatggtggcaaagagcactctagggaaggaggactggagacaagtgcttggagtgaggagtatatgagacgctcagagaatatttgatgggtgaatacactcacgagagagggaagagttgaaacctgggccattgagccatgttggagtcattgatagaaacaggatgcttacaaggagcacctagttggagagcagctcgtcaaacgcctgtcacccagcaggtagatgacagccttacttcagcaattggtgttcttcacctgtgtttcattatcagacccctgcccaggagaaaagttaaatttaaattctacccagcctgagaaattaaatactaaggaataagattttgtagggtaggattgagctttggagggctaccggccattgtagtgtctaagatgctcccctccccctgcctccaagaaccagtttccacccctttggaagtgatatcac

SEQ ID NO: 100921 - DNA, 1020 bp, Homo sapiens
tcaaataaatgtaatataaaagaaggtaacagaaggtaacactttttgccaaaacattgctagtaagaatgcagtgaaactgccatttttatatattgttgatggctttggaaatagtaccacctttatggaacttacttaccaacatgctttattccattggatctaagataccatcatgtgtaagaaacatcgttattttatgtgtcaccaaagaaaaaaaatgctgccagttatcattgtaaaatgctgtcctaatttcagtgaattaaagttagaaaaagagcgagtcttaaaattgatgagatgtgatatgtcattaaccataaaaataacattagccttttgcacaacaatttggaatgtatcctatggacatcatctaatagtggggaagctttattcatggaagatgttagctgtagcaatagaaacaccagttaaaatggaacatttgaaaaatttgaagaattacttcaattttcaaacactagctcataaccacagaagtaacgttgtatactatctccagtttgtgttttatagaaagaacattgttgccatatgacactcttttacaaaggagttctgaggtcactgaccagcctgcagagcagcactcttaggttctggtgcccagccatggtccagtcatctgtggcttaggggaggttggaggggtcccaggttcaaggagcagaccagcattgttgtcagcagcagttgtggggagtgggacctccttagatggtgctggggcaggcatccagcattgggaagggtagggctggagccatttcaggagagggtttccaggtgtcttgaagcagcctggggtggtgctgggagtggatcctgtgcattagagcacacggagcctagggcaggcaagggtttcacccgcctctctgttggctgcctatgtaggtgacccggatctggttctgaggtgcattgtctccggcttcttcgccaatgcagcgaggtttcattctactggagcttataggtaacatgata

SEQ ID NO: 100922 - DNA, 1487 bp, Homo sapiens
actgtacccggccccagcccacagttttgacatagggacagacacagagtcaactaccttaggggaagggctttactagcagcatggatgaagtgctgggctcagcacatcatgtgccagtgagagtcagggcaggcttcatggaggagataacattcattctgaacctggaaacaagagtgttcagtcagaaaggacccggagggtattctaggtagagaagtagcaggggcagagccatggaacataaaggaacctcatgcgtttgggaagtggggaatcattggtatgggtggcccatgcaatggtgctgctctgtaacactgcctaggaagaaagaggtaagcacagaagtctagagtaggcctttagacatctttataacatttcaatggttaagtttatgtttgtccaatttaataataaaaattgggggcttatatttttcttgtttacaatttcatttttctagaattcatttatattgtattttaccaataaaaagtactgattaaaagtactgatcaaccatggattggattttgtttttttgagacagtgtctcactctgtgtttttgagacagtgtctcaatctgttgcccagtggtgtgatcttggctcacttcaatctccaccttcggggttcaagtgattctcctgcctcagcctcctgagtagctgggattacaggtgcatgcaaccatgcccagctaatttttgtatttttagtagagacggggttttgccgtgttggccaggctggtctcaaactcctgacctcaggtgatctgcccacctcagcctcccaaagtgctgggattacaggcgtgagccactgtgcctggcccagattggaaattttaaagacgacaacaacttgtccttctccaattggaagatggagaagccctgggaaaaagggtggggtgtgtgtgaagagagggagagaagatagcggtagatttgaaggcaagaaagtctgtggtcaaacactttgtaccctagaattgcagctttcaaaatgtggtctccagcccagcatcagtatcacctggaaacttgtacgaaatgcagcttctcaggccatgccaagtcccattcaatcagaaactggactagggcctaggactccattttaacaagccctccagatgtttcttttgggcagtaaagtttgagttctgtttccctagaccaaggaatcggatttatcctgtagccactgcagacctagaagttgcttaggttgaaagcaccttggtcggttctgggtttagaaatgttacccagtgaccacactaatgtggtcaggatacgcacactcgtgtgcaggataatttgaagagtgcccacgcctgtcatctcagcacttttgagaggctgaggccagaggattgcttgaggtcaggagttcaataccagcctgggtgccatagccagacctcaactctcaaaaaaaaaatgagccaggcatggtggcacgtgg

SEQ ID NO: 100923 - DNA, 1117 bp, Homo sapiens
ccagctaatttttgtattttcagtggagacagggtttcattgtgttggccaggctggtctcaaactcctgacctcaagtgatctgcctgctttggcctcccaaagtgctgggattacaggcatgagccaccttgcccggccatcctttagtcttttcttggtgctaagatgcttttaggaaacaatggtgatagtagatggtggttttattttttaatgttttctttggaaaaataaaatgtcaacagtcgttcatctatcacccaattaaaaaccaattcaaaatgatgaaacaaaaactgatgtaatcctcaagtctgggaactactgggttgtggctgagtgggccgggcagggcatctggcagcatcagcaccaagatcatcattctgggaagtggatctgaactgccaagcacccacctgggtttcaagtgaactttggcgccgctggaggacatttctatcccctggaagaattcgagttggcaagtctcagccccatatccctttttcacctcaagataagatcaggtattttccactctccaatgattcatctgaattttctcctcagccttctaatttgtgatgaaacaggatgatggaactctggatttcttgtcagtttaatctgtttttttttttctttttttctgagtcattggaactggaaatagccaatcaaataattgcacaaacagctggctactgtggatgaccaggtggaatttgcgtggcagacggtctggagagggcttgtccctgggtcctcacagtcattgctccctccagcaagcaaggatgacacgttgacgtctctggtgaatcctggcagtgttcccttttgcactcttgggtggcattggacttgctggaacagggcgtctccttgcctgcttaagtgcggccaaagagattcccagcgcagcgttcccccaggccctctggcacacatggccaccgctcccacttgtgggttctcctgaaggcaatgagcaggctagggaggctgggaggttcacaagggaggggtggtgcaggcacaggatttaataccccaggatctccatagccaggtgaacgaccagcacaggctactgcccatggcttcttga

SEQ ID NO: 100924 - DNA, 1049 bp, Homo sapiens
tcatcttctactttagtgtattagtttaaaactcaacagttgacttcccattttattttacttcctttgccccccttctcttcatttctttttttttttttttttttgagacagagtctcgctctgttgcccaggctggagtgcagtggcatgatctgggctcactgcaagctccgcctcccgggttcacgccattctcctgcctcagcctcctgagtagctgggactacaggcacccgccaccgtgcctgcctaatgttttgtattttttagtagagatggggtttcaccgtggtcttgatctcctgacctcgtgatccgcccgccttggcctcccaaagtgctgggattacaggcgtgagccaccgcacccggcctcttcatttcttattatgcttaatttgctttagtggttggcaaaaggcctacctgtaggtgtgggagctgggggaaggtattccaaacaaaggattaaatgtcaggaatgtacaaggagctcctataaatcaccagtgaaaagacaactccagcagaaaaaaatgggcacagggaatggaaggcaatgtataggggcagacccaacactccaccaaaccactgaagagatattcaaagttagtcatcaggaaaacacaagctaaagcaacaattagacatcactctgcaccaatgagattagcaacacagtggaaaggtggcggatggagatgcggcggcctctgtgcgcagctggtacggcagtcctggagagccacctgggactactcatgtgtgttcctgccccacagcccagaaactctgcttctgggggtgtgttcccaacaaaattctcacccgggtccttaggagacacatgtaaggatgcttactggtgtgatggatggggtggggactaatgtccatccctgggaggtgtgcagggacaatgtattggatgacactgtggatcagtacagagcaggttcatagaacacagacctgagaaatagctgagtggaagaattaagaaactgctgtaatcccagcactttgggaggccgaggtgggca

SEQ ID NO: 100925 - DNA, 1005 bp, Homo sapiens
ggagaagctgctgtggagacagaggcagagactggagaggtgcagctgcaagccggaaatgccaaagactgcgggcggctgcaggagctcagagacaggcatgggacaggttctctctcggaccctccaggaggaaccaatccggccaacacctctattttggactgccctccttctcagaactgtgtgagaaggagaaatgtctgttgtttgacatcaccaagcttgtggccatttggtacggcagccctggggaactcatactggggggtaggatgccgtcctcaaagaaatgagggttgtcatgtggaagagggaccctactcactctgtgtccctggaggaatgtgagctttcctctgagcttctaggtccttaggaaaagggctccgtacagtcagggggttcagggatggagtgggctgcactggggaggtgtgagtaccccattactgatatgccaccagggagtttcaactggcatctgttgtgtagttgaacttgaccatttgtgaggccccctccagccctgagaatctatgcactggtgcaaagaaagaggtaaatgtttagagaggtgacagaggacctagagctaatgtccaggatgctgcccaggggccttagagatggtgacaatggttggtggggatatgggtctgttggagaggaggaagaagaggaagagagcctgactgccaggcaggcaggggtatctttggggctctgggagccccagcctctggattctgccctcagtgagctttgcaggacaccctaccataccccctccctgctttcttctgatagagtcgtttccatttggatattgccttgaacatgatgttcacaatccccaaagggaagaacatccctcaataagccacacaattctcccagccaagaacttgctgttccaaattcattaaaattgctgtgatattctcttcccatttatgtgccaagagccgttgtggacagaattcataataccatggagtggtg

SEQ ID NO: 100926 - DNA, 1042 bp, Homo sapiens
gttttctgggactcagaactttcagtgtcaaaactgggacagtcctgggcaaactggggcctgttggtcaccgtaggctgtctgtgattgtaacacagagtagttgcacattactcctgctgaagacaccaggtagttattgccatgttttggaataatctctatcccgtagcacatttccaggtgagtcacgttgaccacttcatccacatggtagataacgggttgactggctgattaaaacaccttcggatgtgagtaataggcttccaatgtattggagaatgactgtttggacttgaggtcacatacttttcacgttgagttccattcttttttttgtcacccaggctggggtgcagtagtatgatcatggttcactgaggctttgagctggtctcaagcaatcctcccacctcagcctcccaagtagctgggactactggtgcaagtcatggctcctggctcttgagttccactcttttaagcaatatggaccttaaggtagttgtacctgtggagtgccactttccatttacatttcattccagtaaggaaacttgggtgtctgctctttgcattttaaacatttaactgagctttacaattttcataaaagaaaaatgcatgatatcagttagggcagcaaacagatgattttaaaacatttcaacaattagttttttttaagaaaatgaacactagctttaaaaagcaggtatttgggtagaaaaaagtagtgagatattaaacaaatcttatgactgggggaaagcactacaatggaggtataaaccacagccatatgggtgtgataagtgcctgatatggtttggctctgtgtccccacccaactctcatgtcgaattgtaattcccaaagttgggggaggtacctggtgggaggtgattggatcatgggggcagatttcccccttgctgttcttgtgatagtgagttctcataagatctggttgtttaagagtgtgtagcacttcccctttcactctctttctcttgctcgccatggtaagacatgtttg

SEQ ID NO: 100927 - DNA, 1524 bp, Homo sapiens
tttgtttttttttttttgagacagggtctcactctgtcacccaggctggagtgtagtggcatgtgatcctggatcactgcaacctctgccttctgggctcaagcaatcctagcacctcagcctcccaagtagctgggaccacaggtgcacaccaccacacctgacttttttttttctttgtagaggcagagttttgccatgttgcccacggtgatcttgaactcttgggcttaagtgatctgcccgcctcgacctcccaaagtgctgggattataggcgtgagccacaatgcccggcctatatgcctatgcctcatttttgagtgtcactgtgtaccctagtcggtgttagacactgcaggtccccgaagaagtagaggtgactgtctgtaccttaggggcaggcacagttggggcgggacccagaattcatggaacacttaatcagcaattaaaatgtccacaggaccagtgactcactcatttaatacgtacttaacatttgtggttcggagacccggaaatgacaaatcaaggtcctacttggtttcagagtgagccccgagattgaatcagcaaggaaaccttttggtatacttgcctcctgattatgggcctgtcaacaagcctcagtgggagggcaggacgggtgatgtgtcctcactgcccagaaaattgcactttcctgcctcatttattgtatgtagagaagtgaactgaggagcccgacaggctgggcttgccacaggtggtttctaggaccttgggtgactcactcccttctctgagcctcaggtttctcatttgaagcatggggaggctcctcctgccttgaaaggcacatttctcattcattcattcgtttgtaaaagatggtatttcataagaatgtggagggatgactcaataaacatagccatctgggggaaaaaaagaattgggtgatttggtagattgtattactgttcagcaaatatttactttccccagcccccaccaccacggaaggaatatacttcctcaccctgttgatattgcacttggccacgtgacttgctttggccatgagaatatgtgtggaagtcacaggggccaggcccaaggcacaaagtgtttccattcatccctttgagcaactgtcctcggccatgagaaccacaagtcccagacagtggaggctccttcagcctggactccaaatgagaagatatatgagacagccacctactcaccccaaagcctggagcccagcccagctagccccagaaagccctgcagagccccagcttgacccacagacccctgggcaagaagtgaatgtttactgctgtaagcaccaggcttctggaagttgtcttttatgcatcattgtcacagcaaaatctgaccaatgtggatccctggctcactccttatattgattttagcttgggtcttgagcgaggattttctttttttttcttttttattattattatttttttcgatacagtgtctcactctgtcacccaggctggaatgcaat

SEQ ID NO: 100928 - DNA, 1795 bp, Homo sapiens
tagctgggcatagtggtgtgtgcctgcagtctcagctactagggaggctgaggtgaggaacacctgagaggctgaggcagcaatgagccaagatcgtgccactgcactccagcctgggtgacagagtgtcaccttgtcttaaaaaagagagagagaggaccctgatgaatgaagttcaggaccctcgttcctactttctcctgaagcctggttgcatggttcctgttctggcacctttaaattgattcccccttttgcttaattgcactctgatgggttggtcctaatctctacttgattcctgggcactcacaaggcttttgtcatccttttggcaccccctctggggctatcatgctgtggaacaggatgtcccacctgacgttttgacccttggatgctggcacattcttgactttgccaattctttgacagtgatgtcttctagcagctctccccgcccatgcctaagaatctgctgccctttcaagattccgatacccttggaaaagaaactgctgggtgctcaagaaaggagattcaggctggtgatctcaggaacaaccagaaaagctctttgcctcctagaatgaaacagctcagcaacagttgagatgtgtggaataaaaaggtcagaatcaggccgggcgcagtggctcacgcctgtaatcccagcactttgggaggccaaggcgggaggatcacctgaggtcgggagttcgagaccagcctgaccaacatggagaaacccctctctactaaaaccacaaaattagccaggcgtggtgctgcacgcctgtaatcccagctactagggaggctgaggcaggagaattgcttgaacctgggaggtggaggttgcagtgagccgagattgcgccattgcactccagcctgggcaacgagagggaaactccatctcaaaaaaaaaaaaaaaaaaggtcagtatcaataagaaagctggcaactcttgaattatgaaatgagaggcagtcaagcaacaaagatgtaggatcctggccatgtggcttggggcaagaaaagtagtccacttgcatctccattgtcttcctgccagaatacatcctaaatgaggacatttattcattcaaccagtattccctgaggaatgaaggcaaataggtactacttacctatttgaggttggtaggtcctatactaagccctagagatacagctatttataagacctaatcctcattttggaagagtgcctagtctgataatgagacagaggtattctccagctgtaacactaaggtataaggaataatagggaagaggaggccagccaccagttgctgtgggaactcttgagtaaaggagcacatccaactcaccagtggtggtgggggcaatattaggaaaggtttctagttggacactattcttgaaagatgaggggttgctagcccgtggaagagaagaaaagatattgcaagaagagaggcaatatatgcagagccatagctttggtcaggatggagcagagggtaaaagtgaagatataaccaatgtaggctgggcaggtgggagaggccctcccagttctggtggagatactgcaaggtgaattatgacagggttttaaacaggtatgagaacaatcacaggcagcagagggggaacagtttggtggaactgacactggaaataggcagattagctcggaggtccagggagaccattgtgtttcagaagcaaccttaatcatggaagatcatttggaatacctgaagatagaaagtatctgtacctgtgacggggacagaag

SEQ ID NO: 100929 - DNA, 5476 bp, Homo sapiens
cggctcgctaggccgcgagcgagggccgcgaagttacagttcgaggcagggatggctgccctctgtggccacccccgggtccccgtcctccccgggggcgcagggtgagccagaccccggccgcgcgcgctcgccgccggaggggttaaagtggctgttgtttgatattctctccttttctttttccagatcgaagcggatttccgattgaatggtgagtgtgccccctgcgccgactccggggccccccagccgccggccgcctcccccgcgccctgccggtgccgggcagaggacagacatggcgtcccagagactaagtcccggctcctcgctcaccggccccattgttcccatcgggccgcctcttgaccccctttccggggaccccagctcctccagatcccggccctcccaagaggggacaacggagaccccgtgtcgtccgccaccgggcctcgggcggtctttccgggccgggattcctcccgggaaagtcgccttgtcgacggtcgggacttagtctctgcgccattttctttttctctctcctctcctttctgtgcctgtgtctctttctctccctccctcggctctttccttgagctgcccagaatgagctttctgcagagcaaagccgtataaatcacatacttcaccagagagggaaggctgggggactgaattattattttttaaactttattttgggggttattccctttatgcttcatgtttgtttccttttctgcttccagaatgaaagatttccttaagcaactgttaattttttttttgataggctgtttatgataggaattatggctctaaaactaaagccacgctttgtggagttctttatatttccaggttgtttttcccaagttacgttctttgcaaaggtagcagtacctccctaaagaaagtttgcaagttctctgtgggtcacccaatgtaaatgttggatttttaaaaaattatgttagtcactggaacttttcattgtggtcgaggttcccaatgcagtgtttttctggaaacgcagtttagtgtacttgttggaaggaaagattgttgagcatctcttgtggacctggtgtgttggccttttcgtttgggttgtaaggaggaaaaaaagattttatttattgaagcaaagagtgtccagtacccacccctgcttcctgttcattctttttcacgagccactgtttttcaggaatcaagaactggctttttttttttttcccaattctttatgtttttgaacccttttcagccaaatcaaggcatttattcttactgtatttccacttcagttacccagggaagagtcctccaataaaaagctcatccttgcaggctttcgaacaaccctgttgaaggagaagttaccttctgtagtgtgctgggaattcccactgattttgatggtacataatcctgctcaattgagtttgggttccgggaacctctccaatgggagaagttgatgagtaggttttctaatgttgtaatcagcagtccatcatgttagcctgctctactgagagcaaccttatgttcagagtttgaagtggggcatccagcaggagatggtactcagccaggagagaatctggtttaaagtatggcatttcttgagcaccagatatgtgccaaccactgtgcttggtgctagagctgatcctgtaaccataacactcccttgctctcaattcagtctattgggggagacataattagttaattataaggtaactactggggcatatgtgtacccaaaatgctttgaagtataggggagttaattttgtctgagggtggggaaatttctcagaggaggtgacttctgagctgggggttgtggaagactgggcgcagagaattgtcaggggttggagtgtttcttaagtacgtttaaccaacctatcacgattttaaaagagggaggaggtgaggcctgcagtttagaaagccacagtatagacatgtttctttgggatacaggagcaaagaaaggatgtgcaggtgaggatgtaagaagtccttttgaccttgctagaggaaggtgggatctttaatatggaatgtgttcttttggctgtcaggctgggctgagtaggtaatgtaagtaatgaaacaaagtttagccctttcttgtgagaaagttaacttacatggttctcacctaagtcacgtgaatgattgtgagctggctaggttattgatctttactgacatttttatagaggctgaagtaatctgcgtatgttgacttttagaatgtgttggctcacatttaatagcaataatagctaatatttattgaatacttactgccaggcatgaatctcagctctttccatggatcatctaattaaatgtaatccttggaaggacccttgtgagttaggtcctgttatttctgttttgtagatgaggaaactgaggcttcagtgtatttactagcttgcccaagggctgtgagttggccactctaaatcccatgagctgagccactatgctagagtgatactatatgatactagcatgaaaaaataaaaagccacaaatctctattttcttacagagctgaaaaaggagagaaggaaggatttgataatttgtcatttgctttttatctaaacatgctttttgaagagaatctgccaccataaagttctgacattggtgtaattattctttgtgaatattgtctggaagatgtggtgttggtaactatgcttgctatctcaagtaatacattgttaaccagtgattgatttatgtaactatgaaaaaaactttaaaaaaagtagaaatcaatgtttaattatgcccagacatgtcattattgaactttgtattaagagattgtttaagcgtgattttaagagggcctaacccatcttacagattaactgtacaagttcatatattaaaatcaaacgtctctcattttgcctgccctcatcccctaagatataaaagattcccccccgtccccccactttggagctcattcttcgcaatatttaaaattgtagctctttgcatgtaatttagaacattctgacccatactcaactgctgggagactctgttatttatatttaaaatgttgacagtgagttaggaatttggagcagaaaccatatctaagtctaagtgaaaagacttcctaagtattggtagaactaactgtagtggggctgagtcattattacagtactgtacaggctgcgtagctatctgtagaattgataatggtaataccaggttaaagtgttagcgattcttctgctgtttcagaggtcttgaagtttttgcctgtctgctatggagatagggagttctcccccatttgacccccttagcaaagcacaatacttggctccatcagtctttagtctaagaagtgatatataggatcatggtttgacatcatcttgtgctgattctggttggcttaatggaatcaaattggatgaaggtaattaaatatgaattgtttctgatgctaatagatagttgtacttctgtctgttgggtatgggttgggatgggcggtagcatagctgattgcggtgggggaatttcagatagctgatgatgtggctatctgaaaattgccactacatttttaaaactgaaaagtgatggtaccgccaaatgaaatctgcagcatcctcagactcaatcaggaaatacttaagcattatgctccagggtggttttcttcccttacattgcaactggactccttgaggcacctttttagaattagtgagccgctaggatttttatactatgctttgacataaaagaaagttgcttgtcaatatgtgtttttttagtttaccagcatatcagatctcacaaacaaattttaggctcggattggatgtttctagtaaaaacaagaaaatccaggcatcactaaaagaatcagaaatacgttgtggcttgaaaggtgcaaactaaataatatagctagcagtaacggtcaccaactcctgcttttctttggttcagtagatagagtaaaatggaaaataggaaaccaaggtcagtccccaaatctcattttaaccaatagcagcaaaaaaaaaaaaaaaaaaaaggaattgagtctgactttttccccttgctgtcagcataaagatggggaattgagagagttggaaagacattcattagtttgttcagattattaaataacatgtcttaaagtttatattccaaaattgggctgtgaggtttttttgttttgcttgttttcagtgcatgtgtggggtggggaggtgcaaaaaaatgtttgccttctaatatacagctttgttgtatattaattatatagtaacagttgtccctgctgctaatggtatggaaaatgattctgttgtgctttctgaatacatatcattttagaagtttcagattatactaaaaccatgttatttcatattagttggacatgaatgcatatttatatgacacatcattatcaacttttgccttttgccatctttttagtgcaaagtaaaactgatattcttcaaatccaaagtcgtttcctcagaagtgtgttttgtgagggattgcatctttcccatgtgaaactgtgtcgaactccagtaaactgtgtttgcttgggaaaatgaattcaaatgtaattagtttgaatgaagctgtggaaatgtttgaaatgagtattttgacattggacctggaggtttaaaaaaaaaaaccctattgaaagaatagtaaaatatattggatgtggaggtgagagtcagttgagtgaattttctgtgttgtatggtttagattatctgactatcccttaattattttgaaaccattaactttggataataagggcatttaggcaaacagttgacacatggatttcttaaggtaaaaagtttagagacttccaaactagtccttaagaggcgaatgggtattgtgtttaaaggaagctttcagattgtgtttaaacttcgagtagtaatatttggaactgtcttttctccctatttccatgcctcatacatctcaagtttgagcagcagctttccatccccatggctccaggccaatagctgcagtagaaaatctaaaatagaggccagggttggaataattagcattttgccaacccccaccctccctgccacctgcctatctagatgtggacagtatgtgctgtgttgatagcatagggcctgggaagggtggagagggatgtaaatgagggcagggtggacaaagtttgattgggggttgcggggaagcttgtagaggaatgtctgttagatattgatggtattttggtggcgttatgagaaatggctgatagtttgctgaaatgatttaatagtaaatagatattgttgaacattttctgtgtgtataggaaagatcctagatatttttcacactgggagagaagtgatgttactggtat

SEQ ID NO: 100930 - DNA, 1880 bp, Homo sapiens
ctcacaatcattcacgtgacttaggtgagaaccatgtaagttaactttctcacaagaaagggctaaactttgtttcattacttacattacctactcagcccagcctgacagccaaaagaacacattccatattaaagatcccaccttcctctagcaaggtcaaaaggacttcttacatcctcacctgcacatcctttctttgctcctgtatcccaaagaaacatgtctatactgtggctttctaaactgcaggcctcacctcctccctcttttaaaatcgtgataggttggttaaacgtacttaagaaacactccaacccctgacaattctctgcgcccagtcttccacaacccccagctcagaagtcacctcctctgagaaatttccccaccctcagacaaaattaactcccctatacttcaaagcattttgggtacacatatgccccagtagttaccttataattaactaattatgtctcccccaatagactgaattgagagcaagggagtgttatggttacaggatcagctctagcaccaagcacagtggttggcacatatctggtgctcaagaaatgccatactttaaaccagattctctcctggctgagtaccatctcctgctggatgccccacttcaaactctgaacataaggttgctctcagtagagcaggctaacatgatggactgctgattacaacattagaaaacctactcatcaacttctcccattggagaggttcccggaacccaaactcaattgagcaggattatgtaccatcaaaatcagtgggaattcccagcacactacagaaggtaacttctccttcaacagggttgttcgaaagcctgcaaggatgagctttttattggaggactcttccctgggtaactgaagtggaaatacagtaagaataaatgccttgatttggctgaaaagggttcaaaaacataaagaattgggaaaaaaaaaaaaagccagttcttgattcctgaaaaacagtggctcgtgaaaaagaatgaacaggaagcaggggtgggtactggacactctttgcttcaataaataaaatctttttttcctccttacaacccaaacgaaaaggccaacacaccaggtccacaagagatgctcaacaatctttccttccaacaagtacactaaactgcgtttccagaaaaacactgcattgggaacctcgaccacaatgaaaagttccagtgactaacataattttttaaaaatccaacatttacattgggtgacccacagagaacttgcaaactttctttagggaggtactgctacctttgcaaagaacgtaacttgggaaaaacaacctggaaatataaagaactccacaaagcgtggctttagttttagagccataattcctatcataaacagcctatcaaaaaaaaaattaacagttgcttaaggaaatctttcattctggaagcagaaaaggaaacaaacatgaagcataaagggaataacccccaaaataaagtttaaaaaataataattcagtcccccagccttccctctctggtgaagtatgtgatttatacggctttgctctgcagaaagctcattctgggcagctcaaggaaagagccgagggagggagagaaagagacacaggcacagaaaggagaggagagagaaaaagaaaatggcgcagagactaagtcccgaccgtcgacaaggcgactttcccgggaggaatcccggcccggaaagaccgcccgaggcccggtggcggacgacacggggtctccgttgtcccctcttgggagggccgggatctggaggagctggggtccccggaaagggggtcaagaggcggcccgatgggaacaatggggccggtga

SEQ ID NO: 100931 - DNA, 1020 bp, Homo sapiens
cagcacaagatgatgtcaaaccatgatcctatatatcacttcttagactaaagactgatggagccaagtattgtgctttgctaagggggtcaaatgggggagaactccctatctccatagcagacaggcaaaaacttcaagacctctgaaacagcagaagaatcgctaacactttaacctggtattaccattatcaattctacagatagctacgcagcctgtacagtactgtaataatgactcagccccactacagttagttctaccaatacttaggaagtcttttcacttagacttagatatggtttctgctccaaattcctaactcactgtcaacattttaaatataaataacagagtctcccagcagttgagtatgggtcagaatgttctaaattacatgcaaagagctacaattttaaatattgcgaagaatgagctccaaagtggggggacgggggggaatcttttatatcttaggggatgagggcaggcaaaatgagagacgtttgattttaatatatgaacttgtacagttaatctgtaagatgggttaggccctcttaaaatcacgcttaaacaatctcttaatacaaagttcaataatgacatgtctgggcataattaaacattgatttctactttttttaaagtttttttcatagttacataaatcaatcactggttaacaatgtattacttgagatagcaagcatagttaccaacaccacatcttccagacaatattcacaaagaataattacaccaatgtcagaactttatggtggcagattctcttcaaaaagcatgtttagataaaaagcaaatgacaaattatcaaatccttccttctctcctttttcagctctgtaagaaaatagagatttgtggctttttattttttcatgctagtatcatatagtatcactctagcatagtggctcagctcatgggatttagagtggccaactcacagcccttgggcaagctagtaaatacactgaagcctcagtttcctca

SEQ ID NO: 100932 - DNA, 1157 bp, Homo sapiens
gcttaagacaacaaatgaaaaatgaatacctaccaaaaagaaattaagggtcaggcacagtggctcatgcccagcactttgagaggctgaggtgggcaggctgcttgagcccaggggttcaagaccagcctgggcaacatggcgagaaacctcgtctctacaaaaaatgcaaaaattagcccggcgtggtgacatgcacctgtagttccagctacttgggagggtgaggtaggaggatcgcttgagcccaggaggcagaggttgcagtgagctgcaatcacactactgcgctccagcccgggcaacaaacagaaaccctgtctgccccccaccccgcccaaaaaaaaagtaaaggaaagaagttaaaattaaaagttgcctaccttccttggaatttctttcttactaaacgttaagagacataaatgacacacataaagacagttaatacaaacttcgatacagatagccaaagttgatattacgatctatatactccagagatatgcatgagataccagtaacatcacttctctcccagtgtgaaaaatatctaggatctttcctatacacacagaaaatgttcaacaatatctatttactattaaatcatttcagcaaactatcagccatttctcataacgccaccaaaataccatcaatatctaacagacattcctctacaagcttccccgcaacccccaatcaaactttgtccaccctgccctcatttacatccctctccacccttcccaggccctatgctatcaacacagcacatactgtccacatctagataggcaggtggcagggagggtgggggttggcaaaatgctaattattccaaccctggcctctattttagattttctactgcagctattggcctggagccatggggatggaaagctgctgctcaaacttgagatgtatgaggcatggaaatagggagaaaagacagttccaaatattactactcgaagtttaaacacaatctgaaagcttcctttaaacacaatacccattcgcctcttaaggactagtttggaagtctctaaactttttaccttaagaaatccatgtgtcaactgtttgcctaaatgcccttattatccaaagttaatggtttcaaaataattaagggatagtcagataat

SEQ ID NO: 100933 - DNA, 1030 bp, Homo sapiens
acgaaagaaaaagagaccaaagctttgaagacttttaaatccaaccctattgtgggcacattccttgtatactgagggcaatggagctacagagcattaacaaatactcatcttcccagatttttttccccatattttatgagctatatttttcctgatatgtttatctttgaagactctttaaaattaggccctattccataatttctatacaacaaaattatgtcctcctgcctacttttaattgaatttaagtctgcgcctgttgtgatgcttctgtgataatccttttgctgaatggcgtaagatctctactaagatccatttggcttaaacctaatgaacactagtgaacacatccttaaatgacttttgtttatttcctttaagtaacacttccaaaaaaacaaattcaaggcaattcaatattcagcattagctagacttatgagccattactgaaatttctactgactttatcaaattttttcatggaatctcccaaatgcctatactcacgcataactgttaacacggcatttggtactaaattctcacacataagctttattatattatttaaggtattcttattcccaagaattactatttcaaagaaaaccaagttggtcactttaagcaactatttgaataaatgaaaaactgaagtaattctcaggtgctttgagagttctctgtttaatttaaaaacgttttgggggagaagtaaaatagtggcctttgaaaaaatatgctgacacaagacatattgaattttgtggttttaaaaaattaacaaataatgaacttggcattttattaaatgcatcgaaaagggtcaagttatttttaatagaaaatccataattctattaaatggttgagaaattagtcacatcaatagacttctttcatttctgagcccatcttctgtactgctacaagttcctttggcaatgaccactttgctgtaaacattcttagaaaagtaggaattaggcttggcgcggtggctcatgcatgtaatccc

SEQ ID NO: 100934 - DNA, 1089 bp, Homo sapiens
tagaagacaacactggaatttttttacttatctctgaaagtaattaactagtacaagacccttaagatgggcaattgcatttctttttttcttttttttgagaaggagttttgctcttgttgccctgctggagtgcaatggcatgatcttggctcactgcaacctccgcctccagggttcaagcgattctcctgcctcagcctcccgagtagctgggattacaggtgtctgccaccacgcctggctaattttgtatttttagtagagatggggtttctccatgttggtcaggctggtctcaaactcccgacctcaggtgatccgcctgcctcggcctcccaaagtgctgggattacaggcgtgagccaccacgcccggctgggcacttgcatttcaaatactgctctataacaagtcacattttcacaaggacatccctgcactacaaatgcatcttctttcccaagaggcagaacttaaaagggaaaaaggacttgtctaacctgaaaatgtatcttctcaggccagctcaattagggcaggcccattcctgtaggcttgtcctcctttgcttccattaaggaacgcttaatgcctgggaagagtgagagtgactacaaacctctggcctacgtgcggatccacagctcagcctaaactgcctttgtttccaatggtcaggggcctccaaacacactaagaccatactttgtctggccataaagactttaagtgtgctgacacattgtttcatgtatcctattactaattcaaccaagggaccttctttgtctagacaattctcattgacagggcttgaaatgcgcaggccattctctgggccactagctgtagaaagaataagactgaacacacctctcctactgaagtggcatatattcagtagaaatacaagaaacctttctggtgttaatcatataactgctccttaaatttttttatactccagaagatcctcccccgattatgaattactccaacttcacaactgtaagaaagcacaagtaatgaactccatacatggttccttgtgaaagaacaaggaatactgcttaagaggttgaatta

SEQ ID NO: 100935 - DNA, 1103 bp, Homo sapiens
cctggataatttcatccagtagaactttttgtcatgatggaaatgtcctatatttgtgctgtccaatatggtagctattagccatatgaggtgtgtctgtgtgtgtgtgagtgagagagagagagagagacaagagtcttgctctgtcattcaggctggagtgcagtggcgcgatctcagcttactgcagcctctgcctcccaggctcaggtgattcgaccctcagcctcccgatagctaggattacaggcgtgggccaccacgctcagccagtttttttgtatttagtagagacggggttttgccatgttgaccaggtttgtgtcaaactcctggcctctagtgattcacctgcctcagcctcccaaagtgctgggattacaagcatgagccactgcacctggcctatatgaggttttgagcccccttgaaatatgtggtaagtgggaccaaagaacttaattattttattttattttattttaatttaaatataaactagccaatagtggctaccatattggacagctctagataaaatttaggtaagacccaagagattgtggtttagattctgcttggaatatgagtgattggggctcttggaatttaaaaatccaaagacacgtgtgaatttgatgttatgagtttgaataacagccttccttcagtatgtctacattgttttatcctgactgacattgtaagtcctaagaggacttacaactggtaagtaaagttgtgtttaccaaagcagttggaagttcaggcagttgtacgttttatttgaccccttagagctaaacaggtgaaaatttcaggtcctttggatgaagtaagttctcattttatctcagcaaccctatgaggtaggttatgtctgttgcgtagttgacaaaacagatgaacttatatttatgtacacctttatggattagtagcctttaaaatggttagttttatcccacaacttcatttgaaattgtaagtttctagcatgttgcctataacaagaaggtaatttatttctatttgttaaattgttatcagtaataagtcaatatcctactataagtggtagagaatcaaagattgtagactac

SEQ ID NO: 100936 - DNA, 1014 bp, Homo sapiens
cacaaaaactcaagttactcataaattgactaccctaagataactgcttttaatattttgatgtctgtattccagtcttcttcatatgtatttatgcgtttgttgaattatacacagagtagttttttttaatgtgatgtcctttccatactctagggctgtattagcagatcttgatgttctgaagcttgtttattgcatctggcctgcaaacaaaattaattgacacacatgctttattccagattgtggtgctattacatgtattgtcattattatgattttagccataagtgtttggtttgaggcagaagtagtgggatattgctgtcaagtaaactggggccactaaccttgtgggaatcaacttagcattttaaaattatagactcgaggtttttagaagaagctgaagggttctgtatgctgcatggaagattgagttcaaatcctacttctgacaccatatgatattatttttcccatctctgtaggatgggaatttcttacagttagtactacggtcatgcagatttctattttcccagggcctgacacagaatagatgctcagcagattatgacacatgtggcttcttttgctgtgagccagtcatgggatgaagacacattgcctatgcattattaattgattgctataaaacatgttgcctcaaaatataatagcttaaaacaacagacacttattttctcatgtagttcctgtgagtcaggaatccagacatagtttatctgggtggctttggcttaccatctgtagattgcagtcagtatgtcagccagggctgcagtcatttgaaaacttaatttaggctagaaggtccacttccaggatggctcattcacatggctaattggcaggaagcttaagtttcttactacatgggcctttccagagggcttctgagtgagtacatgacagtgtgtcactggcctcccccagagcaaggagagagcaggaaggaagatctaataccttttatggcctagtgtc

SEQ ID NO: 100937 - DNA, 1036 bp, Homo sapiens
aaattctgaacctatgaaaacttcatctctgtctttctcttgtctggcctgtaacatgacaagaacagctcacaccaaagttagaagataatttcatcagtcatcacttatctcttgacactgcttctttctgttagcgttaatattttgctcctcagatcctttttctttttttttggagtcagggtctcattgactgctaagcttgggcgcggtggtgtgattatagctcactgcagcctccctgggcccaaggggtcctcccacctcagcctcttgaatagctgggacaataggcatgcaccaccatgcttggttaattaacttttttgtttttaatagagatggcggtcttgctatgttgcccagggtggtctggaacttctgggctcccacattggcatcccatagtgttggggttacaggcatgagccaccatggccggccctcttttaaaaaatacataaataatctcaaaaggaatactcttctagatgccaaggaattacgtagcttgtaggatctcacgagctacctttcttaaagggttacattcttatccattgtttatctttaatagtagatctcttgtataaacagaatattattaaaagcaatttgggaggggggcttgattttagaaaataagagaatcgtgtgaaatgaaattcctcctagttttcgactctgtgcatctcttgccaattttaaacctggcattcacactggagtgacaaatttgtggaaagcaagggaagacagaaaactgctgtaaaatagcaagggaagtacttttccagccatattggcagtgctattctgtactgtcagtgtgagaaacatctgagaataaggatgcttttggcttctgctttccttttagttccaaatcctacctgaattgtaattgagagaatgtaggattttaggaatatgcacttgaattacgcatctagttctcagattaggggagatttttctgaaattaataaaatttaaaagatatgtttgctgctttccttgtgagtggtttgcc

SEQ ID NO: 100938 - DNA, 1050 bp, Homo sapiens
tttgatacttctataatataaaacgccggagtccttgtgattttgtttagagatatataatcggcattgtagtgtgtaatgatgatggacattaaggaacccttgtttcttagtgccttttggaaactggctcatttcagaagctgcgctcttttcccagaggcaacttttgaagttacttaaatatttaatttaacaaatatcatttaagatttaactgtctactatccttgaaagggtcatgagtttccctcctaaaccaagactttgaagctctctgtgctgtctcacaggaatccccatgatccaacttcatgtgacctgcagaggtctgctgccttgaggagtagacaggtagctgggctgttagtggctaagtccttttctcagaatatgtggaggctccttctacctttaacagtgcttttttgctttgtttgggaagtaacagagtagtcaagtgcatgaccctggagccagactgcctgagtttaaatcctgtttctctctttagaggtagttccttgggtgagttacttaacttgtctgtgcttcagtttccacatctgtgaaatgaagataccagtagttacctgagttttgttaccgatatcaaatgtgcttagatgagtgcttggcactgggtgctactcaagtatctgttaaatacttttatgggggatagaggacagatttaaatggtttcccatagccaacattctagctttccagaatatcagtattttgttgtggtagcggtggtcttttttcctaaagaaacagtgcttcgccagaagggagacattgttccctactggctccctacttccaccgtttctcccactcttctatataagtgccttagagaaactctggtcacccttttctgtggtctgcttagctccaacaagaatcatagaccaaaggttttgctgtcatcactttaaaaatagtgtaagttatttttttctttcctttttttaaatttttttttttttgagatggagcctcagtctatcgccaggctggagtgcagtggcgtgatctcgg

SEQ ID NO: 100939 - DNA, 2213 bp, Homo sapiens
gtttgggggttatggatgccaggttgggctccaggcactctgctctccatttgtggaggcagggacggtaacagcacctgacaagtagggatgatcacattgtattcagaagcctggtggagctctataaacccaaatttctaacagtctccaatgtaatgccctgtaatagaagctgtccttaaccctcaatcatctgtattcagctagtataaaaatgcaaatctgctcttatgcctaaacagttaggagtagaggagacttggcttcctttggaaagtcaggatgatagcttcatcccattctggtttttgtgattaattgtgacctacaaaggggtttactactctagcaggaactttgaatttcctatatacatctctttctggttagcaggcagaggaaatatcgttgacttttggcttcctggcaaatgtctcatttgccttgtcatttgttgattccttttccctgatctctgtttggtgtgataatgtacagcaaagctgaaaaccgcagggctacatgtacacttgtaggtacctatgttgtgattgccaaaaggctcagaaagccagttttctagtgaaaatggctaacattctaagaaatgctttcactgagaaagagaacgggtcaggggaaggtggaacttaaaggaagatggagtgttcctgaattcagattcctgaattagccatttatagtttcatgggaagacaatgaaaaaaaaaaaaaagaaagaaagaaaagaaaagaaaagaaacaagcaaccccaaaggtttttatcctttcaggtatccaaacatctttattctagaaagtttctcctcgatggtaaaataaagctaggaccttatagcaagtctcagactcaccatggctgtttcttaacaccagtataccttaagcagtaggtatcaatttagtggaaatataagggtattgatatgtagtggaggctgctctgaacttggaggtggaaatactaagtttaaatcccagcttttcttttaacattgcaactttgagaagtcttttaaccattgtctcctgtttgtatcagcatgaggggatagataataaaacctgcctcacaggagtgttgtgagaattgagtgaaataatgtatgtgaaaataccaagtacaatgcttgcttagaaagtagaattttgttttgccatcccctcccccactatagttggcagggcagggggaggcagtatattcatccatcaatattatagatgcaattgttcccagatgttttgcttttaggcaaaaccttgtatagatgactgtataccctcttacagttgatgcttaataaaacaaaactaccatggttttataatggaatggtaagctcaaacattttgctggtagtataaaaaccaagtgcctgtgattacctatacattaactcctgaagaatcaattataatctcagcaaccttgctctttgaccattcattctaaagcttggcgaagttaatgagaacagataataggagtgctaatgcaattggaagacttttttttttttaaacaaagtaaggaagggatacatttttaaataaaacattgcattttggtaaaaaacacagattatgagaacacattgagttagaggaacatcatattgattccaagaacaaaaagcatggtggagaaattttgtaaccatgcaaatccagtgtgctctgttctcatgagttaaaaagaattttcctcctatagaaacttgttatttaaatgtgtgtcacatgtaaataacagtctaatgagagcaatatagagggagaaatatgtaagcaagggaaagtgggcattgttttgtttttttttttctccatctatttcaatacttgggtctttcctaacctatagtgtgtcctgtttctccctggctagatttcttaaagtttctgcctattcatcactcaagtacctatctcaagttgtagctacttttgtgtgcagggtgtaatagcagatgttctcctgatctagattttgttgctctgcctaactgcatgccatcatttgtttctccctttgtgatcttctactgtagtcaagtgtccctttagaacaaacttcatgggatggacatagcctaatgagctcattgctgatgaagtctttttttcctgtgcattggttagtgcagtaagcaaggctccttaactgcctgtcccagtgtactgaa

SEQ ID NO: 100940 - DNA, 1004 bp, Homo sapiens
aatttaataagtggtggctgtggcactggtagttttaagatctctgtgaatccccacagtgtcttaagttaaccacaaccagcagtgattctgctctcagccttcctgggtgtctgtctacccacagctaggctgccaacagatgttcttccaaaaactatgtcatcttcatatatacagaggcagtgttaacaagaaaccacattttggcttataaccctgaagaaatttccctaagaattttttgctgatcattcactttaggtaaccattcctatctaaagttctttaatgggtacccctttgacatataattgacacccaaactctttactgcagctcctcccaatctggcccctgcatcttgtgtctctcttcatcttgtgcctcttctctagcttacttgtaccagtcacactagcctcctttgtttcttttccacaccagattctttcaaacttccgagctttacgtagcacctgctgttcctctatctggaacacacatgctcccttctttatccttttggcctataaccttcctcaaaaaactcagttccgtttaaatgctttcctaaatgttcttgttgatgcttgtggtagattgaaaatagaatcatatgcttcctccttttgacacttttgagttcttgtaccaaaaaattgttagcaggtaattcaagaaaagatgtcagaaattcacaggggtcttaatgatgccctcccctaagacaagaaggggttgggtgagttcttagctcttatgctacatttgaggttagccactgtcatgggcaaaatgggatcacaaatgtaaagtggacagtttgaagtaccagcagtaaagagaatgatagtgaaggggcagggagtcttaagaggataatctatcataatagaatgatgttaataatcacaattaaatgtaataggtgcttaccatgtgccaggcactcttctatatatgtatcatttcatttaatccttacaacctgaataggttgt

SEQ ID NO: 100941 - DNA, 1056 bp, Homo sapiens
gattcttcataaagaattacctggcgagtttattgcaggtgttaggtgtgactttaaatggagttttcaatctcttagcaaaggtaaaatgctgtgatgagtcaggactataatgttttaaggaattagtgttgcaagaccaagactcataaatatatggtcaatgatagtggtaagaaatttatggaatatggattattgacattttgctcaaaccagaaaaacttcccttaatttcaaggattagcattcagaagctacagcatctgacctttatttctaaatttaaaaaaattaaatatgagttttatagcatactgtgaagtgcttgttaactgcaagggaacttgatatcaaacagcacatggagtttactttcctgtctttatatttctagcacttttccacctttcccccttcaagcaaattttattattaaattggtacttgattattcaagtcaagctgccaaagggaagccatttcgatgtctaagtacatgtttttgtttgtttatttgtttttaaattgcggggggcggatatatgcactcatggggaggctaaaaggacagaactgtttgcttttatttgtataataatagctgtcagcccagtcacatgagcttactgaaacagatattctgtctttctgtttaaactgaagtttagtgttgtgatttgctgaatctcttaatttgcttaaatggtaaagaagttgctgtgggtcttcaggatacacatgttgaaataggagtcgtaaaaacagtttggagtcttgatttaaaaacactgtagggccgggcgtggtggctcacgcctgtaatcccagcactttggaaggccgaagcgggcagatcacgaggtcagtagatcgagaccatcctggctaacatggtgaaaccctgtctctgctaaaaatacaaaaacaaaattagctgggcgtggtggcgggcacctgtcgtccccaggtactcaggaggctgaggcgcgagaatggtgtgaaccctggaggtggagcttgcagtgagcggagatcacgcgactgcactccagc

SEQ ID NO: 100942 - DNA, 1078 bp, Homo sapiens
gtctcagtctcctgagtagctgggattacaggcgtatgcccccatgcctggataatttttgtatttttagtagagacgggggggtctcgccatgttggccaggctggtctcgaactcttgtcctcaagtgatccgcccaccccagcctcccaaagtgcggagattacaggtgtgaggtactctgcccagctgcaattcatttattctttttgttacctgtgttttacgtgtcatatccaataaatcactgtcaaatccaatattgtgaagcttttcccctatgttgtcttctaagagttttatatttttgctcttatatttaggtctttgatccattttgaattaatttttgtgtataatgtaaagacccagtttgattattttgccaacactattgttgaaaaaactgttctttctccattgaatggtcttaagcatcttgttgtaaatcatttgaccatatatgttgactttggttttatagtaataccattgttacaatatggtttgatacatgtaatttttatttgatgtttctgaactttgtttaaaatattggacttgttccatggctgaatgattgataataaaataataaataaaatattgtacttggaaagtaaatatgagggtagtaagttagttatctattcgagtaaaagaaacttgaggcatagccagttgcaatttgtgagcctgagttggatcctggtctataaaataaatttagataaaatagggaagtttttaatatggactgggaattagaattatactaggagattattttgttagatgtgataatagttttgtggttatgtggaagaatattatttttatagagatacttgctgaaatatttagtggtgaagtatcaaatctgcaaccaactttgaaaatggttcggccaaaataggaaatgtagcaaattattaaccttttttttttttttttttttttgagatggagtctcactctgttgcccaggctggagtgcagtggcacaatcttggctcactgcaacctctgcctcctgggttcaagcaattctcgtgcctcagcctcctgagcagctggg

SEQ ID NO: 100943 - DNA, 1009 bp, Homo sapiens
gtcacagttgcttctccctctattaggacagaattcagtaaaacagcccaaaatctcattttttttaaatttatttttatatttatttatttgagacagagtcacactctgtcacccaggctggagtgcagtggcacaatcttggctcactgcagcctccacctccaaggttcaaacgattctcatgcctcagcctcccaagtagctgaaattaacaggcacgtgccaccacacctaagttttgtatttttaatagagacagggttttaccatgttggtcaagctggtctggaactcctgacctgaagtgatccttgcaccgcctcctaaagtgctgggattacagatgtgaaccaccatgctcagccacatttttttttaaatggtgttaacagtttacatttttttcttgccattttatttcatttattttattcctaatgacttaatgttttcctttatattggaaacatgttacagttttctaaagaagttcagggaatcttttaatacacagcctatcttccccgaagtgtctttcttccaaagcagaagcttgggggttgatgggggcagctgcgccacctgttggccttttaagttaatggcgtccaaagtgggttctttctattataactgtttcaatattgtgctacagttctctacacccctgcaaagtcagattgcatatcattatgagataagatgtcttctgagttttgaaataaatggatttctggttaaattttagttttctataaagaatgtgggcagccttggtgaattattaatacctgtgtaatagtaaggtggtggaattatagttaacctcattttaagtatagccaaatgctcttagtatagcatggattggttcgaggtgatgttgtaaagttggatttttaagaaagaatggaaattggcactaagagtactgtcaaaagcatttgtttgaaaagtggattaaattcccaagtacttttctttcattgctttattaactaaatca

SEQ ID NO: 100944 - DNA, 2707 bp, Homo sapiens
tttttgtttatttgagacagtctcagtctgttgcccaggctgaagtgcagtggcgtgatcttggctcactgcaacccctgcctcctgggttcaagcgattctcatgcctcagcctcctgagtagctggagttacaggctcccaccaccacgcccggctaattttttatatttttagtagagatgggttttcgccatgttggccaggctgatctggaactcctgacctcaagtgatctgcctgcctcagcctcccaaagtgctgggattacaggcatgagccactgctcccagcccctttagacagcttttacataaacaattggatacaccaggaaccccagtcatcccttgtgctgtggatgcatcctggttccctgaaagaggcagcatcatggtacccatgttccagagcagtgtgtcgcaaactctagtgtgcatccaagtcttgttaaaaatgcaatttctgtataggattcagtaggtctaggagggggcctgggattctgcatttctaaactcccacatgatgccaatgctgctggtctgtgaaccacttgttgaatagcaaagttctagaagaaggtcttattaggcttttcatatgggaaatctgggcttgcctagtatggatatatatttttttattcatattccacccacctaactttgaagaagaaagatgcctatttcttttccccacaattcctttcttccactccctgccctatcccttcctccccttcttgaacagaggctgcttagcttagcagtggcaggagtccctctgaggatttgatttttaaaaaccattgaagaggtgtaaaggaccctgcttgctgaaaggaaaaggaagagtgactgggcctcccccaggtcatccctgtcctgagcaggcacctgggaacaattaactggcatagtctccagagaatgacccaggtaaatatatgctaaagagaaggagaatttgtacaagtagatataaatcagtatgttgtctttgttgttgttgctactatgtgtcaccagacctttatataccatgagaaggcaaaccattattaaagagaattcgctagccctgggtatttatgcttagaacatgaatactatacctcactttttggaaccacttttttctctaggtaaagtcatgaagctgagccccaaagcagaggaagtagctacgttctttgcaaaaatgctcgaccatgaatatactaccaaggaaatatttaggaaaaatttctttaaagactggagaaaggtactgtagcccatgtgttaatatcctagtaccttgcaaaacaatcaagtactaagtaataaattatcattttgcaaaacatttcctgatgtaaaatttgagttgtatggattttgttgtatttaaacttgcgtattttttgtcttcatttactatattatgtagggtttctgtccaacaagagtacttgtatatctttgctattggctctcatgtgatggcaggtaggtgggggttatcagattaggccaaacagaaaacctcaactccagttgcgcacaggaaagtttgtcgctgcaggactgccccgtgtctgctgttgcaaagagaaatgttaatctgatgtccctctcgctgttaattcttgctcatttattttaggtactttctactcttgaaaccacatatactatatttgcctaggtgattttttaaaatctcattattctcaatttggataatgtggacagaggcagcagtaaagtttacttcctgaactagctcagaaaaagcagacttaataaatgaatagaataggggtaatgtttccaagagagaatcagtatgggatttcaaacttgtattcataatgcctgggggctgtgtgccacggagtctaagaaaccacataagaattcatttttttccatgataagtcattttaaaacattttaatattagtaagtacatattttataataaagtaatacaactgtatttttttgttttttcaaaattcattaattgagattggctacttccagaaacctttgactgaaaaaatggtgcttgggtgtatttgcaaagaaacccaaggacttattagtgtattttcgttgtttttctttcatctccccattttcttttgactaggaaatgactaatgaagagaagaatattatcaccaacctaagcaaatgtgattttacccagatgagccagtatttcaaagcccagacggaagctcggaaacagatgagcaaggaagagaaactggtactacagaatttattaaacctctggagaattctggaattgtgattggttcatttaactttcttcttggttcttatgacacaacattaacatcagtaatttcacatcattctatgctaaagacttagagttctcaaagtctaaattttcttaaaggttttagttagactgaaaattgtgaacaagtactttgctcagtagctctgtacaggaatcttggtgcttcagtgacctaaaaaccagtcagtaactccagccaataatatagtaattaaggatgggcagacctgtcccacagtggctactggatattaaggatttaagacagatgaaatcatattggccatgtacctccctgctctttgatctattttactctggaatcttgtgatgctcatccatctccatcttccagccttggccatcctcattactgaaggatc

SEQ ID NO: 100945 - DNA, 1023 bp, Homo sapiens
cgtttttaagctgtttaactgctgtttaattaaatggcttgagctattcttttatgaggctctatcagagactcttctccatttcctgttttgatagtactcagtaaaacagtatgaatttttaaagtacatttaaaaacacccaaataacatttacaaacatatatcctttaagacacaagaatcagttttgaatctagttgaaatcaatccttataggcagatctttttggggaattttatgatatttaagtttgagaaaaccactagaggttttcctttatttgaatttattttttagtgatttttcagactttcctctaccttgacttagtctcccacaagagataaaatgcattagtagagaacagcaatctgaatctattttgagtactttcttgctgtcttccagaaaatcaaagaggagaatgaaaaattactgaaagaatatggattctgtattatggataaccacaaagagaggattgctaacttcaagatagagcctcctggacttttccgtggccgcggcaaccaccccaagatgggcatgctgaagagacgaatcatgcccgaggatataatcatcaactgtagcaagtgagctcgcacttcatcctatgggccaaaaagggggtggagggcgtcctttattgtacttgggaatatttcccaggttacacaggactgtttgggaagggagatacttaagagcaggacagtatttcatgcgtaggtctccagatgtttttgaggtacagttgtctcccctcatccacaggggatatgttccaagacccccagtggatgcctgcaacttcgacccaattgctgtcacttggaacacatttctgttgatgtcttccacccccaaatttaatgtcttttccatgtttattaagtacttatcacatagagtggctataacttttgcagtctgaggcacaacagcaaaactagcacgactttctttttccttcttcacaatttcacagatggaaggttaattcttaccttagatct

SEQ ID NO: 100946 - DNA, 1744 bp, Homo sapiens
gcttctgtatggcatatccaaattgccaacatcaccactttcacactttggggcctttattaagtaaaagaaggattacttgaacacaagcaatgtaaaaccattaaagtcaacctgataaataaggcagctactaggttacccatgggcaagtgacatatacagcatggtatgttgtatatatggttcacgcatcccaggtgggactacaagagatttcatcatgctcctcagaatgatgtgcaatttaaaacttacaaaatgtttatttctggaattttgtattgaatattttcggatgacagttggctgagggtaagtaaaaccatgcataaggtgggactactgtattgactgttaagaaggaaacttggaaaattatgctcagcagataggtccacttggggtcatgaaaggtgaaattattcctcacatcttatttcactatcctcgtgctctgttatttccagagatgccaaggttccttctcctcctccaggacataagtggaaagaagtccggcatgataacaaggttacttggctggtttcctggacagagaacatccaaggttccattaaatacatcatgcttaaccctagttcacgaatcaaggtaaggggatagttgagagctgcactggttcatggtgctgataacctttttttgttgaaatgtaacgttctcgtcctctagaatcactttgacaaattaaaaatcctccccattgaaagaaggcaagtactttcatagttagcattatggtgatcttcctacagtgcctccatttttttggtcacattgtaatcttatttattaattcacaaatatttactgaaatcccaaatgtgccccacacagtatacatttgatgctaggaattatgttggtaaacaagatagacgtaggccctgccttcatattgcttaacgtccagtggtcagaatgtgttgaagtatggtgattgtatattggcctctgcagatgtcttctacttcctcacctctcttggttatgagaagggaatgtagtttctgtatatcctgaaacaagttgtaaaatctaatgtcttacatacttctggcttcctgcagtctcatctgggtaggttcaccagggccaaatgaaatgtgtgtgaaagcacatcataaaactgtgttacatacctatgcactgttatttattgatagtgttattgcaaggagataactgccttgggggaaatcagtttttgtttgccagatagctatgtatatctagctttggagagtcccacgaacttcttccctccaacatactatgaaatataaacctaacagagacaaaaacacagtcaaggaattagttctatgtagactgttaactgttttatgtgcaggagacctgggactaaagaccttcttgatcctcgttcataggttataacatctgttaaaatgtgaaagccacagctgaaaaggctatgtgaataggcaagactaaactgtacattttctggcttgtagccctgtgttcttctgtatatcactacttttctaatgaaaaatacctgtttatatattttctccaattataaaatatacttttctggctgggtgtggtggctcaagcctgtaatcccagcactttgggaggccgagatgggcggatcacctgaggtcaggagttcgagaccagcctggacaacatggcgaaaccctgtctctactaaaaatacaaaaattagccaggcgtggtagtgggt

SEQ ID NO: 100947 - DNA, 1710 bp, Homo sapiens
ggcatgtgtgggcagaaatcactaccactttcctttgttgcgggtggggaaattaagagcagagattcttggattcttaaattccttctctatgtttatgtcatctagtctgttttatgctgttttatgtaattccctgcttctggatttcttgaatttttttccccttctcacttgtcataattggctcttgcttgtgagtctattttcattcagcttggtagcagaagtcttcttcactattgtttagattcagttttcacatggttttagtaacccttcattgggtttagaatcaacttttaacccttccaccaaaagctcttatttttttaaaggcttcccagaaacatagtttctctcaatctcatcaagaaatgcttttaaatgcagaagttagaaaatggtgaataattatggctgttcctggaagtcattgtgtccttagtaattacatgttgtagtctttggttctgcttctttgacagctccaccacactgtaatttaatggaattcacttagatttaatggaattcagtcctggtagaaaactgctattgggtcacagagttggcagcaaggctgtgaaattgatgtgggaatgggggtgattatgtgctttgtgttgacagaagttagtttttgggacatcccatgtgggtttttcccaggaacataaacattttagagaattagagctagaaactttcttctgggaaagccttagaagtcagttgtgcttggcagtgagatgggacaatgtgcattcttaacaggttaaatgtgccaaactctctcttcagtactattcttttttacgtttgcttaaggtcaagttcctgctcttttgttcaaagtcttgctttgtcacccatggtggagtgcagtggcgtgatcttggctcactgcaacctctgcctcctgcgttcaagcaattcttgtgtcttagcctccctattagctagctgggattataggcttgcgccaccttgcctggctatattcaaagtctgtctttactacactgtcccaaagtaatctacatttgggtttgggtctttacagggtgagaaggactggcagaaatacgagactgctcggcggctgaaaaaatgtgtggacaagatccggaaccagtatcgagaagactggaagtccaaagagatgaaagtccggcagagagctgtagccctgtacttcatcgacaaggtgagagcatcttcccatcggcattgtctagtgttgagcttaacaaagggagtttctgctctgccccaggccctgtgccacatactgtatatcacaactcaacatacatatatttgtatgtaaaactgaatcaaaagttgcacaaaacaatgcttagccttactgtgagcagtagattctgatctttttttaactctatttcattcctttagaaagttggttataacttataaaattgtttaaataaaccatgcaggtatcaccattatatagttttaaagaccacgctctagaggagatcaatttcttggtactcacgagaagaaaaaaaagttcatgtttttcccccagtcttgtattttaacataagttctgaattgtctcaaaattcacactagctttttgagtttgattgcccagagtagcagcactccctcatttgctgccttatttaattttttttttccttttctccatccctatttcagaggacagaatag

SEQ ID NO: 100948 - DNA, 1022 bp, Homo sapiens
gtgagtgggggaggaagtaacactgcagaatccagagttcccaggccatgctgactgatgctgtggcttcaaacagaattgggaggcttctgttttggatgcctagaaattgcataagggtcaaaaggctgggcgcagtggctcacgcctgtaatcccagcactttgggaggccaaggcaggtggaacacgaggtcaagagaccatcctggccaatgtggtgaaaccccatctctactaaaaatacaaaaaaaaaaaaaaaaataaaaattggcgtggtggcgggcgcctgtagtcccagctacttcggaggctgaggcaggagaatggcatgaacccgggagacggagcttgcagtgagccaaaattgcgccattgcactctagcctggcgacagagcgagactgtctcaaaaaaaaaaaaaaaaaaaacacagaacgaaattgtgtaaggatcatgtctcttccattcatgctcatcttttctttctttcctgggcagcttgctctgagagcaggcaatgaaaaggaggaaggagaaacagcggacactgtgggctgctgctcacttcgtgtggagcacatcaatctacacccagagttggatggtcaggaatatgtggtagagtttgacttcctcgggaaggactccatcagatactataacaaggtccctgttgagaaacgagtaagttaatgtacctgtactgtctgacttgttttccattattcaacaagcatgggttgactgcttttttgtgtgctttgcactttgctgggcaccagcaaaagtgacttgagacaggcaacatggcacatgcctgtagacccagctattcagaaggctgagacaggaggatcactggagaccaaaagtttgaggctgtagtgtgctgtgatcacacctgtgaatagccactgtactccagcctgggcaaaatagtgagaccttgcctctcatattaaaataaataaaaataaatgacttgaaagaggggagaggtattatttgatatcttgtgta

SEQ ID NO: 100949 - DNA, 1032 bp, Homo sapiens
ggttaaaaaggaaacaaattatattgaaatacagttatcaaaatacattttaaagtccgataatagatgtgcttccttattaaggtcttgaggtggcctgtagtaaatttcaaggtagtaattaattaatatcaatgatactttaagatttctgcagcaattcaaatatgaaatgaagatgtctaacatctattgatgataaagtcataagtgctgctgctattactatggtttgttccccatattcataactgaagaagaaatactaaatttcagctagaagctgggtgcagtggctcacacctgtaatctcagcattttgggaggttgaggtgggagaatcacttgagctgagtaattcaagaccaacctgggcaacatagtgagaccctgtctgtattaaaaatttaaaaataaatataaataagttccaaaaagaggttattgaaattatagattttttctcatccaagttcatggaattctatacttgtacaactggagtttaagaactactactgtggaatgagactgcattttaaggcccagaatattttccatttgttgagatttccttaagataagtacccatgagtaatatagctggttcaaaaggtacacacaacttataatttatgctacagatgccatctggctttcttgaagagacgtacatgtccacagtgaatgagtatacatccatagacctttgattccttggatcatatgattggcaggcaaagaactctatagacggcccatcctagcagctcacatttgctgccactctgttaaatgctggtcatctggaattgtttattctcctcatgttatcattacaagccagaaataaaagcatgaatattcaggtgctgtttacctaattcaggaaaacccctcccaggagcatgaggaggtcttttgttgctctcgctctggaaccgggtttgggcagcccaggctgcctgccagatgagccctccaaacccaggattcctctcctgtgtgcccacaaagcaaacacacgcccct

SEQ ID NO: 100950 - DNA, 1035 bp, Homo sapiens
gcctgccaatttagcattcacagaaatggttaaaagatcatggtttgctacatttctatcctaaaaagaatctggctagtggtgtctgtgatgcttttgtatatagaatcagtcccctcagtttggctttggacaacatagatgttggaagtaagccattcatagtaaaacatatttagtgatcctctcacaatggtggcctctgtttccaatcttgggctgtgtgtatctaacaacaaacaattccaggttcagtgagcagcccagtgtgtgtcagacatgttatttactccgtagaggttgtcttcacctcacatagatgaccataggtatggggttctcctgccctctgagtagcgtgagctcagtgacaggggctctagctccatgttgttatccactgctgtctctaagcaggaatctgagaagaacttagattcaccaggggtgcttcaaagattctaacaagcaagaaaggctgaaactgcccttgtctcttcccttatagatatggattccatgagagttcacatggggaaaaaagctccacagctaaaagtgttttcacatccattgagtgacaactaaggtccttcccacctcagacttctctcctttttttttgagacggagtctcgctctgttgcccaggctggagtgcaggggcatgatctcggctcactgcaagctctgcctcccgggttcatgccattctactgcctcagcctcccgagtagctgggactacaggcacccaccaccacgcctggctaattttttgtatttttagtagagacggggtttcaccgtgttagccaggatggtcttgatctcctgaccttgtgatccgccctcctcagcctccccaaagtgctgggattacaggcgtgagacaccgcgcctggtgaccgctctccttttaaaaacagaatgccaaagctaagccctgccatgtcctggtttgggacagactggctgagctgtttggcttcctgggtgtcttttaattgccagtttgtagccccttgagtactct

SEQ ID NO: 100951 - DNA, 1398 bp, Homo sapiens
ggttgcccagtagatgcaagtatcctgcttcagtttcctaaagaggagctcctacagtgttcttagaatgaaagctaagaactggcacaggatctatttgataaacagctgtcatttgtagccatcctcccagatgtatgacagcagagtgttctctgatggaaagatcagcacccagattcccagccccagcgggttcctttccctgagcccctaggttactgccctgtaaaacccttgtttctttccagatcactgaagaacaaatagttgaattcactagtccttgtgcatcttctccctgccttcatgaagccacccttgtttttttttatctgacaaaccactgacagagacagcctggtccagataacatcttggtttcaccttctcaggtggagccatttttcctctacagctcataaccttaccactattatttcccctagattgatgccaagaaggaacagctagcagatgcccggagagacctgaaaagtgctaaggctgatgccaaggtcatgaaggatgcaaagacgaagaagtatgtacctggtattgtgaaagttggggctggtagagaaaagtgtgcagcatctgtcagggcccctggggccctggcttttcgatggtttctgagaaatgtcttttggaaatctctatactagggcttttattgactcaaagtggcaggatgggtacagtgtgctcttgtctagagcccaggcctggttcttgaggactttgctattcttctagggtagtagagtcaaagaagaaggctgttcagagactggaggaacagttgatgaagctggaagttcaagccacagaccgagaggaaaataaacagattgccctgggaacctccaaactcaattatctggaccctaggatcacagtggcttggtaagtgttgagccctccttgagctcctgctgctagcttaagaaaggtggagggggttccgagagcactggtggccttcacatgccattcctaagctacacactttagtcctctggggaaacttctggcttcagctgtgtacaagttactctggttgctgaaccttgtctgtaaatgcattgcaacattctggttgctcctaaatggtcagtgctgttacactgccttgtagtgtatatttttaagaggcaggtgccatccctattcctaatggaactttaggacaggaatggaaactcttagcttctggaagaataggaaagagcccatccatctctacacttcaacaaaacttttcgttgaatttttttgcagttgaaggtaggaacaagagataaagatgagaatacagatctgagcaacttacacagagaggcagagggacctttaacaaaagcagataaatactaggtttctctgtgtgtcaca

SEQ ID NO: 100952 - DNA, 1022 bp, Homo sapiens
tctttatctcttgttcctaccttcaactgcaaaaaaattcaacgaaaagttttgttgaagtgtagagatggatgggctctttcctattcttccagaagctaagagtttccattcctgtcctaaagttccattaggaatagggatggcacctgcctcttaaaaatatacactacaaggcagtgtaacagcactgaccatttaggagcaaccagaatgttgcaatgcatttacagacaaggttcagcaaccagagtaacttgtacacagctgaagccagaagtttccccagaggactaaagtgtgtagcttaggaatggcatgtgaaggccaccagtgctctcggaaccccctccacctttcttaagctagcagcaggagctcaaggagggctcaacacttaccaagccactgtgatcctagggtccagataattgagtttggaggttcccagggcaatctgtttattttcctctcggtctgtggcttgaacttccagcttcatcaactgttcctccagtctctgaacagccttcttctttgactctactaccctagaagaatagcaaagtcctcaagaaccaggcctgggctctagacaagagcacactgtacccatcctgccactttgagtcaataaaagccctagtatagagatttccaaaagacatttctcagaaaccatcgaaaagccagggccccaggggccctgacagatgctgcacacttttctctaccagccccaactttcacaataccaggtacatacttcttcgtctttgcatccttcatgaccttggcatcagccttagcacttttcaggtctctccgggcatctgctagctgttccttcttggcatcaatctaggggaaataatagtggtaaggttatgagctgtagaggaaaaatggctccacctgagaaggtgaaaccaagatgttatctggaccaggctgtctctgtcagtggtttgtcagataaaaaaaaacaagggtggcttcatgaaggcagggagaagatgcac

SEQ ID NO: 100953 - DNA, 1826 bp, Homo sapiens
ctgttaagttctgagcataggtggagatatcctcccctatggcacttgctagtccgggctaaagtttccatctaggtcttttgtacctctttctgctcgttttgccttgtttggtgctagagatttggttagctcttaaaaggcaatatagtatagtggttaagaacatggagaaaaactgcttgggttcaaatttcaggtcacttaccagctagctgtgtgagaaaatcagtaaattacctaacgtctctgcctcagtttcatctgtacgtttttcacttgtacatctgcagaagcacctactttagagatcactgccaagattaaatgagttgatcacataaaacctttagaacatgcttggtgcactattaatttgcatcctcactagacagatgtgaaagagaagatggaacatctgaccctgggcctcagatatgggccattgctgagtcaccctaatcccccccttatttctcctttgtttgcaggtgcaagaagtggggtgtcccaattgagaagatttacaacaaaacccagcgggagaagtttgcctgggccattgacatggctgatgaagactatgagttttagccagtctcaagaggcagagttctgtgaagaggaacagtgtggtttgggaaagatggataaactgagcctcacttgccctcgtgcctgggggagagaggcagcaagtcttaacaaaccaacatctttgcgaaaagataaacctggagatattataagggagagctgagccagttgtcctatggacaacttatttaaaaatatttcagatatcaaaattctagctgtatgatttgttttgaattttgtttttattttcaagagggcaagtggatgggaatttgtcagcgttctaccaggcaaattcactgtttcactgaaatgtttggattctcttagctactgtatgcaaagtccgattatattggtgcgtttttacagttagggttttgcaataacttctatattttaatagaaataaattcctaaactcccttccctctctcccatttcaggaatttaaaattaagtagaacaaaaaacccagcgcacctgttagagtcgtcactctctattgtcatggggatcaattttcattaaacttgaagcagtcgtggctttggcagtgttttggttcagacacctgttcacagaaaaagcatgatgggaaaatatttcctgacttgagtgttcctttttaaatgtgaatttttatttctttttaattattttaaaatatttaaacctttttcttgatcttaaagatcgtgtagattggggttggggagggatgaagggcgagtgaatctaaggataatgaaataatcagtgactgaaaccattttcccatcatcctttgttctgagcattcgctgtaccctttaagatatccatctttttctttttaaccctaatctttcacttgaaagattttattgtataaaaagtttcacaggtcaataaacttagaggaaaatgagtatttggtccaaaaaaaggaaaaataatcaagattttagggcttttattttttcttttgtaattgtgtaaaaaatggaaaaaaacataaaaagcagaattttaatgtgaagacattttttgctataatcattagttttagaggcattgttagtttagtgtgtgtgcagagtccatttcccacatctttcctcaagtatcttctatttttatcatgaattcccttttaatcaactgtaggttatttaaaataaattcctacaacttaatggaaacttaagtgtctgcctctttgttacaaagggcctcaggccaga

SEQ ID NO: 100954 - DNA, 1043 bp, Homo sapiens
ccagtttcatctctcacaagtgatccttcactctccattctccagccacaaggcctttttctggttatggaatataattcatactctttgtctttctgaagccattcttgaaactcacccctgcaatctatctacccttgtcagcaccgccaaaattgaggacacccacggtcgcggtggagcctgtctgacatgttgagccaggcagtgggtcggctgccaggcacagcaggacaacttactgcatttcagaggtgagaagcccaacagagcttccagctgatgccagagaaagagccaggcttcctgggaattgtgagatagtaggactagactagagtttgtaagagcgtgtgctcaggcaacccactcagctggatagtgacctggggctgctgcttctgactttgtcttgctgtagtggaaacttgtgtgttaacgttgatttcctcaagtgcgtcccctaagaagctcagaattcagcatgacattgagaccctttgtcctagccagcctctgtggagtaaggagcggtggggtagctgagatggactgccacctagtggcaggtctttacgtgggcgggacggagctagcgtagaccctgtgctgaaggtgtgcacctgtggtcacacctgatcctcataattatcttctaatcaggaatgatggtccacaatttactgatgaggaaacagagattcagagaagttctacaatttgccccaaagccacataacatgactaggtgggaactagaacccaagtcggcctgactccatgagttttctgcctcacaggagatccactggcttaggtaagtcctggtggtcagtagtcagtgggcatggaggctatctggttaatcagcatgggtgaggggaggcatgctcaccgctggccttgggcacagggaatccagcagaacgtgagtgctcacagagtgtggcttgaactggcttaggcttgaagttctgtggaccctgctcttctctgtgttgggcattgacaacatgaggagcacaagagagacacagcgccag

SEQ ID NO: 100955 - DNA, 1001 bp, Homo sapiens
acccgagcggaagaccttccaggtcaagctggagacgcgccagatcacgtggagccggggcgccgacaagatcgagggggccagtaagtgcgcccacttcctgcctgggcccgccccgcgcgggggtcgtgggagcccggcccgactgcttgcaccccggccggccgccccagcgacttgggcaaactttcgggccctcccagactccctccgggccccgcccccgcttcgtctcgggtggtcactgggggcggggggcatccgggtcctcggtcacctgacaggacaccccccctcccccagctggggggagtgttccaggcgctttgccctgaggcctaaaaatcctcgcgggctggagacctgcggtgcaggcatcgggccccccagaccctgggagtggtggcggcgtcggcgaggggagctaaggcagtggcccccaccctgcacgggaacctggggcctgaccagacggtccccgcccactctttatccagaaagagcagtctgtgaaactctccgggcccccaggctgggctcttatttgcaaaggaatctttgggttccctaagtagaacttaggcagatgttgggtagggctggtcttggagcagagctgggcctactcatctccctctgggggagagggaggaaggtggtcttgtttggtttggagaagcctgagagaagccagtggctggaatttttttttttttttttctgctacttttgtcccaaagctgggttttggaggcctatgtgggtgggcagacactcaatgccagggcagggactccccttgccctgggaagcacgttcccaggagatgggccccataaaggcctgccccagcgccttggagtcaggtattcttctcaggagtgcagctagtttgtgagtctagccctttgtcctctgtccggtggcttcagggagcgggagcggcttctcttagtttcctgccttttcgccttcccaggcctgagcttggctgcttttgc

SEQ ID NO: 100956 - DNA, 1050 bp, Homo sapiens
caggaagtgacaccccaagggggggtcccacaaaccttcttgggtatggtgtgcatgtgtgtagatagttgaggagattgggaggaaggaaggtcttgtggtgaggcagccaaccatcctcagctacaaactccagatctgacacagatctaatgcagctgctcaacttagaaatggcagcccccttcctcagtgcccccactgaccctgtcagccattgggagaacattttagtgacttgagagcctgtggattccaaagtaaaggaagaatcgacactgcaaagagctgagataaccctgggaacatcactcaggcatcaggctccaggcatggtccccttccttactccctatgctgtgttgagttggtggcactggctggaagttctcagagatctcctgggtaacagactgcattttaaaccacgcatattagcaggcaataaatgtagcacagtggttgatggcaagtctggatttgaagcccatatattcattgtgtgtttcccggccagttacttaccttctctgagccttgatttcctcatgtgtaaaatgggggtaataatatatccagtatatatggttgctccaggatcaaatgagacaattcatataaaacatctagcattgtctgacacataaatgtttaataaatatgagctgttattagcaataacattaacaatagaccgtggctgcccttcaagaccctgaactgggaatggtgagggggtgaggtgtggctataggtgaggatgaaggtgcaggaagggaggaggacggtgaccaaattcacatttcacttagattgctactcagaaaaaggcaggaaacagttttgttttgccccaacccatgtgcccactcacccacccaccatgtagaacagtgtttctgtagagaaagtgtttgcagttgtgcacatttgactcctgggtgtgacctttcttgtttgtaagttggggcctgaacagaaaagaggggtgcagagaggggatgatttatcatgcctcatgtatttgggggatggaggcaggcatacaga

SEQ ID NO: 100957 - DNA, 2051 bp, Homo sapiens
cagtaaacactggtgtagacactgtggaggtactctgaatactggctgagcatgtccatggggacttctgaggccccaggcttctgtctttggctgatccttcactagatacttttctagatgccaggccctctgaggtgaaggagtatgggtgcttgcttttagggaaatgaaaacaggcaatgacaattgtgagcagtacctttgatgaagagggtgagggtggcggaagaaaacagctaactgccttgatgaggcaggcgggctcagaagggaggtagtagtggaaccagctggctggggcttgacccctgtggctggggagcagaccacaccaggaggcctgctccgagggctaggcccacagcacgggagagggcaaggcccaggccggtgtcatcaagggttttctttgtactggctgttactcccagtgggagaggggcaggagcacatgtccggatctccagagctagccatccctgcctgtgtatttcctgtctgatgtagttttttccaagggaagtcagaccttttagtgtttcctcagcaccccaggcttgccccgatgtgtgggtttccaggcccccccgcccagctgggatcctctgtttcctgtgaacctaggaaaagggcctgcttcacagataactggaggagctgagcacacccagtcctgggacccacaacacctccagcttctctccagactcttgtgtgtgtgtgtacacagatgcacaggattcagttggagtttagagatcttggctaccagctttgctctgggtagcttcttggaatgaggcacatttattaatatttgcaataagtattattatacctccccatttgcccagtgctaggcaccaaggattcaaaagtttattgagacatggtttgtgccattgatgaactcttggaaaagacagatgtagaggcatatgattataaccctgtgtgttacataccataatataaaggcctctaccaagaactgtgaggagctctgccaggaaggcattaaaggagaggtgacctttgaggtaggccttgaattactgaggcacctgtctgtgccgaggctaaggaactgggaatcactctgtgcaggggtagggaacagatatggtgtggtagagaggaagctgggactggttggagacagctatagccctagtgtgccatgtccagcagattacactcagtcctggaggcgacgggagtcagcggaggctgttgtgggactgacttgcctctgcctgggagaccacagtggcagtggtttgtcaggcaggtgttggggagggaggccagtgagctcctacggtttgcacagtttgcaggagagagctgctgagggcccagacaagaccttcttgctgaggcagggtggggatgccatggtggtagatgggagaagggctgggtcttgaggggtgagacagagcttagtagttaagcatttgggccctagactctgcttgaattaaaatcctgttgtgcagcttacttgctctgtgaccttaaagcatatgactacctctctgggctgcttatctgtaaaaaggatagtattaaatggcatttattttataaggtttttgtgaggatttgatgagaacctgtataaagtgcttagcacctgtataaagtgcttagcatggagtgtggcacagtgtaagtgcttactacgtaggatccctgacaggacagagatgaggattaagttctcaggaggacctggtggggaggagttcgaatgcacctgctgtcctaaggggctggtgcctggccaccaagccctttgattcagaggcaaggaggcccgcccatcctctcttgcagctctcagcagtccctctattgtcagggctctttcccactgctggttttgcagggagacagggcagttggctggaagcagctgctttgggtggtaaccccttctgtagagtgaaggtatgatattgtcctatttctaagtgcctagcccaggacgctatctggagagatcttgtctttgaggaagtgctctaatgccacagcctcga

SEQ ID NO: 100958 - DNA, 1679 bp, Homo sapiens
ctgtatattaataataagggagattatatataagagtaagagattttatgtgaaaactacccagcacaacatttgtcacttagtggccacttaacagtattcatttcctttactctcacctttgttaaccacagagctccaatcttttccaccactaagctcggccacaagtggctgctccaacaacctgggctaggagtctgtttcctacttgctttctgtgttccttccctgagtctgtacacagaggactggggcatcaaaaaactctggaattggaatagcatattgggagttcatggaacattttctcacctgttgtattgtttgaacttcacagcagctccatgaatccatggagggcaggagttactatccctctcttacagaggagaaaaccaagccctaagggtaaggtcacatagcaagttcatggcagatcctaggatttcagattcctgctatagtattcagtttattctcccattctggggaaaatgataataggatggaccgttctataggaacagagggttattttgttttgttttgtttttcttccctctggccacatgtgtttgaccagcctagacttccatctgtggacaagctggactcattgcctcaatttcaaaacccgtcctgcactcatccttgccacaacaccggtgtcgagatgcttggcccacccagacctttcccacactcctacatgggggtgaatgtagccgctgattgggggtgggacacagaagagcctcaccctcttgactttctggtttgtggtgacacttccgcctaagcttctacagaacatgggaacctggggctccatgccccaaatatcctgagaagggcttttccaggattctctatgacaactcaagagcatgcattcattcatgtgctctttaatttgtcatacatttgttgtgggccttgctactgtgtgttgggcacactgagctggatgtgattactccagcctctgacttgttcatggtggcagtagatctctagcgtggtttgtgttccatctcaccatacctactctccttaaaaaaaaacaaaaaactagctttcttgggcctcagtggctcattgaataagtgagagacgacttgtgcttccctggctttagactctggcatttgctaactgtgccaagcactgtggagaccagtagtggacataaggttagggtagatacagccagaaaggagataaataggcagacagataaaattcttataggatttggtgagttctatgaaggaaataaggcaagaggctgctctgtcagggtaggtgagggtgtgctgtgataacaaatgatgcccacatatcaatggctggcaacaaggaaggttaatttcccctgtttgctatgtgtgctaacctacaccaccgtccctggagagtggcctcagtggttctgggtgaggcctctagtacagaacctgaacaccctgggcaaactaggctggagagggatttggagtatggaggtttagaaggaattaatttctatgacttaggatgcatgtggtgagtgtggctttgctgttgtggtagagtagagtgctgcctgtgtgggtcaagagactgtcttggctgacatctttgaaataggtatatttgtgtggcccttgcctaattgtcatctctgccatagctgc

SEQ ID NO: 100959 - DNA, 1837 bp, Homo sapiens
atgagatccctggcaccttggagtgagatcagagtctagatcactcactggggccctgtttcccaggaagcaaaaagggaacaggagagtggcttggcttgggctggcatggcgcaaagggagtgcagccagatgctgtggcggctgggtcaagtagctctaaaacaggagagcctagtgggttctgctgaagcaggatgtctcagcaagcaggcctctgacctgacgacttccggtcattatttagaacgtctccagccccacagatttactctgttggaggcttaaggactaaaccaacatttactgtccaagaggtggcagtaacacagaaaccaaagaggcaggaaccaaggttggggtggtgagatgtcatggggttcagggagtggcagaggggaaggcctctattctccctttcccacttgtctccctacctcagcccctgttgctctgacgcttcccccaccactatgagtcctaggcccctgttgtttccttgtaggagggagaccccagatttttatttcttctcccaacccattccatttcctctcccttgtgagagggctctgcagagacagggcagcagagagagacttggagatatgctgggctgtggtcaggagggcctcatttatctagtgagcaggaacaggttatatagcagtgatgctttcatagtatttttcttgaataaggtccccaaaaccttattaagttcctggtaggcatggagcattgaagatggcagacatggtgcagtctctcaaggagtttacgctctagtggagaaaacaatcagacagccttaaaatacatgtatggctactataataaatactgtgaagcaggagtgcaccacgaaacctggagtcctctccatcctccccttctgtctgtgctggccctgcttggccacttccaacaaggattctgaggcattacagagcacacgtctagggtacaggcagtcttggctttgaagtattgttggctttgccactcaccaactgccaccttaggtaagttaattaacctctttgtgctcaatttcctcactcgggaattggggaccctaatacttacttcatagtgttatttgcaagtataaaatataaggcagtttttatcgttgtaaggcagtcttatcaagagctttatgcaatgtctatgcaaagtaaatatgcaagaaattagtgttaggatgccagatgctgctgttgctcatcgtctcttcccacccagcagaggtagtaactacttcatcctctacttctcagcttcttatagtatttgtctgtggactctaacgtaagctatctagcataatactcatatctaatttttccttccacattcaagctccttgaggtacttgtattccaagtatctagtttaatgtctctcatgtaggtgctcagaacgtatggttaattttgaataataaagccagtgggacttctcagagggctggattgggggctggtgagagaaaaggagatgcgaaggatcattctgaagtttggagtttgggtacctgtttgaatggtgatgctcttagctgacccagggggtatggcaagaggccttggttctggtgagagagagaagacagtgtttggttttgaggagttgtctttgagacgttttgagatgaagagtggggatagcaagtaggcagctgaattgaaggatctgaagcttaagaggagaggactaggctagagacctgtttgtgaattatctgtacataggaggtaattaagggtgtgggcatggctgacactgatgaggaagaaggcagagcaccggaagagaggaccttgacctgagc

SEQ ID NO: 100960 - DNA, 1358 bp, Homo sapiens
gggcatccctgagacatggccctggtgggtccccagtctctctcctgtagctaggagcctggcatacacaggccatctagaaagaacttaggcagcatcagtctgcaagggaggcagagtttggagcacactagactcctgacacagaggctgacccatggctgcctggagaatcttctgggcttgtgcagaaaagttggggaaagccacctttccctactgtggcagtcaaggcttggtataggccatcttccctcccttctcatccatgatactctgaatgccctgtttgtggaacttagtggactcctgcacctctgtcttggtttccatgaacccctctgcccaatgtgtgcttgtcagccctccagacctggcttttacagagcactccaagacattgctctacacacactcagctccacagacacctccctgttgttctactcgttgcatgacctcatagttatctgcttccccatctgtttcctccatcaggcaggggttttctcaaaggcaggaactcaaatgccttattgatctctgtttccctaggacccagcccagggcctgacatggagtagatagatgcccgataaatgtttgatcagatgatggaatgaatgactgcataagccgaatagatcactgctgagtgctcttccagctttaatttctctgggtgggacctcctttcccttccttcctttggattctgttcttacctctgaaataggtgagattaatttagagtcctagggaagagggctgcctgcctggatggtacaaaggctggctgtggctgctctgtgtttctctgtatacccagtgtcagggatagcagctgctgtggggacactgcagagtgtcccagttctgccatgactcaccatatgaccatgacaagaccctttggaccctctgtttcctcattgtttcaaagagatttgtctagaatctagaccaagcttgtccaactcgctgcccgcgggtctggtttgaaggcagctgctgcacagtaatgggaaggacagtaagccccaccatcgccttccctttgccatataaccctgtgacctcagaagtccctgaacccagatccttgtttgtaaaatggaaagggatagctacccacccctccactttgaccttcctttggtggcagccagatgtgctcagggaaacctcagatttgtgagtatgtttctactgagaggcaggaggaggaatattatagtctcaggaagagggaggaatgagagggagaggagaactctcaccctttccacaggctttgggcatatgcagccagcttggaaatgctgaccatcctgtgacctggctactattgcatcagg

SEQ ID NO: 100961 - DNA, 1212 bp, Homo sapiens
ccgagattgcaccactgcactccagcctgggcaacagagcgagacacccagacccagagaaatatttcagtgaaagcatgtttcatgttcagaaatttggggtacttttggttatggttttcttggccatatcttcatcatttggtgggtttagttttcaatatgtcctcctgtccctttctgattaaatcacttctgtatctcttacctcattggcatctcactgtagtccaatgaaggaggtgccaggagtggtgattctattttgcagatgaagaaaatgaggctcagagagatgggtccaggcctcctgcccaccttgccagtgcttttgttcataatacctctctacaccctttttgcctgctgagcggttaacaggcttataaatttgggggacctctgtctgttgggctatttggaagtggcttttttgagcacaggggatactaggacacaggttccaacaagaaacttaggtctaatttagggtcttggatttgatgattgggctccctctcccccttctagggcctgccatgtgtctgccccctagggcaggattggctggctctcactggctgtgctctgaggagccctgcctttgctcttctctttctcttccctagggttcctgctgtccttgaactctgccggggcaacaggaatactgcccttatgcacatcctcgtggtggccagacagggtggttatcccactttactggacaggaagagagctagtggcaggcctgtgacttggcctgatgtctcgggggagtcggggtgggagcaagagtcaaagacaggaagcagccctaccttcagaagagccaggcacacagatgggtcctttgtggttattgtcttctccctttcccaggttccagactggctgcccgccatatagcttgtcccttcgacagcaccctctctccccactcagtggattgggtgctgtcccagggtgggggcttactctcctgcagaggcaggttctcagctggccctgagggttgtatagcttcacagctcccagagtgcttgggcatagggtggctcagatgaggaaacaggctcctcttttaaagggaaagcaactgccattactggcatgtccaaaagggggatgctgtccaggactgcatggcccagaagctccgctctgagtaactgctggtctctaatctctgtggtctcaggccaggagtct

SEQ ID NO: 100962 - DNA, 3308 bp, Homo sapiens
caggaagatgaagggtgaggttgggaggtagcacaggatgtggctttcaagaacctagtagagcatctcactgtgctgccagggccaggctggtgccttcttacggaagacagtacaagggatcaggtgtggccaacaggaacttgggagcattggatgcctggcgtggagctgcgctatgcttacctggttcctatctcaggcacctgttctgccttcaactgatctcaatggaaatatgtgcaggagtgcaggcctgttgactctgtgtgtgtgtgtgtgtgtgtgtgtgtgtgtgtgtgtacagtcacactcacctttgcaagaaggtgtgggagggggatgacagcagctccacaccggaagagcagactggtttctgtttcaaaaggcagagtttgtggttgttctgcagtttctgatctagccatttcccctgatggaagctcctccttctgtcattggaagccctgtgttctcggttaggtcttttatggcccagttctccctgcccctgtttctacccgagtataactgttcatttttgttccccatccctatttggttttccctccttctgcctgtgtacctgcctttttcatttcttcagtcattaagcaagccctggaggggccctgcctggccttaggtatgtgagcatgtatgtacgtgtttgtatgcacgaggcatcaagtgtattagtaccacaggaaggagcttctcagttgggcccttggtggaagagaagggagccggggaggtggacatttccagactaggaatcaagatgaaatagggatgggaagcaacagctattcttgccctaggtgtggcttagtgtggatggagcagagagggtgagagggcaaaagctggggaggtaaattcctgagccctgtcacaaagagccttcaaggccatagaaggtgtttgttgtttgttctccttagactggcagtgggcagcctcgggaggggcttgaatgaggtctaggggggtcagaataatgttttatgaagagccagaagactggggaaggatggctgatgggtgagaaccaggggtcagggaaaacagcagaaaaggcaggactctcagctggaggacaggctggaggggtttgctgaggggacaggtggttccaggtagaaccagaaatgtgtcggggagctagggttagggccagaagcaatgcccactgttccaggtgggatagatgtggagttttgtgacagttgctagagggacaggacaggaagagagcatctgggggagttgggccgttaggacattccaggcaggttggtgtgcagttcgggctggaagggctcctggggtgggggctggccaggcaaatgctggcactgcatctggctccgaagttaccaggccagtctgggtttagaggattttaagaggcttcagagcttggggagtactcaaagaaagtcatagctgttggctaagccaagcttttttcctttgacctaatctaccttaaatcggtgatttctgggctggaatgtctgccctccagccagcaggcagcccctccctgtgctggagagtgtgtcagagcctgtgcacctttgctgagggagcagaggagtccattggatgggccccctccatgtcccacatatagtgctgggtgtttctagctgttacgacttttgatcttaccaacatctttctgatgctattgtgttactcttatgttactctcttcacaggtgtagcagtgaggtcagagtggctgtcactttattgagatcacatagctaatgtgaggtagagctaggattttagttcagccagtctcacccagagctcgtgcatgttttttctaccaccctgccttctagagaaactcagtcaagccctttgctttacacatggtaaaactgagactctgagaagttaaataaattattcatcattgcctcaagttttagtggctgagggcaggtcatctgctattcaagcccgtgtacctctctgactatgccttgtgaaggccacgggagcatgcaagggccttggatagctaagataaggaaatggtcccaggcaaaatggtggtctgggtccaggatggttgctgctcttggacagccagtgccttggtcaggggatggggtggggattaggccccttgctgagacttgtgtggggatggctttagcagttaggcatttcagggatgcaccagtcctctgggccagagcctactttctcccagggatcctgaggcccatcttgacctacccagccctgcctctgggactttatgatttgatttgtgtgtaccttgtgtcaggaagtggtcctcatgaacagccttgggtccctatttcttcttctggagtctagctcttttgcaggtcaaaatgtctcagtgagggaacaaagatagggaagggacaccccacagaaccacctttcccccatatagccctctctgacatctcagcccttacttagcaaaggcctatccctagactcaacccagccctcttattaccagagtgactgagtggtcttggctctgcctctggggttcctccctgagagagagtgtaagaatgaggaaaccaggctgccctcctttcggtgttgactctgggagaccccagcttgatcttggcctctttgctaccttcctagttgacattcgtgaaattaaggagatccgcccagggaagacctcacgggactttgatcgctatcaagaggacccagctttccggccggaccagtcacattgctttgtcattctctatggaatggaatttcgcctgaaaacgctgagcctgcaaggtgggagttaagggggtagaggaggtagaggatagttaggggaatgcctgctggctcctgcccagtgggaggtatgtgccctcggggcagctattgataccttgctcacagccacatctgaggatgaagtgaacatgtggatcaagggcttaacttggctgatggaggatacattgcaggcacccacacccctgcagattgagaggtaagaaccactcctgaaggggttagggctgggagcattagggaccagggggacagggacagcagacctttgtgtgcccagacatctcccaggcctgactgtagatggagaagtggccctcacctcaggcttctctctccaggtggctccggaagcagttttactcagtggatcggaatcgtgaggatcggtaagtactgagctgtggctgtagcccagcagggtggggatgggcatccagaaccttagccaggcctctaagtagctgcccggagagccagag

SEQ ID NO: 100963 - DNA, 2260 bp, Homo sapiens
agctggatgagaccactggggatgtccctgttttctcagtatatcagccaaggacctgaagaacatgctgtcccaggtcaactaccgggtccccaacatgcgcttcctccgagagcggctgacggtaagtgccacccagggctgtctgtagatgggggcaggggaagccaagagcccttcagctgggggcctgactgcctgactggcactcctgctctataccatgcaggacctggagcagcgcagcggggacatcacctacgggcagtttgctcagctgtaccgcagcctcatgtacagcgcccagaagacggtgcatgagccacctgccctccctcaacccctgcccctgctcttccaccccacaccccagctctgcctgcctcagccctgctgccctgcttaggggcttttgggtgccatttctccagttcttctcctcttgaggcctgcccccatctgctgctctagcctgccttcttactagcccatttcccacatggcctcccaggggtcttgccctgaccaggttctgtttcctgcagatggacctccccttcttggaagccagtactctgaggtttggtttggagtggggaggtggggttttccctgggcccccttcatctctccactgggcgattcttgatccaggtgggaggcagtgggagtagggaaccatgctggaccattctgggaagctgtgctggctgggagttgggttctgccttccgtggggcaccttgttgtctgttgaccatactagctagcttaccttctctccctgcagggctggggagcggccggagctttgccgagtgtcccttcctgagttccagcagttccttcttgactaccagggggtatggctgggctgacattggcccaggctggtaggttgtggggggctgggctcatccctgactggaggcttctctcatcccctgccctccctaccccatcaggagctgtgggctgttgatcgcctccaggtgcaggagttcatgctcagcttcctccgagaccccttacgagagatcgaggagccatacttcttcctggatgaggtgagcccgatgtttcacccattttttgtcaagagaatgagtaggggtgaccaggaccccacccgggctccaggagctagacgctccttagggatgccaccttgtttctacctactgtgcaccttgcccacccccagttgggacagagcactctctctcctacccccaacctaccatcttgggttggacagggcagggactcactgtctcttcccttccacatgtttctggacagtttgtcaccttcctgttctccaaagagaacagtgtgtggaactcgcagctggatgcagtatgcccggacaccatgaacaaccctctttcccactactggatctcctcctcgcacaacacgtgagtgtggctccttcaggcccacccagcttcttccccaggagggcccatctgaccatacctacctgcctctccttgcctatccaggtacctgaccggggaccagttctccagtgagtcctccttggaagcctatgctcgctgcctgcggatgggctgtcgctgcattgagtgtgcgtggggtccagggctgggggagggaagatgggaggcctgcccgcttgaccatggtgatgttgctccccagtggactgctgggacggcccggatgggatgccagttatttaccatgggcacacccttaccaccaagatcaagttctcagatgtcctgcacaccatcaaggagcatgcctttgtggcctcagagtgagtcggaggctggatgacccaggggttaacttggctccaggtctctcgttctagagggacagagggcagaaagactcctcaaatgccctgtcccctctccctcagcctttcatctttgtccttcctcttggcctctcctcgtcacctgctccctgcttgagctgttgcttcccaagttacactttctgtttcctacgtgttgggcccactctcttcttcatgggtcctttagactgtagaacacatgctcttctcatcttcagaaaacatgccctggtttctttaggccagtgtcctgccaactcctttgccctcacagcccagaagattgtctctgttccctgtgtcccattccttcaattctgtttactgcttaaactgtggtcactggtctcccttagctcaccagggctctaacagctaactttggaggcttctcctctctcctggcctctttggtgtgaaaca

SEQ ID NO: 100964 - DNA, 1037 bp, Homo sapiens
gaaacatggcccaatacttcaagaaggtgctgggggacacactcctcaccaagcccgtggagatctctgccgacgggctcccctcacccaaccagcttaagaggaagatcctcatcaaggtggggtggcgggcttattgcggaagccccacacttctcagtgccttgcccaggccatggcttcagctgttgggcctaaacctgggtgaggaggtggggtgaggactggggtctgcattgccctgttctggttgcccctacagcacaagaagctggctgagggcagtgcctacgaggaggtgcctacatccatgatgtactctgagaacgacatcagcaactctatcaagaatggcatcctctacctggaggaccctgtgaaccacgtgaggactgggccaggctgggggtggtaggccagtgggtgtgaggaccctggctcacaagtccctctttggtctgttccaggaatggtatccccactactttgttctgaccagcagcaagatctactactctgaggagaccagcagtgaccagggcaacgaggatgaggaggagcccaaggaggtgaggaaccagctcaggtctgggggctgggccaggtcaggcctgggccagggtcacagtatctttgctgttgccttcccctgacaggtcagcagcagcacagagctgcactccaatgagaagtggttccatgggaagctaggggcagggcgtgacgggcgtcacatcgctgagcgcctgcttactgagtactgcatcgagaccggagcccctgacggctccttcctcgtgcgagagagtgagaccttcgtgggcgactacacgctctctttctggtaacacttcccatgcagatgcgtatgttcagtcagcgtgtgtacacagacatcacatcacccagagataatcagttaacatttgagcctttgatccaggacaataattaggctttacatggaacataatttcacctacatacacacacacactctctgtctcaccccccccccatacccctcccttttcggt

SEQ ID NO: 100965 - DNA, 1661 bp, Homo sapiens
ccactcccggcaagatgctgggacccccaagttcttcttgacagacaacctcgtctttgactccctctatgacctcatcacgcactaccagcaggtgcccctgcgctgtaatgagtttgagatgcgactttcagagcctgtcccacagaccaacgcccacgagagcaaagagtgagggaagggcctgggggcggacaaggcagggcagggccatgggtggtgctggccgggcctgactctgcctgttctcaggtggtaccacgcgagcctgaccagagcacaggctgagcacatgctaatgcgcgtccctcgtgatggggccttcctggtgcggaagcggaatgaacccaactcatatgccatctctttccggtgaggggtgtggcactgggttgtggggccttgcttgggtctgagctgccctgaccctgtgtgactgttttgtccttgtgaagggctgagggcaagatcaagcattgccgtgtccagcaagagggccagacagtgatgctagggaactcggagttcgacagccttgttgacctcatcagctactatgagaaacacccgctataccgcaagatgaagctgcgctatcccatcaacgaggaggcactggagaagattggcacagctgtgagggggctgtggtagacggggcatggcaggggaggcaggagagacccagaatcttaccagtctctggatgtgtgtaacagcaagacctggtgtgttgtagaagttcgtgggagggcccctgactccagctgggagccacagtgtgggtaccaggagggtgtctgcaggaggggacatctgagcagcatctttaaggatggggacaggcacataagcagagggttcctcatgagtcaagatgtggagtgaggaggttctggggctcacactgggagaggtgcacacagtggaaactcatccacctgggcttggcctggactctgtcctagggcagatgagatgaggctacccaagagtggttgtggagcctccgcctggtggatggtatggagggcagagccacaggaggtgagaccagtgagggaaaaagtcaggacccatggcagcacagctggtgataagggccctggacagaaggaaggggtctaggaccagaagatcagttgagagactgctgtcgtcagtagacagggctggctggggagagagaggcctgttgtccactggcacctgggactcaagtgatggagaggagcggcaggaggaatgtggggagtgggaaggcttttcctgactttgggctcagcagtgaaccaacaagccactgaactaaagcactgaatatgggtagtctgtgaagggcccacctgcacatagctcagaaatacttgggagtttgggcatttaggacctgagagattttagaatcctgggctgggccttacatgtaagaatgtgaagaaaggaaagggaacagtgaggccgggcctgaggcctctgaagccgtctctactgaggtcgaaggatccctgtggatcaggtgcaagtttgctgcactgggggaaagggaagctgctccagaaaccagtagctgctttctacctctgggctctggggcattaacatatcccattgtgtcctgtttccaggagcctgactacggggccctgtatgagggacgc

SEQ ID NO: 100966 - DNA, 1635 bp, Homo sapiens
aaatacaaaaattagccgggcatgttggccggcacctgtaatcccagctactcgggaggctgaggcaggagaatcgcttgaacccgtgaggtggagattgcagtgagccgagatcacgccactgaactccagcctgggcgacagagcaagactctgtctcaaaaaaaaaaaaaaaaaaaaaaagccactgaaagaaagtcctccaggagaggatgggttggggtgcttgtaagtgggcttctgtagagatttggcatggagatttgccatgaagagtgggtggttatatttgagttgggggcgctgaggcagtgaggatcatccttaggacacagatggaaaccaagccaggggcctgtatccccagtgcagtcacaggtaacacagaagaatcatttttaccccagcatgaggctgggtaataaatggtcagaaagtgtcatttgggagtgtggccaattccaggatccctggaaggtcactgggaacatgggtggtgatgaggagtctgtatcccccaccccccctaagagggttggagggcaaatgtgtcctctgggacagaaaagaggaaagatgatttcaggatgaggctgaggacagagctccctcatttactgttgggtgtggtgtctggaaggtacaggggaaggtgggagaggggcccagagcacctgcagtgtgggcatgcccaaggttggcaggggcttccttctcctgggcagggctgtagcctggggctacagggccttgtgtgtgtcaccagctcactgaagggaagataatggaacggaggaagaagattgccctggagctctctgaacttgtcgtctactgccggcctgttccctttgatgaagagagtaagggccagggcccaggcggggtgtgcatgtgcctggagggcctggtgggtgcaaaaagagtatttaggtatccccccaacacttcctgggtgggcgggctctgtaagtgttttccctgtttggcccagagattggcacagaacgtgcttgctaccgggacatgtcatccttcccggaaaccaaggctgagaaatacgtgaacaaggccaaaggcaagaagttccttcagtacaatcgactgcagctctcccgcatctaccccaagggccagcgactggattcctccaactacgatcctttgcccatgtggatctgtggcagtcagcttgtggccctcaacttccagacccctggtgaggaagtcccctgtgaggagggtgaggaggggcactgtggggcagctggactggaatacaccataatctgcctcttccagacaagcctatgcagatgaaccaggccctcttcatgacgggcaggcactgtggctacgtgctgcagccaagcaccatgcgggatgaggccttcgacccctttgacaagagcagcctccgcgggctggagccatgtgccatctctattgaggtgggtgctgctcatctgggcttcagggtaggaaaggggctgcttgccgttggagtctgtttatgttgagttctccaaaagtaggtattttcaggcatcaaggtggtcagggtgggtggggcctgagctgagtctttgaaggggtgaagatagcatgcagtcactgtatgcatctaggacgtgc

SEQ ID NO: 100967 - DNA, 1455 bp, Homo sapiens
tttcctggctcaggctactttcccagtaaaaggcctgaagacaggtgaggaccattcctggaggcagtgcccctgcaatcttgctggcagggtggggctgggccccttgctctgtccctcgtgggctgagggccaggcttttcctcctcctaggatacagagcagtgcctttgaagaacaactacagtgaggacctggagttggcctccctgctgatcaagattgacattttccctgccaaggtatctgcagcaggggtgggctggcctggggtaggtgggaggagagccaggcagcagcctctagaagtgcagaggagtcattgaccctcttgtgcacctggcttcgttgaagcaggagaatggtgacctcagtcccttcagtggtacgtccctgcgggagcggggctcagatgcctcaggccagctgtttcatggccgagcccgggaaggctcctttgaatcccgctaccagcagccgtttgaggacttccgcatctcccaggagcatctcgcagaccattttgacagtcgagaacgaaggtgaggaagatggaggggtgctagagccaggaaggcagtggctaggtcctccttcttcagtgtttctttctcctgggtagaaaagttgtaatattgtctggcattgggctgcaaggccctgcctgccagtaaggacactcttcccttctgtccagggccccaagaaggactcgggtcaatggagacaaccgcctctagttgtaccccagcctcgttggagagcagcaggtgctgtgcgccttgtagaatgccgcgaactgggttctttggaagcagccccctgtggcggccttccgggtctcgcagcctgaagcctggattccagcagtgaatgctagacagaaaccaagccattaatgagatgttattactgttttgggcctccatgccccagctctggatgaaggcaaaaactgtactgtgtttcgcattaagcacacacatctggccctgacttctggagatggatccttccatcttgtggggccaggaccatggccgaagccccttggagagagaggctgcctcagccagtggcacaggagactccaaggagctactgacattcctaagagtggaggaggaggaggagccttgctgggccagggaaacaaagtttacattgtcctgtagctttaaaaccacagctgggcagggtgagaagctagatgcccctgcagtttggccctggagccagggcagaggaatgtagggcctgcatggagaagggttctgccctgcctgaggaggaggacacagcacaagggcacattgcccatggctgggaacatgacccagcctgaaagatacaggggatcatgttaaaaatagcagtattatttttcgtctcaatggtattgtaactaagttatttactcctcctgctcctcacccctgtagggaaaccttggag

SEQ ID NO: 100968 - DNA, 2625 bp, Homo sapiens
aagaacatgattttggtttcaaaagcaagacctctcctggaaggcagaaggggccaccgccatgcttgtccttggagccacatgagcacggtgccctgccaggtccagttccctgggtaggggagaaggacggtccctaaaacaccaccagtgcttcttgcccaaagcccttgccctctctctggggtcttctagcactgtcactctgcccagcccaggaggtgtctgtgcccacgaagcctggtacttgtggcttggcactctgggaagcaggtggtttctaagaaatgagcggagctacaggtggacaggtctttagttcgcccctctttaccagctactctcagagcaaccggtcttggggaaattgaggatttaccatttagaacagctctgtaagcaagttttctaattttcaaaggcaccatttcctgtaattttctcaattcaaaaaaggacatgagggttaggctaaagtagagttcttgtttccaagtttggggacataaatataaaactttaaaagcatcctcacaaggaccagtgatgcccagcacccttgggcatgcatccagcacaccggccagaccctggggtgggagccacgggcactctgggtgttctgccagggatctctgcatgcaagtctttgtgctaaagaccaccctacctctgataattccaagaagtcaacaaatccctccagccttcacccttactaatgggccagtgtgttattccttcccaaaccataggaggctctgaaatgagtgtggagaaagggctctgaaaaccgcagtggtcaaagcttcaggctgtggctatagatttccacttacgtccctaccccatgtcttttttccatctttctctcactccaaacatgtctagattaaaaaaaaaatgcaggcacataggtcagcacattaggcttaacaacaaatgtttctttagttgatctgataactgaaaagttatggtccatgattcaaactcccatgaaaaagcagaattacggtaacaactaaagagaatggtaaagcatccaacgctaatcacattgccagtccattttttgaactgagggttacagcaggttctgcactgagtagcccacaaggcaaagcaagcctgacatgaaacgtagccggtcatcacttaatgcagcagagatctcttcaaaggtactgcttccttgaggaacacaaagggggcacaaaggggttccagacgtagctttgtgcctataacttccctgcctgactgtggaaggtgaggggcacctgtgacccagcaatccccagagaacagacacaggtcatttttagagatgacgtaactgacaatgcactgcttggctaaccaaagtttctacgtaatgacagtgttgataatctgatgttttatttaacatatagaggtggatgtatatgttaaaagcttgattctgtgtctatgaatatgactatgaactctgaactattttatccattggaaggtaaaggaaaggtcctacattgtgggaggaagaactgatgagaaccccatcttgcttgctgcttgcttggtggtgggcaggccgagggtagcggcaggctctgggctgtctgcgaggattctggaagctctcccaggtgcccagcagccgggcatgggaacggcatgtggcagcagagagtcgggtttggctcttccacgtggcaggcggtttcccagactggccagtccttcacattaatcagatcaaattcagtctgtttctgagaagaaaacacatgcctgtcactctacggcagctgccaccacctgccccccaggcagcctggtccttgctataccagggtggcatcactggctttgaggacctcttaattccatgagcaatgaatggccttctgccacccactcccccaccctccagcctgagggaatgtgggttaaggacaggatgctggctcaaccttgtaaggccatcagactctctgagagaccctgctaaaccctaggcctagcagcaggagcagtggtttggcctctccaggcccactaaatccccctagctccccaggcttccgccaccaccgtctctggagtcctgtcctaaaatgcttcatcctgccctctccttccaggctctccagaacatactgttccaatataatagcagctgggtctagttctgatatgtattctactgatgtcttcacttcatttgtaacttgcaaccctaacatcaaagtcaaagtaaggctgatatcagagaggttcatcatctgtgattcataaagaaatggtccttaattgcagctggctgagaaagccatgagaaaccaggtacagataaacagattggcccttcctgtacccacagttacctgtctcagacagaagagaacaatgccaatggcaatggccaccccctgccattcctgctctgtcccacaaaggacagcaacatgtcactttgtgttggatttagtagctgaggggagccaatgcttgtcattcaaatccactcatcacatttccatgttgactttaagaaaaaaaccatggtaaaatataaataacataaaattcaccattacgacaattttaagtgtacaattcagtagcattaagtac

SEQ ID NO: 100969 - DNA, 1090 bp, Homo sapiens
tctggatttctctttcatttttgaagaatagttttgccatatacagaaatcttggtttagaggttttttttttttctttttttcacgactttagatatgtcatctcactgcctttgggcttccaagatttttgatgaggaatcggctgttaatcttgtcaaaaattctgtgtgacgagttgcttctctcttgctgctttcaaaatcctgtcttcaggttttgacaatcctaatataacatgtcttggtgtggatctgagttcatcctgcttggattttattgagctttttggatgtgtagattcatgtctttcatcagatttgggaaattttctatcattatttctttaaatattctttctgtcccttttctttttctgcgattcctatatgagtatatgagtatgaatatactaatgaatataataactatatgaatatatgagtacattagtatgcttgatgatgtctcacagctctctcaggttttttttcctaaatattttttttctttcttctcctttggataatttcaattattttctcttcaaattcactgttctcttcttttgcatgcccaaatctttgttgaatccctctagtgggttttccatttcagggattatactttttagctctagaatttgtttggttcctttttataatttctatctctttattgatattctcattttgttcatgcatggttttcctgatttcctttagttcttcgtccatgttttcctttagctcgctgaacatacttaagatagttgatttaatgtctttgggtaataattccaatgtctggacttcctcaaggatggtgcctgtcaattttttttcctgtgaatggaccatggttttctatttctttttatgttttgtaattttttgttgagaactggacattatgagtattacattgtggtaactgagaatctaattctgtcatgcctcagagattgctgatttttgcttattgagggctggagccaactatttgtgacttttccaactatttttgtgaagtgtgtattctttgcagtatggggtcagtgaagtttctgttgtgatatctctgtggttaa

SEQ ID NO: 100970 - DNA, 1232 bp, Homo sapiens
cactccaaggcgtgacacaaatgtaaacttgggggtctgtgtggtcaggctgcaggagcttcttgtggaggagctggagcagacctttgtgcaagccactgcctttctttgccagcaccagccatgaactacgtggggcagctggcggagacggtgtttgggacggtgaaggagctgtaccggggcctgaacccagccacactgagcggcggcattgacgtgctggtggtgaagcaggtggacggctcgttccggtgctcacccttccacgtgcgttttggcaagctgggcgtcctgcggtcgcgggagaaggtggtgagtgctcaggctggctgaggtggctactgcagagtgggctttttaagctggggcagccactacagtcccaggacaggacctggggcctcccttaggtggggatctgtcctctggacaggcttcccttcatttgtactttctttgaaggtttttgggttgatttgggggttttggtctgggagggttcacagttagtttctcatggaaacagaccagtagggctcatcccagtgctggggccgtcagacctggctcagcttactaagaccttacctgtgtgttcttggtaagtcacttcatgcctctgagcccagttacttcacctgcacaaatggatatgattttatcggcctaatgatgctggtgggacaagtcaatagcaactgataatactgtctcagggccagctatgtgggaaacactcaaatgttagtttctctctcttaataaatccacttcaggctgggcatggtggctcacgcctataatcccagcactttgggaggccgacgctggtggatcacctgaggtcaggagtttgagaccagcctggcccacatggtgaaacccagtctctaccaaaaatagaaaaattagccgggtgtggtggtgggcacctgtaatcccagccactccggaggctgaggcaggagaatcgcttgaatccaggaggcagagattgcagtgagccaagattgtgccattgcactctagcctgggcgacaagagcgaaactccgtctcaaaaaataaataaataaataaaaataaataaataaatccattccaccttcacagggctcaggcaagcacagcagagatttttgttagcagcaaggtctagggtgtgaatcaagattcacactgaggcaactgtgacgtttccaggatcctaatagaaaagtgtagcctatg

SEQ ID NO: 100971 - DNA, 1078 bp, Homo sapiens
ggggtgagtgagaccccctattggggctctgcagggggagcctgggaaagatggccctgggtgcaggtgggtggcagggaggagccagcaccctgtctccagctgtgggtttttttttttgtcattcctcaagcaccaagcacttctttttttgttgtttttgtttgtttttgagacagagtctggctctgtcacccaggctggagtgcagtggtacgatcttggctcactgcaacctccacctcccgggttcaagcgattttcctgcctcagcctcctgagtagctgggattacaggtgcccgccaccacacctggctacttttgtatttttagtgagacagggtttcaccctgttggtcaggctggtcttgaacttctgacctcaggtgatctgcccaccttggcatcccagagtgttgggattacaggcgtgagccaccgcaagcacttctataccttttctttctcctgagaaatggccccattttacagatgggaaaaatgaggcctagagacacatttcctggccaacaaccaggaaatggcagagctgacacaggtcctcaggctcctgccccagacaaggggatccctattaaggaggggcagggcctctcgcagcccaaataagccagctgactttgtttcttttccacatctgaagtgacccagctgcctaaggctgggtggagagtagctaaggatggcctgactgaaaccaaagcaggtggggttgggaataagcccagagatacactttaggtatttcaggtaaatatctccaaggcagacactgagggctggcaaccctgggtctcggcaccctctgctgtcacttggctgggtggagactgccagcctgcacccctgtgtctgccaccactccaaatgggttgcacctagagggagggatcactgataccctgggtaggccctggcatggcggggacaggtccagcctcctcttggcatctcccgggagtgaaggccctttggctggaggagatggcctgagagccagtgtggtccacagggagaagacagaagtcctgagcagtgatgacgatgccccagac

SEQ ID NO: 100972 - DNA, 1027 bp, Homo sapiens
ttttgtataaaaatgaatcacatagtggaatataagattcatgtctacttttgagataaaatgcttccaagaagcccttggctttgggcatgcttcttgagggccagcctccaaacccgagggcatactttcactttggaggaaacactggagttgccctgtccccctcccctcttcacactgagtcttttttgtttgtctgtttttgtttttgtttttttgagacaaaatctccctctgtcacccaggctggagtgcagtggtgtgatcacagctcactgtagcctcgaactcctgggctcaagcgatcctcctgcctcgagagtgactgtcctgttccccactgagatgtccagctggctctcagaagcaggacactaggagaggctcaagagtccaggtcgatgcagtgctgtggccagactgaagcagctttgccacgtcaccctggtctcatctaccatcaggcccctgctggctgtgtgtgcctgttccccctcaggatgacaacctggcctcacctttctctgtccccagcgccttggggctctttgaaaatcctcagggactcccaaagcctgcatagggcaggagagctgggccgaggaaggtccacgctgcacagggcaggcaaggactcagcactgctgggtgtttagactctttcctggctcagaccaagaaaactctaaactctgtagacacagctcccaacccccacccactccccactccagctctgacccaggcttttccattcacagatcccagactttccagaccggcaaagagcccggaggcacaaggcaccgtgagtgccttgggcaggggttgggggcggggcggtggattgtatgaggctgaggaaagccccagccgcagccccttgggcctccccaggtagaagacacccctaccctcaccccagtcccttgtcaaatttccccgtcaagaagcagcacatacgtatataaggatactcctagtgttggtgtgcatctgagagagagggaaggagggagggagg

SEQ ID NO: 100973 - DNA, 1209 bp, Homo sapiens
aagtcaacattattttctcttcttcctcagcttctccatgtttaggaactgagaaagaaactgcctaagcagcacttccccatgtcctttcaccttcatgttaacgtcccttctgatggtctcactcttcacaggtagttcacactctgagacttgaagtaagctcatggttcagtactctgggggcgcagggctgcgcaggacccttggaaatgttgcaagtgttactagtaccagtttcactttttgttgtcacaatttactgtattttttactttttctgttacagttttgctaatttatcagaaggtccaaaagtctgacataactatttcattttgcattatttatttatgatgcttttttcattgtcttttatacatttgggattataaattatgtaaatgttaaaatgagcatctcaaagaagtctgttaaatcatgactgaaaaaaatcaatcagatgtatcttcaaaaagtggagtcccagttttatgaatcagagatataaaccagaaattctataactgatcatagaagaagaatccagtaattgaacaaatcctatttaatgacatccttgtagcatagatggtctataatgctgaccacagatttcttagaaatgctgctctctctatttaactaacattttgttcagttttgcctccagtggaagcagaaagggttttttcagctgttaaatcctaaaaatcaatataatttatttatgtaagaaaaataactcaatcaatatatttttgaaccttttaagtactaattttctttttatcaagtagaaaaaaaaatgtatttgccctaaatccttaaaatacaaatgctataaaaattcctgtatcttgaaagccttactgcaaatgagtattatagacatccagcagagtctggttttctttgttgtcgttgtgttgttgttgttttgtatggaaaagctgctttccccgggttccacttataacctccggtaggtcacagggttcaatgtggatctgacttaaaaacccaccagcatgctcaatcccttgttatccttatggaatctgtatgttaactctctgggtgttcaggcttctatttgactgctgttgtgaccctgtttgcaaaatgaatatgacactctgtggattatttgctctgtaaggcacaagtgcttcttatgattattttgacgtttccaagagcaaaagc

SEQ ID NO: 100974 - DNA, 2101 bp, Homo sapiens
tgagggagaagcctgtcaggtacagtcaggccagagagctgcacaagtaggcgggaggtgctccttgtactgggaacccttcgtgcagctggagacaggccaggccagtgcagagccctggtcatcaccctcagctgaccacctgccatcctgttgccttcagcattttgtgtttctttgtttttccaggggtttcttccagaaaacaagttcaatcacactctggctgagcctattcttcgagatacgggcccccgcaggagggggaggcggcctcggagcgaactcctgaaggctccttccattgtggcagactctccctctggaatggggccactgttcatgaatggactgattgctgggatggacctggtaggacttcagaacatgagaaatatgccaggcatccccctcaccgggctggtggggtttccagctggctttgccacgatgccaacaggtgaagaggtcaaaagtaccctgagcatgctgcccatgatgctgccaggcatggctgctgtgccccagatgtttggtgttgggggactcctcagtccacccatggcaaccacctgcacttccactgctccggcgtctctatcaagcacaacgaaaagtggtacggcagtgactgaaaagactgcggaagacaagccgagtagccatgatgtgaaaacagacactttagctgaggacaagcctggtccaggtccattttctgatcagtctgaacctgcaataactactagtagtcctgtggcttttaacccatttctcatcccaggagtatctcctggactcatttacccatccatgttcctctcccctggtatgggcatggctctgccagccatgcagcaggccagacactcggaaatagtaggtctggagagccagaagaggaagaagaagaagacaaagggggacaaccccaactcccacccagagcctgctcccagctgtgaaagggagcccagcggtgatgagaactgtgccgaacccagtgcccctttgcccgcagagagagaacatggggcacaggctggggagggggcactcaaagactccaacaacgacaccaattagaacttttttcatttaagaaattattgtgacttgtaagtttcttatcccataaaggtttgttacttccctcacttcacctccataagaacctgtgtttccataagtaagattacgtacctgatttcctgtctgagaactatggtaacagatgttaatagttgcagggtctcaccacttcattagataagtgttgtctacctagtctaggaggcacagaattctcattctgttatccagttcattccagcaatcatagttaatacagtacttggtgacacgccctacccccttctcttccaagtttcccactcacttgaggaggaaaaatggcaaaagaaagctgtctagggttttaccattgaagggtggaagaacagagacaaagaggagctctttttctgtgagctgggttgcacaggaagaatgtcacagggaaccaaaaagcacagaaaaaggaagtgctggtgcatatttttgagttaaaatatttccctattttatcatgattactaagtgagtagtatagacagaagtatataactaatggttgaaaatacatatattcatttctttataaaaaacaaaaaccttaccggtagtaatataatttcccccttggtggtttttcagacacctgcagcaagaagaaatactgactgactaggcattattttctatacatccctctcaccagtgaaaagattcctcttgctgcgagaaagctttacccaccatgagttattgctgtcgacgggggtggggcaaggacccgcgctccgtagagctacacgctgcttcacaagcacacggctagcgctctgctctcacctggttcgcttacagatttctctagccattaatttgcctctctgtgtttaaagagcaccaggaccgaatggattttcacttcaggctttccttcaccaagaataaggttctttctggagcctgcaagaagacagttgcccaacactttgacacttgctagtaggtcctttgatcaagagtgtctgag

SEQ ID NO: 100975 - DNA, 2834 bp, Homo sapiens
tggtggttgggggaccatctgtccttagttttatgtacattccatttgcggtggttgggggacggtctgtccttagttttatggttattctgctttaggacattcccttcaagtcatcgtactgtctttgtcctaagtccctcagactagacatttttaggagaggactcgagcacagatgtcttttttggtttttctcttctcacttgctcatctaccccaccactgtctttgtcctgggtgcgcctaactaataagatatgtaggtagagagcgcacaggaagaggagaacacattcacagatgtgcaccctccagagacaggcgaaaccagccaggcaagtagcagtgacaagagaatgcaaggaaatgatcaagaggaaaaggccagggattaacagggccctggcagcctggtgaatcggctcaggtgttctagtctggagggcgggggtgcccacacagcctgttttccagattactgtaggaacactggtgcttcaggagagaaagcctaggtgaagccaggtggctatttcctttagtttaacctggccagctcctgtgcagacaaccattgacgagaacaatagcaaaaccagttgaaaagcatcagcctcatcagaagaatctgggatagcatgttttgtaatattggtctccgttttcatcctagaatttttcagacaaaccaaagcagaggaggccacgctgtaaagaacctggaaaattagatgtcagctccctgagcggggaagagagagttcctgccatccccaaggagccaggactgagggtaaggaagaaggccacgtgagtgtggggccaggaggagcatcctggttgagccgtgccttacatacttgagagaaagccccagctgggaaggggttcgctgggagacatctttcaagaggactagaagccagcacaggaagttgattagcagcaagaaatggtgctgtggcatttttgagcgctctgtgactcccagtggtcatttgttttcaacccttacctccagaattgtttgttaaaccattgccaaaacttgggtttgtgttttgtttctcctatttgtagagttatgaggggaaagaaattttaacctttgtcagtgaacaaaactcattattggaagttttcatttcctaatttaggtttttttggctaccatttaagacatttcttcctggtccagcctcactggcaatgaaaaacagctgcctctaagcactacccttttcctattatagcatcatgacactggaagggacttcaaagacttctgcagaatacttctagtataacgaatccgagttaattatagtttacagattagtacaaatttggactacaaaagtcataacctctagagggcagtaacaacatttcaacttgaaaatgtgttgagtttgggcagattatacataaatgtgcttttagcctcctaaaagcactttctgcccaaatagggagctcctgaagatgctcatggggacttttgcctttcccaggttgttccataaactcaagctttcctgaatgccttctcttaagtactctgccagctacatctttcctggagtaggaattcccttctcggtgggattgcttgaatgtgatttctttttatagctccaaaagaccgcccaccctagtcatttcctcctctcgcagaaagagtttggcatttaatgttctcagggaacttgttcaagagtgtcacctggatgaccgctggtctagtagctccaccagtggccgttgctcatctccatctgctaccacagcccctttgggggagacttgggccctagacagtttgtcacgttggagaagctgcccttttttcccctcttgctttagtctcagaaaatgtcccttctacccttttcttaggactcttccctcactttcttccacttgcgtgagcagtacgagctagttcacctttgtttgtgtcccctctgtctttcctcaccccttcacgctgcctcccaccttctccttttgtctcggcacacggtgtctcagatacgccatcaagggaagatctccggttcttgctttgttgtagtctctgagctcttgctttagagatgtctcaggaagagccatgtggttcccccttggcttgcttgtttctttccccgtgtctaacagtttccctcatgttccttggaaattagtgttcatccctccctacagatgctgaccctttgccagaaaacccatttctaagctgttcttgcaagccagcctcttcccagagatgtgttagcctcttttattaaataaacacactccctgcctcggaggcccttttcctgcagtaaggcaagaagaagacctcgggcagctcagccttccgaacaggggcacccgtgtatctcctgcagctcctcttgggacagggccttctagggtgcactgtaccctttttctttgccatagaaccttagtccattccgactaccataacagaatactgggaggcttataagcaacagaaatttatttctcacagttctggagacccaaatgtccaaggtcaaggcactgacagattgggtatctggtgaggccccataccacatcatccagactggtgtcttctcactgtgccctcgcatggaggaagggacagccagctctcataaggtcactaattccattcataagggctcgacccctatgacctaatcaccgtcctaaaccccccgcatcctattaccatcaccttggggcacaggatatcagcatagtaatttgaaacatttatagcggaaaccctacccctctttttagaaatagatttaaatctcacaagg

SEQ ID NO: 100976 - DNA, 1099 bp, Homo sapiens
tagcagctttagcagcacctggaaacctgttaaaaaagcagattctcaggctctacctcagacccactgaagtagaatctgcattttaacaagctgttcaggtttgaggaggcctgagttagaagaactcctaaaaagatgattggaaacaatatgaggcctagggaaatcaggcctggagaaagagctagcattcagccacttgtgtgacattcagacctctcttgctgtttgtgtgttcacaggagagcttcttagctccagtattcacaaaggatgaacaaaagcacaggcgtccctatgagtttgaggtggagagggatgcaaaggctcggggcctggagcagttctctgccacccacgggcacacccctatcatcctcaatggctggcatggggagtcagctatggacctctcctgctcatcagaggggtccccaggagccacatcccctttcccagtgagcgccagcacccctaagattggggctatcagttcacttcagggagcccttggcatggacttgtctgggattctgcaagctggcctgatccatcctgtgactggacagattgtcaatggaagcctcagaagagatgatgcagccacgaggaggcggagagggaggcggaaacatgttgaaggagggatggacctcatctttttgaaggagcagacacttcaggcgggaatcttggtgggtattgaggtcattagattaaaaacatttacctttctacactgagaaacaaacccttcttcctcagacgcaaaataatttgtggatcttttatctctatttcggttgtcctgctttattttctctcattataagatgccctccatcttctgtagaactagatagttactaactcattaatggcgcttaatctgcttacagcctggagaaatgagccaggaggtcttgccatttcaaataggaacaaccccgctcctccagggtttcagaagagccactgttgacggcacggcagagcaagatggcagggttgagtgtgcagcggcttttctccggggtagtgaggctctccaagactggggtatgggagaaagaacaggagtcagggctacctgaat

SEQ ID NO: 100977 - DNA, 1033 bp, Homo sapiens
cctgtaagtggatctttgaagatccattcacgttgacacattgatgataaactttcaccattactgaagcttgaaagaataagttacatgtccatttctttccatgagtgaagtaattgaaatgttctgagtttcttggcatctttttttacatgaatcaggtctgtcttacctttgttgtaagcttcatgactttcatcctttctcatattaatcaccgtcttgccgtgttacatttcatagactgtcccttcaaagatctcaaagtgttagaatgttcagctttcccttgaccactacactaagtgagaagcctctttgtggttagtcatctctttcactcttggatacacaagaaaaatttcctttctcttttcttgtgttgggatatggatgcaaatgctcactagaagacttgccttgggagccccagagcaggatttgcttttatggcttaactgatacggttctcctggaaatagaagatatcataattaatattccatttaaaatagcacagaatgagctaatttaaaaagcaaaaggaaaagaggatatcctaatctctcagatcactagtatctcactactatagttaagtgcctgattaattttttaacctcttcccagattatccagggaagtactctgaagaggagagcaagagctcaacatcgggcatcacaggagacattggggatgagctacaggaggctcgagctcccactattgctcagctgctacaggagaaaactctctattccttctctgagtggccaaaggtaccccagagcttgcgtttcccaccctacccccaaaccattcccagctttgaattgctttttttaacccttttagaaatagttctgaacaagaaactcagaaatgtttaatacctttaaaagatattagttatgtagcatttgaacattaaagatacatgcgcttaactaattcgactgtaagatgaaggtgtcaaattgtcctcttatttatagtacgatggctttaatttgtattgtccagactatga

SEQ ID NO: 100978 - DNA, 1056 bp, Homo sapiens
gaggggtgtagacagacacattgtccctttctggagcactgattttatgttaaagagggaaagagaggagctaagctaagtccctcaagttatctagcctttttttttttttttttttttttttttttttttttttgagacagagtcttgctctgtcacccaggctggagtgcagtggcgcaatctcagctcactgcaacctgtgcctcctgggttcaacatcccaagctgggattacaggtgtgtgccaccacgtctgactgatttttgtatttttagtacagagtttcaccatgttggccaggctggtcttgaacttctggcttcaagcaatccacttgcctcagcctcccaaagtgctgggattacagacgtgagccactgcacccagcctcaggttatctagctttttatttttaaactcctcgtcttggttttagttattcagaactcttgggaagagtctgaacccaaattaaaatttacatactagctaagataaaaaccgagaagccaaattgaaagtagcttgatagagttgtaaccccagccaacccagaaggagccagtctacaactatgcctgatcctcctcatggcaggccacgaagcattgctgccatgtgttgaattataaaacccacattgctttttgaaccctgttgcgggtaaaaataaccaaattatcagtccttggaaacccaggcaatcaagtgagtacaaggtaaagataagtatggtttagaggagaaattatgttcctgaactggtgtcctttgatggcagcgtcagccttgctaagtcagagtagagggagcagtgaccttaataagctttggtgagcatcatgtgcacgcgtgggtgggagtccctttcactgatgcttttaaaagtgcttttgcagaccctggaagggatcctccacacatatgaggtgtgggacaggtaggccagagaggattagccctgctttcgagactagaaatctacagtcctgaaggagcagtaattaattggtacacctgtcagggccagcccccaggtctcctggcttttt

SEQ ID NO: 100979 - DNA, 2708 bp, Homo sapiens
tggcctcaagtgatcctcctagcctctgcctctcaaagtgctgggattacaggtgtgaactactactatactatgcctggcctagtacatgcttatttaaaggaaactaatactgttttcagaactggaatttttatgctcttctttcacaccctttgggtctgtccttgtttcataaaagccttccattctttttcagtttcctattttggcaagggctcacacacctgaaactgccatgctgaggagccagggagctaaactccaagaccaaagatgcaggggctcaggtgggcggggagtgtctgaggtcaccttcagtgataggctttatttccctttctctccaggtcccccagataccaccatctacgttgaacccatcactgaggaacgtgctgcaagaactctgtaccgcattgaactgttacggaaagtccgagagcaagtgctcaagtgccctcagctgcatgaacgcctccagctgtgcaggcccagcctctacctcccagtctggtgggagtgtgggaagcatgatcgagacctgctcatcggcactgccaaacatgggctgaaccgcactgactgttacatcatgaacgacccccagctgtccttcctggatgcctatagaaactatgcccagcataaaagatctggcacccaggcaccaggaaatctctgttgcctttaccagaccaactccaagttatatgaatctcttacatattctcaaatgagtaggacttcagagtcccttgaaaatgaacctgaaaatctagtgagagtagaaagcagagatgatcatctcagcctgcctgatgtgacatgtgaaaactttatttctaaagttcaggatgtcatttccatcaaccatgatgaaagtctgctgcctgagtccttagagagcatgatgtatggtaagaaggtgctcagccaagaaccaagctcttttcaggagagcccaagtaccaatactgaatctagaaaagatgttattaccatctcaataagcaaagatgggaactgccagtctggtggccctgaggcagaaatagcttctggccctacttttatgggtagcttagaagcaggaggagtagctcaagcaaacatcaaaaatggaaaacatttgttgatgtctatttcaaaggaaggggagctctgctgcagtgaggcaggacagagacctgaaaacattggccagctggaagccaagtgtttagcttccccttccttgaatccaggaaatgaaagtgggtttgtagatatgtgcagtcttagtgtctgtgactccaaaagaaacctgtcatcagatcagcaattaattgatttattggaaaacaaaagcttagaaagtaaattgattttgagtcagaaccacagtgatgaggaggaagaagaggaggaaaacgaggaggaaaacttagccatggcagtaggcatgggggaaaggccagaggtattgcatctcacggagcccactactaacatctcaagggaaaagaaccaaggcttccaagatgaaaccaagaaaggaagcttagaggtggcaaaccagactcctgggctacagagggctttccccgctccagcagcctgtcagtgccactgcaaacacatggagaggtggatgcatggcctcgagaatgatgaatttgaaatcgagaaacccaaggcttatatcccagatctgttcaaaagtaaaaccaatactatcgccatggagggtgaacccactgctattccatcacagccgtttaaagtgaagcatgagcttttaaaagaaccttggaaagaaagtgcagaggggcaaaacgttttccccacatatcctcttgaaggaagtgagctcaaatcagaagacatggattttgagaataaagatgattatgatagagacggaaactgccatagtcaaggtacagtatgtaggatcttgtggcattttggataaactagttcacacacgacggggggttgggttttaggggagagagtgcttcatatttttacagcttctgaaacagacctgcctaccctcaccaaaggtcataggccttggactgaaaattcgagtagcttagtaactgtggtcatgttgtagaaaattgaagatcatagacaatcatagcagtttggctgcctcactcatataatttgggcaggggcttgtgtgttttcattcaatagatgctatgtatggtgttaaggggaaatagtttgttcttcccctagataaggtgcttcaaactggctaaagtagaacagccttgggatgttaggaacttgcactttaatataggggcagttaatttttcaggaactgaacaaaaatacaaataaatttgatctttgttaaggtgagcaaaaaagccatttattcatgtcattgtcaaaactgtgtggcttaaggtcagtgcatttgatttagattcctttcagtaactcaacagaaataaaaagtttacaacaatgaagaaaatagatctgatcctatagggaaatcttatataagggtttaagctagaaggaatttcaaaatgttaagaatctaggtgaccctgagattctatgggctttgcaagaatagacatacagtgatcagggatcctgaggaacaacagcaacaaaatgattgttagctgtagttttaatttttttcagatccaagaaggcctattagggtgaacaaaaaaccaaaaaca

SEQ ID NO: 100980 - DNA, 1140 bp, Homo sapiens
ggtctggaacatcccttcaggattctctgcttctatattgccatacgggtaaaaaaaaataaggctagatatttaagcatatatagtattttaaaaatcttcatcatctacaggcagaagttaactaggtgattcctaaaattgatgaatcaagagatagcaagtgtatacctggtttagaaatagggaggtaaataccagaagaaagagctgaaagatttggaagtgattacctctttgggagttggataataggctgttttcattataagcccttcagcccagtttaacttaaataaaaataataaaagagacaaaccagctctgcctcctttcttgactttatgggctctcatagtaggctctcaataagcagttattggctttaaaaaaagaagaaagagctcactcttcctttctgattaaatctcaaggtggactaggagagaacaagcagacttctatagaacagtgtcttcctttggtgttgtttacgatcaagaaaagaaaacctttgactggacacagttccgcatcatttcccgtttggacaagaagtcggatgagagcctggaacagtatttttatagttttgtggccatgtgccggaatgtctgtcgtctacccacatggaaagatggcggtgagaaaactatcagtatattgtcagatgatacaaggaaagaacattctgattttcaaattgcagaattactttaggtatacctataaaaactagagtctacatgaggaatttaggtaaagatgagtggcttttagaaattcatgaacttctaattgggtccacctcataaaataaaatctctctcccaaaatgatgtaacttcagtgaaagttgaaattcagcttaaaacatcacagaaatattggaagactgccaaccactttctccaaagtataagggtttttttaaagtcatggttttttttaagtcatgttcagatttatcctactctgaactttgcaccttccttagattaagtcttaataactttaagtatttcctcacatgtcgacttgtaactatagaaagtaagtggctgtcatttaaatatcccctgatgcaatagagaacccttttgaaaaatgtcttcatggttggcacttgcaacagcttcc

SEQ ID NO: 100981 - DNA, 3357 bp, Homo sapiens
gagagcagtggatcatgggactccaaaccacgtgtgtcctcaagatggagaaattgcacattgtaaccaatcagtttgctgtgttgttgacattcttgtcagcactctggggcccttctctgtgagatgattcatacctctttgaagatgaacatttctttcaagttaatcatgtaagcagaaattgaggtagcacacattagactacatagttcagatgcagggcctctgcatgctcaggactgtcactgctacagcacctcacacacactcacattaaacggattattaactaaaagtctgacatctttttcacttgagctactaacaaactaggtcttcttcattctgtcatttctagagagaggaagtaccttcaagagaggacaggaacagaaaaacactatgaatgctcaaagctttccttacttgaaagttttgcctaaaactattcatgtttactaactgtaccaacagaaactactaggtggactggaagggaagctagcatttgctgtatgcctgcctcacaccaagctgggagcctgttgtcatggacttggggtatgatgatgcccatgtcagccaccactacatggcacgaaggaacatggtagctctggggcctgccacctgtgttgtgtagactgtagagcatttctcagctggaagtactacacttatacatttcagcattcaaaggatcttcacagatactgtggggatatttaaaaagtcctctctggcaggaaattatataaggcatagtaggttgtttttttaactgcctaaatagtagtataagataaaatggtatatttaactgccacttcaaaatggtacagtagatcagccctgggttttcactcttcattaacattagataacaggagacaattctggcccaggcaaaggaggttagctagtgttccccacttctgttataaatatgttttcactctccaagacaaattttcatctaagactctcttgtccttttttagacagcttgttagttgaaagtgttggctctcaaatcagattacctgtatttgaatcccagctctgccacttgccagctgtgtgaccttgggcaagttactgaacatttctagggcttgttttctgcatctgtaaaatgagcatagtaatggtttctatctcatgagacagtgctgataactaagtgagatgagccatgtaaaaggttttgtgcaatgcttaacacgtagttctccgtaatattagctgttaacgctgttctgcgtaagagagaaattcattcagaaaatgggctcctgttctttgcgtcgtatcaggggcccaaaagagcattttgaattttcactgttggcagtcatgggtgtctcctttcctaccatactagattactggtctaccatgttgtgtattccaggaagtagcaagtaaaggaccagatagtaaataccctgggctagaaggccatatatggcttctgttgcatattcttcctccctttttttcaccctttaaaaacgtaagaaccattcttagcttgagggccacacagaaagtctgcaggccgcagtttgctgacccttctttctgaccctgtgctctaaaatagcaaagtcttgaatcctgaggttgttctgtactgtcattcaggtcaaaagatgctagtcaaaatatagtaagttttagtgttgaaattagagtccagttgaaaaatagcacagtcacttctgttacccctcagattcccacctgaattacatatgaggagtttttaaagttccattcctgagaccaagaaggatttgcgaaggaattcattaaagctggtttgacacatacaccgacttgggcaagctcagtgcttgtgatattactccagattcacttagagctcaagtcatgattttaattttaaattcctggggttttgcgccatcaggtttcatgtctggagcagtagtgttttatgaaaatagtgtctgttgctgtgaagtaagctaaccataatgaacatgagcatgacactttttcacagcaaaagaacagaaatgcaggcacaacctttgtgaaatgaaatgacagtattaaattgcaagtgacgatggtaaggcaaatatttaaattcacaactaaaatagtacttgtaaaatgtaattgccagagagagcgtgccagttcatcattgctcaagccgattctctacaggcagaagcattccacatggttccaggaaaagaaaaaaaaaacttattttaaataaactgctttctggctcttttaagattgtacagaagtaagctttatcaggtcctatcttggtctgagttgttcatgggcaggggacagctcttatgcgtgatgcttactctttccgtttcaagactttctgagctggtttcttctaagctgcagttttgctgatgggatggctttatttatccctaggagagttccagtgatggaggtgatggcgtttttagcgaaaagaaggatgacagccgggcaggtgagactatgtccttctgaaggcataggaaagtaaggtcttagtttgttagttatcgtggagtttatatgtaattaataagtagttttttaaggaggctcttttaaaaagccaagtaagttgaccatcatcaaactcccctagagtcacacatggagcttcagcatggctctggcttcctctacctggcattaaaatttgaaagtgaagtaaatgttaatatcttcagttagaataaggtctgagaggtaaaaaggaattgtgatgacatcgggttttttttgttttttttgtttttttttttaaagaaaggttgtgggggttggtttagtttggtttggtttttgaattttctgaattcagacgtgagaggagctttggtaattggaaggtgcaggcaacaaaggatctgctcattcctgtgctttagagcaaagtcctcacataacttctgccaccacaaaaagacacttctgtgtttgagagataacagaattaattgaccacaacataagctgtatccaaggcaaaattgcagcccttccagtcatgccttgctcctgggccaattattaaaacagtaactactttgagtaaattattgagtcagctttgtttttatttaaacaaaaccaaaagacagtcactcctgttttagttctgtttgtaaatactaatatcctcactgatgtttgaagcccaggatggctccgacccagacaaatcgccctggccagtttcctccgccctcacagctcgtctcagacgtctggtcactgtttaccagcgctgcaaccgcaaggaactgtgccggcctgaaattctgggaccaggtaaccaaggatattggg

SEQ ID NO: 100982 - DNA, 2089 bp, Homo sapiens
agggctgggattacaggtgtgagccactgcacccaccctcaaagtcagtttttaaaagaatcatgaaaaacaggtaggcatcagcagtagttaagctcacaaaagagaagacattaggcagctgagctagcatcaagggtctgatggtaacaaggggaaaatgtccttgttaaccagtggcagcagagctcccttccaagccaaggagtgactttcgccaaatgtgattctgtgggaagattcatcctactgtgaccagggagttgcaacattaggcctcatttgatgtgcacagccttcagtttctagagtgtgttcttttatcagagtcacatgttcagatgactcttgatgggcaggaattacctttttctgaacttgcctgagtagacgtgaggctggagcctcatgctgcagtctcagttgaataaaggtccttgcctgtagaagtgataactgtttggtgatagtttctctcattctcagtgtctcttgaattctcccacaagggagggaaaaactaaggcttggaatgccttcagaagaagggatctattgtcagccctccttgtctgtggatgcagaactctcagatccagagggccaaccaagggacttgatcatctgccgatattggtatccctgaggatctgagaaccaatcctccatgggtacagacggctgacttggaagttccactttattcatggaggatacctgaaatttcagatagtaccaaaccctgtataaactgtattttctcctatataaacatacctatgataaagtttaatttataaattagggacagtaagggattaacaacaataataatagaacaattataacaatatactgtaataaaagtaatgtgaatgtgatctctctctctcgccctgtctctcccccaaaatatcttagtatttttggactgtggttgaccagggtaactgaaactgtggataagggggacctaggtagtatgtgatgcctttttttacttttatttagaggcaacacagataaagaagacaatgctgaggacaaagtagatggcctccagaaacaaacggtgagtcaaatgtgcagtattggtcatttacaccgtctttcatattaagaaagaaatccctatcttggtagtgatctgggggaacttgattgcattactacagttacattgcattttgcccaacattttattataaaaacttaaaatacacagactgcaattgcatttttattctaattaaactttttattttgagataactgtatatttcagaagcagtcacaaaatataatacagaaatcgcatataccttttatccagtttcccctcgtagtggcgtcttgcagtattgtagtacaatatcacaaccaggatactgatatggatagagtcaagatacaggacattctcatgaccacaaagattcatcctgttgctgtcttataaccacatcctcttccttctgccttcacccctctttaaattcctggcaaccactcatctgttctctattttttatgatttcgtcattttaagaatgttctgtaaatggaatcatacagtatgtaaactttggggattggctttttcatgcagaaaagttccctgggattcatctaggtggttgtctgtatcaacagttcattccttttcactgctgagtagtattcagtggtatggaagaaccagagtttgttcaaccattcatccactgaagggcatatgggttgtttccagtttttgactattaagtcctctgtaaatatttgcatatagatttttgtgtgaacatacattttcatttctctggaataaatgcccaggagtgtaattgctgggtcatatgatagttacatgttgtgttttttaagaaattgccaaattgttttccagagtggctgtaccattttacattcccattagcaatgcatgagagatccgctttctctgtattctccatccacaccaacatttggtgtggtcactattattttcttgagccattctggtaggtgtgtagcaataccttgttgtgattttaatttgcatttccctgatggctaaatgatgttgaag

SEQ ID NO: 100983 - DNA, 1853 bp, Homo sapiens
gctgggtcttcactactccagtctttcttggctagagccgacaccactttggtcactgggggggggccttgcctgcccacaccccgggtagaatgactgcagaaacaacagatggtgacaagcagcactgggggccagggagcacatcaacttgagcaagtcccagagaatcttctctgcttgtcctgtggtcatggagacagcaggtgtgctgggaatagcccttcgtgctggaggatgagacggggcatggttctatcccaaatgtgtcctgaggatacacttatgctttgtgaaaggagtagagaaaagaggactttcttcccagtagtcctctccatttctaggaaagcttagtgatcgaccgacctcgcgtgagaaagcagaccaaacactacaactcgtttgaggaagacgagctcatggagttttcagagttagacagcgactcagacgaaaggcccacgagatccaggcgcctcaatgacaaagccaggcgctacctccgagcggagtgcttccgggtagagaagaacctgctcatctttgggtgggtattggctctgcttagttttgttgttattgttgtttgttcccctctgtttttcagtccctgagatttgtctaggatgtctctccagtcacctttggaattatagggcaaagggggatctgttggagcaagagagaactgtgccttctgcccagaatccgtctcagtcaccgtatgctccgcaaccacaatgcagacatgccatgattttctcatatgcctgtcacaacaaatctctggtcctaatttgctgtctggtactgatttcctgcttcctcccaccccgcaaggatatacaaggagtccacacaacacatgttatcgccaaggcatgattcgtgcagggctttggctctggtagaaatcaaaggttcagctgccatgagctcatcattgcttttgaatagtgctgttggactctttttgattccaaatttattccctgctcccagtagtttggtccctccctttttaacattgtagtggccatatgaagctctcagtgtccaacgtccaggtcactttagtgatattcggtgtgctacagtcaggtggtcctcaaaggcctttcgggacaaagcccttgggatgattaacagacctacagagaacaaaaagcatgtatggctcttgtttctcctcctgtggggaggctgcctgcatggcctggtccattctccctccaacacctgtctgtatgtccactgtcagctggggccggtggaaggacatcctgactcatggccgattcaagtggcatctgaacgagaaggacatggagatgatttgccgtgccctcctggtgtactgtgtcaagcattataagggggacgagaagatcaagagtttcatttgggaactgatcacacctaccaaagatgggcaagcccagaccctccagaaccactcaggtgagaggtggcagggccatgcctaagaagcacgattcccatgcacttcatcccctcttcctctgcggggccgtattgctgtgctttgggggacttctctttctcgggtgtttttcagaatgttaccagtgggaaaagatgttgctttcgtttctgcctcagaatctcccagtgttacctgtgatattttgttgaagtacaactggaccctcttaaagtttcccacatctggtcctgcccactaacctgagtctcacacagactccccctctgaattagggatgcacagtgacttgccttttgcatttcaccatcctgtccctgtcccacctctgtctgtgccttttcttgtgctacattccttccctatccttggctaaggctcccct

SEQ ID NO: 100984 - DNA, 1209 bp, Homo sapiens
gtctctacacctcatactgcccagcctaataccttttccatagcagacatttggtaactgttgcactgaaagaaaaatctagaaaagttttaagtgttaactctttcataggaaactagacaccaagtgtcacattgccattgtcttccggggtttgccttcctgcttccaagcttaagctccaaaaaaaaatgatcccttcagttgaaattatgatttcctcacccaatttttaaaataaaaggtaaaaaaagaatagccttgagattttcaattcattttggaagctctgttaagggtttgattttgaatgcaaatagataatatacttaggtttctcttgaagtaacactggtgttttattagtttgtattgtgttcaagcacagtttattaattcttgtcttcttcacaggctagctttgtggcttcaggaaacagaacagatatttccttagatgatcctaacttttggcagaaatgggctaaaatagctgaactagacactgaagcaaagaatgaaaaggtacagcaaaataatattttattccatggaacattcacttatgtcatacatgacaataaattcctacacagctcaagtcattatttactcttgagtcttggttcttaaatggtatttgtaccatgcttaaaatatgcctggcacatagacatcactcaataaatcttaactgttgtcatttttaaatggccattcagtctgttgggcacctgggaaattagatgaaggcaattagaactggaactggatacacaggtcaagttcaggcctctgcctcaaaccaacattctatccctggcatgtgactattttatttgtatttcaacactttctgtgagagaaacttcacacataatagagggaaaaagcatgacaaaagtttgttggctttacctccattctttcagtgtctcatgttttcttaattctgaacatgagaaagagaatggacttgagagtgaaaccagagtatgccttcggatgaagcttttgacccccgctgagattagtagaagaggaggtggtcaggcccacactgtggggttacaaggtaacatttgtgggtataactggcaccagtgcccagcccactgtgaggcaccccttaaatgttgatttcccgtccttcatctctgaccctgtcacctcacttcaggatgagtgtcttctcaggtgagtattgaa

SEQ ID NO: 100985 - DNA, 1109 bp, Homo sapiens
agattggatgcttaaaccttctaaatgagttgtctttagtccagatgttccatatcctcttagctatgcatatgttgctaagtataatacttcaagttagtcatgcagagagtcatggaattccctcttgtgattgatataaagagaaccagattcttaattagaaccagaaaagggtgtttgggaccccatttcctgttttttttgagaagatcacatttatcatgggatcattttttttttagttgagaaatgacctcatttacaatactaatatacatatttatttaataatgaataaatcattgttcttctgcttgtttggtacatctggaggtttttaaagatacaagctctaactaaaatataaagatgtcaaaagtaccatcttcaatgatgcatagttatagtggcttgtgacatctgataataaccaacatcctgaagaatgttagggaccttggatcatgtgctgagctttatttcagagctgcctatagaggactgtctgcctgccctccccagagtatcgcatctgggatttcactagctgaagtttgttgcccacgtcctttgttctaacatgtagttcatggaggaactatgcactgaatcacaaaaaccagatttgaggctgtttttctcctatacattttccactttgtgagtagcctttggtgacctgtccaggtacagcagctctcaaaaatggaggtggaggacctactccggaaaggtgcttatggagccttaatggatgaagaagatgaaggctccaagttctgtgaagaagacatagaccagattctgcagaggcgaacgcacaccatcaccatccagtctgaggggaaagggtccacttttgccaaggtacagggccttctctccagagctgttgggggtgggagagaaaaaaaaatgtttattctctgaaacccattagcagggcttctgtttctctgaatgcaaatcctagaaattggctgcacatttagtctgcgtgactatctaaagatatagatccttagaggaaggaagtctgaatagggagtcagggactataccaagaaaataccactcctcacctttgagagctgatctttaacaga

SEQ ID NO: 100986 - DNA, 2093 bp, Homo sapiens
tcttaagtccttgacagttacaaagttctcggcttctttgtgatgctcacctgactgtgaggcatggcagctggaagaatagtggcacaggaaaccaaagttgaatggccagtttgaggacacctcggctggacatgcctgaagcgatatccaggaggatcagtggaagcatggggctggcaacagctcatggccagaggcaaacattttggaatgaccatgcttcacctaggtgaagtctacacattaccagttgaataggtgcaatgccatgggaaaagcaagaacgtgaatagtcaaacctagtggagaaggcaaagtcatctgaggtgactgatttatatgtgtagcaaccagggaagttgggtgggactgtccagaataagggtcttggatgaagggagaagctttggagtagctgttctcaatgtccactgctggggagctggcaagagatgaattaaggaatagcagtgaagtccaaactgaaattggatagtgtgaactttactagtgtgttgagtcagtttctgaacttcctctaatgctcagcctgaatgaagaaacgaagaagaccagcactgaggaagatccaaggtggaagatgcagggtgggagttcgtaaggagaatgcagcaaaaggttactgtgtgagagagaacatgtgtacaactcggaaggaatcatcctttttttttttttaaagtctagccagtctaggtagagatgaaggaattgagaaatgtagagcagttttaggacaggggactagaagagtggctattagttagtgggactggtgggctataaaaagatgtgatagagagaggaaggtccaaattctgtgtctcccacagagatggagcaaggttcttgcttgcttggtgtgatgaggaagagagcaagagggctttccaaaagcaagagggctggagactgtccacagaatgatgcactctccccacacaaacacacacattcccacgccccttggcatttgcccttgcacccacgtgctataaatatagaatatttactccagagagagtgtggaggctgggacgctgacatcattgtgttcctcttcccaaatcctcctgtcctcctcttgctttccagaaaatgaaggcacaggttcattaggatccaggatagaaactgggtactacttaggaataacaaaagagattaaagttagcactgagagatcttagcaatattactgttttatctggactattaaaaggaaaaccaatttttacgtccccttaatggggagatcttatctagagtcaggtaagtgccacaccctctctcaaaccttgaatatgtctgtattcgcatcaatgtgtgtacaaaattgaaggttatcagtttgccttttctcaccatcatttagaagacagaggctctaatttagtcctggcacatcagcagcagcaagtgttgtctaggtttcccataacacctaaggttaagaagtggcacaggacgataacagtagcctgagaaggaaagacaaaggaaaaactgggtttttgtcttctttcttcttaggagtaggccactgttgctgctacccctgaaggcaaaggcagacctcttgggaataacatgctatcatgctcccctcagagaccacaaaccttcctcttccattgttctgtgatacttctgcttcttattctctgggggactttttgcatctggaggcaagagatccttagggttgaagagggttcaagataacaacggtgggctgcacagttctgcgtccttcctgctgctaaggtccctgaaggcagaattcagaaagtgtgggagcagatgtcctggccaagagcacagccacaagataatgcagctgctgcatgtctgcaggattttggaagtcagttgggagtccagagtgaggagacaggccctttccacaatcgccagaagcaggactcaggaaactcccacactgctccgaggggaagaggtattggacccctgtgcctcttcctctgctgccaccacattgcttgcaccccctatttcttacctaattttatgttttcagaagacaggatctcgctatgttatccagg

SEQ ID NO: 100987 - DNA, 1253 bp, Homo sapiens
acttggtgagacttcccaggagagtggagcacccgcattctctcctgctgccactgcagagccctctgctgaaggcacagaccaaagagtgcacccagcatctcctcactggactgctggtctaggacctaagaattcacttcatttttcccaggatctgtaaagcagagtacaacctttatccttatattctgtccgaggaatagttttgttccattccttttcaggagcagaggagaaaattctagaagatttccgaaaaacccacagccctgatgcccctgactttcagctgcaggccatgattcaggcagcaggaaagcttgtgttgattgataaactactccctaagctgattgcaggtggccacaaagtactcatcttctcccagatggtgcgctgcctcgacatcctagaagattacctcatccagagaaggtgagacttgtgtcaaagctctgcattcaacaatgggacagttcctttcctttgatatttttttgatccattcaaaaattttgtttaaacacaaaacattcaaaaacggaggaaaggaatctccttttaaagatagactgaaattcagagttaaattttatgaccaaatggacccaagtttaactgtcaagagtaaatttcatgacctatgatgtacagtccttgctttgcttaaaaaaaaaattccacatatttatttatattcactttagttggaggaaataattcaaatagcattagaaagggctaagaaaataatgtatttacatttttgttgcttaataatggtgaaagaaatatatcctggaaatcatcactatatcaaattcctgaaagagcataaactggcaactcacagagaaagaatgtggggatattttatgtcctttctcagcaagccctcttaaggttttatgatgcactggctatggcatcccaatttattttcttgttcatactcttagaattccttgaatctaagttacattcctcatgcaagtaaaaagtctgtggtgctgtgtgggttatttggattctgtatggaaactacatttgttacctcatgtgtattactttagattttccgtcattgtgacacatcaatgatctgaagatgacaaatgagtttttaaaaattcattcttaatgataaaagactttcaagatcatagaaactggtagcctaggcattgctaagtctaaagaaaatcttgttttcatagcaaatctcgggtgtcttaacagatgttcttatt

SEQ ID NO: 100988 - DNA, 1863 bp, Homo sapiens
taattagcacatgctttttgtgagaacattcaaaatccactctcagcaatcttcagaaatactgtacattgttattaactgtagtcaccatgttgttcagtagatctcttgaacttattccacttgtctaactaaaattttgtatcctttgaacaatacctccctaccccgccccaccccccagtccctggtaaccactactctaatctctgctctatgagatgtctgtattttaaaacacagtaaataaacgttctggaaagcatctgtttgcaaaataaagcatgttcatcattgtctaaaatgtgcttttgtaagtaactcttctaaatcactctctgtaaatcactttatatttcttcaggaagcaatctcgcagcacacaacttgtttatgcagagtctaccccttttaaatttttgaacagccgtttctgacttgaaacgtgatttcttttgcactttcatcttcccttattttgttttaccatcagagttaatcttaccggtatcatgttttagctccaggttaactcaggtactttgactttgaatccctcagtctgtcattgtctcactgggagggggaacaagtcaccttgctggtgcagtcagttgcataaagatctgctgtccaggcctgtgcttttaggggaagaacagacaaattgtagcaaagaacaccatcagacttaaagtgcccctgatgtgacagattccatgatagagtagatgtcacctataacattagttctttacatactgctacacccaagcatgtatgctgctattgttacttaaaaggtataggaggaattgttttccagatcatctctacttcttactccattctctcagcgtctaagtttccttgtaatatatcactcatacctccgaacataatttaaaatactcttcaggtaattactgtgcatgtggtgtgtgtattagagaaagaatgacagagagacatgttttctccatcctagagaataggtactcttttatacctttctccctttttatcttctgagattgccactagattctcagtaattgcttgtgaattaaaatcatatcccttattccctttcagtactattataaactctccattttcaggggtcgatcataatctttcttttagtctactaccacagtactatgggtaaatgttcaagaaattagagtgaaggttggaataccccagtaatcgttaacttgggattgaggcaggtaactaggtctcatttccctggacaggtaaagaaactgcagtctatcctaaaaccaatgatgcttcggcggctgaaagatgatgtggaaaagaaccttgctcccaaacaagagacgatcattgaggtggaactgaccaatatccagaaaaagtactaccgtgccatcctcgagaagaacttttccttcctgaccaagggggcaaatcagcacaacatgcccaatctcatcaacaccatgatggagctgaggaagtgctgtaaccatccctacctgatcaatggtgagtcaggggcactaggaagtaactcaggactgccatgacctctgcgagaagctaatgataatcaaataactcatgtattgaattttcattatatgctaggatgtacgcattctcacctttttacagagtataaaactgagattcagagagcttgatgaatttgcctaagtggtatagctactaaggaccaagagccaaggtttgaacttaacttctgccaacaagctgcctcacagcatgtactctgccgggcagaagatggatatcactcaccagtttgctgccctttatttgttcaaagtctggcccacactttctacttggggacagggaaatgtgtta

SEQ ID NO: 100989 - DNA, 2134 bp, Homo sapiens
tttcctttgggcattcaaactatgcatggtttagatggactcctggctggggacttgtgaacaacacctatctgatttccttatcatgacagctaataaataaaaatgctcccttgctgtgccttccatattgcccatccttctcacctttgtgagggcagatgttgtctcgcttctgtttcattgatggtgtgaggccttctggctaactagctcgttaattcttatattctcttttctcacatgaggaaaagcagtgcttgtcttctcacctaggccccagcatctgtagtgctgcctcctgtagtccagcagatattagcagaattctatagccatggtgtaaagctttgactttggttgtgtcatcctcagggaaaccccctttcaggagtcttcaagttccacgtcgtcatcacaacatttgaaatgatcctagcagactgcccagagttgaagaagattcactggagctgtgtgataattgatgaagcccacagactgaagaataggaactgcaaacttctggagggtctaaagcttatggccctggtgagagttagcatctctttacataaacacaggttccttttgttcagcttggaggaaacactctttagccattctgcatgtaacttatttctgcctagtcgttttacattagattttcttttttggtctctataactgcaatagtataggaattaagattttttggttacaaactgggtcaacaatttgacctttgccacagattgatttccatagacttaggaggactcttaaataccatgaaatatatgacttggaaatgtaaggtgttttggctggtttccaggcccctaaatgaactggtaccaaagatgatgcccttttaacattactgccttggcacagtgcccagtatctggtggggaggcactcaataatatttagtgaatgagtgaatagttgctttaattaacatgaacgtgctgctggaatcagtgatgtgaaaggaaggttgattcgtttattgactgtacccctatgatggcatattatcttttcattaaagcagatcagaattgccccaaattgagcactcaatgccctggcttaattttccccacgaaaatgcactattttgatggctcaagcactgtccatcatgtatgtttaatttgcgcaggaacataaagtgcttctcactggaacacccttgcagaactctgtggaggagctcttcagtttgttaaattttctggagccatcacagtttccttcagagaccgctttcttggaggaatttggagatctgaaaacagaggagcaggtaattagggacccaaagaattgaggagacagtgtgatcgttatcttcatcaagaaaagagcaggatgctatggggccaggatttagcaagttgtcacgttcctggtaaaatgagcgttacctcctttattttatgtgtttgtgtatgttggggcgggtacgctgattattagcagttcttattgccccagaggatagatgggtccatacccaaaatatcttatgcgcccaaaatattttatgttggtgtatcgggcctccttgcttcactaatttcacatattgtgcgttcgctgattttgcttacagctctggtctcaggagcatggtgctttcttttgcttccctcatccttcatccttttcccttcaaaatctgcaacttgttcccaggcccatcttcttgcatacagcacaatacacaggtagtgaggaaaagaaggcagtcacatacctggagtagttgataagtccacttttgtccagatcaactgcatttctgcagttttcaaggtccagttccaagtctaccttgttggactcaaagctaataaaaaacaactgatagtaataaatactctactagggattatagaatctccactagggattatagaaataacccagacaaatgtacgtgccataagaggaacaaatagtagaggtggtccttcaaaggagagacaggttacatctatttgagaattagaaaagactctagggagagagtacaatttgaaaatgcatcttgagggatgggcagcttttaacaggtgtggagagaagaggtggtaaccactctgcatagaaaaaaaaaaac

SEQ ID NO: 100990 - DNA, 7775 bp, Homo sapiens
ttatcttcccactaattcagtgagatatgtatttttaactcctattttaatatatttggagactaggaggtattaattgacttgcctaaagtcaatagctggtagatattagaactaattttaagaccccatactcttagagctttctgaaaattgtatgcagcaacatgtaggtagttttgcaaagaaggtaaatctgaggaccaattttaggtatgttaaatgcagatctgaaattgcatctgaaaaacttctctgctcttgtagagttgtgtccagagcttagaagccaccactttaaattctagctttgcaaaatgcttgtgaccttttgaccactctgtggcctgatgggaggccttggtactcaaaggtgaacttttgaatgaagtagtacccattgtagtatttcttacagaattgttttcttggattctgtggttccagcaattttcttttttttttatctttgtccccaggagcctccagaagatgatgcaaacatcattgagaagatcctggcatctaagactgtccaggaggttggtggctcatgtttctagcttttatatcattagcacagattacatcttctgtgaagagatttttggctagagaacctagaatgaccattattggctggagtgagagctaggcaagaatattgtctggctagccaacacttatttttacccctgtagagcattttaggacataaaactcttaaaatatctagaatggctcaagctgatgatttcctccattgtgatcctagcaaaagccatatatcccttagttgctgtagcccaccacaatttagcagagggccaagaagaagagatggacaaaaagtcctaatagaggccaggttcattggctcatacctataatcccatcactttgagaggccaacatcggaggttcacttgagcccagtagttcaagaccaacctgggcaatatagtgagaccctttctctatttaaaatacacacacacacacacacacacacacacacacacacatacatacatacatacatacatacatacatacacacatacacacccatatgagtcctaatggaaacgtgggggtttttttcttcagacatctcagggccattgtaggaatctcctataggaaattcttggagtgctagagtatgttggtgctggtgagagcacggcttcatctttacttcaagaatttatgaaagtaaacttccttacttggagagtgactaccattggtgtttcagaagtgaagcgttagtggggtgccagagatgaatgtagtcacttccacaccaggctctggtcctgacatttctcattgtcctgggccagtttgggtttatcagctgagtgccgtcccagcctagaccttggaaggacatcaggaagatcagttttttaccttgcagctgtgtattccacctttggaaaacctgaccaataggtgtcaggaaaaggcctgggaaaatgaaaatatgccttaagaaatctttatggaaatcaggcagagatattgattacctgttttcttttggctcagtaagggtgatctgcctgggatctgggctgataactgcttgctgtttgttacaggttcacccaggagaacctccgttcgacttggagctgttctacgttaagtatagaaatttgtacgtctatttaaagtattctctgtatttgggttttatatgaataaaactttttttctcttgtgactttattatcttctacatcttcagagtcttgcctctaaggcatgacccacaggtcttggctgactcaagtttaccttaggcagtaacgctcaattatagctgcacacagaattacctggagagcttttttaaacctctaaagcctttgctccacccaagaccattggctcagactcagtggggcccaaggattgttgtgtttttaaaaactccttgggcaattctcatatgcaaccagggtagagaaccactctcctgtagcatatgctcttttcccctcttgtatattttcctttctgctacagacccactttcactaatgtgtgttaatgataacctgcccacagctgccctgcctctgttctcagccagtttctctagaagctgcagagagatcagttgcttggaattactccgttttgttttgttttctgttgttgcccttaaggggaaggtctttctaagcccaatctccagcagtttcacaataaaccattttactatttctgtgttaggtggtcaccgtgtttattgaacaccttaaagctcgatcatttgctagttatgtgcttgcctgacaatttgtatgtctttggatagttcctacttacattgtaaatgggccacaatggaagagctcgaaaaggatcctcgcatcgcacagaagatcaagcgatttaggaataaacaagcccagatgaagcacatttttacggaggtgaagcaatatttactgactcatttgactgctgcttttcttgcagcagtaaatactgtgtttacgtttctaagtccaagttaaattcctatacagatctgttgctcaagtcaaattgataaatgtgtgctgatttgcaacaaaactagtctagattcaagtcaaagaaaactatccaccaaagttaaggatcaaaccttataaactgacaactcataacggcgtgcatcttggtctgaatactaataaatagctagagtgagaggaatacgcacacaattcttttgtccctgctccctcaacccactgcaacccaaaaaggacatttcagaaggtcctaaagtttgaatgtaaaaaacaaaacaaatctaaaagtgagagaaagtaaacaaataaataattttatttatgtaaacttgggaatttctaagtattgtacctatagcaagaggaaggactgatggattttaatattaaacaaatctataatgctatatatcagaaaatgccacaaaccttaaccttaatgtgttattcttggaataaagactaaaccctgtaatagagcctacacagccctttgtgtctgttttctgatctattcccaaagtagtggtttttccttggccgagaatagaggaaactgtgctgggatatatagaaataatgcaacaagagttcatattcttgtgggaaggaaaggctcttgagaagattggaacacatgaaattaaggaggaataatactgacgagtagttcaacactgcctttggtcttgacctattcaacatatttgttagtaacttgggtaaatatttttgtgatacaaatagtaacttagttttgaatagagctttgtatccattatttccagctgctttatgaggtagctaaagcacacgtggaggaaactcaggctccaagagcctgcaacttcccacatgcgcagagatagactcctgatgaaatcctaactcctgaacacccaggagacgttctaaccagatccaatactgagagaataaatgtcaggatcagcctgggtttgcctggacagggtaggatgaataaatgtaggaataaatgtaatatcctacattgttcttggaatctttctggttctgaaatgaggaaaatgactgggtagcagttctagggagaaaacatattgccagttcaattaactacacatttactgcgtgtcaagagtaggacatggctgtttaaaaagtaaacgaatcctactaatcctagactgcaccaatagaacagtcctgctgtaccatgcccttttcattcctaaatgctatgttcatttgggtaccaggattcagtgagggactttgcaaaacctgagggcagctgcaagaggactgtcatggtgggaatggggcataggtggagagcggactgcacaatggtaagagcctgggctctgcagtcaaactgcccctcccagcccagcctcacacacacctgggtggcctcaggccatggcataagctctttcaaactcagtatcataggaaaaagcaggactcctgatagaatcagcctcacagaatacctgcaaggattagatgatagttttcttgccgttttaagctttattggagtataattgtcaaaaaattatatttaaggtgtacaacttgatgttttaacgtatgtttacattgtgaaataaccactatagtcaagctagtgagcatatccatcacctcacataagtagggggttttttttctttcttttttcccccctaagggtgagaacacttaagatttatcctcttagcaaatttcaaatatataatacagtagtttaactgtcatcaccatgctatgcattaggtctccagaacttattcatcctgcgtaactgaaattttataccctttgaccaatgtcttccccatttcccctccccttcatccctggcaaccaccatttactctctgcttctatgagtttgattattttatattccacatataagtgagatcatacaatatttgtctttgtgtgtcaggcttattttactttgtataacatcctccaggttcatccatgttgttgcaaatgatgggatttctttcttttttaaagctgaatgatattctattgtctaggtatatacaccccactttctttatccattcatcccttgatggacacttagcttgtttccgtaatcttgactattgtgaataataaaggacacaatgtttatagcagtgtttagctcataggcactactccataagtattagcttttcgtatcattaagatggaaacggtatatgaagaactgttgaacaaactgggttttttttttttaacccagatagggaggggattgctgaagagcctaaagagagaggaaagaatcctcttattgctgctgtaaaggaagcagttcatgccaatgagcaacagttataaggaaggaagttaagttataatttactaatgataaagatcatgatgctactcctaaagaggtagagataaagctgtttcgacagtgaatcaggtcttgaagggtagtaaatttcttagttgggaataattgaatctgagaggcttgccagggatgttgtaaaaagtatcctgcattgattagacgatgaaattagccccaaaagtgccttgcagcctaagtggcagtaagagctcttcagcactcctggaggagggcttcagcttctgggtaagaaagacctgggtgaacggtccagttaacatagctccgtcaacttggtcacattacttaatatctctgagtcagtttcctaatctgtaaggtaattatagtacctactccgtaaggtagttttggagcttaaatgaaagtacttagcattactctggacataccttaagtatttctatatgttgcttcttgttgttttgtagtaaactttttttgaagcatagtgtgcataaagataaaagtatacatctcaatgaatttttacaatgtaaacacatttgtgtaactactacctagatcagcaaatagaacattgtcagcacccaggaagcttccctcatgccccctgccagtgttaactattgttgttattaagaaaaagaaactgtaattcctagttgccaagggctgtgtttgaaataaggaccagtaaggaaaagggaacccttctgctgatttttgtacattgctataatgaccaacagggaattattacctggctagggtgtagccactaagatggttagatcctttaaatttagtcatggagagcaggatttggagacagtgaataaatgccgtgacttttattcttaagcaaaccctttctttttgtgtttgttgatagggcctagagtagggatcacttagagataacaccctaggtgttggatttgaggcaaggggacatacttcctaactgttctcctctgtttgtgttagcctgatgaagacttgttcaatccagactatgtagaagttgatcgcatcttggaggtggcccacaccaaggatgcagaaacaggggaggtgggtatttgcctctcctgaagcatcttcccttctttccacgtatttcacttgttttaacatgtgacccttgtcttagtggtattcctgtctagtcacgtagggtggtttttcagaggttggcagatactactgactcctttaacctaatagaacattaagtttctttcctgttttcccaccaggaggtaacacattacctggtgaagtggtgctcactaccatatgaagaaagcacgtgggagctagaggaagatgtagatcctgcaaaagttaaagaatttgaatctcttcaagttctccctgaaattaagcatgtggtaaagtagttttgtctctctctggcacttctcggaacatgtaattttatgaactttgcaatcatggaagtccacctggcttgttcctaggtggtttctgtggtattttacctttgttacttctcattgaaccctcaattcagtgttttccaccccagatcgaactttcccagcgcccttgtcacctttaggtctcaggtctattttgatgtatgtgacatttaagaagctttgatattggcttagatttcttggtgtgcggctgttgtatggagtcagtaaaataaaatttgtaagtaatggctggtgtgcaagagaagctcagtagtatctttcctgtttcttatctcttcatcagctacctcttttctttgattttcccttcttcactcaactggaatattattaagtggaagaactgtcctttatctgcagatccctgtgactcccacagagagaacataggtttttgataaacattattgaatttatttgtttttctgattctggattattaccactcaactgccaagatctcccagggcgcctgagaagtatatagattatccaacaattaaaaggaggggagttgggatcagagcttttatttatttttttattttgagatggagtcttggtctgttgctggagtgcagtggcacaatctcagctcactgcaacctccatctcccgagttcaagcaattctcctgccttggactcctgagtagctaggaatacaagcgtgtgccaccacgcctggctaatttttgtatgtttttagcagagatggtgtttcaccatgttaagctcgtcttgaactcctgacttcaggtgatccgcctgtcttggcctcccaaagtgctgggattactttggcgtgagccaccacacccagcccagagctttattaaggtgtaactaacttgaaaagagaatcagttgttaaagaatatggctataggctggaatgatcagtttctgtttaaaaaaacattgccatttttatatgaaaaactgttatccagttccttattaatattatttcttgcttttacatcactggaaggttgatactcggaacattaaacttaggtccctgtaggagtccattcaagagcagtgttttgtttttgttttctttggcatatgaaaggtagatagaggtgtctcgagatgcagaactgtgattagaaacttacatagttaatagtgttttgtttgcatggttgattattattctttcaaccctctcccataaatactgttttctgcttttaattcaacttgtcagtcatctattaagcatttgctgtaggttgattcttgtgtgagatatggtaagaaacaaggtacaggccctgccctcaggagctcacagtctaatggaagaagcatgtgtgtgcatggataaataaatacagcaccaggctaattgtggtgtgtggtgtaatgcagtgacggaccagatagaaag

SEQ ID NO: 100991 - DNA, 1042 bp, Homo sapiens
gcagaaaatacaatgaggacctggacttcaaagtggtggatgatgatggggaaacaattgctgttcttggagctggtcgaacatctgcactctcagcctctacactggcctggcaggcggaggtatggcctttgcatgaggttactgaccttggctggacagtcattttgacctagatgacagacgtgtttcttggcctttgctaaagcataagtcagatcattttaactgctgcttgtggccttcgattgacttcctgttgcattgggaatgacattcagactccttactgtgctcagcaggaccctccacgatcacactctcgccttgttttgccaaattcttcatttttttagataaacaatttttccctgtctcattactctccagccaaaagactggctgtcttttaatgccttgaactaacagttcttctctacccatagacctttgcctctgttgttccttctgcttgggatgctttacgtgactggtttatcagttttgcctaaaatgttatctccttagagaggttcttcctgatcttttatctaaagtagattcctgcccctcatcccaatgatattctgtttcagccccttgtgtacttccttaaagcacttaccacaacacaaattgcatttgaatgtgtctgatctctgattttgttttacttgtctctcattaaaatgtgaaagtcttggccgggcattgtggctcacacctgtaatcccagcacttttgggagtccgaggcaggcagatcacttgaggccaggagttcgagatcaacatgggcaacatggcaaaaccccatctctacaaaaaaaaaaattagctgggcatggtggtgcaggcctgtaatcccagctacttgggagattgaggcacaagaatcacttgaacccaggaagcagaggttgcagtgagccaagatcgcgtcattatactccagcctgggtgacagagcaagactgtgtcaaagaaaaaaaaaatgtaaaagtcttttgtataataaatcgctgttaagtggatgagatcaa

SEQ ID NO: 100992 - DNA, 2035 bp, Homo sapiens
taggattttcataattgtaagcttgtcaagggcagaggcagtgttctcttcatttttgagtgcctagtgttcactccaggtccagcgtgtactcaatagaggttggtgacagattagggagatgtctcttcctaagaaacttaaagggagattgtaatttgatgattcttagtatctgtgaagcagttgaacttcctagagaagacatttgtataaactgaaagtgaagtttttggagatgttcatattatttcttacatattaattgtagctataatagtcatgatggggtgtaataaagtgaattctgcattgatccatgtagatatttccatgtttctgtttatttcttggaagaaactcttgtagattccccattaaagcctgccctggtcctagaattccaggatgtgatttcatgacgttgatcacatgagaaatcttagttttaaaaactgcccaacagttttaattctgaatttctccttgtagcaaggagcaaggaccaaccccagtggagaaaaagaagaaaggaaaaaggaaaagtgaaactacagtggagagtttagagctggatcagggcctgacgaacccatctctgcggagtcctgaggagtccactgagtctacagacagccaggtacagctgtgaccgggaggcctggtggagattacggctcctggatgggatctggctgacactgatcgtgttgctcctctatgcctttctctagcacactccctagccctgggctgggcttttaccgttttggtgggtgagcaggtagactgtagtcttttgccctagcccgatcagtatactaatgatatcccagttttttagtggtatttgcctcattcctggaaggtagcaggatattaggctgcagagggagttgatgtggaaaatgaagttgtgagccaagctaggtaaggcctcttttgccatacaggtaatgcatttagtgctcagagtgccaggccagcccgtacagggatattttcataatcccagatgctgggaaagtcagaaatgtatccattatgccaacaagtaaggaaggtttggccaaacttggaaacaaggagttgcccatctaaaccagattcctgaaaatataccaaaatgtgcccgtgacagtgttagggattttctgagttgagaacctctcttgagcatgaagtctaatatttgaaagtgctttgtttcctctgatattcttagcaatttatctgagccactctgctgcaaggctcatttagaataagactgacgtactataccttccaggatcatctggaccttcatgggtttctcactgctcttccctgtaggaaaatgacagctagtaatgtcatagtattaataagcagcagtgtctggtgtcagagcagactcctcactgcctataaactggggctggtggctgttaagtgtctagattggcagaggagccaagcacgttgagttgatgggatttggcagggaattaggtgtttgtagaatggtgatctgtatgtggtgttggggagaggtttttatgtggaatccctcatataaagtaaaacatcatagaggtaacttagtgaagaagtgataggaacagaagagagacactcaggaggtatcttttagaagaaaagagaggtgggattttgcttttgcttttgttttttaagatttaaatatttgagagtgagctggctgataaatggttccctgaagtgattctactgttgagatatgattagtatgtagagatggactgtatgctgctctatttgtagaaagccactgggctgttttgttgttgattattaaaaggtacagcttcttaattagagatgaatccttagatcatcacactcaaggtgacttagggaccttgttttgtcacacttaagatgtctccctgcatttcaagaagtgttacgagattctcaaagtaaatccaaaaaattgatactaattagttttcaaactacatttttagaagtatgtggtaaggatggtgaatttaagcaaaaacaataa

SEQ ID NO: 100993 - DNA, 1035 bp, Homo sapiens
tttggtatattttcaggaatctggtttagatgggcaactccttgtttccaagtttggccaaaccttccttacttgttggcataatggatacatttctgactttcccagcatctgggattatgaaaatatccctgtacgggctggcctggcactctgagcactaaatgcattacctgtatggcaaaagaggccttacctagcttggctcacaacttcattttccacatcaactccctctgcagcctaatatcctgctaccttccaggaatgaggcaaataccactaaaaaactgggatatcattagtatactgatcgggctagggcaaaagactacagtctacctgctcacccaccaaaacggtaaaagcccagcccagggctagggagtgtgctagagaaaggcatagaggagcaacacgatcagtgtcagccagatcccatccaggagccgtaatctccaccaggcctcccggtcacagctgtacctggctgtctgtagactcagtggactcctcaggactccgcagagatgggttcgtcaggccctgatccagctctaaactctccactgtagtttcacttttcctttttcctttcttctttttctccactggggttggtccttgctccttgctacaaggagaaattcagaattaaaactgttgggcagtttttaaaactaagatttctcatgtgatcaacgtcatgaaatcacatcctggaattctaggaccagggcaggctttaatggggaatctacaagagtttcttccaagaaataaacagaaacatggaaatatctacatggatcaatgcagaattcactttattacaccccatcatgactattatagctacaattaatatgtaagaaataatatgaacatctccaaaaacttcactttcagtttatacaaatgtcttctctaggaagttcaactgcttcacagatactaagaatcatcaaattacaatctccctttaagtttcttaggaagagacatctccctaatctgtcaccaacctctattgag

SEQ ID NO: 100994 - DNA, 1495 bp, Homo sapiens
cagcataaagcaggaaaaggaagaaagaaaagaacaactgtcatcagaagaaataattcaaggaaaagaatgaacacattttaaattagcatcctcagattgaggttattttgtctgcaacacaagaatgggtcatgacagaggagcaatcagaaaagcaaagaattaatgaaaatttaaagtgtggttgcctccactaagagagttcaacgaaaatactgagtagggacagcaacaggggaggtatatgagatctgaattcatcaactttcctatcaggatgtcagtagccattgcttaatgttgataaataatgaactagaagcatgagcgtatttggggttagagaggcatcagtcaaaagtgatcctctctggggatttggtgtactgaggatgggttatactttttatttgaaactcttctatactttctgaatttttattttcagttacttttattacttttgataggactacttggtaaaactctgctttttcatcttaagaggaagtaatctttttgtttcctttttactaggacaatatcacaaacctctctaatctccattttgaaggtgttgatgatacggttaaagggactgacagggcagatttagttcacagtttatctacagcagattatatctgtaccaaaataattagggtctttttatattttttcttttaactagtatctttaaaaaatcaataccaactcagttttctatgtagactcagttaataccggtattatggaaaagctgaatcaagtgtgcaaatgagctttttcaaggtgatatccatgttttcagtattgtactcctgggaagaagatcaaagcctataggaaggtcagtgctggaagcttctctgaagcattgttgctggagtggagtagtggttcctggactggacttctgagactctacatgtctttggaggcagtcattgggatcatgagctattttcggtggctgtagtagtaacgcattctttccgtaaggctctgatggatattttataaggttttaattttaaaatgagaagatgaatcattttgaattaatgcatcttagtagataagagctttcaatacctggagtccacggggacagagccataaaagattcatagtagtacgatgtcgtgacatgtacccatatctttcctcgtactcagattcagcactcacttcctaactctcagttctagcaaagaaacctggaggttagaaactggagatatgcttgaagagaaagtttgagaaatcctagtgctttcatatgataatgaaatttcctatttggaaagcaaaaaaaaaaacaaaaaacaaaaaacacgttttttctaggacaaactacagaaagtaaagatgcacaaaatcttcttggctgatgaagccatgtggaagacaggataaaagctttgatggttataactaatagttgtcctacatgtatgatataactgattgggagtttcttgcatgtcat

SEQ ID NO: 100995 - DNA, 1045 bp, Homo sapiens
ttttcttcctgaaatagcctttagtaaaaagtcagcttcgtggcattaaggcacagccgagtgagcaggaaagatgatccatttcagttgtgtatgaagccttctgattcttttactctatatccagggagtgagtatctgaggagtaggtctgtagccagctctttaggttgccctttctcacatagggagccaagcattttgactgagctgaaggttgcttctttttttttttgagacagggtctcgctctgtcgcccaggctggagtgcagtggtgtgatctcggctcactgcaatctccacctcccgggttcaagcagttctgcttcagcctcccgagtagctgggacaccacacccagtttattttttgtatttttagtagagacggggttttgctatgttggccgggctggtcttgaactcctgtcctcaagtgatttgcttgcctggcctcttaaagtgctgggattacaggcatgagccatggtgcccagcctgaatgttgcttttaaaagctagggtcttgagttttggtgttcatgttgttggtgagggcagaggatgagctttggaatttccacacatatgagaatggttcatattctttcttgcaagtcaagaaattagtcaatgtgctggcccaagtggaggtctatctacctggatctctggtcctcagactttgctgtgcctagggaactacctggacagcttgttagaaaagtggattccccagagagaatgattaggtctggggtggaacccaggaatttgcagttcaaaattctcccaggtaattagagtgtggctgattcttagattatcctttgagaaacatgtttcccaggtgaaagatcacaggaaaagtggagcctgtgtaagtttttatatgtaacgtctgctaggaatgaaaaagcaaaaagaggaaaagaagtggttggtgtgatcagccccagtttcagtttttcatccccatttgtttggtttgtcagcccagagcagatttttctcccaaatccagcattttaccttttttcgctt

SEQ ID NO: 100996 - DNA, 1677 bp, Homo sapiens
tgtggttttcaggtatgtgtgacttgttttcctcaacaaaagttaagatatgtatatgtatatataccaagaataaatggatagagctcttctccttgaaaataagacctgtataaggtatcttataactcctattgttatataacagtaggtaatatatccattttataattgaatgaaagttcaaaaagttaagtaacttgtccaaggcacaaaactagtgagcaccattgttgggatttgactccaggttcacctgactgtaaaaccgacttttctctccatagccgtgtgtcttttatgttttgctaaggaagatcagaaatggacgtggggagatttcagtgtcagagaagttggtttttatttgtaggaaatggtccctcttctatagaatttcagtttgcatactccatggtatcctttcaaggactaaaatgtcttcaactttttcctttgtttgtgtttgcatttgagaggcaacaagcagattattgaacatgtctgttctaaacaggtgataggtagagtctagcaaattttccttttcaaggatgatattaatagtgatcagtattcatttattgcttaagagataaaagcctaaaattcttaaataggagaagtttcaattgaaactagtatttattcttttccctccaaattattattattattttttttagagatggggtctccccaatagctgggattacagatatatatcaccaaacctggcttaattctctaaattatttttgagtatgagtttagttcattcctttattgtgtaaaacttaagcaagaaagaaagctccttcaggaagccaagttaggctctgtcattttcctgactctgaaattaaaatttcatttggtataactcatatgtttatactatttttaaaattatagtgccttattccagagaggattggagccacttgcctaagaagacatacacagatgtacgtttatgtgtatacatacaaacatatacacatacctatgcatacatagctgtacatggctggtatagctggaggaggggatcagaaaggcaggggtcaggtcatgtagggtcatgaaatgttaataagggctttgggaatatattgttcccaaaattgttcattatattgaatataatgttttggccttagaaaagcaacatgccagtttctcagagaagctaagtttttaccatttgagaaagaaatttcttattagggaactgttatagttcattttatgttgctataacagaatacacagactggataatgtataatgaacagaaatttctttggcttaccattctggagactgggaagtccaacagtatggcactggaatctggggaggacctgtgtgcagctcctcatcctgtggccaaaggcagagagaggagcaagagaggatgaaatgttaacgagagagggctactctcaagagaatccactcctgtgataacaatattcatccattcatgagtccagagccacctgacctgatctcctcttattagaccccaacccccgacactgctgcattggacatgaggtttccaacacaggaattttgggggacaaattcagattatagcaagaactgttatgcagtagatctgtgctcaacaacagtttttgcatctaatgcttctaaatgcctgtgaat

SEQ ID NO: 100997 - DNA, 1684 bp, Homo sapiens
cttagtacttagcattatttagttgctagctgtgtagatgtaccccctatatcccatgtttatatgttctttgtgtctatattagctttcagccaaaaatgaaccacttttcttacctcctaatgagagaaagataaccttaattaatactgaccatgcagtttcttgccattccttttggactaaaaagaattaaaatgttaacatgcacagggtgtaagggaagtgacatcccaggtgtgatacagggggcagtgatttttggaacagcagtcgtgtagagtggcagaggagctgctatgaggaggatgcacagtcacgggaatcagtggtgcaggaagcctgagagagccgtcagtatgcacagatttccagatagatgaggactgactaggttcccctaggttccaagctctgagtgcaggaccattcctgatctgtttatctagttcattgtctagcacagtgcttgacacattgacaagtgcttaggaaatgctgagtaaatgagaccagaggagaccataatgacttacagagagaccagagtgcataggtacagattcactgtatagaccctatcaagacagcaaatgcattccttgtgcagggaattccgtatctgtcatcatatgcaaatattatatttctcattttgtttctaaattccttgtggagaactttatatttagaattttgaggaaacaccaaatacatgactcctatcttaaggaatttacatgtctaaaatctaagtgcaagggaaggttaattatatttatctatgtatctattattttagaccaagagcactcataaaaaaacacagactgatgtggatactaacaaaacataaagtaatgaggccatcacacctgtgttggtcaggcatgaaggaggtaattttaagaatgcattttaagtggtgtgtgttgcaacgtggagtttactatatggttcagttctttttcagaaggacagcttgttgggaccagatggatagtttcttaatccaaattaaaattttgcctcataatgttcactcccttctgtctggcagggaatttcatctttcatctaccacagaaacttgggtgggatctcaggaatgtaggttacagaaaatgcccataaaataccttacagacggccaagagagaggtagacaaaactcaggattctgcctaactaaaaccttaacaggatttgtttcttagtgaacctagtgagcatactctagtctccagtgtgtggatggagtagcagagtgactgttcagcctctgcaaataattttcatttccagattactttggaggaactgaagtggtactttgggataatagcatatataaagaaggaggatcagacatgagctagtgtggcaacttttttttattattattacagagaataataaggcataaagattgtgtttgagaatttagggtgattagaggagagttttatagccctaataagaagtcttggtttgtatctagaagacattagaaagccataggtgtctgagcccacttagccactggtttctgatgtttacaattttatcaactcctccttttttaaggaattcatgtttacattgtatgaggtctgaaacaaagtgatgagtatgcaaacattgtcataaattccattttgggggaataaggaggcatttaaca

SEQ ID NO: 100998 - DNA, 1094 bp, Homo sapiens
caggtagtttggtttttgcaagtggctaaaggttatttggtgctcagtctggtggctagattagatgatcatacagaacagcacaatttttagttaaaatcaaaggcctacctttgaatgatcctgatttagtatgctaacaacacgttggcacagctccacaagtgtaaaggccgtgtatgtcctgtttgccactctgtctccaaggcctagcacaataggaactaacagagagtgggaactcagtaaatatttgttgagcaaatccatgtattcaaactgggtaactctctttgtctgaagcatgaattggaagggtaatatgcttgtttctctttcttttacagttgtcaaatttaaaagttttgaatcactccccaatgtctgatgcctctgtcaattttgactacaaatctccatccccatttgactgcagcactgatcaagaagagaaaattgaagatgttgctagtcactgtctgcctcagaaggacctgtatactgctgaagaggaagctgctaccctttttcctaggaaaatgacatcccataatgggatggaggacagtggaggaggaggtactggagtgaagaagaaacggaagaaaaaggagccaggagaccaagagggtgcagcaaagggaagcaaggacagagagcccaagccaaagaggaaacgagaaccgaaagagccaaaggaacccagaaaggccaaggagccgaagaaggccaaggagcacaaggagccgaagcaaaaagatggggcaaagaaggcacggaagccccgggaggcctcgggcaccaaggaggccaaagagaagaggagctgcactgactctgcagccaggacgaagtccaggaaggccaggtacgttcctttctcccttctctgagcacttgcctatgccagtgcagaacgatttgcctttggcattagcccaagcccctaggcataaccctgctgcactcctgtgggcctaagcttcacatctcacctgtataggatggggagcaggggtaaccccttggtgctaatgcaaggggctgtccttggaggttgctgttttctcattgcatttctaaagtcgtggtat

SEQ ID NO: 100999 - DNA, 1058 bp, Homo sapiens
cttcctgaccccatgccaagagttgggtaagcagagcccttcattcttaggtcctctagaaaacataaagatgggaagagttttcttcagatatactgtgagaatctcaaagactttcagattattagaccttattttcttccctggagtgaatatgggtataatttattcactgaacaatttgttgagtttttcagcattaatttattaatactagttcagaaatatttgcgttctacttggggtcaggttcagtagtaactaaagcaatttctcaagaaatttctagcctggttacaaaccattaatgtaaccaggggatgaaatatgcctcggaagagccagagttttaccttgtggtggaagatcatgctctggaattggagagtatgggggccaagggaaggtcagccccaccaaagaaattgagagtgttctaaaaagaggcagcgtcttctgtggggagctaggtttcaggctttttgcttcagggtcctcaggaggaaagcttaggagggaagagagtaatataggtggttttgggaagttgaaagacgtggtgggaagggagaaaggaaaggcctagtgtgtggtgctgaattttgggtggtgaccaagggtgaactaggacaaagaataattcccaaaagaattggtcccagaaatcctctagggagagatgaggactcagtttactagtagtatggatcactaaatcatgatccataatttagaatagtgaaagaggaagaatagcaaagttgataatatggttgagtgaataatttacttttaagactttttggcctcatcctgcagagggtctgaagatcatctgggccaataactagcctagatgactaaagagcctcaccctagaatcatgtttcaaaaggacttaaaagggacctatccacctcttttctcctccctcctccaaaaaggaaaagaagtctgagcattaaatgctttcccctctttgaacatatcttaatatatttttttcattattcttactttatgttctgaaacatacactcgaggccagaataaagtca

SEQ ID NO: 101000 - DNA, 1683 bp, Homo sapiens
gattctggatattagccctttgtcagatgagtaggttgcgaaaattttctcccattttgtaggttgcctgttcactgtgatggtagtttcttttgctgtgcagaagctctttagtttaattagatcccatttgtcaattttggcttttgttgccattgcttttggtgttttagacatgaagtccttgcctatgcctatgtcctgcatggtattgcctaggttttcttctagcgtttttatggttttaggtctaacatttaagtctttaatccatcttgaattaatttttgtataaggtgtaaggagataagcatttatttaaatcaaaacattctttagtgattccaccaaaatgaattctggtttcttgtgagattttactggttcatgttaagacctttggtatgttagccagctgttatgtagcttcagttggatgggtttttgttttggacctcatggtaattttgatgaacagaacaggatttttcatttaaaagttaatattagataggatagagaagcaggttacagaagtgagcaactttcagaaagacttgatcctgctcctcttataaatactgatggtaggccatactgataactgaattgcaagaagttgcaaagaatgaaaatagaaaatgatgttcaagttaaagcaatatataggctccaggatggagaattcagtgcctaatagagaagaggctcatgttctggagtgaatttcagctttgatttccatagaacaggattgaaactctgaccttacgatttagttgtataattttgggtaagttcagccttgtcaaatgaacctttatggaaatttttcctttgtgcttcttaactagttgggcattccaccacaacactgttgatgccatccatgatgtcatgagggtggtggccatcaacattgcagacacagactgggcagtagtcagtccccaggagctctttaatagttccagagagttctctggctaaagattggtgctgcatctgtcgagcagtgttgacaatctcatcaaaagtgataattccactgtgtttaatgtttttctgtttctttctgtctattggtggttccttgagggctttgatgattagggcagaggcagaaggtaccacctcaatctgggcctgtctgttctgaatcgtcagtttcactgtaatccttagacccttccagtcactagttgccttggcaatgtcatcatcaacctttttgggagacagacccaggggtcttatcctgggagccagtgcagacatggcatcgacttcacccccggtgcacctcaggtatacgactctaatctcattggggtcaaacttcagcagcatggtggaggcagcttgtgtcagatgaatccgattcaggacgactgaaagaagttgcaccttggcctcctttgagctggaagacaaaagccagccttgtttttctgtcatttaaatggaagtaatcataacatgcctcacatcataagattaggattaagtggggtaattcgtcgagtacttggtatttagtttgtcagtggcaaggaaatctttcagtttaacaataaaagtaaccatcaaactttgtcttttaccatgattctgaggtgttagaagtagcagcaaataaaacatccaccttttaaaaaccctcattcctattaattcactttc

SEQ ID NO: 101001 - DNA, 1126 bp, Homo sapiens
aaaggaaaagcagatgtatttatcccttacacatttggatcatcctcactgccgtgtcctgcatccattggctggagctagacctcacgctcttaaactaatacccgatttgctaatagcctaaaactttcctaaataggtaagtgtggggaagaacaaagaaggagaggaagttgcttatgaaaggtttaaggaagcaataacatttccaaataaggaatgggcataggctatgagctggaacgtgcctgtgagcatgtccaacagttacttaggacagggcctgacaaagagttattagcccaaaccaaggaggcttgaagaaaggtagtctttaaaagaaactactacttctaacacttatgattcattctttaacaagaaggggaactttgaagaggaaactctttactttctacacgtatgtcttattgttaatacccttttttattagctggaattttcccccaaacttctttatttttgactttgtggcagtttgtgatggttaagaatgtcagttttctggggtctgataatttaaagaatagagataaaggagataaacttgtactaacataatttacctacaactgactccactgtaatgaagcttaggagataatttttttctaaattttaactgcgttggttcagagcacttaccatttatctggaatttatggattcttcaggtaaataactgtcctatcaaacactaacccttgcattgattcttagaagcaccatttactaactggacttgcctttccctgatttagccagttagtctctaccctcctccccttcaccttagcacccgatcatgcctgctttccaactacttacctccttggccgctgcactctttgcaaacagcagtaccttggtagacatgtctctctaggacagattccatggcattttgtggttcttttaatagaaaatgcctctaactcttagagggagaaaaatctaaattgacagacattaaaatgataaactgtaattgcggtcccaaggatgattggaatcatgtctttcatttttctgtttgcgtccaacatgccatgaacttacttagaattggaactatctcactttaatcttttttaaattgcaaatt

SEQ ID NO: 101002 - DNA, 1003 bp, Homo sapiens
attcttccattcaaagaatgcttattgcacacctgctaggagctcaatcctattccagactcagggagtatagcatgaacaagacaaagtttactttgtgtgtgtgtgtgtgtgtgtgtgtgtgtgtcaggaacaggcaataagcttaaaaccaaatagatacataggaagtccttactttaagcaaaacagcatttaaggaaactaattttttttctcatcaacattgtaatgaaataatgttgattagaggacctgccttaagttgtttcacttaaagtcgttgttccactgaaaggtgtagctttttccaagagtctggacattaagtaaggtattactgtaatataatatcagggagtaataagtacctggtggaggaaaatgaaattagaataagagagtaacagagtggtggtgggtgggaggtgggggtgctgttttctgtaggctggctagggaaggcattgctgctaaggtgatatttgaggagagtcctgaatgaaatgaggaaagagtaactgggaggtaatcaagagactgaggtgactgagaagggggagagagggtggatctcaaatacagatggaaaggttacttgtccccaggagatgaggcactgttgcagagtttttgaactggagagagaggagtaatttaaaaaaagaaaactttcaaaatgttctgattgaaacttggcaccctttttcttaataggagcatccttagatggtgagtgtaagaaggaatgggagcttttatattgtttgtttttacatcattaaaacatcttcttcgtcatttacgtcttcttcctgtgacactggagggatgaccataaggacaggtagcacaaatagctgcctatagctagtcttcaccatgtggcagacgccatagattgccatcccttttaattctcctgaggccctctgaggcacatgttgtcagcattttacaggggagaagacattcacatgtctcgtcgtcattacagcccaga

SEQ ID NO: 101003 - DNA, 1052 bp, Homo sapiens
acagggtcatctttgaaagaaaagagtaaccatttgtcatttgaatgcccttccattattggttagttgacatgagtttaggagactataaaaataaaatatcagagcacactcaaaaaagaattattgaatgttaaaaacatattagctataaagaaaaaagaaggcttgaaagagaaagttgaggaaacttctcagaaagtagaacatgaagagttttttttttgttttgttgtaaatgagacagaaaattagaggtacagccaagaaggtccatcattcaaatagtaacatgagttccattaaaagaaaacaatagggagggaattatgaagaaataataccagaggaattctcaaaactgaaaaatctgacagtttccagattgagaaagaatccaccaggtacctaacctcatgggtgaaaatagccccaaggcacatcattttgaaaagatgattctaaaagctttccaaaaaggaagagatgtcacatacaaatgggcagaaatcagaattgttcagattcttcaaaataagtggtggaaggaatagaacaatggagtagtgctctcaaaattccaaggagaaattgacctccagcctgtgatttgcaacccaccagtccatccagatagaatagaaacattttcagacatgaaggtcttaaaaacttacatctcatttttaggattttctagagcattactagatgttgtgcttcactaaaatgagagtgtaaacctagagaggagaaacctaggagtccaccatggagagagactgagggagtgagtctctgggaggatggtgaggagaagtcccaggaggcagattagagacaatgatgaaggactcctgatggaggactctacctataatgacccaagagaagaacattgagcttagattgaaaggagtttcaaggttttagaggagcattttaggagaagttagtgattcatagaaaaccatgcaaatttttaaatgaggtagttattatcttcagggaaaaaaatgacacaaagtttcagcaaagtatagttcatggct

SEQ ID NO: 101004 - DNA, 1042 bp, Homo sapiens
atgttgtgtgtataagtagtttgttcttttttataactctgtttttaaaatacccccaagagggagtttacattgggagttgtgagttttttgtgtcttatatgctgttttggaaaacgggaagagaaaatgtcatctagatcatttttagcgccccaaaacatgtttaagctattttgtagatggcttctcatttcaatgttaacagagtaactttttgtttttagcccatgtgtcagtctcatatgattggcttttgtaccagttctgtaaatgaagaaactgagacccagggagatcaaataagttgcccaaatcccacaacgcttgtgttcagaacccagatatcttcactcccaagtctacaggtactgctgttctaccacaaaagacattaaaatgtaatgagtgaaaagttcttgtgttactggtgagacctcttgaaactgaatatatagagtgttgtttgtaaaaccctttgtcttcccccataagattatgacttgaattttcagggctctgaagcttgaatgggcttggctgtcaagaaattggtttattcagtcctgtgttcacagctgtgttcattcctgatctgggtcaattgacattatgacatagggaccaacaacaacaaaaaagtacagtcagattttaccttacaatgtgatatatgatagctctagaagggtctggccacttgcttctactgttcttcttaatagtaattattatcaagctaattgatttttatgagcagattaggatttagaaatgatttttttctgaccaaggaagatgaactggagttggtatttctcctcttgaattgtgcgaatgtgcctcactcatcactgaaatcaaagagtttggccatgtgacctcagagatcccattcagttctgattgtgcgaatgtggcattgtttgaggtatttctggactatagaaagcttccttagtttatacctttatatcatctcaggtaaaacaggttataggaattatagcaacataggatactgcttcaagttaatagtaat

SEQ ID NO: 101005 - DNA, 1114 bp, Homo sapiens
acctttttcccagggttagggttcagatttaattggtaaaggtgtggttgtagcccattgggtggcagaggagttccctgcttgcctgggccagagttaatacacagttgctgggcaagcaagaaaccaaacctgatgggtaggcatgcagaagggagttgggtgccgctgtggctacaaggtgcagaggcatgcagagtccgcattgggaaggccctgttaaacaacgctttgggttccagatgagccaggcctggtagctgggcatgcagagggaagtggtacatggcatcctttttaggagggctgcaggaaacaactctctgggatacaagccagcagaggccatcaggaggctattgtgtgtgtgaggcctggagtccctgctgtccgtgtctacaggagcacaggaaggtggtcaccaggcctggtgtcactgagggaccatgtgctttgtgctttgtgcatgtggtaggcagaacactaccatatgtccccacatacttacactagaccttggagcaagagcaagaacagcaaaagcacagcgcttttgaacccaaaagacaagctcccttcttcctgcgttgtccctccagctgcctctgctgaccaggtttagcatcatgtgctctgtaaaggaggaattctggagagtccagtccattattacagagctagtactgaagggtgagtttggagttaagaggcaataaattgataactggcacagaagccaaatataagagtattgactaaataatagctaagtacaagaacacagattacataattccacttttataaggcacaggacaggtaaaactaatctacattgttagaagtcaggctagtggttacttttggggaaaagcagtattgaaaggagtatggatttgtagtgctaatgttctgtttctggatggggatgctggttacacagctgtgtgcagtttgtgaagagctgtgctttctattataatgtctattatatttcattaaaatttaaaatatggtgtaacctgattcaaaaagtaaaagctttaaaacaagatccagtctagaatagaggaaatataatccagggtatctcatccttttttttttaatgttt

SEQ ID NO: 101006 - DNA, 1064 bp, Homo sapiens
acctcaggtgatctgcccgccttggcctcccaaagtacctggattacacatgtgagccaccacgcctggcctgtgtttgaagtttcaggtggcctgtgccagtggtaaaacttaacagtaaaggcctcaagggattgattcgctacatatatagtggggatgagcttaaagacaacgtatttcttacttttacttattctgtttacaaattcaaatattgatgctgtatattattttggtaattattattacagggctaattttcttcatgtacagagaatttcttcaagtacctaacatgttttggtaaagatgtttgtgtcttcctgcaaaaacatttcctgaatcattttcctgacttctgtgcagcttttcctttttagtaaattttgcttgaagaaaaaaaaagaattaatttttcctctatattaaaagaagctttctttttcatctagagaataaataactcagtaaatagagatgatattactgtttcttcaaaataattcatttcccaaagttttttttcatggtatgtagttttagggaatgagtcatagaattatgggattttatggcatagcatctttagaaaaggattttttttattttggcttcactttatagttgaaaaagagttgattctttagtttcattaatgactgtcctgtatatcttctcatgttggttgttgagtgaggtgaccagctcctcggagggacaaaccatacaatgaaagggagaaatttgagaaatgattggatttggtgtagtggaaattcaagatgaatattatgttggacatattagcacaattctgggtgcgttaatggtgttttttgttttttgtttttctgttggggtcggttccagtgtggggctgaactgtcctctggaaggttgacttctcatgtctggtctgtgtgagtggatgggccctcctttggcaccagtctcttaagtatgcagttgcagccagttggtattcacttggtatttatgacatgaaccatagcaggtgcatatgtgaagaaagcttgaggtttcttttcacaaagttattg

SEQ ID NO: 101007 - DNA, 1023 bp, Homo sapiens
ccatcttctatacatgtagtagactgctgttttcttaagttttgaaaggaaattggtgatacacttgacctatgaatctatgatatagtcagttaatgttttaactacactgataccaagtatgaggtgataatagcctgacctaagttgggaatagtggaaatggagaagagattgctgtaaatgtactttaaaaagcaaaacaaaacaaaaacccaatttttttcttttattgtactaaagattatttctttgattgtataaaaatatatgagtgttggaaaagcttgaaaagtagaaagaggcaagctgttgaactcttagaaatatatatatcatgtttaaaaacatgttttagtggtcagtttctttgaataattttcctaagggtaaggaggttggaaaagttcagtttggtatcaagacatcttgtttatactttgataatagattttcattgcttagtggaaagcacacctccataggaatgtgcagagaatttctgctgacaaggaggtatgcttaaaacatctcacgtatagtctttagagaccactagtatcagatgtttttgtgttttacagatgtaggccttctgcagtttttcatgcctcatggacggtggccagacttaggactggttatgagttcctgtctcttgtttcttttagccttttaagattttttttttttttttttgagacagagtctcactctgtcgcccaggcaggagtacagtgttgtgatcttggcttactgcaacctctacctcctgggctcaagcacctctcctgcctcagcctcctcagtagctgggattacaggcgtgagccaccacgcccagctaatttttgtatttttagtagagatggggtttcccgccactgttggtcgggctggtctcgaactcctgacctcgtgatcagcccacctcggcgtcccaaagtgctgggattacaggcgtgagtcaccacacctggcacttttttttttttttttttttttttgagatggagtctcgtt

SEQ ID NO: 101008 - DNA, 1054 bp, Homo sapiens
cttggtgtgagatgaaggctggggtaagcccacaggtaaaactgctctggtggtcaaccaaggggcttgcctcataggaaggtgaaatgggcaccttctttttgtggtttgtggtgccagcatcccctcttctctttgccaggaagaaagagagagggagaggagggggtagcggaaaggaagctttgtctcattagacagtagagcctgaaattcttgtaattcatgttactctatttaactgagtttattcatgagaatctttgagagagtgactgtagggacatgggtatttgatcagtttgctctcattaatctgctaaccaaaaggagatagagcaccacggaaatgaaataggaaacaactaagttttcattaggaaagtggaagaggagagggactaaagaatgcagtgtagctttgctttgttgggttgtgttcatggccagagggaggccctgtgtggtgagggtaatcagctgtgcaagcaaggaagccagggtggagaggctcagagaagagatttggtgccggtgccaggtagggcaggaatatgacaggaccaaataaaactgagggatccctgtcccgtcccagagcagtgaaataattggagcaaacatttattgagtgctcacgatatgccaggcactgtatcatctcatttaatcctttaacaccacatgaaattttgggttctgttattaccttcattttaccaatgaggaaactgaggcacagggaggtaaagtaacttgtttggggttgcacagttacttgttctgacatttatataaatgcagggcattgaagatcctgccttgaagcgagtgaacccactgcttctgggaccatatctgctataccatagcttcaggagcatacctttcctggcagatcccataatctttgagtcatttagtctccaggttgctaccttgaagttcactcttagaggctggtgaccataatactaaaaataacactgtcctagagaatatttatagttttttcactccctcttcataagtacagactgtgccttatctagga

SEQ ID NO: 101009 - DNA, 1057 bp, Homo sapiens
aatgaaaacccttggaaaatggtgtggcccagcttcctgagccttcttccctgcttacctctttctgtgctccccgccacaggtggggaattggtcttcttagagaagatgggtggcagagttctaaagtggaacctcacatccagtgcagacgtgtttgttcaaatcttcctgagacttggagaggctttatctggacagttattttccgttttaggattaaggccatttgagtcacccacatgcttagttaagaaattgtgatagtattaatgagactaggaaatgattttcatagccaactctaagacatctgcaacctgaagagttaggaatcttctgctattccttgaggaccactgattttcatgaccagtcattatgtagttcctggggttttaatttttaaaaaactattaaggactcctctaatctttaactattcctcagtcatatcttattggtcttatgtccttctagttttatactccttcctgggcatgctattctttcttgttgtttcaacttttgatgactctagaatctatttttccatcccaaccctctcctgtgatccaaacctttatttccagccatacactcagcagctccacctgcctgtccaagtgcaaaactgaactcagcatctttttgtgtaaacctgggcactcgttggattgttaagcatgggatggagaatgagatgatattcaaccaggggcctaggaacatgaggatcacattctttagcagcccctgttctccctgacaccccctacctacccacccccacccttcctatacaaacacgcatgcgcacacatgcacacaggaataggtgaacccagggtaaggccttgctaaccctgtcatttccagctggatgtagaatcttgggagttaggcttcatgaaatgaattcttttttgttttgttttgttttgggactgagtcttgctcttttgcccaggctggagtgcagtggcacgatttcggctcactgcagcctctgcttcccctgggttcaagtgattctcctgcctcagcctctcaagta

SEQ ID NO: 101010 - DNA, 1066 bp, Homo sapiens
cattaaaattggaaggttccttaaaaatcacggatagggctgccagtgtagcaaaatttataatgcagcagtgtctgttttgtttatggcatgagttaatgctatatagtctctccttggtgttcattacagatcagcactgttttctcattaattctgttgtaagggtggttgtatactcacaaagcagtgagtggcggtaggttgtctgggcaggtgcttctgtttgacacaagtgtcactgattatggggcacaacattttgtaacttgctgctttggcttttttgtctgactttcttctaaggatgtcaagttctagatctctgggcatgtattttgtttttgtttttgttttatagaaactgggtctcttacgttgcccaggctagactcatgggctcaaatgatcctcctgcctcagcctcctgagtagctgggactacagacatgccactgcacccagctctctgggcatgtatttgaattcttgctgtagggttttaaagaagtggaaagcccagtgtgctgaaatttagatctgatagttggacagatcctaagcttaaaaggtttggaggttccttacttcaggtttgttctcatcactgccacttgtccttggaatgctgtatgagatgttactaaaatattgtgatttcataagctacacacaaaataaccacactctgtccatttttatctgcactttgtgtctgcagcatttcatgtagcagagctctccctgtgtgttcttgactgtgttgcatatttactcttgaactaagttttgttgttgcccttatgagtgtggttgtggcagatttaagtgttatcgggtcttacacaggtcaccatcattactagattctctgaaaccaaagctactttctatcttgtcgggattgcagaagagtagagttagaaggtacttctgaagacatctatccattttcattattcataatgggatggggtcctagtcatgtaaatatttgtgaggtcacagagctgatctgtggtcaagccttgattagaattcaattttcattttgctgtataggact

SEQ ID NO: 101011 - DNA, 1058 bp, Homo sapiens
ctgacttctttggaccttttttgtcctttagcagtctcagccttgatcacttggcctgggcttggggaagaactgcatccctctggcagcattcaggcattccctggggttatcccccaaattcttccctcgctgtgatcacatgatcacatggaagccattcgttgcccttgcccttgcagcctgatagagttaaaggttggagtgggagacatggaggctcttagagggtcctcagcctctctttttcacacatctgcctctgcagatgggactagaggggaggccatggcaaatgtgcctgacattttcttgctttgaatactgcttcttactaattctgctattgcttcattcaatatgttaggaggaaaagggtttttctttcttacattgaagaagaagaattaaaagaagccctccatttttttatattccccagacttttatgaaatgctttgcaacttccattagtgctaatttttagtggagttcttccttaaaataatgtgtagttgaacataaaagcttatttttagactgctaaaaattttacagagaacatacatataaaaccaggtgttattatataaaaaggattttatattaaagttctcagagccttattatttacttaataagtcaagcaaattgccaaaacaatattagagtaatgaaaaaattctgagagtaactctaggaggtggtcaaacttaaagttattctggagattttttttgttgggccagaccagaagttgaatagaagaaaaatcagtttattttgtttaataatagataataataattagattagggaaaatacctaagctttaggcagattgcgaagggcattgacttgattatttggtttgttccttccttaagtgtatatgagtaaagaaatatatctggactctatctactttgggtccaagaaaaactatcagtattctaagaaatactttgaaggattatgtctggtaagctaagtctagatcatagattttatttacggaaagaattttacataatttaacacagagactttattatagc

SEQ ID NO: 101012 - DNA, 1351 bp, Homo sapiens
agtcgtgtgggatctaataaggcagtataattcaattttgagctcgtaggaccctgttctccaaattagggtttatggaccattagtaatctggccaaggtttctggtgaatccttggcatctctgagcatctctctggggctgtgtgtgtgccttatttcccaccccctgaaaactcctcgtttctgctggcagatccacgaacacagaaaatacacattttaaatatttacagttttcaggatgtctgaaatattgcctgaaatttgattattgtttcccagatggtatgtaagagtaccatcccaatgggcccccaattttgatgtactttgtggaaatatgtttgtggcgtttggggaaaaaacaccggggcagaccactcggttttgctccctaggctgatgtgagctgtgtaacttattgggggtctgtcccattgatttcatggcacagtcgagtttgactgtcagccaaattggaaaatcaggttggcaacctcagagagagagtttttgtgaactttatggctctctggcaacagaaagaagatttgagatctgtgtttgataaaatgattaggcatgaatcctcaagtaacatgatttatgccaagcagagcaggtggtttcatataagcaatgcatctttataaccaaaggccttgggaaaatgcggagtggtaagattattaattttggagttatttttgttccagggcagatttcatagatgaattataagttcttttgaatttaaacatttttcttgattagtgggtgactaaaagctatcctgcacacatctttccccaccgttttgtttgctttggagtctctctaatagtaaccagaccatagtactgttcttggtgtagtctggccatgggcgaagtaaatctagatctgttgcgaaattgagttgtgcttcagtgtggtatcacagtcttcctggagtcacgttttttattctgcagctatttctttgcttttcacatttagctcttctgttacatttaatagcactgcaaactctttcaatatgatcatttttacaacttttaaatattctatatctttataatttttataatttattattcatgtagttggggaagttctctgaactcatcagtgtattagttaaggcaaaccacacaaaaattgaaagacaagttagaagtgaagtgggagaaatacgactaactgctgcatttctggaagaacctttggcagttatgtttttgtatttattgatttactttttgtatatttcaaataccaaagaaaacctgaagcagaatcatatctcattagaagccacatcttatttgtgattttgctgtgaaatt

SEQ ID NO: 101013 - DNA, 1121 bp, Homo sapiens
cgagggacccgcaggtcaggaaaagaagatcctgagtggccaagcgaacggagcagcctccacccgcgtcttctgccgctcagcccggctccctggtactcctggctcccaacgggcttcttcccaaggcccagcgcacccgggagttttccagccccggggaccctgcagcgccttggatagatctccgtgaaatcaggtgtcgagctatggtgcatttattttcgggcctgtcgcccctaccatccttgtagcatcctcaaggacagggcccagtgtttggcagagattcaactaattgttacactctcgaattcattcgttagcaggtaatctttgagtgcccactaaattccagacattgatataaaacgggatattgcggtcaacaagacaaagcccttgctttcatggaataggcgaaagactaaatacaaggggtaggtagtgataaatgctgtaaagaaaatagatggaagaagaagggaaattagaccagggtttaggaattaggaaattcctaaattatgaaaggaggtatggagagtttgccctgcctggctgaatactctgtatggcgtctcattactgccccctcccaccctaaccttggcagtcaccagccctcctcgcgccctgcttgcccatcgtgttttctaagcacccactaaaaaactgattggattctgactgtagaggctcattctacctcaaagcagaaatgatctgagtctgatgattctaagagcagtttgtgggatacatttaggataagcacattttgactgtgtcaggggccatgataatgatttagcagaggcttactaactccagagagagaatatttttagcttctttgaaatcccagttttctgatggctttcagcctgtggccctaactctcttctgagtaacactcttcacttcttggcagacacaagagatttctccagcttgaaaacagaggcagcagccccctgctgcctatctctctcatctgtgtgcatttctgtcatttgactcaaggctggccaagatgtcttatggtctttctttcttgtctttcttcctcccttaaacagatatttattaggcaccaactatgttccaggtattgttct

SEQ ID NO: 101014 - DNA, 1035 bp, Homo sapiens
accagagaaagtgcaaagaatagcttcacccattctctgtcctccaggaacctagttctggtatttagggccagtcagtgcccttggtgatatggcaatgggctgctcaccaggctgagaggttctgaaatcttggaagaggtgtattgtttgttgttgcaacaaatagcttgaggaaaactaaaaatggctaaaagagtacagaatgatgtggatgatgtttttattcagggtggtctgggaaggcctctctggggagatgacatctgagcagagtgagtccatagggtcttacaatccatttcattcttcattcttgattagttgtgtaaatatatctggtataaggtccctgaattccttcaaggaggctcagacctcctccctacccccaaatactaaaagagaccagttttttctcaaagcccaaaagaaataaatttcaaatactgctcaaaagaaactttagcccctgttaagtctgtcagttgccttatgctaagtttatagtcagggtcctctcctacgagtaggtgatgaaaaggggttggaaattcacccaagggaataagtacagaggaatggtaagaattgactctggaatgagagagcaacctcctagtgttcccactgaaataaggtggctactactactaacaactcacacttgttgagtatttacgtgtcgctgagtatttgcctgtgcctggtactgggcttgacctttccattctttagcctggcacatccctccccaacaattttagagaagtagagaggtaggctatcagctgagcagagcccagtggggtttagaaggcagagatggtgaaaatgggccgctggactgtaagcttcatgaggatagggactgtatttttttttcctcaggatttagcacagtgcaaggctattatcaatgtgcaataaatatttgttgaatgaatgaatggatgaatgaatgagtagtactagcgaaagcacagaggcaggagactaggcatgtgtagaattccatgtgtctggagtctggag

SEQ ID NO: 101015 - DNA, 1072 bp, Homo sapiens
ttatagtcatgtagttaataacaaggaccaaagaagatccatccaaactatgtactggcaacatgcctgaccagctttctcctttatcaagcatgaataataggaaaaacaaaacaagagaccttgaagatttttctgagacataaaaaggagaatactagattcagaagaaaaatgtcttgaaaaaatataaaatagttaataaaggcatttactaggatgcgtctttttgtgttctcagtaaatttgaacgctgagatacaagaaacgacagatgacatagtaagattaaaagagttgctaagatgcaagcagaaattgagataaagattgtaaatacctgtaaaatccaatagcttaataaaacttgtattgggattagaagcagtaaagaaaataaataatattgcagaaaatggagttggtgttaaggaagatgcagttaagaagatctcctggaatgtagagaaaaagcccagggaaagaaggtagttatcaatggggaggatatatggaggacagagaatggaaattctgggctgtagggacaaaagatggaagcagtgtcactgcgcccaggggcagggatcaccaagtagaaactggaaaaagagggagccttgtccagcccaagttggagtcacagaagggatgcagtcaaggcaaggaagagggggaaatacccttcttcttgctttccacactgcaatcttctgccagtctgtatctctggccaaacctatcctgaagggagcggatgagggaacctggaaaatgcagcctgtatgggtcagccctactgtgataccaaataagcaacggaaagggcagggatgggcatgagggcaaaaacaggtgaaggactggtctatacaacttagaagacactttttacaacaaaaactgcctgagtcaaaagttgatttgactgacacaaattaaatgtatcagttaaatacgtgaaggccaaacatgacagtaaatggattaaattcctccattaaaagaagatctgtcttagatttggtttagaatccaccaaagccaattatagctatttgtcaaagcttca

SEQ ID NO: 101016 - DNA, 1156 bp, Homo sapiens
gttctccaacagccagggctgactagttcccttgacctggagaaaatgacatcaaatagtaacatcactcaacacctggctgctaattgtatacctgcattctgtgcccttggtatgcactgttgtctgtcctgtgtcttccccttccaacctccccaacttttctttcttgcaggaaaatccaattactaatcctggtacacctactttgcttcactttctgcccattccttaagacagtgtcattaattcaggcctaaaggaaaggatgctggattagtagaatgtgaagtatgttttcaattcagtccaattatattccaattaatttatggtaatttttacaatagagagcatttatagtagagagtactatggaggaaagtgtgataaagagagtgtgtgggcagagccccgggtgataagacctggtaccatggtggaccaccgcaccatgcacgaggagctttaatataagtctttaaacctactcgaatagtggtcttagtcaaaatgaggccatattaacgtgtgggtcacagaccagcagcagcatcattatctgggagcttgttagaaatgcagaatcttgagccccactccagatttactgaatcagaatgtgcattttaaaaagatttctggctgccttgtatgcacgttacagtttgagaagccctgttgtacaaaacagtaaaaaagaaagggaatgatgccagctgggcattcgaggaagcttgggtagaagcaggcatcaagcagaattttgaaggatgtccagatatgggtaattttgagttgacataatatggatatagaaaaagttttctccaaaatctgtatctctaaactaaatgcattttccctttcctttttcatctctctcgtctcctcttctccctctctgcctctgctcctctccgcctctcaggaacagtataaatttgtatacgaggtggcactggaatatttaagctccttttagctcaatgggatggggaacctgccggagtccagaggctgctgtgaccaagcccccttttgtgtgaatggcagtaactgggctcaggagctctgaggtggcaccctgcctgactccaaggagaagactggtggccctgtgttccacggggggctctgcaccttctgaggggtc

SEQ ID NO: 101017 - DNA, 1050 bp, Homo sapiens
ggtaggcaaagtgttcataggcaatgaagagtgcatttcaggggagggaaacccacttgtttgtgacactaacagccccccttcagaacttgccctttggagccgcctcactcaaagtcatctactcactggttgacacagggtgtaaaagcaaccccagcttcagggcctcccctggggttggctttagccactgctccaactgcatcaccattcaacctttcctctgcccactccctttctttttcccttccctttccttccctccttctttcctcttcccttcctcctcttccccttctctcctcttcccttttatctacaggtgaagcttccccaatacatctcctgcttgtcaatctctctcagagtctgattgattttcagagaacccagcttgggactctcccattggcttttctggagacaagtgggtttcccaccactgaaatgcactcttcattgcttatgaacactctgcataccaactgattggggttattactttgttgcccactgataatacataaactctaaaatgtttttccttgggcgatcattcattcataggcatttgctgttcacctgtgcttgtgctggacctgagagccacagagatcttcacacatagctcctgcttgggggagctgaagatgtatcacagagaagaccgtagcaatacccttttgctgatccagccagaggagagaaccagggtcagaagtgcccagccacagtgcccacttagcaatatgtctccaaggcaggattgggtttacttccgaaagcactaccttcagcaagcatcccccaaatgggaaggactcttacagctagagctgtagcaaagatgggatcctgagatgcacaaactggaaaatgcctttctaagtgtttcaaaatagtgcttttaatggaaggaaatgctttagttaagcccctcaatgttgatgatgatgctaatgattgcattttgtttgtttttagggatttatctcttccaaagtgctttcccacttattacctagttgtctagttaagcttggaggt

SEQ ID NO: 101018 - DNA, 1102 bp, Homo sapiens
aagagtgctgttcaatagaattttctgcagttacagaaatgtcctatatgtgtgctgtgtggtatgactgccactgaacacatatggccattgagcaccagatatatggctagtacaactaggaaactgatgtttaaaatttttattttaattaatttaaatttcaggagccatatgtggctactgactgccattttggatggtaaaggtctacaggaaagacaatcagaaaaagaaaaggtgccaatgagcctgtgtttggccagcttgttcagaagtttccatgagagttcagtagagaggcagcccttggtagaatggtgagctcagaagctgggagggcttcctggaggcagtgttgcttaaattgagacctagggaatgaggaggagttagtgaagaagggaagagtgtaacctagaagaaagagcagcctatgcaaaagcgcacacagagaaggtacagggtgtgtttggggagccacaagtagctcagtgcgtggggacagagagatgaggagagaagcaaaggagcaggcagggtccaggtgaagaaggtcttcactctggatttagactttgttcagaagggagtgtggaacattgggaaggtgagtgcccaactgtttgtccttctctgagcaaacaggcccctagtccatgctgttctctccaccaagcatgccattctccacctctccaacatccggttcacactggccacatccaggaccatctccactcttgcagcagaatgcaccagctccttctgagttgccactctgtcatggtcatccctctgtcagtgccttgcgttgtcagcctctgctagactgtggcctccctgagggcagagatgggtcccatacggagctcctcactcagacctaagaccattatgctcttcctgccatagctgacttcccagttggatacactgaaacaggagtggctcctaaaatcagaccagtcttatccaattgtcccactgggtatactggaagcaggtacttattttctctgaaccgtaagttgcttgtcgataaatgggaatacctacatcacagattgttttgaaggtcgaataagctaaactgtgtaaa

SEQ ID NO: 101019 - DNA, 1056 bp, Homo sapiens
ggcttaaacgttcatttttcattggaggtttatcactgcttatgtatataagcagttgaatgactaaccccaaattcagaaaaatgggtgtttcttggggtaaagaaatgtatgaattagaagagtgcagcaaagtggaattcagagatatggataatgttgtttctcaaactgctggtgaagagtgttcttctgatgatcgttctttacactttatgtgtagcatatatatttcccagcacctggaaatgtaatagaatattaataacaaaaaattatctcatgcaagtttcaagtaaaagaggaaaccaatattaaaattgcaaaatatctagaaaataagaacacaaaataatacaaataggtataaaataatacatatcagacctgatgggatacaactaaaacagtgaacttctggacttaatgtctactctctcatgtttgttaatctgtgtgaattaagaagttaactcaataaattagaattttttcaacagaataaactgaaaaaagtagaagaaagaaaattgggtatccagaaattaacaaaattaagaaaaacaatggcttcttcaaggaagctaggggggtaattggcccagtgattttgcacctggaaaacacacacacacacacacacacacacacacacacacaccccatcaatagagaacatatgaaaaacacaataacaacattaggtcgggtatggtagctcacgcctgtaatcccagtactttgggaggctgaggtgggtggatcacctgaggtcaggagttcgagaccagcctggccaacatggtgaaaccctgtctccactaaaaatacaaaaatgagctgggtgtggtggtggatgcctgtaatctcagctactcaaaaggctgaggcaggagaatcccttgaacccaggaggcggaggttgtggtgagccaagatcatgccattgcactccagtctgggcaacaagagcgaaactctgtctcaaaaaacaaaacaaaacaacaaaaaacaaaaaacatcacaatgacaacattaaaacattgcagcctgatt

SEQ ID NO: 101020 - DNA, 1035 bp, Homo sapiens
catacatttctttaccccaagaaacacccatttttctgaatttggggttagtcattcaactgcttatatacataagcagtgataaacctccaatgaaaaatgaacgtttaagccttgatgtcaatggaatcatagtgaatgcattccgctctaatattcatttttctctgaacagtatgtgtggaattcatccattttgatactggtggctatagtttgctcactttcactgctgtgtagtagccccattgagcgtaaatatgacaatttacttctcattttttctatgatggtccatttagattgttatcaatttttagcttgtacaaacaaatttgctaggaatgttcttgggcataatccatgataaacatgggtttatttaggttagctcctccaggatggaatggctaaaatatacgatatattcatcttttgctttataataaaatgccaatgtttgcctgaagtggcttgaccaattgatcctgcatgtatcggcaccctcctgctccccatccttgctcatgtttgataatgtcacacttttaaacatttcttacatatgggatatgaagtcatatcacctagtacttttaatatctgtttctaagattttaatacaatttctcagttctttgtgatcatccaactttataaaatgcattttctttgttcacgcttttcttttcttttcaaatgcctttttaaaattgattcactgagattcatgatttactctagatacttatttgttgctggctttgtatgttgcaaatattttctgccagtgtgtggtttgtcttttcaattgatttgggggtgccttttgaagaagagaaattcaacgttttaacacatttgattaacattactatttgtataatctttaagaagactctacctcacagtcaaaaagtattctgtctatatttttctcttaatatgaaggtttaccttttataaataagacatttattcatcaaaaattgattctgtgcatagtgagtgataggatcccagcaatttttccaa

SEQ ID NO: 101021 - DNA, 1027 bp, Homo sapiens
atgactaaggcgaattcattctcagaatgctagcttattatgtagataaaatcttagaattcatatgagaatttgccaatgtttctataataagaaatattaaaatgtcaaattacaggctgtatttcgtattggaattcttatctactacaagtgaatcttggtacaaccactttggaaaaccagaagcgtatggcaggatctacaaaaactaagtatatgcttaaccattaattctacttctaagtacaaatgagcagacatgaacacctaagtatgtaaaaagatgagcccatgaatgttcatactagccatatcccccaaatgtaaactgtttaaaaatctaccaacattaatgtgcataagttatagtctagtcatgtaatataaacctatacagcaaagagaatgaacaagctgtagccatattcaacatgatgtatctcacaaaaacaagggggaaaagctagtcataaatgaatacattctctgtcattccataagtgtccaaaagatggacagctaatatgtggtaaaagggatgaacatagtggttatctttatgaggggaagtcactggttaagatggttctcatatcatggtgatgtgttcattctttttttttttaatttatttttttattatactttaagttttagggtacatgtgcacactgtgcaggttagttacatatgtatacatgtgccatgctggtgtgctgcacccactaactcgtcatctagccttaggtgtatctcccaatgctatccctcccccctccccccaccccacaacagtccccagagtgtgatattccccctcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatc

SEQ ID NO: 101022 - DNA, 1075 bp, Homo sapiens
ataggaaagtcaaagcattttagctgaggaaagggaaaatcaatctctttccccagaaaggaagaaaagcctactatgcaaaaatcagtggtgagcaaggaaattggtaagcagaatgggaaatctaaataaacactgactatataaaaaatagtaaagttcaagttggtatatgtgtgtgtagaaaacatgatacaactaaactattggtcaaccataacatgtaaactgagagggagtttctatttaatgtattccaagatctttggattgctgtggaagtgatgtattgatactacttagacttcaactgagatgtgtgcaattttttttttagagatagggtctccctattttgcccaggttagaatgcagtgactattcacaggtgtgaacatagcacactacagccttcaactcctgagctcaagtgatcctcctgcctcaacctcctgaatagctagaactgtaggcacatgtcactgtgcctggctacaattttaactaaaagatgcagatatatatatattaatttctgaaacaggagagggaaaaaatggaattaaagagagggtaaaaaatgtttagaaatttaaacatgaagtaaaaatatagaataagttgaaaaactaatatcaaacttatcaataactacaatatatgtctacgtcattgtactaaacttaccaatcaaaggagacattgtcagattaagttgttgaaagaaaagaaaatgcaattggctggaaaatgacactggtgacttagtttttaaattttccaaattccctcacacaaacaaactgaaacagcaaaacaaaaccccatgaacaatatttacaaaacacctaggaggcaagttatccctataaattacaaataatgagtagagagggtcaaactattgacaatcaggttgtccaacaatgagacattcaaataaaatttctggactttaaaagaaaaatgaattctgtgttcattcaaggcaaaactaaatcacttgtcaaggaaagacgatcaaattattatgagactgacagctacaagatctgcatggtgtcaggactactca

SEQ ID NO: 101023 - DNA, 1027 bp, Homo sapiens
tgacacttggaattgtatgtaacatacacatgattcatcagagacccagacccaagatattccaggcagggcatcaggagtggaagggggacaaacatttccttaacttcagaaaagtaggtttgaaattaagagctttgtctttaacatgaaatattgaactattcatttatccattcattatccatttattagatgaatggataatgaatggatattcatttatccattcatctaaccacacatacttattgaacatctagtatacgccagacactgtgagcagtattgggacataaagacataaagtggacataaagacagggaaatctggtgctattagatggtatatggcagggctgttcggcctgtgaaagctacccaaataaatgaaatttgagctgagttctgaagggtgggtaagcatgaaaaggcaaaatgtgagagaaagatcttctaggcagaaggaactaaatatgcaaacacccgagagctggaagaagcataacatgttccaggaacaataagaaggccagtttggaaaatggttcaaatttagaagggccgacaggagccagatcatgggcctatgaggccatgctgaggatttcatccttggcctatgaacagtggaaaactgttgaaggattttaaacaagagagtggcatagttttgcattttaaaagattctatattctactaactagaacttggaatttattttttccttagaaataacttaataaatggtagttctatggagccagaataatgctattaacacaatgcatccagctaaactgcctattggaaagctggtcttggttgccaaataccacttacaacttggttcctataagaaaattcattccaaattccagacaacctaattacaaatgacattttcagggacagcctacaatctacttaggcttgtgaaaagcctccaacatttttccatatcaaaggttgttaagaaaggtgaggaacagacttctgattttgagatagcaaagacccttctgc

SEQ ID NO: 101024 - DNA, 1065 bp, Homo sapiens
tttgcagggtatgatgatagagtaacaaggcagatgttttaatcaatacaccaggattaatgccttaaaacgtctaatatgcataaatccataaaacataccccttatataaagagatatataatttgttgagggtcaacaatgtgcaagaattcttccagatgttttatgtgtttgattacctttcatctatgaaaaacaatgcatgaagaagctatcattaccccaatttatacaccaggcccctgaagcatagagaggttaagtacattacccagttatacacacagtaaggggagaatcgagtccaattccgatgaccacattctgtgccctgtatcttttcaaagaagcctcctttggtggcaatttacttgtggtaatgaggaggccatggctcaaatcagacttagacacactgagaaatgctttcaaaaccaagtgtatgatagatacatagtgcatcatgcttatttcctttcagtgttttctggaagggctttcagttttattccacagatgtaatctgggttttctctttttttccacaggtgtaatcttgagcaatttctaaaacttagatctacctataaaggatgcagcttagccccgcaatgcaataaatgtctgtgccaggagccaaagtggttcctttgtaccagtcggaatttgtgtctaggcaagagataccatgggttaatagggggtaacttggctttggatcaagaatgcaactaggtctgctattcactggttgtgtgttttgaggtgggatatctattctattggattcaactgatagaaactcaactaaaaaaaaaccctaatccaaagaataatttcatggttcatataatttaaaagctcaggggtggcatttgccttatgcctatcttcatttcctccctctctccctctctcccctttcccttcccactcacatcactgcttttctctttgttattttcatttgctagtgagtcccttcaagaaattggaacggtggtctggagatacttctagtctttaatggcaggctctcactgtccttcctaaagtcacata

SEQ ID NO: 101025 - DNA, 1055 bp, Homo sapiens
gcaattgttacagtccttaaatgtagcaaaggcagacctcatttagaggtgattgctgcatcctagggaccagcagcttttgctgccagacacaagttaaccacagggcgctggtgccaattcagaggcctcctagaccttctgttccccaggaggaagtagcccacagacaggaagagtcattataaaaagaggctgggggtggagagtggagggagcagtgtccctgtgtattctgcttccactgaggaggaatccaggaaagagagagtttcactaaagcccctgggattctagcagcacctagaagtgtttccttccagtggccacattgtgcttgaagcctcctgggtggggtgtgctttatgcgggagccctagtcactgccctcagaaggcttgcagtctgctaaaggacacagcacctccaattacatacaaagagaatccatattgaggaccacatatactagtattcacttaccttggggtcccagctacttgcagagagcattgtgaatgggttagcagtgggaattaaatgaaagggccgtctatagagatgtaccctgaggcaattttgctccctatgagaaattggcaatattcccccagaggacatttttggtcacattttggtcacaacctggcgagtgtgctactggcacacagtgagtagatgccaggaatgctttgaaatatccaacaacacacaagacaagatgaccctccatcacaaacagttgtttggcctcaaataccaatagaactgaggttgagaaatgctgctgtaggagaatgtagccactgtacaaaccatggaaaagcagggagagaatcactgcccaacctcgccatcctcctattctccaatcccatgcctgtacctcctattggctgaatataaccagaagttcgaaaccaagagcccattgaggcaacctgtagaagtcggcttccagaacatcagtcattgatacccttagaggttgagcgaaccagactcaacccagagttcccagtgagcctggtcctcctcagacaacaggatgggtg

SEQ ID NO: 101026 - DNA, 1025 bp, Homo sapiens
aacgaggggtgctgccatcagtacccttacagcctgatgggcgaggcagccacaatagaaggcactgttaagccatgggaggaagctgtggtcagtgagtgctcagatgttggaggccatctctgcctggagaccagggaagtgagactgcatttggctattttttttttccctatgtatggttccttttctacacttaaaaaaaagatagcaggaattggtttgaaaaactatgaaaataatgtacatgttgtattggaaaaatgcagaaaacagctaaaatagaacctcaagacatcccataataccaacgtctatctagcctctattaaaattttgtgtcttccctaacaagttttcttcttctcatctatattttacaaaacataagatgcccttgagtatactattttgtacactactcattttacaaaccaatactctcgcatttaaaaaacagctcttttgttgtgtcttgttataaaaggaatacacagctatttcaaaaagtttcacaccataaaaactacacagaaaataaagattgccatctattcccatacctgaagatactgtctgctaatagctgtatgttattttacaattttaggttcattttcacagttatatataaatataagtgtagatggacttaaacttgctatttcctcttaatacatcatagcactctttttacttaaataccttttgatcacttgtgtttttttttaacagctatacgataggccatgtgcatatatcataaattatttgaactcatttttatggatattggggttgctactatagtatatatattcatgatttcaaatagcagaatgatgaaaaggcttctgtgggcatatatatgttctagtccacttaattctttgggatatagtcctacaagtgagattactatggcaaagattgtaaacattttaagttttggtctatatatgctgttggcagaattataagatgatctctgatgatctgtgtctttctttaatcccctccctttg

SEQ ID NO: 101027 - DNA, 1067 bp, Homo sapiens
ctgacctcattcagcaggaggctgaatgatgcaactcacgaccaagggcccatgtcagcatgggtcttaggaggtgctaggttgtttagggtcctgttcattacgattttttgaaccaaagggagatttcctggaagtctgatgtgggagatccctgaagccattgatggaccaggcaagagcctcatgtgctccaagaggtgggtgaaatagctatggagccaggtggagcctagtggggctggatctgggcactgatggaggggttggggaagagaagcatgttggtttatttcatggcagtctgggctggctctcacccttgacagaaggaatgcccacagccaggaggggatggttccatctcaaggctcagggaaggaaggtgagtttggatagaaagttcagtcgctgtcattcctgaccatctcagcaatgagtcacacgtggaacacaaagataaacacatggagagggctatgcaggtggcgtgacgggcctgagagtggactgggatacagggaagtgggagaggtgtcaggcaaacctgacaacacatctttatgcctctttaccagctttgcaaccttgacaggctcaacctcttggagcctcactattgtgatctgtacattgggatggtagtgcctgcccttatggcagcgttctgaagatgaaatgagataacataaaagaagcacctccccacccagtaggatggccaccatgaaaaagacagataataacaagtgttggagagaatgtgaaaaaattggatcctcatacactgttgttgtgagtgtaacatggtcagcctctttgaaaagcagtttgggagttcctcaagaagttaaatgtacagttccatgctcagcaattccactgctaagtccatatccaagataaatgaagacatacatccacaggaaaccttgtacatgaatgctcatagcagtagtattcatgatcaccccaaaatagaaaccgcccacatgcccatcagctgatgatcggataaattaaatatagcatatccatacagtgaacactttttccacaataaaaag

SEQ ID NO: 101028 - DNA, 1059 bp, Homo sapiens
tgaaactgtaaaagaatgccagggcttgggcaacctccatgcagccataataaacaacccttccccaggatttctggattgttttaccatgtataagagtaatcaagttcgaggttactgtagcctaatattattcaaattgtcggtcaactctattaatttcataagtacaattttttagaaatatattcagcattaactcggtgactttccttaaaagccaaagaaagagtcctcacagtctagtagttaataattagttcttatgagttatatataactacactgtatgcaagtccttaagattccaatgtggacactcagcttgcagaattcttggtgacgatatcaagctggcagtttacagatactattcagcaggtgttttgaactccatctggatctcgttctaccaactagacctagaattccattagctgaaagttggatttttacttggtcttaaaacaaaaaataaaataaaatctaaggcttcaaaaaagagatgccacaaactgtatgtgtaattcagattctagcatttccaaatatgagaattattaccatggtatttgttcaaatgtaatcatctgagcatattactacacatatctgtgactcctattacaagcagttttagcaacaaaaataataacaatttttcaaggattataagttcatgtaattgcacatgggagaaaaatatggatgttaaagcctcttaaatgtggaaatgcagcacattgttgcctattatatttttcaggttcttgttcacgaatttcatcttaacctatattcttttttttcttcaattttgcccttttgtgcatagatttcaggaatataattaaccattgcatggaatttaaaatatttcttgatactggagttctctttgctatcaagtggttatttcaaattttatttacatagttattatttttcatctggggacacattcatttgttttcaatgtagttctaagtgtgactttccaaagtttatcatccatccattcatactgatttaaaataaaattaacttgttatgaaacct

SEQ ID NO: 101029 - DNA, 1041 bp, Homo sapiens
gttgtagtggaattagctgtaaccattcttaagtatctcagtggtgtatcgtggtagtatgtaacccaggtatttttgttgcttggaaatattccttgtaaggttattgaaccactatgctgaacagagatgccattttcttgattattttcaaaacaggcctttggtaaaattcctcattgaaacctgattatgaaacttactactttaaaaggacataatgatatgttactaaactgggtaataccttatctcagctttgcaatgcaatattcatccataaaaataattgatttgatcctgctgatgagacttctctctttccacagggtaaatgtaagagtttccagggtttttgatctttataaatgatattcaaagtactttagcagcccccgtggacttatttgctgatgatcatataatacattttgaaattcaatcgcaagatgatcatctcaataaagatttacagtctattgcaaactgttgccatgactgtgtaatggattttacatgttgaaaacacaataatctggctatcaatataaaaattatgagttggaatgcaattgtggtattttatttttaaaaaacgttggtgtttaagttacagctaaaatcttgaataattcacattttacaaaatgtgtcatcaagaagataatcttccttcctgcatcgccactgatggtggaatgttttttgcctcgtaattaatttttaagagaattccagggctggtatctatttgtaggtggtgtttattggtgttggtagtctgagattttcctccttttcctattctattattaatcacgctggaaatgtactcattattttacaaaacagaaagtgagagagtatgtagagtggaaggtataatttctgcccagaggaatttacaggctgggttaggattccaacaaaacagcaaaaaaaggtaaaacataaaggcaagcattgaaatagcatgcttcatggaggaaaaacagcgtcagcatggaaagagaaatggtcttagaatcatcttgggcggtg

SEQ ID NO: 101030 - DNA, 1049 bp, Homo sapiens
ctgccgttagaataatctggttgccccatttctgggtccttttggtactccatgggttaaattggttgtattctgctttcttacctgatggacatacgggcttcagttttcactgctctgcttaatcagttaccatttgtccaaccatttttcttcctccaaaatgtttgcatctctcaattgctgtcacttttttccccattctcttggtatatatgggtttgtttatgtctttttaattcctacactgtcattttggtgcatttggaagaaaatggaggttaatgcatgtgtttactttgtgatgtttaattgaaagttgaactcttctcaagtcgtttttctatatgtagattactatttatatacacacatgtgtatgcatatgctcatacgtttgctaaatgtatatatatattttacaaaattaggtgcaagctataagtcctgttacatggcttttttttctcatttagaattctatcattaacatttttatgtcattaaatattcttgaatgcttggacttttacatcaattaaattatatcatattgccgtattattacttatttaattacgtccttacacttgggtgttgaaattgctttcagtctttcagtacagtaatactgtcgtgagatttttcacctaaatatttgttatgatttctcattatgtcttctagattgggattattcaattggtggtgtgggcattttaatgtgatatgtgattcatattgtgttatatgattcacaacttgataatgtgatacgtattatcaaattgctcctcagaaaatcattgagacaactggtagtccaagcatcaggtaattactcatttactatttgctaatattaggaattatcactgtttcaaaatcttagcttatttgataagaaatgacactgcatcctattgacctggtttttccttattatatagccaaatatattttatgttttgtcctctgtgaattatctgttcataaacatttttatattttccatatatgtatattataagcttttttatggagaaagg

SEQ ID NO: 101031 - DNA, 1001 bp, Homo sapiens
ttatatctttgtccctaagaacctaaacatcatgaaaatatccatatcaaactggctgggcacggtggctcatgcctgtaatcccagcactttaggaggcccaggcgggtggatcacgaggtcaggagatagagacgattctggctaacacagtgaaaccccgtctctactaaaaaaatacaaaaaaaaaaaaattagccggccatggtgccaggtgcctgtagtcccagctgctcgggaggctgaggcaggagaatggtgtgaacctgggaggcggagcttgcagtgagccaagatcgtgccactgcactccagcctgggtgacagagcgagactccatctcaaaaaaaaaaaaaaattaaaaaaaaaaataaacaaactgagctcagatatgtgcattatatgtgcaaaaaatgattgatataattaacatgtaaagaggttttaaaaatcagtaaaaggaaaaataatccggcagacacacatcagtgttggtgagacctctggcaaccaggtggccatacactgttggtataagtacaagttggtacaatatttagggacaacaacttaaaaagtttctgagcagataaatgtacactttatgtcttcatgacttcatgaaattctgggtgtgtgacctatgacatggtgcttgacctcccagagtgtcagttattccgttcataacatgagaagataaatcaacttgcttcacaaagtggctgtgagggtcatttgggatgattggcccaggaaatcattggagttatgaaaccctgagaaaatggtgtaccttcttgattaatgtggggttgtcacattttgcttctcttccccacccccagccacttgaacgctatctactggagtcccttctcctgacgctgcagctcattgaggcacaaaggagagagtaagagccctaaacctttgtcagggtaagcagggctgcactgagggtgggtgctcagctgggctcagtaagtatttagtaccaa

SEQ ID NO: 101032 - DNA, 1021 bp, Homo sapiens
agaatatacagctgccagataaatgggaaaacctgtctgtgctaatatccacatagatgcttgccttgacactcagttttctgtgacatcatacctagattcaaaaagtattatattccaaatggtgtaatgggaagtgaaagtgatggagactggcatcgttcaactaaaaaagtgcttcttctgatgacaaacactgctgcatttgacgagttagaataaaggggttgtctgggaggcagaggttgcagtgagctgagactgcgccattgccctccagcctgagcaacgaaagcaaaacttcatctcaaaaaagaaaggaagaaagaaagaaagaataaagaggttctaaagtctatgtgaatggataataaaccactatgtcttttaacctaacatgtgtataccacttcctggacagtgttctaagggctttacatgtttttacatcgtttaatacttcaacaacactgtgagctggatgttattatcacccttattttaaagaggaggaaactgaggcccagaatgtcaactctctcaaaagtgagttacagtaaatggaggagctgagatttgaattcaggccgtctggatccagaatctgtgccctgaaccactctctatttttcaattaatattttatgaaacgtgattttaaaatgtatgtgtaattaaattgtatattagataccataagtggacttttgcctaattcaatcatctgtacacttaaaattgtatttattaaagttgcccgaaaactttttttttgaggagaggatgtcttctcactggaaaaatggaagaaatgctttacttttaatggagggttgatcctgtcagtttgttgaattgtctaagtctgtcagtgtctctgtaaatgcagatacagtgaacctgcatgttgttcggagtaaattctttgaaaaggaagcatcacaaaaacagtcgtgtgtcagcgacacatttaacaggaccacagagatgacgttcttcaagattcctctgtttcctgctg

SEQ ID NO: 101033 - DNA, 1326 bp, Homo sapiens
aacagcttttctcaatctaaagttaatgtcatcatttgtcatgaaaaattagaaatattggcatagaatttgctattaagactaagttgtctgataacctcatcattcaatcttgaaaaggtaccataaataatggctgttgtgggttgaattgtgtcctcagaagaagttattttgaagtcctaatccccagtaactcagaatgtgaccttatttggaaataatgtctttgaagatttaatcaacttaagatgaggtccttagggtggaccctgatacagtatgattggtatccttgtaaaaacaaaaaaaaaattaggcagggagacagaaaagacaatgtgtggagatgcaggaaagatgaaggattggagtgatacatcttcaagccagggaatgccaaatattgccagcaaaccacccaaagccaggggagagacatggaacagattctccctcttctccctcagaaggggtcaatcctgctgacacattgatttccagcttctagcttccagaactgtaagataatacctttctgtcgtttaagccacccagtctgtggcactttgttataacactcctcagaaatggatatagcataacatttattcagtgttcattctgtgtaaggtacctttttaagcactttgtatccatacagtcgttttaatttttacagcaattttgtaaagaagagatgattgtttctattttactgatggagagactaaggcacagagacattggcaaactttcccaaggccatccgtagtaagaggtaggataggcatttaaactcaggttgtctgtttcctgagctagtctctagcactagcattaattatgccatgttcagatccataataattacaacatgttgatactgatatatttaggcacatagatcagtggaacagaatagaaagctcagaaatagagccatgtatttataagcatttcatataggacatccgggagtagatggataattttaatgatgctgaaacaatagtgaaagtgttttaaaaagtaaaataaagttagattcttacactatgtcatgcattaaacttatttctagaggaagtcaatatttaaatgtattcataatttaacaaaaggatcaagaatgatacaggtgaatatttatttcttctgtagtatgatacgcaagtatctgatactctatgtaggcatttctaccagagtgggaaatgatttgtatttatactcaacaatgtacatgtaccaaaaataattaagaggttaaaagaaactagagaaatgtttataactgaaaatgtagataataagttaatgtgt

SEQ ID NO: 101034 - DNA, 1091 bp, Homo sapiens
cagtttggttcatcgatcaagccacctgctctcctcacccacgctgatcctgtccccattgcaaccaccccccttttcccattgcaatcattcccgttgataaaatctttccttactactgtacaaacttgcacatttttttgacactgtctctagtttagaaggaagggagacaaagaccaactttcatttgagagttcaaccgtttatgaggcatgctgcaatcaggggtcagacagtgcttgcccagatgaaaaggactggtggtactagcttcgagttttgtgtgtgtgtgttctgtcagatctccacagaaaagatgggcaaaaagctgaatctgggtgccctaaacacagcctgtctccctcttctagtttctttccactcctcaacaccagaagaggccctctcagctcatgccgcaccacctatgcaactcactaaacagtaaaacagattttgcatagcaaaggacatcagcttctcccacgtctcagggactaagggccaacaccaggaggcaaagcaggcaaatgaaagctcatttctctgctacaaaatgaaacacaaaacactcctggggaagagtccttctctgtaggcaccagggacacccatcacccctccagcctggggatcccccagagatggcataaagggacacccatttatttggtcgggcagctgggaattttaatggaacatcttaggaaacgttactacttggggctttgggctgggggagagctagatggactctttgtacttcctcttcttgaagctttgctctccttactccattgagtatggttgtgctctgtaatctgagcttcctttgaggactggaacacaggtctacagatggatgacaatgggattatgagacccagcctcaaagacatgagagtgatggctggtctgtggggctgccccagagatgccagctggaaaacgctaagagcaggtggccaagtccttaacaacttttccaaaaacaggggttctatgtgattccgacctggcaagcatagattcacatccataaaacattttgcagcacagactatgtgccaagcctgtgccaagtgttt

SEQ ID NO: 101035 - DNA, 1049 bp, Homo sapiens
gaggcaggaggatcatatgaggctacgagttcaagaccagcctgggcaacatagtaagaccctgtctttgcaaaataaaaaaaaagccaggcatggtggcctgtgcctgtagtcctagctacttgggaggctgaggcaggaggatcacttgagctgaggagtttaaggttacagtgagctatcagtgtaccactgcactccagcctggacagcagagcaagatcctattcctaaaaaaaaaaattaattaaatagaaataagtaaaaaaagtaaagggaattgtgcacaagggtagaagacttgaggcatttagggaacttgcttggtaccatcacattgcaagtgctcttagtggagttttgttgaatgaatgatatggagctgaatgtccaggggcccaaatcttctgaaacaaagacctgcagtggcagggatccagccccctcagctgatgatgatgttggcatcagaagagggacctaggagggcagttgggtggttttccatctcactgatgctgcaggctgctgtcaaaagttgtcagtgcttccaaagcagggctcatcttcctcatcatcagtaagcactccccaagtcctttccctgtcctcttccctcctttatcagaaactagtccggagagattatgcttaaacttttcccagatgactgctttcttggatgggaaccaagcatttgaatggcagccgcctacagccaggcgtcctaattgggggaccatttgcagccagatcaggcactgagatggggacacagaacttgcagtaatgggtcattccaatacccatttagtaatcaatagtggaggagaaatttcaagtacttaataaattgtttgctaacacattgtcatggcaactgctaatccttaggtttcaagaatgggttcttgagttgctttgtctgatccacgcttgcaggagccaaggacgcttgtattcctacaaacatcagaccaaatattattttgcagaattgatttaaggggaaaatgttctccgctattttgactctgagggctgtgaga

SEQ ID NO: 101036 - DNA, 1036 bp, Homo sapiens
aaggaggcagcatgtgggggtgggggaatacaaatgccacaaaggtattagggggctggtgaatggggttggtcactgttttcggttcgtagggctgtagtaacaaattaccatccatttggtggcttaaaacaacacaaatttgttctctcacagttctggggtccacagtctgaaatcaaggtgtcagcagggctgcacttccttggaggctctaggggacaatcagttccttgtctcttccaacttctggtggctgtcagcgttctttgtggccgcatcattgccctctctgccttgatctccacctggtctggccttcttttccacgtgtctgtgtcttttcctcttctgttttttataaggacactcgttactggatttagggcccaccttggtaaaccaggatgatctcatctcaataccttaaataattaaattaaataccttaaattaattacatctgctaagacccgttttccaaataaggtcagattcacacgttcaagagattaggagatggacttatcttctgggggccaccactcaacccactgcagctaccaaagggatggagcagttcctgttctcagggtgtctttaagtagctacaagaggaagggctgggctcttgcacaaatgtcacagcaaacttgaataaactcatcgtctgctaaagagtcatatcacctcccgaggtgcctttccaaagtctgatgagtagataataccagaccaaatgcctctcttaaagaagttgttgtaaaagcacaacaaatggaagttaaagtggaggaattctttagaaataaagtagaaatgcaagtgactgttatttgcggagaatctaattttctctgacagttccgcaggtacactgaaacaatctcttaaggaaaatgtattttctgaagaaatttctccttgatttttacgaacttttctctgcctgatgatcacgtacaatggaatgaactacagccttgctctatttttgtttttcctccttgtttgtgcccagctgccgttaataatg

SEQ ID NO: 101037 - DNA, 1057 bp, Homo sapiens
tgtactaaggggaatgctggagttggattccacaggatgctgcagaggggagtgggtgactcaggatgagtccaggtggaggaagatgccagaatgcttaggtctattttcatcaaacgctggtcgtcctaaaatggacaggtggaggctgcaggaagctggtttgctttggagacactgggaacacctcagtgagtcacagaggggctgggaacacctcagggtctgtgccctcccacctaatcgctcttgaaaatgattctggtacagaagaaaatctggcttgaggccgctcccatttcctgtggccttaggaaggtagtgtgtgtacaatgacatattcgttggcatagtgtcagagcttcatattaatgtcaaggattagttgaatatcatattaagatcctttttttcctgctgctctgttcatggaatgaatgatcgatagagatgaatgaaatgatccgcggtaacttggactcactacaccattgtactaattttatgtccctgttgtcttgccttttgaggctcctgtggttcacggtcataaatgtagaccttgtgttctgcttctcttaccctcattcatctggctccagccttgctggccacactgctgggctgctccttgaacagggaggcgtaccttcaccttggctgctgttgatacctgcatcaaccttcccctggctctggggggcgcactcctcatccccccgctagactttgaacatcttctcagtgaggctgagtctgaccattctatttacaattatggcccctcccctttacctctgatctacttttaggttttcttctctgtagtatttaccaccttcattctatataattttaaaaagtctgtatttttaaaaaagtgcattgtttttgatctgtttcccacccctacccccacaagagagtaagctctacaagagcaggggtcttggttctgttgggttctgttctgttctgttggccactgtatccccactttatttatttatttatttagcaacggagtctcactctgttgcccaggctggagtgcaat

SEQ ID NO: 101038 - DNA, 1064 bp, Homo sapiens
cacatatatgtgtgtgtatatatatacaatctgccataagaactaaaactcatttgggcctttcagtttatttacatatgaatacaattaaaatactcatgataaagaaaatattctcggtcctctttctttgctcacacactccttggaccagcatttcccagactggtaaaccaagacatatgacatgaacaacctgacttatcaccaaaactcaccaacattagcctaaaatattgcatcatgccacctttctggtaggattcagtacctctctgcttggtgattgccctgacatcgcttgtcacacagcgaaataaccaatttatgcgagtaagccctgttgagatatcctgactcaaatagaagagaaactgtctggacacaagcccaaaacacattgtcagctctccactcagtatagtcttctcagtgacagacttgagtcagtgcaatttcatccattaagtaacgggaatagtagaaaacttttgggatgttattctttggattataatttaaaatatgtgtggcaccggtatgtattcatctgctatgtatttatccactcccatttcattgatctctccctaggcacataagaccacctcatttctgagcttctcttgcagttctatcgagaccatgtgactggattccaatcaactgcatgacttgtaggccacttccaagccttaccataaactccactctaatgctccacactttttctcttcttccttccaggctgaactcagagaccaaatgtcaatatgacaagttagaaggaccccagagtcaccacttgtgaggtgccacaaaacctattttgaaatgtgacttgaattagaaatcacctttgtatgtatgtattaacccattaggactttttttttttcctgctccaaaggtgagtaccaaatgaaaaaatacaaaactcaggtgctactggaacctagaacaatacaattttttgttatacaggctgtctcataccttagagagccagatgccaggcacacatcccaaccaaaaagccactgaaatgttagagcttattggta

SEQ ID NO: 101039 - DNA, 1067 bp, Homo sapiens
gaatggatcagcaggaatgtgcatttgaagttttaataaatattgtcacatttcccaatagagggctgtaacaatatccattctccctaatcctgtaaaagttttccactccttaaactcttgatgatagtgaatatttaagctttgctaacttcaaatgtgaaaaaaaggtgtatcagtttaacttgaagttttgaatccatgagttttgtttgcgttgtttttcttgtttatttgctttggttgagtgctttccataaattacctgttcaaatcttttgttcatattttctgttgagttatttgactttttggttggttgataagcacacttcacattttaaggatattaaccttttatcatatagactgaagattcccaccccccgccattttacatttgcctttcaatcttgtttacgatgtcttttgcaattcgaaaactctcaattttaaaaaatgcaatcagtcaaccttttcttgtatgattttatgtcaccctcaaaatagtcttttcatccttcagatcatgggatacagtcctgtatttcttcttagatgttttatgtttttctttttgcatttaattacttaatccatttgtaatttattctgagtttggtgtaatctggagaatgtaatatttttttcaaatcatttagccaactctgaacgttgttttccaaaaaatgaacacagagttattgggttgcttggcctttatttcttattcctctgggtttgtgagaagtttgttcttaaatagataacatggtaaaggaaagggccctgggctggttcttcagaccttttggacccttagatgttctaagtttgaatcaagctgtgagcccgtgggcaaatccctcaacctctctgaactgcagttccttcagttgcagaataggaaaaatcatacctagggttaagttaaacagagagtatgatatccccgacacatccaggcacgttaggcagataccacctgtgacacttctctagttgctgtcctgagatggccacatggagggtgaattgccctttctaggggaatctgagccctccca

SEQ ID NO: 101040 - DNA, 1059 bp, Homo sapiens
gtaggagggaaggggaggatatgcagtaatgacatgcacagatctgctttgatctcaggcctgacgctctgcggggggctaagataagagattccaattcccctgtggactcttctggaactacagaggcattagctttcctctgtttatcaagtgaacataaacaggtacaaaaatggtttcccttctcccttctggattaattatatatatttcccccctcagattaattaggtttatttgccactgttttttttttttttttttaatgaaaagatttgggacagtgggtgaggggcatagagaaaatttagataatcaccgaggctcttttgctcccccaggacctcaaagcagcccttatcagcactattcaatagaattttgtgcaatggtggaaatattcttagacctgacctactcaatatgttacccactatagccactggccacatgtgaccactgagcacttgaaatgtagacagtgcacctgaggaactgatgtttaaattttgtttcactctgtgttgatgcaggtccaggaagaaagaacaaaattctggatcagctgcatacatgttatgtgcctcagacaagggactcaggtttctgtgctttagttttcttaagtgtaaaatgggagtgataatggggtggtatgggtgatagtgcctggtactcatagtcatgcgtggtgcctgtgatgatttctggccgttctgccccaaatctcaggtcacctattgcccagtcttcactgagctcccttccaagccaagttctgccttgactggggcagggaagaaggtcatggagaggctttgtggttggggagtacagttacctaatgcagaaacccctgagcagcaggatttcaaagtactgatcagactcagaccccaggtgtttttgagaacccatgaaagggcattggaggtcttcctcttcagagacagtcccttatattgtccttttggttggtcttccctgtggtgtggcccctgtatagagatattcataccttttgaagataaataccaaaatgtatggggagaatgt

SEQ ID NO: 101041 - DNA, 1690 bp, Homo sapiens
cagggagatcccataattagtctaatttctatagtcaaattgtgacacagcaggtccttgagcctaggtcttctagctcctatctcatttaggatatatgagcagggcagggatgaacaggcctcatgctgttaactaaagcatatttagagctgaaagaggatgccagttgcccccaggaaagcttatttgtcggagtgatttccccgggaaatacttgggcaggagaactgaaagcctcatgttaatggtatcatttagggtttaaacacaaagccagtctgcacttgtctgtctggtcacataggctcagcaggaattgagttgtatgcaaggaatggattctccaaagccttgggtctacctgtgtctgagatgtttggattgaagatgataatcaggttttatactttttttcctcttgtttatactcctttttactgtcttcttcttgggaaatacattggcaagatagtatttttcagatgttgaagtagagagatggctttgtgttttgagctttcaaagtaagtgtgtctacgtatgtatgcatgtatgtatgtatgtatgtatgtatgttttacatggccttttatgaattcaagagatcatacattagatatataaattgggtctgctttatccaaaggatatacactttttcttattaaaagcactgacagaatgctgcgactgtttgaatttgaatgttaatctccacaatctgctctaccaccatggacctggatctagaatggtggggctgagaggtgattggtgttcttttcttctgttcctgggattgaaggagagatggagaacagggtaacagcctctgaagcagaaccagctgctgaatattcatttcgttctcttgtttagctgtcaggttatctgtgttgaccgcttcatctgacacccctgctgctcttgggagtcaggccaagggtgttgtggggaagagcagggcagatgtgttacctgtgatggagggtggctgggcagaggcgagcaggtgtcttcgtgagggtcacttgcaggaagactgctgttggtcagccacctctctccccccacaggcccaaggacaggacagggcttctctccatgtcataaactttgttaatcctatttgcctctctgttgtggagcagatggcaaaaatacattagaaattcactatcgccagaaaaataaaagcagaaacattttttccccaggagaatttagaaaaataatggccaatattcttagacttctctatgagggccaccaacagcgatcatttctctccccttagcctctctcaaatatctgctgtttcccacccccttggcccactgcctggggccaagcccacatctgctcatgcttgcttagatgtctatcaaacatctttctaggtgggccccctgaacctctctctatattgccaaatccgggttgccatggggccatgtctaagattccatgactggttgtgccaccctgttgtgcacccccttccctggctccctaggacccatagttagcctgccagaaagggacttaataaccactggacccctgacagtctccccagccagggctcgtggactgtctatccaccaacccctggcaccagcctcttccatatatctgcatttctcaggcatggtccatcctcctgagcgaccccttcctctctttt

SEQ ID NO: 101042 - DNA, 1053 bp, Homo sapiens
atggtggatggagctgccactcatgggttgtaatcagctctgccagatttgtgtttagagaaaccacccgggtagctggtgcatggggtaggttggaggggaaagcccaggggcaagggaccaaagaggagtcagccgccatgatccagatatgagcactgatgctggcatccagaacagtggatctggggacagagtggagggggtggatgtgagatcacagaggatgggtgagtgatggggaagagagagaaggaacacaagaagagaactttcaggccaagggaatacatataaatggaattaagtcatacgtgttttggggctagtttctttcaattagcatattttcaaggctcacccgtgttgtagcctgtgttagtacttcactcctttttttttttatgtctgaggcatattccatcatatggatatgccatatccacctttgcctattgtgaacagtgctgctatgaacgtttcaggtacagtgttttgtttgaacatctttacattttcacatctttggggtctatacctaagaatgtaactgccaggttatctggtaattctatgttgaacttagcaaagaaatgccagaagagacaaatctgtggagatagaaagtgtgttagtgattacttaaagctgggagcatttggggagattgaaggatgcttagtaaaggatatggtttctttttgtggtgatgaaaatgctctataattggctgtggcaatggttgcatagatctgtgattacgccagaaactactgagttctacattttaagctggtgaatcatatggtatctgaattatatcttaataaacctatttttttaaaagggaaatagaatgacctcatcctatatgaagtttttcacaaagcattaataaacttgtagattcaaatgtaaacacacccattgaagttcagaattgtgcaattatttgcacactttttgttgcacaaacaagattgaaagctccctgagggcaggggccacacctagctttttgctgtgttcccaacccttgcatggtacatggca

SEQ ID NO: 101043 - DNA, 1460 bp, Homo sapiens
gcctcatcatttttaatgttaggcccaaggtaatatttaatgaggctgaaaagtatattaataaaattgcttgtagtaattagtgggaaattgtaatggtagggtgatggggagattttagaaatcaggagtgatcaagaccaatctcaaatgtcactatttattattttttgctttcaatcatcatgaacaacacctttgcatttttatctttgaaaataaattctttgattgggctcacgcatattgctattatttcatgctattttgtcctctaccaagtatcatagagagttagaactagatgggtctttagaaaaatctgtaaaccttcctgctgtctttgctgctccccccacccccactggaggcaaatggattatctatgattttgcctttatgtgtcttacctgaaaagaggtgctgtcagggactacagagtccacaagagcttctccaaacaagagatcagaaagaaaagatcagtgtgttcaggattccagaaaatagaaatgaaggaaaaagcctaaaagctcagatttgggaggtagagatcagggaccaaggttgtttttttttttttttttccccttctttttttggagacagggtttcactctgttgtacagactgaagtatagtggtacaatcttggcccactgccgccttgacgttctgggctcaaaccatcctccaacctcagcctcccaagtacctgggactatatgcagatgccaccatgcctggctaatttttgtattttttgtagagacgaagtttcgccgtgttgcccaggctggtcttgaactcctggattcaagccatctgcccacctcagcctccgaaagtgctgggattacaggtgtgagccattgtgcctggctgggaaccaaggttttaagatcaaggtcctaaaacctttgtaatgtctccattttgatgcttctattaactcttctctaccagtccctattttgtttctcaagtagattggaggtgaagcttctaaaatgaacaagactccaggaaggcaggacttcctattcttaccctggtttgggacttgagctgaggcttcttgtggtttctctattgttgctattgttttcaactctggagtttgattttgtcccttatgagactaggcgagtctgaggaaaaaaagcttaaggaggccaagatgttttcaatatctgagacaatagttatttgttggttgataaataggtgcctaagttattgagaaatatgtattaatttcttagaaatatgtattaacttcttcctccatttcttctgttcctttctccctcattttcattgggaaaatgtgcaaggcaggcttggtgctagttcatggggttatagcggtgagcagatacagctcctggtttttagcagtagttaattaaacagtcctcaaacactgtggagagcaatcgccagggtggtggccagct

SEQ ID NO: 101044 - DNA, 1052 bp, Homo sapiens
aaaactgcagcaccttctgaacagacaaaaggagccactgatcagtctgataattggagcatggagagatgtggagcacaatttcccttggttattcctggtttccatctcactgatgaccactttgttattttgcatgaagcgtttattgcttaatgacatattgttcacattacaataccatttctgagcaattagagcagttacagaggcctgggcctatggtgtggggccgtgttaaaatttggaatccatttgttcaatgtcattttccatgttggggcagattttctcttgccttccctctctcctttccttccatcctcttttctctctctctcttcctctctccttctttctttctctggctctctttctctcttctctccttccctctctctcttcattgttctctctccccactcactttctcttcctccctctttcttgccctctttcacccgatctctctcactactttcctcatatctctttgtctctctgtctcatttctctctctgtgtctgctctttttttcctcccctcttactttttttattatgtaagataaagcaactaccagggatctaagttgagaggcatatggcactaagaaaaggtcactgggcactctggaagccctgatggtttttgtacctgtcctgcttctctccagctgtgtgcacaagggcaaggcatggaaacctctgcacaccactgcctctgtaaagcgtgagtgatacttccttccttgcctgttccccttcttgtttttttgttcatctcacacatatatactgggtgctttctatgtactaagcactgggttaggcattgagtgggggaacaaaactgacttggctcctgacctccaggcatttatagtctagaaggaagacaaagaataaacaaataatcatgtgactaatggcaaaggtcctgtgagtagcccctgaactctctgcagttatcatattcatgttgcccaatctggaagtacaaggcatatttcccaactcagaacctggtggtccagggcctttgccatcact

SEQ ID NO: 101045 - DNA, 1469 bp, Homo sapiens
tggaagacatggtttctggaaatcttttgtctgagagaataaactggctggtagctattttttttaaggcctagacttttgcagatataggggtatatacagagctgacaaggtggactgggagtgatagagtcagggacaggagttccagtcctggttctcttgcttgctagatgtgcaacttgcaaattgctttaactctatggacacctttttttccccaactgtaaaatgagaggtctgcctactctgagctctttgactctgtaggaaaccagaagtcagcctggttcaaccagcgtgaatctatgaggcaacatcaccttgtcttccctcttagacctttcctggtctctttcatgtacatgtgagcctctcctttcagataacttgctctcacctcatgtgaggtcccaccttacctgaacctctggctggtgtacatcatctgattcattgtgctaaggtagcagatctcctttgcatagttctgggaaatttcattttcctaccaacagatctctgggtcatgtccttacaagctggctaactgccttctgtgagacactccctcccccactgggtcacatacagtggagaggtcaccaaaatccatttcctctttccttttaagctctagtgagaatactttactaggcccttttgtcattaggtatgggcctattttgagttctggccagtgaaatgtgagtgaaagttatgtacaaataccactttcaggcctggctcttgtaaatccttactacatgtgatttgcattctcctcccttgactacggaagactctgatgccacagagtttggtggaattataggatcctagatctgtgaatctatattggactgtggcatgaacgcagagaaaacgttcattgttttaagccaccaaaatatcaagatttttgctgtagcagttatcctgtgctgatgagtgcacctcttgtgtgcttggggcaggagatgcaaaggggaaggagatggtttcttcttttggagtttccttcagtttagagcatgaccctttaagagtgtgggttggaagagaggaagttttgaccatggatagaaggatcatcatcaccgatgagggcaagccatgtccacaacagaggaaagggcaaatgtaaagacaggaggggtcagggtaatataagctagcatccagaatcatgactaagtctagaaataagctctgttttctcaaccaagggttgggatttatcggcctgttggatcttgacactttccattaaccttttctttgggagacagtggaaaaagctgtactcagaacctcatgataagcaggtggtggataattgaagtgttaccagaggtggcttgagacatgtgggcttcctccttgacatcagccagctcctgtcagctcttgacttccagaagacttctttgaacttgatgtttgttgagaggaggggatgaggacac

SEQ ID NO: 101046 - DNA, 1060 bp, Homo sapiens
tgagctgtgcagcctgttttcagattgacaagtgggggacctaataagacctgccttgttgagaagattgagataatgcacatgaagcccttggcacaacccttaggagattatgcagtttgtagtgttgggtgtcatgattgccacaatcttacactctttttttcttgacccaaatctgtttattcatcaaattccactgaatgctaccattaattgagtggaggtgaaattaaaaagtgggctggggccagatcacattggtccttttagccatgcttgatattctgaaccttctttggcaatgaggaccaattcatgttttctgagcaggaactggtgtgatcccatttgtagtttagaaccagcactctggagacacttgggaggcaggacaagaagtcccattgggagctggttggaaatccagctgagatgcacagaagacctgagagaagggtatgacttgaggaggggagggaaagggagaggaaagaatggtgtttagaaatgctttaatagagacccagggacctttggttgtaggaggtaagggaaagagaggaatcaaagctctcctgaaagcctttaccttgggtgaccctgtgggcagcagcaccatcatgggataaggaccagaggacagtgggtagaggtgggggtaatgggtggtatggacttttgcttcctctttgctccaactagtaggtggcctctgagttccggagttgagaacatgttgcttggaatcttttttggggaactgagaaggctcttgggaatattttttctctcctccaattaaggaccacatatctacagtaaaaggtcagttgaagaccacatcaaagtaaaaagcaggctcattaggcttcttcttttcctgaagtatttttttttttggtttcatttggcttgcattaaaaataaaggaagagaagatcaaatcctattaaatatattgcatggtagtattttattttagtttcatgttgtacataattaaggcgacttaccgtgttccagatgaatcacagaatttagtgttagactccaggag

SEQ ID NO: 101047 - DNA, 1027 bp, Homo sapiens
taattctcagagtgggatggagtctcgtttgtcccctgtggggatccactgtgtgctacactcctggattgatttttctctcctttgctgttccactcttcccagtttgccatactgtcacttggaatcacttccccaaataaaccactttcccatgtgtccttgttgtatgctttgttttttgagaaaacccaggcaagacagggatgaatgtctctgcagtgagaaccgtaccccatcccagaactgtgatgagatgaatttgctttcttgatcactccatcagttgctagactcagggcatgttatgtttgattttgctggcctgtgaccttattgtacagcttcttatattctaattgtcatttgcttttcttgtgagtggaggaagcggatgtcttcttcaccgaatcatgaatatctcaccgttgttcaattgcacgctgtgaagtgctctcctaccttcctcctgggaccatgagctcatcatcatcttggggctgctcttcttgcggtcctggaattcttctctttctagaatccccaaccttcttttattcttgtattccttttcattttgtctcagtctattcctaattaatattttataaaataataggtatgtggaaaactttttgttcttaaaggctgaaaaaatctctttttcatcctcacattctgtatgtgtgtgtgtttgtgtgtatgtgtgtgtgagagagagagagagagaaagagaggggggagagagagagagagaaatagagagagagagagagagaaagagaggggggagagagagagagagaaatacagagagagagagagagagactctagaaagctagagtcaaaataattttctccttgacatttcaaagtacatccagtcgtcttctaacattcagtattgctaattagctcagtacttaaaatccccattccttcatggattacctgttttgtctgcacgccacttctctcaacacacatacattggaagatttcagggtttgttttttttttgagat

SEQ ID NO: 101048 - DNA, 1049 bp, Homo sapiens
atgcatggatattgattgagtccctactagatgtaggtaccatgtgaggtctgtgggagctcccaaggcaagtgtaccctggttcctgccctccaggtacccactgggctaatagaagagaagtcccaagaccagaaatgatgaccatgcgaggaagaatcaagggttacagggatacagagaggggtggcttctcctgtggctgttgcaggctgtgatggcagcatcagagagtgtcctggataaagagctgttaaagatgggcctgaaagactggcaggattggaggcacaagaatggagatgaggattttagacagaagcagagacccggaggtgctgtgggcaatgtggggctgggacgtgccatttgtaaaggtggaaattaggaggtagggatggaatacttgtgtgggcaaacttgtggatatctttgaagaggtggggctgtctgggggaagcaagttgtcctatcaatgtacctttctgacacctgcaagaagtaagctcagagcaaggaggaaaaaggccttgaagagcattagcccagagtacacagacttgtgtgtggggtccattcctcctcctaatttgctgtgtgtccttcagaaaattgcttccttactctggtccatgcttctttgatctgtggctaatgggacaccattcctgacttacttattacacagggtgctgtgacattcaaagcagatggtggatctgaaattattttgtgaactatgagattccacataatataggaaatcattattattcttttctgaacctggggtataggaggaagatttaatcgtattcccctgctcatgatataaaatacattattattatggtgagatatccagggtgtgtgtgtgtgtgtcttgggggtggaggtgagaatgctgtcacactgccatcacccgaggtagacatggcacaaagagggggtttggactggctgattcagggatcttttgcaagcctggcataaatcctgcatatgctagagtccagaccaatgtggtatactgcagggctgaaaatttg

SEQ ID NO: 101049 - DNA, 1132 bp, Homo sapiens
gatcattgcagttgggtggagctgggatttgaacccacatccacagactccagtccatgttcctgcccataatactatgctgattcccagcgtgtgagctaaaagtgatcaagagcttgctattgtggttttcattgcaaagagtcttttacatacatcatctcatggaatctccccccagcaaatcctgcgaggtctgtattttacttccgtattattgttaagaaaactgaggttcggagcacttgaattttcttatctttgtatgcttcagaggtgatgctatgtaaatcagctttcagcttggtaatgagcatgtgtttatgtggcattaaagcatcctgctaaaaaggaaaaggtagccacatgtttgtttctttgtaccagaaatttcttaaacgtgcctattatctgaacttttggaaaaattattcggataattggtggaaacttttgctttgcctgggaattttagtattgtattttttaacaccttagctactattaatgccatcccaacacacagccccacacatgtgcacaagagtgatagacacgtttatgtgtatttgcatgggaaatgtcatcttcataacgtagcctaggttctcccacctgggcaccttccctctttgcgctattatgcctgtctgggtgtcccccagtgcttttatattgttctgtcattgtctggttttgtgtctcttttccccattaggctgtgaggtccatcatggcagggcctggagatgagagccgtttatgtccctgacctctaacacagagctggaaatgaaagagacattttgtgatagttatggaatgaaaattctgtctggatacagccctagggcttgggggaatccttcaggttctatgtcaaggcctaatgttttgatgatacttgatcttgcctccttagtgactgttcttttaattcataaacagatttggctgttccctgagtttaaggcagcccctatactgactcggtgcagtgattttacattgtgtgtatatcctttctttctttcttttttttaaattgagacagagtcaccctgttgcccaggctggagtgtagtggcgcgatcttagctcactgcaacccctgcctcttgggttcaagtaa

SEQ ID NO: 101050 - DNA, 1037 bp, Homo sapiens
ataactccttggatgcagccatccaattattatggggtagtggggtctggtcttagaatttaagtgacttcattctagattagtgctgaaggcaatgcattgggtgaatgcatttcttattactttaaactagggacttaaagaggataaggttatttgcatcttttcgaagccttttttaaatttcagaccttaaaattttattttgattgtcccattgcgtggctcagagcagtgattttaacacccttaaaatggtatgtgtggtgagatgtttattttgcttttcacattattggcttcaaatacatcctccctctatcccccacgccaaccctgcctctgtgcgatgctagggaatttggagtgctttatttttgaagaggtccttataagaaaataagggcaactctgattcagaagacctttgaggggcagatttcttatctgtcctcaagcccccgcccccaaccctgtctcgagtcacatgtttcagttctctattgctgcataacaaatcgcccaaaacataatgacttaacaatgtattattatctctcatggtgctgtgggttgactggactcagctgggcacttccttctctgaggtctgtgatgagaatatggaaggatagcattgggattggcgtcttccaaaggctcaactgggctggcagttgatactgggcatcagcttggcacgcagctggaactatcaaccagattgtccacaagtagcttctccatgtggcttcagcttctcacagtatggcagctgagttctgagagggaacatcctcaaaactagagttccaagaggtggaaaacagaagatgccaggccagttaagaggtatgcctggagccagcacatgacttctgccatatcctactggtcaaagtggtcggaagacccacccatcctcaggtggatagagagactctaccacttgatgggagagtgtcaagatcaccttgtagaagaaatggagatgggagatattgttgcaaccatctttgaaaaatacactatgcaac

SEQ ID NO: 101051 - DNA, 1032 bp, Homo sapiens
tgtttgcatcagttatgaaaaagtcattcctataggtgtggtggcatgtttccttccctccctgccaaatccagcctcagcagtaaccccaagcctttgatctttccactgggagttttaagtctatccttggttcgtacttgagttttgcctcttgtttaagaaggacatcagaaggacagggcttctggtcctcccatacctcatccattggagattttttcaaagacagaagggtgcactgtcttggccatgtaggtgacccaggatactatttctgggcttttcaatgatgacagttctaaactctgtcacacagagatggtagaagagtagaggatctaataaaaatgtcatcaaattaaaaaccaagcaggatccaatgtgaactgttctataaataacttatgaaaagtgaaaagatgtttctgttagcaaagttaaaataattattaaaatccttcatcagattgcggctaattagattgagaattaaacagctttgtatgagtgtagagttaattaatagctcattacttttttaataagccaaattcatttggaaacagaagaaagacagcaaagttcatcatggatgagttgttagattgggattatttccccttcccttgatgagagaagtagttaattaaaagaaggagacacgtttatatcatgaatgagttacatgcaaaaccccaggaggtacgtttatatcatgaatgagttacatgcaaaaccccaggagatacgtttatatcatgaatgagttacatgcaaaaccccaggagatacgtttatatcatgaatgagttacatgcaaaaccccaggagacacgtttatatcatgaatgagttacatgcaaaaccccaggagatacgtttatatcatgaatgagttacacgcaaaaccccaggagatacgtttatatcatgaatgagttacatgcaaaaccccacgagatacgtttatatcacgaatgagttacatgcaaaaccccaacatccagggctggagaaagcagcaagtgt

SEQ ID NO: 101052 - DNA, 1068 bp, Homo sapiens
gcacctacagaaaaatggagattccacagtggcttgcgaggtttatttgaggacaaagtcatggtgataattgctgcagtttgctgagttcgcagtgctgtgcaaggggattttcagaggacttcctcaggctcctggtttgcagatgagaaaagcagagctcactgattgattgttagttgcccagggctattcaactgcttgtaatagagccctggacggggtgtctggacccaaaggctgtgctgtttctaagtcactccacggcagtgtttcatattcttggctgaaattggtaattgaattgacattttggttggcagttttttgttgtgggcgctgttctgtgtactgtgggatgtttagcagcattcctggtctctatacactagatgctggtaatacttttctcttcctcagctgtgacaacccaaaatgtctccagacattgccaagggtccactgagggacagaataacccctggttgagaaccatggctctgtggtatcatcgatggggtatcattaaaggaaaccagaatttttgactggggggcttgaacaaagtggagaactcccagagaacgtttcttgatgggctttggatttaaatgcctgtgtgttctctgaccttgatgaactatgctggacacacaggctcatgggaagaccttgctccccagctgaaggtctaaaccaggcttcatccatctgcttggtacctgctgtcttccaggcaccttctcagctcctgtggggccttctagggcaggaatattggaattgggcatcttttcccaagaaggaggaggccatgtccttctcagagtactggctacatgggataagtaattggggggaaagaagtataagagagagagctaatccagagaggagaggaccaccagtatgaatgccttcccacacatctatatatgcaatgaaatggcgcatgtaacccactgagcacactgcctggaatgtggataatgcttaataaatgctggctattattactgttattattaatactatttataactacagctctttttttggtaaaataaa

SEQ ID NO: 101053 - DNA, 1107 bp, Homo sapiens
atccttccttatttcaccaaatcttgttacattttcgtgtttgccttatgtctcccagtgactctctgcactgactctcagagcccttggcctctttttcagcatgacgaacagatttttgaaattttcttctggattctgtagattattttcagaggcatatacctgcagggtatcttcatgcagttctccaccccaattttttttcaatatgtaaaaaataagttcctttttttctttattcttctgtgaacaggattgaatctattcagaagtcatgtttattgagaaacgaggcaattgcattgttcgtgagtgtggtaggtgaatgttctcttgaatcctgtggctgttgtgtaggtcatgggtttggcctttaaacagttccccttgaattggtaccagggggtaccaataaatattggcttctttttatttctgctcctacctggtgcactttattctgggggtagggggtggggtaagggaaaagacaatatgttccagtgttttctacttttccccagtgtctgtctaattttctgggatttgcctccttccatctcaataaaagataacacttataaacccataaacccatgtggttcagtctctgaatgacggttgtgttttaggagcacaaacaaatgaagagggcattcacttatccactcacatcatcaagactatcaatgggaatccaaatatatattttcacaacattcttttctttttttcttcctgctcttacccacttgtatagtttttgttacgtagatcaacttagttgttttggcttaaattctttccttgtgtctcctgcctctttagttctaggtctctctgtgaattcttgattctgtgttacaaaatctcccgaaaagaactctttgggctgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcatagtggcgggcgcctgtagtcccagctacttgggaggctgaggcaggagaatggcgtgaacccgggaggcg

SEQ ID NO: 101054 - DNA, 1126 bp, Homo sapiens
aaacatttgcctggcaggaaaaacaccattctctgtttagagagaaggcattctaaaatttattccatgtgactctgccttctgaaacaggggagatcaagtggaattcagatgcctcaaggtcagaatcaggaaagacgaaagccccccaccgcctccaatacactgtcaatgaacttgcattctttaatgcagcatttccttaagggctgtgtgatatcttggtcactacactcagtggtctcttattgttgtactttgtaagatcttgtgtttgctttgaaggatctttctgtttctttcccaaccaacagtgtgtttctttgtaacagtccctttattctttgttagtttttattttatttgtttgtctacattgaataggaggtaaatgttcacatggagagctttgaaaactacagactggaagaggaaaattattacccacaattctaaccaccaggagaccatcaatgtgaatattttgactcatctctcttctgagtttctctctgtgtctcttttatatccaaacggggtcaccgcgtacatattgcatgatctgttcctttttttccccacatactatcatgaacatctgtcagaaacatgtttctacagcatgattttatgtgtgttcacgtttttgtaaacacttttcttaagaagtgttcaaacatatattaaaacacagagaatagactaacgacacccaggtacactctgaaccccacttcgacagttggcagcatcgtgcctttctagctgcatctcatttactctcactccccattgcttttctctggagtattttaaaacacaaaaaaccccagacataacccttcacttgcaaatcctccagaagatatacctaactcagtggttctcaactgggggcagttttgcactccctccccaggggacatttgatattatctggagacagtttgggtggttgcagctgggaatggtggcggtgggtgctactggcgtgaacaggttgaggccagggatgctggtacgtgccctacaaggcattggatagtcctctacgtcaaagaattgtctggccccaaatgtcaacagtgctgaggttaataaacccttagtctaacagatcaggatg

SEQ ID NO: 101055 - DNA, 1045 bp, Homo sapiens
ttaggaggaagaatgaataggaaggtgattatttgtgtgttttgggaagagagatcaaggatggtgcccagttgggaattgggtaggatccatcctccaatgcagtgtttgggtatatggggacaaggccacgagctcaggtttgcatgcattcagagtgtgagtgctcagggatgttgtggtcagggtgtctggtgagcagttgagtatttgagtctgaagcttggatagaggctgaaattttagaccttggagccattggcacaaagttgatcactgaatcgtggaagtggatggatatctgtgcattgagaagggccgagggcagcctggttgcactggaagtatggtgccccatcctggacccttgctctatgtagctgtggatggaagaaccagaacccaaaagtcccagcaggcagatgctcacttggcaatgggttccttggaaggtggagagtttcctgttaccagatgtagcagcaccttgtgaccctatagaaggcactcatgcgttaggtgggattgctgcttatgtgaactctagacaccatcctggtctggtcttgtttgctccagttgaatggccatttttgatggaagtgcccacatcaagcaaggtcccttggttgattctgctgtctgtctgcctctttctgtgtctacttgcttcccagatcagcttggattccatagatatcatatccaccattctcttttttggaatcccagtaccctttccttagatctctatctcaaccttaacacctggacaaacacagctctttctcttttcttcccttttatcaggtggctagatactgctagagaaaagtccctcagacctaaaaaatgtggcctctgtaaatgtgtggtgcccagccttacctgtgtaaacctcttcagtattacctaggtgctgtcatgctgggcttggcatttggtgggcacttggtaagtttttgttgaatgaatgaatgcacaagtgtgtaagttttagattttattcaagggccgagttagcaaccctgtgagccctttaggc

SEQ ID NO: 101056 - DNA, 1064 bp, Homo sapiens
tgtaggaagttgggtagagaaaaaaagtccaagaagaagaaccaagtagttattaaaatcgacttttctaatatatgctcattcgctgagagttacatccacgacttcatttctcatcaaaaactctcaaagagccaatttccagtagttcttatccctccttgcagctgaatatttgggggtattttaaagtgatatcataaaaaagattgaaaacgaagtcctataaatgatctttaatcaacagactctgttgctttatggaacagaaaacagtgaacaaaagactatgattttaattcaaggaaagagagctatttattttaagtatttctgcagaatggcagaagtaatttattcagttataattagacacattgtaaaatggacgattgtgaaaagagtgattcttgctggctttggagagctggagaaggctcttctgtgtgattctctgttatctggtcccagatcctggtgccagaaattaatctgtgagccagggctgaaccagataaaaatggaagctgaaagtgttcacattctctttttcatcctgaaaatgggctttccttctttctgtcttgataagaaactcctgcagcaagtatttaaattggagaattgcttgggtatgagatggtttaacagtatgtaatagaaaaatccttgagttcttcagtcaaggggaaattatgtgtgcatctgaagtgaattgtggcaacttaagaagcctatgccatttggggctgcattaatagagatataggaaacagatcagtgaaggtgattgatagttggaaattcttgctttctttcaacaagcttggagtagatgaaaggattacacatataggaaaccttcaataatctactttattctagtcaataaataaagaaataagtaaataaatacataaataaagtagattattgagggcttcctatgtgtcaggactagggagacattggtgaacaacatagacatgtttccttgttgatcagacattttggaaggagacagataaatgggcagaaaattacaaaacagcaggagataccat

SEQ ID NO: 101057 - DNA, 1171 bp, Homo sapiens
accagtgctacacctcagccttcagagtggttctgctatgggaaatttcttcctgaaaaatcaacccacatattctttactccctctataaaaatagctgggatggttttggggttaatgagcaatgacccactggatgggaacacctcttcttttaagaaactcaggaattatgtggagcataatttaagtctgtgatctcaggggagatttctcgtggaatcattcattcatcaggtattcacagagcacatgctgtgtgcatccattgctgtgctgggtgctggggttgcagagataacatatggtggatgagagacatacaacaacagtgctgagagaatcatggggcaagaactaggggagtctgaagaagaggggtccaggaggcctcaaaagttggggatggggttgaaaggagtagggagacattattgagatggatacttcttgccccagggatgcgatggagggttggtgagaaccgttccaggcagagtgacaaatgtgctaggacagtgacatgtgaacaattgaagcatatatttaatatgaggatatgcagattgattttgtggagttgggagtgaagggcaggtgtgagggtgtggccaagatgaggttaaacatggaggcagatccccccacccaaccagcccagggtatggaaatgtcaatgctctgtgtagattgcacgtgtacacttccatgacacctattgcagcttccacagacagagcccttgctttgcttgaagaggtcttgggtagatttaaagtctcatcatggctatagagttattcatgttttctaacctgataggaagaatctagatgggtcaaatggtgtgtgtggtgatttctgggtgagagtgccaggttctgtgatcctgctttggcttggagtagatgaaagaatttttcagccgaaggcaccttggaagtctgtctgcaaagagaggtcgatgaatgaagctgcccttgggagatgggttttgtagacagctagcagctctgggctctgttggcccatgatgaagaagggatgctcttgggaatagacagagaaacatgatgcagagctgttttgctccctgttctgtcttcttatgcttttcatcaaattctccaatatagacttgaaatgttagcaaacaagaggctgtgggatg

SEQ ID NO: 101058 - DNA, 1032 bp, Homo sapiens
ctggttcaccattttgctgagttccttctctgggttggtcactgtggattcaccagcaagggatacctgaaagatcatttctgtcctcaaggagctcaccgtctggtttggggagacagatgggcatgttggctatcaccatacggagatggtaggtgtaagacgctgctgcaaggagcagcctcacttggctggagccagggatggtttctggcaggaaatgatgcttggctatgagtagtgagatggggagcagacagaagagcagcctgagccaagctgctgtccagcgggtcatcatgaaaagccaaaccctttggtgtggttggaaccatgggtgactgactggtgtggctgaagggaaggggagccaggcagccccagaccagatcctggaagcttgactccttgctgcctccagagtgatggaccatggagaccgaccttccattctttgtcttcaaagaggtgatgttatgtgttggggcattgatcgttgtgtgctttagtggcccaggatgggaccgcacggagtagcctttgcttttgcagaaagctgtcagtaagtctttgcttgttgtgtggttattaccagaacatggactttgaagtcagatgctggttccactgagaaaagatttctgactctgggaaattgcttggccacctctgcctcagtttccttatttgtcaaaggggcatagttataagatccgcgttataaggttgttctgagcattaagtgagttaatgcatgtataaaacacgtagtaagcacacattcaatgctagctgtttgttactgccattgctgttatttaagttattattctccaatcccagctaatgctattttgtgaaaagtttaactcttgccatcgagagtcagttgtggaataaaattgaataagaggtagcagttttagtgtgtgtttttattttgttttactgaacaacctcctaaaatgtgcaccatacttgtttaattacatttccctgcttcttgcccgccagtttcgaaaacaggaatca

SEQ ID NO: 101059 - DNA, 1034 bp, Homo sapiens
attcctgatgtgaggcaagacaggccaggtgctgtcattatctctttctcctggactcagagatggcaatgacatggtttgattttcctctttgtcatttgcatcaaaggggaagatgtggcaattgatgatgtccctttgctggaagaaagggattgagactggtttactgtagtggttctttagaagaaatcaacctctaatctgttcttttaaattcatgaaagcttatgataatgcagcgagaggtgtgcagagacttgacaacatgtgactcctggattaggatgacttgagcaattcaaactgaaacgacaagttggaccctgtactagttaactgttgctgcgtgaccaattaccacaaagttagccacttaacacacatttattgtctcacagtttctgtgggtcagtagtctctgagcacagcttaactgagttctttgcttttaacatctgtcataaggctgtagtcaaggtgttggccaggggtgtgatctcatatgaaggctccatagggaaggatctgtttccaacctcatatagttgttggcagcattgagtttcttgcaggctgctggactaagcattttagctccttgagggggctgttggccagaagccaccctcagtttcttgccacatggacctttctaacatatgtgggcttgccccatttcctgagcaagggagacaatctgctatattcttgctacttctgtagcaggacagaagtcatcatcttatgtagcctaatcacataaatgatatcccgtcacctttaccatgctctgttgcttagaagctagtcactagtctagccacattcaaggggaagggattatataaggatgtgagtactgggaggtgaagatcattggggccattttagactatagctgtcacagaatcacatcttaactcccaccccacctctttttttttgcattattcagagccttgttacagaaggcttcacttctatggacataggatgggttgaaatttaactaagagactgaaattgggaga

SEQ ID NO: 101060 - DNA, 2089 bp, Homo sapiens
taaatgaatattcagtgatttctaggatactttcagcaattttaatcttgaatcgaagattctgtgttctgtcttgtataatagtagctgttttatcttaaatctgtcattcagaaatctcaattcatatttatattttctaaagaaagataataattaaagaaagaatacttaaagtaccctctgtgtgccacagaccttgatacctgcacatatgtcacacattatcccatttaatccacgtcaagaccctgtgaaattgcattactataaagaaatgcagtcttagtgaggttatgcacatactcagtcacgcagctgttaactggacaaacctggtttccacccagctatgttcatttccagaccagcattgtctcagtttcgaagctgcgaaagattcacaagaatcttctgaattgtgaagattgactatattgttgaagactagtttgcccttaaatatatctcatcttgggtcactcaacatgttggaaagagaagaggcattggagtcagagagagctgaattaaaatcccagctcttgccacttactgagtctgcatccttgggcaaattactgtgatgttttgagcccagattccccgctgtcaatgggaataattctaccagtctggcagggggttatgaagatttcagaggatgcatgtcaaatacctggtgagggatagtagcagtggtggttataatattattaccttttggagaattgttaactcacgcatgtgtcgtgataaatttcaatttgatgggtggattttagagttcacttctgttcattaggaaaaatttgtaatgtgacttgaacttatagccattgttggagatcttttcatcgccatctggatgggctctgaagccagacttgttgggattcttaatcatcatgcttactctctctatatccttgggaaaatcagttaacctctctgagctttaaatttctttatggaaattaatagtgcctagcaaatgggaataatagtgcctatctcattagatggttgtgagcataacatgaagtaacatatataaaatggtgaataaatagtgtggaaatgatgatcatgcttaaataggaatttcctctgtatatcaaataaggaatttcccccgtatatatatcgagtatatatacgggggaaattcctaatttaagagtggaatgcccatggtctcattgctgttgtgtattagacatgcagatacacatcaacaccggtgggtgggcaccaggtgagatcctagatagaaataggaaatggtaactatataccagacattgtgtaaatagaagacttgccttctaatgcactgcgtggaacctagaaagaagctaaagagcctctgagccaccaaagagatattaaacacacaaagctcttgttttttcctccagaggagagcccttagtctctccttcagtggccagcagctcttactttacctacaattctagcaagtttttatttgatttctaagctcagaaggtttagaaggagggagaaggctgcttcagggaggcatgcttgcagtgctgataaataaagatggtgatgacctcattactagagaagaggagggatattggtttacggtagtggttctttagaagaaatcaacctgtaacctatccttttaaatttatgaaagcttatgataatacagtgagaattgtgcagagagttgacagcatgtgactcttggattaggatgacttgagaaattcgaattgaaatgacagtttggaccctgtgttagttaactgttgctacatttataacccccagtgttgaattaggaggtataaatgtaaaaagcagtgatgaaagctcaatcaactcagtagttgcagctgctaggtatgagggccaagcatgcttttctccttggaagaccccaaaggtcccaccttattgctttactgaagatgtagtggcagtcatgacaatgataatgtcaggaggagaaaaaatagatgtgggctcccagtacgataaccgattattttatggataactttgagttataagaaaaggtgaaattgtttgccctaatcgcagtgac

SEQ ID NO: 101061 - DNA, 1369 bp, Homo sapiens
caccccacactgtggactttggacctctggggctcccgcaagcacagcagtttaggaaaacacttctggctggacagagttagttgagtttactttctccacaggacaaccaccttgtggatttaagacaggtgatcattattccagttttacaaataagagttcgaagccaaggcatcagatgggactgcttttgcatttgtaggatgcatcaggtgttgaatgccacagattttgctgcaagaatctctgattctgagatataagggcctgcataattttatctctgattttccaaaggcaccaaacaccttgcggttgactttttcattgtgtgccttaaaatgaagaacatgtagatcccctctaagtttccgctctgtgactgcagtgttaatgcttggtttctaacatgcccttttggtagttcttggctgaatcttccttccttatggaatcagatctggggcaggtgagtccatctgctctgtcatgaaccatgtggtggtgaagagtgcaggctctccggcggatcacctgaggtcgggagttcgagaccagccgtgaccaacatggagaaacccccgtctctactaaaaatacaaaattagccgtgtctggtggcgcatgcctgtaatcccagctactcaggaggttgaggcaggagaatcccttgaacccgggaggtggaggttgtggtgagcagagattgtgccattgcactccagcctgggcaacaagagtgaaactccatctcaaaaaaaaaaaaaaaaaaaagactgcagactctgatctcagactgtgggctcaagttaagcctgtgctaatttataagctgtatgtgtgacctgaacaagctacttaaaccctttgagcctcgattttatcatctgtgaaatgaggcaaattgtagtaacttgcttgtaggatggttgtgagaaattaatgaggtgaggtatgtcaaatgcttagcaaggagccaggctcatggaaagtgctccataaatactagccatccttggttatagtgctattgctgggagttcagtggaggcatcataaatgcaagaaaacataagagtgcgtggctggggtgaccaattgtcctcgtttgcccaggatggagatggttcctaggacataggaccttcagtgctcattgaaaacgcaggaatgtttgagacaaatcaggatgagtcggtcactctaatgctcatcccaggcccacaagctgtatttagagtgatcttgctgcacagcctgtgcaagggcttgcgaattgcatatacgatttgtatttgtgtagcaaaaaagattatctgatatttgacctgcattttatagctgttactttaggaagaaatagaag

SEQ ID NO: 101062 - DNA, 2075 bp, Homo sapiens
cacagtcagagcccagggtctcgctctgttgccaggctggagtgcagtggcacagtcagagcccagggtctcgctctgttgccaggctggagtgcagtggcacagtcagagcccagggtctcgctctgttgccaggctggagtgcagtggcacagtcagagcccagggtctcgctctgttgccaggctggagtgcagtggcacagtcagagcccagggtctcgctctgttgccaggctggagtgcagtggcacagtcagagcccggggtctcgctctgttgccaggttggagtgcagtggcacagtcagagcccggagtctcgctctgttgccaggttggagtgcagtggcacagtcagagcccggggtctcgctctgttgccaggctggagtgcagtggcacagtcagagcccggagtcttgttctgttgcccggctggagtgcagtggcacagtcacagctccaagagatgttcttgaaatttaagatttattaataaggtacagataataggaattttaaatatatgtacagtttgcttctgtcatcttttcaagacaaatttaggttttattttctatatggaaggccttatttccgagtttgtaaaggatttctcttgggaatcctaacacccctgcatcatgcagaagaagggaaatagagaactttatcacagacacagggagacatttgaacaggagtgcatggggcccgtggaggggaccttcttagccatcagttctattcccttgtcacacctccgtctctttctctttcctggcatctccatggaggagacttcctcgcatcccagagaaatagcagagattctttcataggacagcctttggccttaggtttgcctgaggcgtcagaaaggcacatttgactcaaagaataatgttgcgcagtcttttcaatgtttagagatgctgtgaacttgggcatcactttcccatctgtgaaatgtccagatgatttctatgtttcttaaagactaaacttctaggcctctgactttaggatttttattttatgttctgaaaaccaaatcattggatatctttgataaagattaaatatattaaaatatattttcccaatggatcagttttgttatttgacactactcatggtttggttgttcaaaaggaataagttttgaaatccccaggtccaggagataaagcaacctgtttccaggattgttcatttcaaacagtgactccattagaactgtccacattcgaatatgacagcagggattttcactttcctgggaggaaggtttctaaacccaaaagagtatacagaggagaagagcatttggctcaagttggaatgaaaagcagaaaatgcaagaaggggaaaaatcatatggtgaaatgatggatgatgggcgataataacagggactagattcaagagttatgaaaatcacaggtgcagcagggtctgctgaatatgaaggatctaaactgaaaatcggaggaataaatgcaggagatgaaatgactaccaaataggaagcactaacattattacatgctttaaatacttgtaatgggccagatacttttcaagggttttactaattatcactccttgagttttcataacactgttatgatgtaggtataatgatcatcaaaactgaggaacagagtggttaagtagcaagccctaggtcacacagctagtcagtgtgggaacttgacttgagccagaggaattcaaggctagattctgtgttcttgggcattactttatgttctctctgtctggcttactttgtgccatgtgctgtgcaaaattcatacttatggagaaaattaggtcctgtttgaaattactgggtggaaagcctttgttcagaattttcaatgagcatgtctttggggaaattctaagactgcatttaattctcataatgatcccatgaggcagacacagcaatcccatgtatcagataagataattggttttatggaggttcaagggcttggtcacaatcacactgtggtcgtctcattcagagtccaggttcttaatcaccatgtgatgtcgaatg

SEQ ID NO: 101063 - DNA, 1003 bp, Homo sapiens
tctttcaagcacaggatactcccctgactccgtgacagtgtgttgctgtggaaacaagagcaatgctgtgtaggcggtggtccttgataaatatttactgatgatggtgaagagatggtagagtctcacggcagctataatgggggggcgagggtgggcgcaggggaatttaactcaggaggcagcctggtttggagaaaagagtatgagctttggcatctgaagtcctcagtttaaatcccgcctctgcttctttctacctatgccggcttgggcaagtcatttaccttctcagctccccagcttctcatttgtaaagtgaggataattatagctgtctcgctggactttgtggtaaccaaataagatgcaatatgcagagtgaatggaagagtgcctggtacataataggcactttgtcccaagaggagccttgtctgttactgacctcagcacaggtgtatgtgcacaggccaaggcgggtggggcatcagtcttatgctaaatagtgaactggccatgagatggctgggtttggtgatgatttttagtttccttttttttttttgagatcagtcttactctgttgcccaggctggagtgcagtggtgcagtcttggctcaccgcaacctctgcctcctgggttcaagcaattctcctgcctccgcctcccaagtagctgggattatgagtgtgtgccaccatacctgactaatttttgtatttttatagagacggggtttcaccatgttggccagctggtcttgaactcctgacctcaggtgatgtgcctacctcggcctcccaaagtgctgggattgcaggtgtgagccaccatgcccacccagttttcctccttttcctcttttcaggggcttgattccctgcaactgcttttacaaagagattgccaatgaaatttgccaacagatgacactagtaaatctggccattcaagggtttaaatagggaatgttgacttttaggcatattttactctct

SEQ ID NO: 101064 - DNA, 1025 bp, Homo sapiens
tctggttgctttcatatcaggaatagaacttcttttcaatttttaaatgagtaatgtgtttattcagcagccttttgttaaaacatttagagaagtgtgaggagcgagcaccttttctttgtttgctctttagaatgcaggagaaagaaaagaaatcctggaatatggtttgggaagaaatctgtggttcttttgggtctacctgggcagggtggtttctgcaaacctgcgatatagcatatatttagcaagtgggtgcctttgtgccaggggctccttaaacgaatgggattagcttgtattggagaactggtgcattctaagcctcacacatttgtagaaatggggattttctgtatatatctgtcctctcctttccagtttaacggcaactagaccatctaaattagattttttttccccagggttcctcatgaacatctgtatttgtcaaaacaagaatactgtaaatgttgacttaaaaatggacttatcttattttattcctaaattcagaaattgttagtatttcaaatctagtataaatatgacaataacttgatttcctttaaagtattttatttaaaacttttggcaagtttggacaaatacattttaaaactaagtagtgtgttttccatgttcttttgatctgaaaattcccaatcttgaaagcaatttcaatttataaggttacatccataacatagttgggctaatatgttttgctgtaacatgttggtctcagtgtccaaaagtcggggcggaagcttgtcatcaaaaggcaatttcctttttccttactctaagacatatttcttgagccacgacggtttttggaaggaatgatagtaaaaatcaaacaaacaaaaaacctttagaaacagcctcttaacaatgtggcaaaacatgatttgggatgggggaagagagagacagttaaatgaataaggggataatgaattcatttactagtgggtttcagaatccacatattgagagcaaaaatgtatcttataggggac

SEQ ID NO: 101065 - DNA, 5731 bp, Homo sapiens
gctggactcggccgcccctgtggtgtgaggcgcgtgttcgggctcttgccgtccccgcacccgcaccgcggttactggcttgcggtccgccgttcgacaaccagcccttgggtccccgcccgccacggacatgccgcgcgtctacataggacgcctgagctacaacgtccgggagaaggacatccagcgctttttcagtggctatggccgcctcctcgaagtagacctcaaaaatgggtgagtcgggcctgggcgcccgcgcccagcgtcccaggcctggtggcggcgggaactctccaaggaaagaagcggccaaggccgcggcgccgcgtggcagggcctcaaagatggcgacggcgcggcgtcgcgggggcgcgcggtggggtacgggcgcgcgcacgtgcgcgtcctggctaacgactcccccgcggttgtccggccctcgcaccgcccctaggtacggcttcgtggagttcgaggactcccgcgacgccgacgacgccgtttacgagctgaacggcaaggagctctgcggcgagcgcgtgatcgtagagcacgcccggggcccgcgtcgcgatcgcgacggctacagctacggaagccgcagtgagtcccacccccgcgcgctccgcgcccttggggaccctgggggcgggggtgggtggggtggggcctcccagcccgggcaggcgcgagggccgggggtcgtttgacttgggtgtccccgagccccgctgccttcacgtctgcccggggcagccatgggacgccggagcgcggggattgggtttgggtgtttggttttgtttatttgccaagttgggaggtgggtggcttcttctggccccttgtcagcactgtcacgggttcttcccacagaggaagtaaggggtggctgtatttgttgtattctccttacttacctatcagtgcattagttagaggttcgggggcaggctcgggtggaggtggggtagggggcgcgggggacggggaaggggaggagcataaagtataggtcttaaagctatggaacttgatgggggccaaagaatgtactatttttaagtaatgtggtattgtaccacaaagtagatctaaataagctttatgctgtatttgaactaattggggcatgttattgggaggaggttggggggatttttggttatgttaaatgtttgatgtttaaattgttgcatgttgaattcaaactttttaacaagtccttgatgtttcaatttgaaagtgaccaatggggctgaggctgtgtccactgaggctaagatgactgcctttcctgattggccttggcttttccatacattgtgtgacccttgccctatgaccctttggctgaccttaccggaagccatgacgacagcagccttttgccattagacgcagggtgatggtgaggattccaagggttagacaaaactggttaatctgaactaggtgactgttaccttgcgtgttttgtggccaaaccaccaccaaaaacctcacactgtgatgtaagtacttagtgtaaaactagtaaacatttttgtaaaatgtagaaatgcatgtaatcagttaagttttatattttacaatgttctgtaaaataaaacttagcgaggtaaatcgaataaaggagcagtcactctctaacagattgtaggagaggtttagttggatttagtctatttgacttgcccttaatttaattttatggcaaatcacaaatgtgtcgaaggtttagcaatataatagcaaagtcctactccagtaaataaaagttgatatgtttgtactaactttcaaagacattatgcgtttttatcattacaaggcatctaattgttcccttcatgtgataaaggtggtggaggtggatacagcagtcggagaacatctggcagagacaaatacggaccacctgttcgtacagaatacaggcttattgtagaaaatctttctagtcggtgcagttggcaagatttaaaggtatgttttgtaattcaagatagaaatgatatgactaatgctttaaagtaaactccttttatattcttatttctgggaatttattatggtatatagatgttttaagatttccgagtctgaccaatcttgtctttcaggattttatgcgacaagcaggtgaagtaacctatgcggatgcccacaaggaacgaacaaatgagggtgtaattgagtttcgctcctactctgacatgaagcgtgctttggacaaactggatggcacagaaataaatggcagaaatattaggcttattgaagataagccacgcacaagccataggcgatcttactctggaagcagatccaggtaacttgttgaaggacactgtgggaaggaaacaatatttgccaataaaaagggagtaattgagtgatgtcaattgttgcctacttgaattaaagccagcttttagtttgttttggctgtgcatcattgcgttcttttctggatgttttgaacagtgtatttaatttcgtagtaaagaaaaacattattctttggcttatctatttttgccagatggcacggatgtatttaagttggattgggattaagacttcattgtttttctcctaataggtctcgatctagaagacggtcacgaagtaggagtcgcaggagcagccgcagtagatctcgaagtatctcaaaaagtcgctcccggtaaataacgttgtgttgagtcactgtgaatattaccgtacttgtttatggagtatgtgtacattctcactaagtattgagaaaatcggtctttccttgtccagttccaggtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatctcgaagcaggtctcggtcccgatcccctaaagaaaatggaaagggtgatataaagtcaaaatccagatcaaggagccagtcccgttccaattcgccgctacctgttccaccctcaaaggcccgttctgtgtcccctccaccaaaaagagctacttcaagatcccgttctagatctcgctcaaagtcaagatcaaggtccaggtcgagttccagagattaactcagaactccttgtttgcacattattatggaacactttcctacttaggcagttactcttccatgtttatacttggcctcttctgcaagaggaatctcttgaaaacaggggcacacagaaatttgatttgtggccaaattggatgaaaaagatgaggctctaaggaaatggtggcatgaagaccctctcccttctttgtagaattaagataactttgattttatagcttttgagctaacgtaacttttgtaaagattaagctcatttagtgttgtttttttttttttttttttttttttttttttttttttagtatttcagcaggatctgctggcagggtttttttgttttatttgtttgcttatttttaaattaactgttttgagctttgaatacttaaggctttagagggagaacccaattttcaattatgttggctttttataaagcttgagttatgtaagatttaaataaaagtttgctaccaagatgattgccttattgaataggtcactattaaattcctttaaatgttgatatctgccatttgtggaaacaacgtaaattctacttaagtgtaaacaaggcaagcctcagaccagcaataaattactcagtttggataacattattttgtgcagttaatcaaatttgccaaagtctttatctgcccctttaacaagttgagtaaaaataaaaggtattttttagtcaatgtgttccatgattttgcttaaattaatacttttaagtaatggaacttttttcaaaggcaaatttaaactatttaagaaatagctcctaatacttgggatcttgtttagagaatccactttctggaagttctcagcataattagtgttgagagtggttcagttgtctttaatgtttgtcatgtggaaatggaagtagcctctttttgttctgaaattgagtttattcaaagtgtaaaagcacatactgcattttctgctgaaagatcattatgtttaacaggcacttaatctcagtaaagtcagttgccagttaagttccacccagtagtcagtcccctttgtagttagtgggattatttgataattggttagatcatacttgtaaattttaatgctttgtgtaattggtttgaaaaacagtgaaatgggtaaacgcaaaacttttgtactttattacgagtaaagtgtaatgagtactgtggaaaccaaatttgaatactgcaaatttgtaggagttactaggttagcaattagtccatacatccataagcctgatgagttgaaattgcagtttgagaagtgaattaaccttacatccctttgttcagataccttaaaagttactttatttaaaagcatttattaatcttagtctgaaatcaaaatatagattaattggctcagctttaatacctttctaggaggtgtcacaatgtagggtaccaagggttggattgtgatggggcatggtcgtacactgctcattgtgccacaggtgtgactggaaagcatgatattctagggttggtttgtagattcaaataatccagaaatatacctaataagattgagtgaaaaatttgagtcaaatatctagggcattcacagagtagctgtgagttcttggtaatgtgaaaaaggccttgtttttcagaaattcctgggtttcctgttaaaaaatcttaaagcccaaccttaggaatatagtgccccaaaaggcggatgcttcttccattatcttattttctttgatactttatttaattagatgtttataaagaaatgggtttatttttccagcataaacctcagaatttaaggaaagaaaatgatgtctgttgttatagttcattgttttgcctactcagcagaagtgatgactcttaaaaattggctttgaccaaagttctcttgttttcagggaaagaacataaaagctttttgaactacagcctttttaaaagagggatgggaggatattacagtaagaaattaggctttctaaaagtatgaaacatccttcaactgggctctcttgttaataggacatcatatggtaatagactggtttgactatattgttagctgccacagtaagcaggtcattgtataggtaaatgcctgcacccataattttctagtaatagccacgaccaatttattaacagtcagggcctatccttgcctgtagttctcagtcactggatgcacaaaatcactgtgtaacattggctcacttggtgagcatagggttgactgataaaatgtttaattcccttgctagcttgtgagaagaatgagttgatgacatgctccataccagtggctagatggagtattaaggtggagcagaaaagaagtgagaacatcttgattcccctttcttttacttgatggtgtttatgaacatgccgtagtgcctttatggccagtttgagtcctgcctactttgacttttacgttcccattcctgtgttaccaccttcctcccgatttgttcacctattttgtgctttaaatctcaataaaatacttactgagggaaaggcttgttttgagtttattgcatatgccc

SEQ ID NO: 101066 - DNA, 1022 bp, Homo sapiens
ggcagggcctgagggggcgtgggcggagcctgagtgtggctgcgatggggagggaggcctgaggcccatttggcccccgcagaggaccacccccagaatcctccagaagatcccaatcaggaccccccagaggatgatagcacctgtcagtgccaggcgtgcgggcctcaccaagccgcgggtccagatcttggttcctctaatgatggctgccctcagctgttccaggagcggtaaggggaggaggtcgcagccctacttgctctaccttcagcccccaaagcctcattcctgttcaggggttaggagaggggctgggtggtgcagggcgggtggttctttccctaaggctggcccttcctcaggtcagtcatagtggagaactcctcaggctctaccagcgcttctgagctcctcaaacccatgaagaagaggaagcgcagggaataccagagcccatcagaggaggagtcggagccagaggccatggtaggaagagggcagtggggaagggagggggaagctatagcctatgcctcaattcccactgtcccctccatcaatccagattatggagctgggccagagaagacacgcataatgactcactcatcatattttggggtcccatcctgagttaggtcctatacctggttaaagggaaatgaattaatcactctcttgattttccagagctcccatctcagtttagtgtcaaggttaagacatagtcaggtgaactagcacccaaagtacatgtgcaggcagctggaaaactccatcactggagtccagtgcctaggccaaaggccagggaacacccagggctctagctgcagaagctggaagggacagagcatgaattctactgggcgtgtaagagcatcacaaaggaagtttttgtgtactcagtttctctaccagataataaggagagttgtagtcaggctgtttaattaggatgtgcatgctcatgtgagtctgtgctcaagtgatagggggatgtctgctggagctgcact

SEQ ID NO: 101067 - DNA, 1071 bp, Homo sapiens
ctggcggcctagaagaaattctgcctgtttggggcagaacaccacatggccagagagccaggtaggggccaggatcagaccctagggcttcatcccaaaccatgaggagaagaagctgggatcaggcttgccttctacaggagaagcaagaagaaggaaaggacccagagggacaacccactgctagcaccccagagagtgaggagtggagcagcagccagcctggtacggtggcttgtgtgtatatatattcgtgtgaggtgtgtatatacctttggaggtgtgaggctgagaatgtgggttatgattgtgatggtaggttgtacatgcataaatgagcatgagttagtgtgtgtgaaagagagagagacagtgagagactattttgggtttgtgtattagtgtatgtattttcttgggagttatatgatgtgtttgtttatcctctattatccagtcatgactaggccccagtgccagggagatcttggctcaatttttgaagacttgagtaacttttactggcaccacatgtcattgcttctctttagtggtggggcaagcctgcactggtcattggtctaacattcctgtttggaaccctattctcactctttgattctaagaaaaatggagcagaggtcattcatatctccaaccttcaggccttctcaattaccatctccacattcccacatgacaactgtcaactgtagctaagtagcatacttgtaatcacatagatactgtgtagcagtttgtttaatgtctctcttctgccctcaaaaccatcaacacaaggacagtatctgtttttttttttcttttttaaaattttttaaattaaaagttttggagggtgaccgggtcttgctctgttgcccaggctggagtaaagtggtgcaaacacagctcactgaagccttgacctcctaggctcaagcagtcttccacttcaacctcctgagtagctgggaccacaggtgcatgccaccatgcatggctaattttttaaatttttgttatagagatggggatcttactttgttgctcaggctggtctcgaactcc

SEQ ID NO: 101068 - DNA, 1044 bp, Homo sapiens
ctaagcaccaactatgtgccaggtattgagctaggtgttagggattcaataggctgggtctctgcccttattaagtttggggtgggggccgggtgcggcatacacgcctgtaatcccagcactttgggaggccagaacgggtggatcacctgaagtcagaagttcgagaccagcctggccaacatggtgtaaaccctgtctctactaaaaataccaaaaattagctgggcatggtgttgggcacctgtaatcctggctacttagtaggctgaggcaggagaaccacttgaacctgggaggcggaggttgcagtgatctgagatcgtgccattgcactccaggcagggcaacaagagcaaaactccacctcaaaaacaaaaacaaaaaaagtttgggattgggggcaggcaaaaaacccaaacattatatacaattatcacaaggtatgacaagtgtcaggaagaaaatgaataatgagctgagatagacaataatgggagggggggcaaattaatagcggcatgatcagggagttctctctgaggaggtgacaattaagctgaggcttgacggatgagaaagaggcagccatgaagacagctgggcaaaggctccccagacacaaggcacagcatgtgcagaagtcctgctatgggaacaaggaggagagtggccagttttagggtgttttgagcagaggtctggcatgacctgatttaagtttttagaagattcctcgggcttctttgcggagagtggactgcactgcatctgctttttttttttttttttttttccgagacagagtcttgctctgttgccaggctggagtgcagtggtgcaatctcatctcactgcaacctcctcctcccgagttcaagcgattctcctgcctcagcctcccaagtagctgggactacaggcacccgccaccacgcccagctaatttttgtatttttagtagagacggggtttcaccaagttggccagatggtctcgatcttttgaccttgtgatccgcccaccttggcctcccaaagtgct

SEQ ID NO: 101069 - DNA, 1833 bp, Homo sapiens
catagattgcttttttcctttgtgtagtttgaaatcctgaagaaatatcttgacactggtggagatgtctttgtgatgctaggagaaggtggagaatccagatttgacaccaatattaactttttactagaagaatatggaatcatggttaataatggtaattagtattattattttcagtagaggcagtacttttctatctattatttgatatcatagccctctaggtccagtggcataatggaaaaagccctgggctgtgtgtgcgtgttttaatgttccattctcatcagcagtctgagcctcctaggcttgggctgcttccatttataaagcgagatggattggaaccaagttccagggtgcccttcaggtcaaaattggtatgagtctataatatcgaatttatttctaacctaaaatatacctccttctctttttccctcatagatgctgtggttagaaatgtatatcacaaatatttccatcctaaagaagctctagtttccagtggagtcttgaacaggtaagcatgttgaaagcagaaatatcttggcaaggcatcgtcgctcacacctgtaatcccagcactttgggaagccaaggtggatggatcattttgaggtcaggagttccaaaccagcctggccaacatggtgaaaccccatctccctgtctaaaaatacaaaaaaaattagccaggcattgtagcaggcgcctgtaatcccagctactcgggaggctgaggcaggagaatcacttgagcccgggaagcagaggttgcattgagctgagattgcaccattgtactctggcctggctgacagagcgagacttcatctcaaaaaaaaaataaagcagaaatatccttacacataactctcatttcttctacataaatcttccctcgtctcttctcatacattcttttcactgccctttcttctttcttgcctttttgttttgtgttattataatttattttactatattactactactcattcatcaaattatttttcttcatcttttgaaacttacttcacattcaatttattttttgtttatatatatatgtattttttgagacagagtcttgctctgttgctcaggctggaatgcagtggtgggaacacagttcactgcagccttgacctcccaggcttaagcaatcctcccaccttagcctcatacttgctgtactaatgaatgcagtgtgaaattctcaaattttttttgtttactagattttaatttttcttcttcaagggaaattagccgagctgcaggaaaggctgtgcctgggatcattgatgaggaaagcagtggaaacaatgcccagtgagtgtgttttctgatgccacatgaggaagatgtatcattttggagtcttctttttcaaaatgaaaagagcttttgtttctggttacaaaaataatcagaatttgaacagttcaagaggaaaaaagtagaagctctgcactgtaagtccatgctcctccccctgaaggtagtcttaatatagtatttaggcccagcatggtggctcacgcctgtaatcctagcacttttgggaggccgaggtgggtggcccacctgaggtcaggagttagagacaagtgtaaccaacatggcaaaatcccatctctactaaaaatacaaaaattagccaggcgtggtggtgtgcacctgtagtcccagctactcgggaggctgagacaggagaactgtttgaaccccggaggcggaagttgcagtgagccaagattacgccactgcactccagcctgggcaacagagcaagactccatctcaaaaaatatatagtatggt

SEQ ID NO: 101070 - DNA, 1210 bp, Homo sapiens
taatttttttgtatttttagtagagacagggtttcaccatgctggccaggctggtctcgaactcctgacctcgtgatccgctcaccttggcctcccaaagtgctgggattacaggcgtgagccttcacgctcggctgttttgttttgttttgtttgagatggagtctgttctgttgcccggggtggagtgcagtggcgcaatctctgttcactgcaacctccatctccccagttgaggtgattctcctgcctcagcctcccgagtagctgggattacaggcctgcatcaccacatctggctaatttttgtatttttagtagagatggggttttgccatgttggccaggctgatcttgaacacctgacctcaagtgatctacctgcttcagccttccaaattgctgggattacaggcatgagccaccacgcccagccaatacaatattgttttagtaaatgctatttttaattacccatatgcttctctatagtcatctttgttgcattcagggaatgataatttgatttcctactgttgcacctgttctttctaatgtaggaatactagatctgaggaataggaaagccagtaccagtccagttttattctgattaggagtgcttttattataaaagcagcacattagagagctctagggtttttcagtgttgaaatcctgtagtcacattactttaggaagaggtgagtgatcttaggaaatgtggaaacatgacagggcatacctgaaacacactaagtctgtactttgggaagggcagaagttaagaattaatctaactactactccaactgtcttaggtactgaagaagacctggaattttatgtcaggaagtgtggtgatattcttggagtaaccagtaaactaccaaaggaccaacaggatgccaaacatatccttgagcacgtcttcttccaagtggtggagttcaagaaattgaaccaggtacagagcctacaaggcacagtgtagtgggagcccctccagtactggtatcttccatggactgtgcttgccatgttttatgacgttgattcagcctgtaaatatttattaagcatctactaggtgaacaaaacagacaataaaccctgtacttatggaacctatatactagctggaggatgtagacaataagcagtaaacataagtgagtcacataggatgctagaaaatggtaagtgcttt

SEQ ID NO: 101071 - DNA, 1133 bp, Homo sapiens
ggggccatagcagtgaacaagatgattgcggttcttgctgtgcctctcagagctctgtgtagtgggagacagaagtgtattggcagttaccgtggtctaagtgccatccatgaagggaacccagagatgagggttttgatgtggctgctcagcagtgaatgatgggatgggaggtcaggtaggttcccagcagtactcactctggtggcatgctaggacagacacccgaggccaatataagaagtctggtgtggtctttgcaccagtgctttcaactctgtttgttactcatcatggtgggtggtgggcagtggtcacaagccctgccatggtagggcaaaaggatcaaaatttgatccttgggttggattcagccctaaagccagatattatgtatatgtcctaattaataaagattcagaatctctaaagtccaaagcactgaagagtttacatttcaggctttatactgaaatactaaaattctgtgtcttattctctcatccaggaacatgacatcgatacaagtgaaacagcattccagaacaatttctgaagaccatgcctcttgaagctttttctgcctcctgattctctctttgtaaactattttcaaattgtttttcaactccttatcaaaattgtttatacactctttcctccatgagctctggaaggtatatgcatcttctgtaatactcagataggtataagatttttcacaaaatccttatgtaagatacattccatttttaaaaattaaatgtatggttgcatctgtctttttataccctatgaaacagtcttgatttttttttctcaaccccagttctggatttgagtcttttatcaaagacataattaactctcaagcttgttgtaaatactgtacagctttctggaccggttgaaaggatacaacagtggctggacacggtggctcactcatgtaatcccagcactttgggaggccgaggcgggcggatcatttgaggtcaggagttcaagaccagcctggccaacatggtgaaacctgtctctactaaaaatacaaaagttagccaggtgtggtggcatgtgcctgtaatcccagctacttgggaggctgagacaggagaatcacttgaatctgg

SEQ ID NO: 101072 - DNA, 1465 bp, Homo sapiens
cctggccaacatgatgaaaacccatctctacaaaaatacaaaaaatagccaggcatgctggcgcattcctgtagtcctagctactcgagaggctgaggtgggagaatcatttgaatccgggaagtgggggttgcagtgagccaagatcacaccactgcactccagtctgggcaataaagcaagacttggtctaaaaaaaaaaaaaaagttaagtaatttgcctaagataccgcaactgaatggtggagctgggactcaaaccccaggaagtttggctgtggaggctgtgctttcaatgaagtgggcatgtccacattaattactttataaggggagtgggcgggagaaaccctgaattaagtgatgtggaagcttctagcacttaagatgtgagttagtcttccttctgtggtaagtgaagtttgcagcagctggtggctggactgtccccaggtggccagcagcttctggaagggggctctgaggcctgaacaggggctaaaaggctggggtttgatttggtttcttcagcgtcctgtctcagagctcatttatcttcctctcagcactgctcccaggaagtccagtgtgacttgatccttggtacttggtaaatgtcaatctaatatagaaaacctttgctaaatctcaaggaaagacagtctcactgtctgtcgcccaggctggagtgcagtggcgggatgacaagggcttgagcccctcgaactcctgggctcaagcaatcctcctgcctctgcttcccaagtagctgggattacaggcattcaccaccacagccaggtaatttcttaattttttgtaaagacagggtctcactctgatccccaggctggtctcaaacttttggactgaatcagttctcccacctcggcctcccaaactgctaggattactggcatgagccactaaatctgggctaatctctgggagtttaaacccaaggtaaacaattcaatgcaacaaacctttgcctggggcttcttatgtcaggtcttctactgggccctggagatactggtgtgcattgagaggccacctggacctcaggatgctcccagttcaaagggggaaatgcagaagtctacaggcagattgtgggcagtggaccccaaattaaataggaatcagccacgtgggaggggcaggaagtgttcctgccctgggtaatggctcaggcaaaggcaaagaggccgtttcttttggccagggctgggtggtggtctggaagatcagataaatgtgattgtggagtaaggaatttaccctgagggagaggaggatggttttaaattctggaaagagctcacgcctgcaatcccagcactttgggaggacaaagcggcaggatctcttgagcccaggagtttctagaccagtctaggcaacagcaacatagcaagacacccccttctcttaaaaaaaaaaaaaaaagcgcagtggctca

SEQ ID NO: 101073 - DNA, 1401 bp, Homo sapiens
gaacaacaaaaaataaagtctattaaggagggtctcttggaggcaggagaggaagcagggagaggcacaggtagggtgaggagccgctttagggtgcggctctagggacccagtagtggcttggactagcgtgggggattccgccctggcgctttccctggctggctctcccatgctcgcgcctcgctccccttcctcggtcttcgctatgtgggatactcctgggccgccccggactgacacgtgagccaggcctcggtcacatcccggcccgctccacaactccgaagtagcggccgccgcccctgtcctgcagccggccctggagggtctgggcaggtgccgccccgcaggccccgccccgccccgccccctggctccgcccctcactcaggcccctcccccggcgcccgcgcgccaggactgggcggcgccgacgcgcttggcgggagatagaaaagtgcttcaacccgcgccggcggcgactgcagttcctgcgagcgaggagcgcgggacctgctgacacgctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctggtgagacgagccgggagggcttgggcccctccccctccctttaactcacccctcccccacccagatacccccgaccctccccaggctcccaccaagctggggtgtgtgtgtgtgttgggggtggggtgtttccgcggaaatgctgcgtcctgggccctctgaggcaggggcgcgcgtaaagctggggggctcttgggcgtccctcgcggctccccaggcctgttgggcctcggagctgggacgggcgggtctcttgggacccgggccaagccgtgcatgatgtcattttgtctcccgcctaattgcgggatgggggtgggccggccggtgtcagctggcagggccttcgccggcgagggaggcgacccctgggagcgagagggagtcttcaagtcccagccagtgggagaccgagcctgggaggcacttgttgcagcctagttttgggtcaacttggtgggtgggctttgctccttaacattccggggagcacagagtcccccaagccctctcccctggactgagaagggtgctgagttgggggctcttttgtctctcccacctgggttccgcgccccagcttggttcggtttgagacctctcttcctgttcccacgaggagttttgggcagctggggttgaaggtgcgggggagagagagagtccctggggcaaaggcaggaactgcggtctccattttacttatttccccagagacttaagtggca

SEQ ID NO: 101074 - DNA, 2433 bp, Homo sapiens
aggctggagtgcagtggcacaatctcggctcactgcagcctctgcctcccgggttcaaggaattctgtctcagcctcccaagtacctgggactatgggcacacgccgccacgcctggctaattttttggatttttagtagagatgggtttcactgtgttgctcaggcaatccgcctgccttggcctcacagagtgctaggattacaggcgtgagccaccgcgtctggcgtgttttattttgtgtagagatggaagggggcgggagtggcctcgcgttgtgtctcacctcactatgttacccaggctggtctcgaactcctggcttccagggattctcccccacttggcctcccaaagtgtcgggattacaggtgtgagccaccttgcctggcgccatcctgattttttgttcaggaagagttattccaggagtgactgcctctagaccaccccaggtcctgggctacttctcccatgaggggctcagtggaggaacccctcctgtgtgaaggatggcagctccacagccctcagcccatttcctggccacttgctgtaactctcctctgccctagtgccccacttcccgctttgtctctgactcacccctgtcctggagcagagcccagcacgttgaagggcaaaaggtagggtatgttggaccacaatgtggttgccaccactaactggactctgctttttcagctgggattaggatatgaggacttgcaggtgtctggagttaggaaggttcagagcctggctctatgaacttggcaggtggcctcacccctctgagcctcaatttccgcatctgttaagggggataatgagaatgtgggtgaagttgatggccagcacatatggtaaagtatatcatctcacagaaatgccccagctgtctgagatgctgaccctatcaaacagcattggaggctgggtgtggtagctcatgcctgtaatcccagcactttgggaggccaagagttcaagaccagcttgaccaatatggtgaaactcctcgtctctaccaaaaatacaaaaattagccgggcgtggtggtaggcgcctgtaagcgcggctattcgggaggctgaggcaggagaattcacttgaacccaggaggcagaggttgctgtgagtcgagatcatgccactgcacttcagcctgggtgacaaagcgagactctatctcaaaataaacaaacaaacaaacaaacagcattggagcaccagggagtgtccatgcagacatcatttcatccttgaaagaatatttgctgaccttctgttagaagccaggcctttgtgctggatgctggagaagcaaagatggtttctgtcacgagctgtctgggggcagttgattttaaagccaacttcattctgttattagtatcttctggatttttgccttctatattgaagtggtggaggacccatgaactgggtcaggaatgaattccagatccttctgtattgctgactgtagacaccgtccctcctttcctatttctgaaaatttttttcttttgaaattgggtcttgcctggcctaaaaaatttaattagtatttcttattgactaataggcagcagctttgcacattttttcatttatttgtatattcagtcagtccctgggcaaacatttcttaagcccttttggtgataaaccctgggatgccaaggtggagctgacctttgtagatgatgtggaggagacaggcagttgcagtgtaagggcccgagacaggagggtttcccatgtgctatggaagtataggagtgactctaggaagcaacggtgagctttggagaacaaggagaaggtaatgtggatagcacagtaagccttctttcatttgtttcatttccaaacaagacttgccttgtttggaaacctgtaagctttttccagtttacaaatgtctgacctagcaacttacctgaccaacgtgacctgatgcaggtcctgtcgggtggagttggggaaagattactaactttcctcaagcacctgacatctctggaggtggatcctatgatttcttttttttctttttttttttttttttgagacggagtctccctctgttgcccaggctgcagtgcagtggcacgatcttgactcactgcaacctctgcctcctgggttcaagcaattctcctgcctcagtttcccgagtagctaggactacaggtacatgccaccatgcccagctaatttttgtgggtttttatttatttattttttttgagatggagtctcgtctgtcgcccaggctggagtgcagtggcacaatctctgatctctgctcactgcaacctccgcctcctgggttcaagcagtttttctgcctcatcctctcgagtagctgggattacaggcgcatgccaccacacccagctaatttttttgtatttttagtag

SEQ ID NO: 101075 - DNA, 1303 bp, Homo sapiens
agaagaaagtagctcttaaccctatttcattaaaaaatttaaaaagaggtgaggtcgggtgtggtggctcatgcctatagtcccaacactttgggaggccgtggtgggaggattgcttgagcccaggagttcaaaaccaccctgggcaatatggtgagaccccgtctctacaaaaaatacaaaagttagccgggcgtggtggcatacccctgtagtcacagctacttaggaggctggggcgggacgatcatttgagtccaggagttcaaggctgcagtgagctacgatcatgccacactgaattccagcccagtgacagagtgagaccctgtctcaataaaaataagtgaagcagaagtgcctatgtcttaaaaagaagaaaaagtaagagcctctctcccccagacctttccctagggtgggctggccgctgcctacacgttctccattatgtaaaacatatggacacaccatccttgacccttggcctgctttccccatagcgaggatctggatgagctgcactaccaggacacagattcagatgtgccggagcagagggatagcaagtgcaaggtcaaatggacccatgaggaggtgagtgccatggggaagagagggttgatggcagctgggggctgtccagaggaactgagcctggagtgtatttgatgtctcatcagatgggatgaagaggaggagccggtgaaggaagggatgggtcctctgattgtcctcatgcctcttctcagagcattctgggggattctcaattttgaggactcagtgggtgggaaggggatgtgtgtcctagacctcagggcccattgtgtctcctgagcagctgccatgttctatgtcatggacattgattgtgctttttgccttttgactgctaggaggtttggccaaatctgtaactccccccaccctttttttttttttttttttgagacagagtttcgctcttgtcacccaggctagagggcaatggcataatctcagctcactgcaacctctgcctcctgggttcaagcgattctcctgcctcaggtgcgattacaggcgtgagccaccacatccagctaatttttttttttttttgagacagtctcgctttgtcacccaggctggagtatagtggcatgatcttggctcactgcaacctctgcctcccaggttccaagcaattctcctgcctcagcctcccgagtagctgggattgcaggcatgcgccaccatgcccagctaattttttttttttgtatttttagtagatacgggggcttcaccatgctggcca

SEQ ID NO: 101076 - DNA, 1876 bp, Homo sapiens
gtgagctgagatcgccccactgcaccccagcctgggcgacagagtgagacactgtctcaaaaaaatggcggtggctcacgcctataatcccagcactttgggaggccaagtcgggcggatcacctgaggtcgggagttcaagaccagccttatcaacatggagaaaccccgtctctactaaaaatacaaaattagccgggcatggtggtgcatgcctgtaatctcagctacttgggaggctgaggcaggagaatcacttgaacccggaaggcggaggttgtggtgagccaagatcgtgccattgcactccagcctgggcaacaagagcaaaacttcgtctcaaaaaaaataaataaaaaataaaaagtgaaaacataaaatctttaaaaaaaaaaatcaaagtgatatgtggttgctataaaaatttaaaccatacagaagtgaagtcaaatatttcttcaccaaaatctttgccaaaagaagcatccactcttcccagtttcttgtggcctgtgtgcacatgagaacgcgtgtgtctgttgtgtaggtggggcctggcctggctcttgtggctgcgtatgttgtggtttgtgtcctgagctaggaagcctgactgagggcaggtggggactcaggtctggctaggtcagcccgcgatgcctgctaccatggctcagcctgtgccctcccaatttccatggaagtgctggagggtcttgtggcagcctggggcctggctggtgtgggaaagtctgtttcccacctttagtttggactccgtgtgtgttgttcctcctcatccctctgctcttttctacttagcttattgggttgagccctggagagggaagcaggactctggcgcctttgtttacccccacttgatctctactctagaaagggtctctggtattcttggcctagatttattccaggcaataaatgagagggatgcggtcagatcctcaggtaggccctgtgggctacacaaagtcatcctgggtggcatcccctgcagctcgctcagtgttgcctgaggggatgtggtaggtggcacctctcagggccatggcaaggctcaggtggatgtgaagggctatggtgggggcgagagaggggccggtgcaagtggctacccagagacttttctctaaggtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggtaagctgtcttcttgggggttgggacaggttcccgggaggccaggcccgtgtttctgatggaggagggttcctgggtgggtattgtggtcctgtgctcttgttctgtaacacccagcctcggctccagggctcccagaggcatgcatagtcaggaggaagggtggttccccagggaaggccctgtcttctgtcagcttaaaagaacagatggtgataagggaggcctcagcaagaaatcgggaaccctggagtctagttctcatcctgttcccagctcactgtgtcttcttggttagcctcttctcttcgacttcagtttcttctaacacagaataggcttgagatgtgggatagatgggctttctttaagaagaaaatgatcaaaaatcaggtagtactataatctgctaaaaggtgttttttgtttttctttttcttaaaaggtttaataatgaaaaacatcagtctttgtcaccactctgttaaatgactctacta

SEQ ID NO: 101077 - DNA, 1840 bp, Homo sapiens
acaggcgtgagccactgttcctggtcttatatatacattttttttttttttgaggtggaattttacttttgttcccaggctggagtgcaatggcatcatcttggctaaccacaacctctacctcctgggttcaagcgattctccttcctcagactcccaagtagctgggattacaggcatgtgccaccatgcctggctaattttgtatttttagtagagacagggtttctctgtgttggtcaggctggtctcgaactcccgatctcaggtgatctgctcgcctaggccgcccagagtgctgggatcacaggtgtggtgagccaccgcactcggcaatttttttttttttttaattaaaaaaaattttgttttttacctgaacctgacagtagctggtgccattttataatttttgccatagcctgaatgattcagttgcttatttcacagagcttcgtggaaatgctctgtaaattattagggctagagacttgtgagacttcatcttggaactgaaagagaccttagagttcatctagtggaagattcatttacaggagcaggaacttggcttagggaggttagtgatgtgcctgatggcaccccacccacagagctggggttcaaaggccccctgctgccccctgcaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccaggtgagacagctgctcagcctttggcttggtttgatttcacattcatctgacaccatctcattgaacaccttgtccacagctattggtcagtttctgccacagagtctaaaagtgggctctgtgcttctggggccttgtgagacttctgcacataactggcacttgtctgcctgcagatgaaggatagcagagcaagctgattatataaaactgtgaattagttaaggagatcctcagcctccatctctccttgctggtggccaccttcttacctgttgctcattttaattttttaaaactgaaagcatgtttgcaataaaaaaatcagaggtggctgggtgcgttggttcacacctgtaatcccagcaagttgagaggctgaagcgggcggattgctcaagcccaggagttggaggccagttcaggcaacatggtgaaaccttgtctctatctttttaattaaaaaaaattaaaaaatgtattgagttgtaatttacgtactctaataaacagttttgagttatgacaaagcatacagccatgtaaccactgtcacagtcaaggtatacaacagtcccatcaccccagaattccctcgtgctccttttcttagccttttttcggcccttagctccttgcactgtgatctgttttctgtctctataattttgacttttctagaaattaacaattaaaatcctatagtattacatttgcaggctgttttttttgagacagagttttgctctgatgcccaggctggagttgcagggtgtgatcttggctcactgtaacctctgcctcctgggatcaagcgatctcatgcctcagcaacctgagtagctgagattacaggcatgcaccaccacgcctgactaatttttgcatttttagtagagatggggtttcaccacgttggccaggctgggtttgaattcctagcctgaagagatccgcctgccttggcctcccaaagtgttgggattacagatgtgagccaccatgtctggcactacatttgcagttt

SEQ ID NO: 101078 - DNA, 1162 bp, Homo sapiens
gtccatgatgcagtctaagaccagacattgcatttagttgtcctatccctttagtcagcctttcttagtgtcatgatgttgacattttggaagtatatggtatggctaattattctgtagaatgtttctctatttgggttcatcacagtttccttcttagattcaggttgtgtggtttagctggaaactactatatagtctatatctcagcgaaatgcaaatggtgtattcttgtgtcttacagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccctgctgtgggttctagcctctctgaagccctggacttgatcgagtcggtatgttggtcacaacacttcacagtgagcacagaacacccccagcaggaagtgcttctctctcaggcccacatccttttgctcattccatcgccctgctaacagttactgacttgatgctgaatgcctagccctgacccaagggctggggacaccagggttgtcagcatgcagtccctatccttggggagctcccggtgtgtgcagcaggagtttgtggtggcatctgacctctatgtatggcacagggcggggtgggaaggctgcccagaggaggtggcactgaactgagtcctaaaggttgactggcaggtgacagcacaggacagcgtggtatttgtggcatcacacatggttgggtctccctgaagaggagcccaggaaatgccaagtcttggtgctggtcttggagtggtgagtgggttctggttactcagggtggggcagccattgagcccgtgttgtggttactgtgttggctgtgtggttgtgtcctttgaggagggcttcttggtgtgacaccccggctcctggctgcatcggccaggcctgctgtgtagagcgggttttgggaggtgaaagaccagaggcctggtcactagggtggggagttcagtatgggggtccgtg

SEQ ID NO: 101079 - DNA, 2557 bp, Homo sapiens
gctcagagaggtcaagtagtgtacccaaggttgcacagcaagtatacttggtggtcttgactgccatgctatgctcctgctactatcgcttggcaggcacagctcgcttgtattgagcacccactgattgccggagccagtgcttaatgagtaattacagtacctaacattggagtgcttgccgcgtgccaggcccatcacttgctacctaatgtgtaggctcttagttggtctttaacagcctgtgaggtgggtagtggactcatcaacagtgagagcaccccacgctcagagaggttaggagacttggccaggttcacacagccggtgacctccaggaacaggagttaaaccttgctgtccggctcagagctcaggctctttccacaatgaccttcagcgcctgttgggggagttactgcgtgtgtggaaatcccatcttccctcctctgctccgtccacttcagtggtccttgtaggatgtacttctggtctaccagacactgtcggtgctgggtcctccctgaattggggtgtgggcctgaggtcggtcctgccccccagctggcctccacccttaggagtgaactaccccagggaaccagaactcggctttagtgtctgggtccactcagaagccagaacccaaagaccaaagtggaagcctctgtgtccagaagccttttggtttgtgttgtgatttattgggtaaaggagggaaaacctgtagtgactcacgggcttgttctagaagctgagtgagtaactttgggaagaccgaatccccttagctcagcttccttggtatgaaagggaaagtaatgcttccctagcagaattgtggggattggaaataacttttgtgagctgccccaaggaggcatcaatgatgagtgacatcccattcactgctctatatttcgttctataaaaatatctgcaggctgggtactgtggttcatgtctgtaatcccagcactttgggaggctgaggtgagaggatcacgtgagcccaggaatttgagaccagcctgggtaacacagtgaaacacagtctctataaaaaatattttaaaaaattagctgaagccgggtgcagtggctcacacctgtcatcccagcacttttggaggccaaggtggtcagatcacctgaggtcaggagttcgagaccagcctggccaatatgggtgtggtggcacacgcctgtagtcccagctactcaggaggctgaggcaggagaattgcttgaacccggaaggcggaggttgcagtgagccgaggttgcaccactgcactacagcctgggcgacagagcaagtctctgtctcaaaaaaaagtaaaaaataaaaaattagccgagaatggtggtacatgtctgtagtcccaactactcgggaggctgaggcgggaggatcacttgaacccaggagttcaagcctgcagtgagctgtgattgtgctactgtactccagcgtaggcaacagagtgaaaccctgtctctttaaagaaaagaagaatctatgaaaatatagatgtatagtcatagaaaactttgaggaaatgcatgaaatattaatgattggtcctgggctgtgggatcatacttgacacttaaatatttcccgtaatgaatgagtcctcttgtattaagagcatagtaattgcaattcctaacctccctccctggacaggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccaggtgcgtggaccccactctggctgcttattgggtcggtacagacacctagtgttcagtgctggggcaagggtgagcaaaacgagacctggctctgccctcatgcagcttatgctctggtaggaagaccaggtaactaaaaaagactcagaaaatgtgataatcaggatgaaagagaaggcttatggtgctgcatatgtgtatctagtctgggcaagtccaggaagactgccaggaggagaaggaggatgctggtaactgggtaatgaaggagaggaagagaactgtcgtgtttgttcagtccacgtatggaacctatttcacagcagacttaccagcactggggagcaaagatgaagatgatgggttgtctccagcactggctggccctgcctggtcctgggaagacctgggatagccagtgctggggatgggcttgtaatgaattaacca

SEQ ID NO: 101080 - DNA, 1152 bp, Homo sapiens
ctcagtgcaagactcaaaacctctctaagcgttggttttcttatctgtaaaagggggatagtaatagtgcctatgtctcaggatttgtggtaactaattgaaattatttgtgtgaagtgcttagcactggcaagagaaggtgccctctaaatgataaccccaccgccaccagcacactacaactgtcacatgccttttgccttcacaggtcagttcagagctagttttatttcttctgagaaggagccactctcccacagttggcttcctgtgccttaactgcgtcgtcagcactcgagtagagatggcaaaagctaggattagggtgacggaagcccagaggtctgtgtgaacctgcttggtgggctcctggcatcgatctgtcccagtccttgttctcgggtgtctgatgggtcaagaggggacctcagtatcagagcagacgttttgggggagaggctcaaggatctctccccatgatcccctgaggtctcagggatactcatgcaggtcatcattttgtcttgttccctctctcttctttggcagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtgagtgctgcagtgcccccaaccttcgccgtcctctccctcagcaacaccagaccatgggccttgggaccactggtggaacagtggggagggggcacccttggaataacactgaagactgttttaagaaagccctctcctttctggccaccacgatttatcatttttatcgatatagttttgggctccacctttgcttttcctcatttgtattttttaatttgatagtttccttttttgtgatcctcctgcctcagcctcctgagtagctgggactccaggtgcatgccaccatgctcagctaattaaaaaaatatttatttatttatttatttatttatttatttatttatttattttgagatggagtcttgctctgttgcccaggctggagtgcaatggcgcgatcttggctcactgcaagctccgcctcccaggttcatgccattctcctgcctcagcc

SEQ ID NO: 101081 - DNA, 3989 bp, Homo sapiens
aggctctccagggagagctgggcaggatgggatcttcctgggttcccaccttgctccgtgccccctctcactgttcctgaagtgtggccacggactgccttgttttctggaaagtcccaagtctggaccatgactgagcagcattctcggctatctgccacctgtctggggctcctggcccctcttagactcccctctcccttctgtttcccccgagcccctgacttggacctgcagggtggggagagggatgggacgagaacctgtgctggggccaaaggtcgcactgggggaaggtggagccagggcagcagagtgcctggcgtcggcccctatcctgtcactagttcccccgttctggcccctggcaggtttgtaaccccagatcagaagtactccatggacaacactccccacacgccaaccccgttcaagaacgccctggagaagtacggacccctgaagcccctggtacgtggtgtggtcgctgccgtggatctctgcacagtgggatcccttcggttcatccaaccatgttcagtccacaggacccttccctctgaggtctcatttgattctttctcctgagaagatgcagagatcctgataatataaatggggaagctgaggctgctctttgtcacttcctccgactgctcctgagcacctgagtttgcaagcacgcgccggctggtgctagagacatggtggtatcccgtgacactcagcctcaggatgggggagactgatgtgaaatacaaataacttaaacactttcaggcaaagataagcactgggcctagttcagagaagtggcaaattgctactctggcctgtctctgaccaactcccagttctctacagagcacgggaaagcccctcggggacgtctttcctgcagtgtgcaggctgcccttctcccctgctcttcccagttgatgggatggttgtgttttctctatgaaaaaaggagttggcaccttgggctttctgaaacacacaggtgttttagaaatcagtggagggtgagagaaaggcatggttgtggaggcactggactgtgaacaaggtctgcagcgggtccccctgctgtctctctccactgcatggagcctcctatgaagcccaaggtggctgggggctgaggctcccttgggcctgccatggaactgattctgagtcaagcagactttccacggaccatgctacatgagccgaggtgaggcactagttagtgctcctttcctgttgcagtggagatttggctcctctgtactaaaatatctgcatgctctccaaacaggtgtgagggcaaatcacatgaccttggcagctgtaattaaagtttgtgggggcttttcggatgacttatgaggagtggctgtgattcgcacctttcactcttagtagcactcgccctcccctgttctctgttgcctgaagctggagaggtccttggaaccccgaggcctgagaaagggaaatgggtttgagagcccccattagtgtggaacaaagggttgagtgagcctgggctttgagctgtcggggtcctaattcagcagctgtgtgactgtgtgccaggctgttgatctctgagcttctgtttctacctgcttaaaatgacggttactgcacagggctgtgtgagggttacagtgcgtctctgggctgctcccagccatggcaggcccctgggaatcaaggtcatcagctgcttgtccaaggcagcagttagtggttgtgaatggtgcgtgtgagatctgcatcctggcgtcaggcctccttcctgccttacccaggacagcccagttgcagctgggttggtcccacagtcccacacacacacagcccgagtgtggtgcctcacgtgggctgccccgtgcctacccacagccacagaccccgcacctggaggaggacttgaaggaggtgctgcgttctgaggctggcatcgaactcatcatcgaggacgacatcaggcccgagaagcagaagaggaagcctggggtgagtagggtaggggtgggagagcctgggcagggggaattggagccgtggcatgggggaggcgtctggggacaggttgtagaaagtgaggcgctggggagaatgggggcgtagcatatcccctttgccccctttcgcacggtggttgttgaggaaactgacaagataaggacagtgtctctgggaccctcctctgctctgctttgaaggattcacttacttatccagcattgtgttcggaccctgctcaagttgggctgggctggatgtggtggatggagcagcaattacgacccagactggatctccccttagtgttcagggggcagagacagatgctagacagacacaccatgactgaattcacagggtaccaagggccgcagaaagggaggttccaaaggaatcttttgggtggaggcgaggcggtcgggatgagccagccaggccaggcagtgcctggctgagtgtcaagctgcatgagctgggggtgggggagtgggttcaggtgaggtggagtctgcaggggctcctgggcaggggggcagggaagggactgtcccaagcctccgttctatgccagcctccctcccactgcgtcgttagctttcatgacagtgcgcgatcccttcgagtctcctagtgctcctttttcccagactgctctcctcaagggagagctgggaacggtgggatgtacagggtgttaggtaaggaggggaggtgggcggtcagcctgggcgggacttgcccgagctggcaccccatgtgcacgtggagagaacttggcctctggcctccagggtcctccctggcctctccttggtggggatggttgtgagccatggcagcccctgctgagtgcactgttgggtagagtggggatgtgactctcagagccgctccctggtatcggagcaggccctggacctgcttctgtgaggtgcacggttaggaatggggcgttccttgattgtattaggcattgtagaggggcttgtcctgaggggtttgtgttcccatattactggcctgtgggtgctattttaggtgttactggggtgattctctgctgggcctgtttgaggggctgtgtctggtccattcggggtgagaacaggtcacttcgtggtggaggttcatgctgtgttcctgctcactgtcgcagcacctggcaggatagggtctaccttgggtacagagtctaatggggccatggggcctaactttcccagccaccccattcttctgacagcagattcccactagctgggccttgctccaagtctgcactgcagcagggcctggttttgtgaccatccatggccatgaccatccaggtgctgaccatggggaatccagacactcaccctaacccccttctatctgccaacccctagctgcggcggagccccatcaagaaagtccggaagtctctggctcttgacattgtggatgaggatgtgaagctgatgatgtccacactgcccaagtctctatccttggtaaggcttctgctccttggaactgttgagttttggagaggaccctcaaggtggagttagtgtagtgactctccaactgggcttctggaaccctgggctctgcagggaggggctatcagggagggtgggtccgggcacccactcatggcttcagtcagcagctctgcttgtctctcacagaaggttttgtttggcagagttgcgcggctaggacatgttttaaaaacatgcatctgggtctcctgcgctctcccagagagggtcagtgatgtgtctttttttttctttttttttttttgaattggaatttcgctcttgttgcccaggctggagtgcaatggtgccatctcggctcactgcaacctccgtctcccgagttcaagttgttctcctgcctcagcctcccaagtagctgggattacaggcatgcatcaccacgcccggctaattttgtatctttagtagagacggggt

SEQ ID NO: 101082 - DNA, 3072 bp, Homo sapiens
ttcttccctctcacagcttctcgcaaaatggtgactccttgacttggttttggtttcagccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctgtgagtgctgtggccatctctgggggtcctgcagtgcccgccttcttagctcagggctgagtgctggccatccctgggggtcctgcagtgcccgccttcttagctcagggcctttgcataggctgttcctctgcctgggtgcttttcctgctacttcccgtggctgcatttgcttaacttactcttctgatttcagtctcaatgctgcttccttaggggtaagccttctctgaccctacattctgtagagatacccccattctgccattctctcttttgtggcctgggtttcacttgtaactaagtcattatccctgtatttggtttgcttagtacatgtctgtcctcaagcaggggctggcttcaggctgctgacccgtctcactgctccttctcacccgcctcctggctgtggcttctcctcgaggctggtgctgcacggggcgggcagtgcatggccatgtctccttgtccagcgtcctacttacagttgaggaagcccacagccaggaagtgacttgtccagggtcacagggaatgtggagagagaataagaaggctctggcttctaggggagggaggcttataactctacccttccctggccaggatcaccagggtctgttgggaacacatagtccctgcctggatggtaaccctcttgcctcctcccagatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctctttgtgctggtctggactctgcctctctactgggccctgctcatggttccctggtgacctaggggcctcttctgggatatagggacctgaatgctcatcctcagaggccagccttatcggcacagcccaggcctgagcccttgaccctgtttccacagaggggcacaatgagatgagagcaatttctctcgtctctgcacccagtgggcatctctgcaaagctctgagtattaatagccatggggttgggcgggggtgggcagagactgggggcggaggaggacgatgggttggtgcagtagggccttgcctggcccttgccttgggtggctcacctgcccattaacaagcccctgcctcaagctgagcgtggcccccaggtcagaccagtaagcaaggaagaggggtgaaggcagctgggcagaaccctctagccccattggccaaggctgagcaggaggccaggatgggccagagcctctgcccttgtggccctaaatccctagggttgtggctacagagcacagtgcttggcaggtggttgggaagagtcactggggattgaagaggggaagatgccaagtctgagaatgtctaaatgaggaattgatgttttcagcagcaggcttcatgggacaggcacatgaacatccctgtgggcagaggttgagcagacttggggcaggtcctcacctggggcaagagatgcggccaactctagagggatggggactgagttaattagggtgccagagttcagatgtgtctggcctcagacacacccctttctccctgctgagctcccgcctacagtccccctactcctgtccattcacatgcaggcatgccgtgcttggtcctggcagtgtcccagttcttgatctaaagccgaggaggggcgggggctctgtgcttcccaccctgcaccccgcaccccgcagcccatgtggctgggctgcatgcacctgcaggttccatggatgaaccacacctaactcacgccctgagcttttgtgatttgtcagcatggagcctatcccctccccaacttcttccccaaggtctgtcactggccgctccctacagtccttggtcacccaaggtggatgacctgtgccccacggtgaggatggaggctgcattaccttgtctcctatagctcacaccaagactcggtggaacaactttgtcaaactcaaatgcagtgcgctgcaggctaatgatgaaaattcctgggccctctgagtcaggtacctggggtggagcctgcaaaaagggatttttaacaaaccaccagtgggttattcacatgcagggcgttgactggctacactctgagctgacgcctgtgaggctccaggggcttgtaccccatgccctctcttgcctgaggtcttgctcattcccagggactgccctcaggccctttcctgtcctggagggaggaggctgtaaagaacagagtggctgcaggtaacagcaagcttaacataccatcctcactgagctctgtgtgctgtgggcttgttctttggttcatgcattaaataaatactaggccgggtatggtggctcacgcctgtaatcccaacactttgggaggccgaggaggccaaattgcttgagtctaggagtttgagataagcttgggcagcatcatgaaacc

SEQ ID NO: 101083 - DNA, 1358 bp, Homo sapiens
actcaagcgatcctctcgcctcagctcccagagtaacaggctacagctgtgattcaacacacctggctcatttctaactcttttgctgctgcaaataatgctgcagtgaataagctagtacttagctcattttccacatgtgtgattatatttacagaatgaagcctggaagtggaattgctcaatcaaagcctgtatgcattgataatgtttatagctattgtcaaattgccctctgtggaggttgtaccaactgacattctcaccaatgttatgaaagtgcccattttgccctacctttgccagcagagtattttaagccttttgatatttatcaatctgccaggttaaaaaaagaggtagcccagggtagtttactttgcatgtcttttattctgatgcattgcacgttcttccatgcattgatgaggcgtgtgctccttcctcagctggcagtttactgtcctggtctgaggatcttctggggactggtctctcttgctgactctttcgtgtcattttcacaaacaaccttttgaggaaaaaaagtcttaaggacaaacacatgctggcaattagcgccatcgacattccagatatcggggctgggaaggcagggtgagacctgctgggtgtcatcgttctgctctgaactaggaggactgactttcagagggttctcggtgtcctcttcttccacagcgctcctgttgacacaaacagcctcatgttcctccagatttttgatggggaccacgtggcaggcgttgtatttgcaggtggccatctttttggctttcttggggttctttctcctgcacgatgccaggtggtactggaatctgctgagtgggattcggtggtgaggatcataagggcaaatttcaaaggcttctggctccatgagaaattcttgaagcagggtatctcactgctagagtctaacggaaatgcttcttgtggagaagcccttttgtaagaaggatggagttgtcctctgcccagttttggcccttgggattctgtaggtgacggtcttaacttgtggtctgttctctaggactgtgagtggtggattagaagagagatgaggagctgccaaaagcagctacacagagaacagagttagcaaatggcacccgagacagaactatagcagatgcaagagccaaaaacccacagccgcttgactcacggatatactatgatgtcaagctgcagtcaccggtggtcacaatgggcagcctaagtcatcaggaagaggctattgtgcactgcttgggaggggtggatggctttgggaatgctgccatctaaaattgctcatggatgtatgttgtgacttaagtcttttaact

SEQ ID NO: 101084 - DNA, 1004 bp, Homo sapiens
gccaaaggagcttgctgcccaatgcactagaagccaatactatgacactgggtttttgagaaacaaaaagctttttaagtcgactaacaaggagacaggagtccggctcaaatctgtctccctgtgctggctttcagtcatttcattaaaaaaggttgagggggtagattctgggattagcggatgattggtggaaggaaaggggaggtctggaaagtcctcgggcacgcgcagttctctctctatgctaccacatgtgcaaatttgcggggagtgttcatgtggaacaggcagtgtttcctgtttccagaccaggcaaggtggctcacaaatggctctacgatccagagaaagtcagcagggagggttgtgatttgttattatgaaaaattaacaaattacatccaaaatgtgtttaactcctattccctttgaaaaggatctttgggtacctaattgacatattttaagagacatattggctagttagacatcaattgacatcctcattaaatatcaattaacacatatcctaacgtaatatttaattagcttgctgtagctattcttttaaaagtcaattaaatgcttggcatattcttacaagccgactccattgatagcaattatggatgaattcctgtcataagtcatttttagtggatagcagggcaaactgattctgaatatacacatcaggtctttcaagaagaatttaaaaatcaatcattagatatctaatgaaccctcttctctgctgattgtgaataaaaggcatgttcggctcttggactgtagtttagtgcattttcacatgattgttggaactctaggtcaaacagaacagacacctgcctccagggagagtcgtgcttcatttgaaaagaaaattgtggtaaaataaacataacataaaatgtagcatcttaaccttttaaaaatgtatagttcagtagagttaagtacatttgcattgtacaaccagtctccagaaccgttttaat

SEQ ID NO: 101085 - DNA, 1140 bp, Homo sapiens
tagaacagggtatggcatgtgttagtgcttttattactactactactactattattgttacatgctgaaaagttgagactttatgtttaattatgacgattgggtcaaaaacccaagcttctgcgctctggatccagttttctttcttctgctcaaagcttatgacttcagctaattttagtccaattgactctgaacacgggagttacgtgattttgccaggctggaggactgagcagtaagtacctggtatcacattctctgggcctgtgatacatgttccttgcagagataagcttgaaggaacttaacttccatatttatttatttatttgcataatagaatatcttttctgttgatcagtttgtctatctttatgccaatgtcatgctgccttggttactgtagctttatattgtcataaaatcagagtaaattcttcaactttgctcttcctgttcaaaattggattattctggatcatttccattttaaaaccagcttcttcagcctgggcaacagagtgagaccctgtctcaaaaacaaaaacaaaacaaaacaaacaaagaaaagaaaaccagcctcttgatttctgaaaaaggcctgctgggattttgatgaagactgtattaaatctatagatcagtttgagagaatggacatcttattagcagtgaggcttccaacccgtgaacatggtatatatccctatttgtttaggttttctttaatttcacgcagcaatgttttagagaattcaatgtcttacacatcttttgttaattttatccctagatattttattttctgtgctattgtaaacggcatttaacattttattttttcaattgttcactgctagtttatagaaatacaactatttttgtatattgactttgaattcttttaccttgctcagttaatttcttagttctagtggatctttttgtttttgtttttcaggtgaaaaggaatctcttttaacttaaaatagtttgactgttattgaaaatcaagtgtagaggccctgagagaatctgatattactaaaggaagacatgtgatatttaagcaactgagacttagagtaggcagatctgggttcaaatcccagctgtgccggttcttaaccatatgaa

SEQ ID NO: 101086 - DNA, 1016 bp, Homo sapiens
agttcttacatacacttcaaggcgagcagatcaaagaaaaatcccccttatttagaaatgttcctgggggatgaagaaaccataattacttgagactggcagcagtgggtatatggtaaaagcctttgtaaaacagtgcatttttcagatttgtttaaggtttgctagccaaggaaagtaaaatgtgattttgtaactgcactaaacatttgtcatgctgtagttgccagcccagaatattagaagttacaagactgatttaaaccgtctctgatttaatgcaagatatattgtgtctataaaggtttctcttgttattgttaagccagagatctaaggtttagattcaatttgaataaactagctggcctgccctctattgtttgagagagttattaaccatcactaaataagcccctgctggtgctattcatcctaagacatgttacatgcagtttcaagtaagcagcttggaatgggctgcttcagttggagggagggggtgtaatatttgaaacgagtgtgtgtcttcaccatctccagcattttaaatatatggcggttttttttttttttttttgttatcagttgtaatacaggtctcatacctcagtttcagatgttatagatggttacctctttgagctgccctgtcaccccagcaaccctaaaagagaattttgtacattctgtatcccacagatttggtcagccatttcaaaattccctccagtttggtaaaaaaaaaatctgtcttcggtttcagctggatgatgaatccttgtttttcaggtggctccaaaaagaatgttgcatgtgttcagaccatcctgagcagagccaccaaatttagtgacagtgtctagccatgttagcaataatgttaacagaagcttttgtttaaattacaaaatacatttatactatttactaaaactgcgctggctgtggttgattcatgataatgggatgtgggcttcaacaaataggtgatttgtacttgggggagaggggaa

SEQ ID NO: 101087 - DNA, 1345 bp, Homo sapiens
tctcaatctcctgacctcgtgatccacctgcctcggcctcccaaagtgctgggattacaggcgtgagccaccgcgcctggctatttaaatattttataaatagttatcttacatagtgtgtccagtaattcccagtatctgaaaacctcaggggttgtaaatattgttagttttttggttttgattgattggctgttaccaatgatagaaatgaatcagaaatctatttaatagtaatggcataatggtcatttgtaacgttagcctcacagtggttctgaagctgctatattcaggtttagggcacaatatttaggcttcacaggatcggtttcagttgtatgtttgaggtgcttccctcagacccactggtcaaaggctcccaagcttagagttggaacagggcaggtgttctgtcccaaatgtttggcccaggtgattcagttaaaaaataccattatctcacctcgttctatagcttgctaataagatgatgttgaagttgttgagacacaaagacttaggcagcatgaaaatggaggaaggtgcatctcttgcaggaaatttatgagcttagactcataaagctgagggaaggtaaatttcctactgtcataaagaatctgtttaggacagctccatatcccaacatcttcttgtatattttttttcctctttaggtctacaaggaagtcttcacgaggagcagtgagaactcagcgtcgtcgacgttctaagtctcctgtccttcatcctccaaagtttatacattgcagtacaatagcgtcttcttccagcagtcaactcaagcacaaaagccagactgactcacctgatggcagcagtgggctgggaatttcatcccctaaagagttcagtgcaggagaaagctctacttctctcgatgctaatcacacaggggcagtcgttgagcctttgagaacttctgttccaaggctcccatcagagagtaagaaggaagactcctctgacgctacccaagtcccccaagcaagtctcaaagccagtgatctctctgactttcaatcagtttccaagctaaaccagggcaagccatgcacatgcataggcaaggaatgccagtgtaagagatggcatgatatggaagtgtattccttttcaggcctgcagagtgtccctcccttggctccagaacgaagatccacacttgaggactactctcagtcgctgcacgccagaactctgtctggctctccccgatcctgttctgagcaagctcgagtcttcgtggatgatgtgaccattgaggacctgtcaggctacatggagtattacttgtatattcccaagaaaatgtcccaca

SEQ ID NO: 101088 - DNA, 1050 bp, Homo sapiens
ttacttgctaaaagtcacattggtaggacgttgcagagccaggatttgaacctagatagcctgtctccagaacctctgctcttttttttttttttttttttttttgagacggattctggccctgtcgcccaggctggagtgcagtggcgcaatctcagctcactgcaagctccgcctcccgggttcacgccattctcctgcctcagcctcccgagtagctgggactacaggcggccacaaccacacctggctgattttttgtatttttagtagagacggggtttcactgtgttagccaggatggtcttgatctcctgacctggtgatccacccacctcggcctcccaaagtgctgggattacaggcgagagccactgcgtctggcccagaacctctgctcttaaccatcctttatgtggtaccttgaaggcgataggaagaaatgcatgcagtacctagcacaaagtgaaaactagatgttagttgttgttacagccacctgcctattgctagtactatttttgggctatcaaatgagaagatttatgctgatagatttgcacagtagatgttataggtgctcatatttgcttccatgttacttcaaaaacatatctttcctcctgatggttttctaatatggtcaacttgccagttcatatcagtactttgataaattgtcttgggaaacagaagcaaagcagagaagcagagagttccagattgtggctgcagtgtatcctttgtgatttcttatataggaataatttttttatatcaggaaaatactaggaatgtgtacccacaattatacatacaaatctcttagtgtgtaattttgtataagtaactcttgatacacggacttctttcctgatgttttaagaagttgaaatgtaaaataaagccaggccgggcatgatggctcatgcttgtaattccagcactttgggaggccaaggtgagcacatcacttgagctcaggagtttgagaccagcctcggcaacatggtgaaacccgtctgcaaaaaaacaaagaattagctaggc

SEQ ID NO: 101089 - DNA, 2455 bp, Homo sapiens
tcttaggtcttctcaggggcctggaagtgtagacctaggcttgggattcaaggaggtcttggttaaaacggcaagatgtaaataagattgtgacgcatccattttgttgaaagaaaaaaccaggaatttggccttttgatggaggaacttagaagaactttgtaatttttgtaaggttgtggaaaatccgaggcaaagttaaattgcctggtgtgatttgactttaacttcgaataggctttttaaagtttcatctctttggagattgttcaacttcacgagttcactgcagtgaaaacgccaagactgtctcccacaaatttaatattaatgaagaaaggcaagccaattatatctgttgtccggagttagttgtacagccctttctttgaatggggatctggggatgcagaggagcataatgagccttttataattacaaacatgctcttctctagctcttaaggttatgcctaacgctcatttgctcttggctaaaataactgagaaaaaaagtgagtagtaaaaaaatgctggaagtctgaaaatggtttagacagaacttcattcctgaagttttagtctgtagccagattttaattctggcctgttttggtttttagatgatagatcttttagtgtgtcaacaggaatgtaaagtttgtattaacatctagggtgatcacctgccatgctattaagtcagcatggtataattaaaagttacatatgtaggttcagagcctcttagcacagtgttacattgtaagctcttggagggcaggaatgagattctagtccttacggaaatggagtttgggcttctatccctagcattcattctagtgccatgcacgtggtaggaattctgtaaatatttgtgaaagaaatgaatttctgcctgtagggttcagcagtgtatacttaaatgtgatgtgtacgtaaatgctgactgatttccagagagggctaaagaggacttggggggcggtctgcgggttggggagattggctcagatgatttatgaactcggtaagagctgaacattgactaacggatcataaggtaattgaggaacattgtaagtcaaacttcaatttagttctaccagcaggaaggatttgtttacaacctgcaatagtactcttttagatgatgtgaagctttgaaaatattgaaataagtgattgctcacctctccccccaggtatataggaattgattgtgtatttgggggatcctaccctaaactgagaattagagactagtgaagcatgggattgtgtggataatgtttcttcatgtttatgtacttaaataaaccagcaaaatatacgtcgagaatgtatctaaattatttttttgtcctaagaagttgaggtgcaggctggctgaatttttttttttttttttagtagctgaattcttttgagactgttttcagtgttccccagagagctctgcctaaaataccttaacttccgcaaataagtaaagtgaaaagtcctgattccttgcctctttattttgcgctggtactacaataatataatggttactttatatcaaacattatgacaccttgacctttggaatattagaggtctcacaataacttcggagccaccttgagaaacgagcagatatgaatcagagaggacccaagggccgttggagaggcactgctccctctgagaatgcccaagaggggtgggggcgggggggggcgggtaaaggcttagaaataaagaggtgaagtgaaccttttgcttcaaatattctctatttctattttttttgtggtacttttcttctgattctctctgatatgttcatagatgctggtttgcttaatttgtattcaaaatttggtactaataaccctgagtgaaaaaataatttggagactagattcaagggtttattaacagacttctctgttgtgtttcttgttgctttggttggttcttcatctacctttctctgtttaaatataaaaatcaggtggaaaatatggaggactttgattaatcaaactagttaagagatcatttagtggtgcgtctacacaatagtcatttctgttttttttctttactttcaacctttctttaggctaaagagaagtttgtttgttttcttttctttttccactcatgtgcacaatgaagtttttagggggttgcaagtgtatagttcatttattttctttcttgtttaacaattaattacactattccaggctatgaagaaaaacacaaatggaagtatcaaccttactggtagagtgcatttctaattctgctttcacagtggtaacgtcttgttctctaaaacgtgtcttcctgtgaacatagctgtctgggtcaggactgctctagagaaatgctatcatgtgtcatgaaagttatacttaactagggttaggccagacaaatactcagtgtcatttta

SEQ ID NO: 101090 - DNA, 1065 bp, Homo sapiens
cagaaactctggccaagcgctcagccggggattgtctgccataaagacccccgcaccctgtcctcgcccccgccccgtggaattcctctgcataggtgactccacgtagaggaccgagcgcaaggagatcccggggcggtggaggcagaggactactgtgaagaatgacgcctactcactcacctaacagagaggaggaagcaggcacgccccaaaagcgggtcgggagcaaatccacgccactgggaggaggcaaaccgaagaataacaggaaattacgtaaggcgcacgtgcttctgaggggggcgggtgcggggcgttggagaggcgcggccgccgccctgcgtctgcgcagtcgtcggctgccgcgctgccgagtcactggggtgggaggagcataagcagggggaggggtgcatgccggagtgcgcaggcgcaacgcgactcccgaggcgcgggccgcccccttggctggtttggatccgggtcagtcgggtgccgagatttgggagagacgctctgaactgactgccccgcatcaccggagcgtcccagctgcgaggaggtaagtgccctgacgtgacggggaggggccgcagcactgcgtctcagcttccactgccggtctggccgcgggcggttttccccgggcccgcccgccttgggtcgcgtcgtctcccgacgcctcctgcctgggccgggcctgggcctctccgcgcccccttatctgccgcggcctgtgcctgctggagctccgagctccacgctctctccccttcccgccttcccgtcctcccgcggtcccccgccccgtctcgctcctccgccgtctcccgcccagcggcagcttccccttttcgccctccttggccgccctttgccccttccagtcctttctctctcgcctcggagccccattctctttggctacctcttcggccccactcctttcttctcccgcatcccttgtgcctcgctccgactccagcctctcgttctgaccccaggaatctcccgaggagcgcaacttcacagctggagaccccgggcgggcagtgcccctgg

SEQ ID NO: 101091 - DNA, 1072 bp, Homo sapiens
caggaggctgaggcaggagaattgcttggacctaggaggtggaggttgcagtgagctgagatcgcaccactgcactccagcctgggtgacagagcagactccacctcaaaaaagaaaaaacaaaacaaaacagtatttcccactggtcagttttgcataggcatctatttcaggcagggtttttttcttttttttgagatggagttttgctcttgttgcccaggctggggtgcaatggcccgatctcggctcaccgcaacctccacctcccaggttcaagcgattctcctgcctcagcctcccgagtagctgggattacaggcatgcgtcaccacaccaggctaattttgtatttttagtagagatggggtttctccatgttggtcaggctggtctcaaactcctgaccgcaggtgatccacctgcctcggcctcccaaagtgctgggattacaggcatgagccaccgcgcccggctcaggcagggttctttataaaaacagcctgatgcctgaaggacactctctggttgtaatatttgtttcatccatgaagtgtttaaatattgcaactgacttgcgattagccaccaaaacaggcccttttagatgcagtgcctctccgaccaagtattggatgattcatacgtaatggactatgatcattttctgtccatgttttctattactatatgctggtttttttggagcaataagattactttttttctgttctattttgagcgaatcctttacagtttttgataagaactgtgacatttgttctttgttgataaaactcctgaaaataactcacaaggccagtgctgcactctggcacatgtaggttgttttgagggtttgttggttggttggttggctggttgattggttggttggtttagaacactaatgtacttgttatgaaccaaactctggtcttacagtcttaaattccacctcatggggctgttttctctgttagcaatgaaacctgggccaggtgtagtggctcacacctataatcctggcactttgggaggctgaggtgggaggattactggatcccaggag

SEQ ID NO: 101092 - DNA, 1131 bp, Homo sapiens
cgagccggcccgctgtcgcctcgcccagagaagccggtgctagctgccgtggtggacgagtcattggaggggaggtcctcctcctagccgtgacagcagcatctgcacgcgtgtcacgcctgggaggccccggggtagctggtgtcactagcagttagtgtttgcagacccactttgggcagcatgagcttgactgggcaggtggtgacaagcggggtcgtgtgtgtctctgtatatgtaggggtgtggaatggggtggggatgaaccagcccctgtcaccactcccccgcctccccttggagttaggagctgacccctgccctgtttgggagatgccatctcacctctgtcctgcctgcctgtggcagaccccgcgcagaccccaccctgcgtcagatcagatccctccagcgcgtgacagaatccctttacgacctgtggaagagcctcgccccagcctgtgacaggcagagcccccgcctgtgagatactcacagagggctggaaccccctagtctgtgccctttcccctggatctccttggatcatctcagccactcagaatgcatggcagtggcccagaaaagcaatcccagctgggcgctttgagacatctccttaactccacccatccactcctttgcttgcttacttgcttttttcaaaactcccggttagtaagtttattgcacaaaaactctgttgcggtcataaagggaaactctgaaagataaaactgctcccttgatgtgagcctaagtgttttccagaataagtgtctctggcgtgtcctgaaagtcagcccaactttggttatctgcttaaaaccctggttcctttcacaggcagcttcctcaaatgcctgacgggtcttggctctggcaagatcttccttatcagtcccagtgaagattttagtgacaggcctgggggtggtgcctgagaatccattggaacctagaaaaaagtccttctgtccttggtccaccttccttcctcacccaccctgagaggctgggctaagaatagatcatgagagtggtagtggccccaagtctctgtcctgggtttaggtcagccacctttcgtgaacgctggggaggcggacaaggcagctgctgcttcctctg

SEQ ID NO: 101093 - DNA, 1352 bp, Homo sapiens
aagcatttccaaaacagggcctggaatagtgagggaaacggaaggggtggagatcccaaatcccctccgtcagtaccagccacccaccgttgtattaaaaacgcccagcatggactgagttcttaccaggtgccaggtcccgtgctaagcatgtcatatgtattcacttaactaaccttacagagatgcaatggagtagaggctcttccatttaacaaaggagtaaacagactcagagaagccacatcacttgtaaatggtcccacggagatggaatttgcaggtctgtgattgtggaattctggagtgttagctccgcaaattcactacttcactcagccctcaccacaaacccccacccagtaaggtgctgccacccgcagtaaggatatgaaaaaactgaggctgggggtggtggacatgacttgtaagatgtttctagaaagctctgctgtgacaaccagtaactgttttttaaaagcccagtccaactctctgggctcggacctagttcgcggtgacatggccaaacctaccaagaaagtcgggatcgtcggtaaatacgggacccgctatggggcctccctctggaaaatggtgaagaaagttgaaatcagccagcaggccaagtacacttgctctttctgtggcaaaaccaagatgaagagatgagctgcggggatctggcactgtggttcccgcgtgaagacagtggctggcggtgcctggacatacaataccacctccgctatcacggtaaagtccgccatcagaagcctgaaggagttgaaagaccagtagacgctcctctactctttgagacatcactggcctgtaataaatgggttaatttacgtaacaacaacaacaacaaaaaagagcccagtccaaacccacagctgctaaaatttggccatggctacccaaaacccccacatttactattacccctatacccaccacattctcctaggatgggaagaggaagcaaagagttctttggtgaccatctccctggaagggtggaatggggtcatgggggctcttccatgagaggggccactatatgtagagaataatgtgtggccattatgagggggcccagtggtctcatgtgggcatggacatctagaggctgagagaaacgggctgcctggctgaactggtgaaggagccagtgtgggcgtgctaaggtaagccacattcccaggactttcggagtacaggctgctggctggagtgtttcccatgggccagtgttggcagagagcacctacaaggggtcctcttgggtcctgtcccctagagcctcctggaggggcagaggtgtggcagcagcaagaagcttgagt

SEQ ID NO: 101094 - DNA, 1053 bp, Homo sapiens
tttagcctccaaagagagtttggggaatgagtaaaggcggaggaaagtgcatggaggtgtccactccccatcaaacttcccttcaagagggcgtttatatgaatgagcgaaagagggctattagtgtgttctcattccctggcttacttggggagaacattgcatcttactttccatttttctctcagctctggtctgatggaaaatgttgaggctaggaatggagtagaacattccaaagtttaataacgcttttggtgtcatggaagagaacaggcctaagaatcagaaatcttgagttctggcagcccctggtcattgtgttgaaatgctccccaaagagcatttttttttaaattttttgtagagacaaggtctcactatgttgcccaggctggtctcaaactcctggcctcaagcaatccttctccctcaccctcccaaagtgcggggattacaggtatgagctgctgcgcctggcaggggagtatttctaaatgctcttttagtggcagggagcccccattcgtaaaccaccatgacaaagaaatgtaaggtatcctaatcactgccatgaaatgctaagatcaaaaaacaaatccaaagtgaatcctgtcagtggcttcacaaaatagaggaaaggaaggaaaggttggaggaggcacagaggaggcacctttccaggtgtctgcccagtccgcacccttgcactgatacctgtacctcaacctattcacaaagagggctcagagagggccctggcagtcatgcttgtatcctatggccaggggcagattcttaggccccaccagatgctccccactagaaattgggaatctgcattgaggaacttaatttggtggtcaggcaaacctgagagctgagagggtgccagatttaactacgtgcacaggagcgggacagccatacacagaaaaagtgtgaagaagatatgcaaaaggcagaaatgtgtggctgaaggatacacagaccgtcaggcagagacagggagaacggctgtcttggctcctggtggcattctggttcttggtt

SEQ ID NO: 101095 - DNA, 1060 bp, Homo sapiens
actggaaaaacctaagaaataggcctctccaggtcccttctggtctttgagataattctctaggagagctgtggccatgcctgcattaaaacaaatgcgactggccaggaatgcagtgtagaattgaaacatcagggctgagtgattcattcctctttacccagtttttgttttgttttgtttatctgtcttccctcttggggaagcctccacccagttctcccatccaggccagtgggttctgaaccccctccttccctccttcagccatcccacttgccctgcttgggccttttcagcagtgtgtgtcacatcatcatcagatggaaccagaagcagccaggagtgctttttggcacttccagctcagccagtaccgtagaggatccagggttactatccatggtgaaaagaactttctctagaattggtattaatgaggttaagtaacttaatttccaccaacaacttatccagacatttaaaaaggcaatagagataaacagcttagtaacaacagattggccttcaaatttcagagtattgttttctccctaactgagctgtctgcttgactggttagtctaataaatgcacggagaaggtgcacacacaacacagtacttttcactatttaacaccatgatcatgtggaatacattagaaaggaaataggtcaaaaaccatcatgtgaaccgtctaatttgatgtttgggctaaggctaaaatcttcacagggaggttctaaagtgctgaaatgcagaacattcaggctgactggttcacccacaccagagagagaaactcaagtggggctgggagggcaggggggcccagaagtgacccaggaataacctgcccttgtgttcatttccagagaccaaaaaaaaaaaaattttttttttttttttttttttttgaggcagagtcttgctctgtcgcccaggctggagtgcagtggtgcgatcttggctcactgccacttctgcctcctgggttcacgtgattcttctgcctcagcctcccgagtagctgggactacaggagcccgccaccacgc

SEQ ID NO: 101096 - DNA, 1725 bp, Homo sapiens
ggactacaggcacccaccaccacgcctggctaattttttttgtatttttagtagagacagggtttcaccatgttagccaggatggtctcgatctcctgacctcgtgatccacctgccgcggcctcccaaagttctaggattactggcatgagccaccgtgcctggccagcaattagaattttaacactggcagttatgaataatatgaaggagaggtagatttctgagtgattctggtttaaccagctgggtggatggtggttccacgtattcaggtggcaaacaggaaaaacatgtgttcgaagaagaatggaggtaggtggtctcttaagaatggttaagaggcttgggagtcagactgcttgggtttgcatcccagctttgccgttttctggctatcaaacttgtcagctattatttgttgagtacgtactatttgatttatgaccacaggcagctgagcctcagtgttggtgcctagtgtacaagattgttaaagaataaagttattttgcaaagtgtaacccatttttagcactgacatagcactgacagtagctgctgatctcattatgggctaaaataagacaatattcaaaggtcagagatatctagccagaatctgatggaggctggatttcagattttgttacagaattagacagaggaacacagaggggacaggctcagttagggtggaggtgtggggtagggaagcaggacttgatataaattattggaatcattgtcttttaaaccagtggtttatgtcagggtatagcgtttcaagggatttgagggtcagatggggaaatgtagccccttattttgccagtgtgaagcagataccctgcttttctttacagtagcggagtcagcttaagagctttaaaggtcctaaacttcaaaaacattacagtgccccatcctccgccttaatgtaattcaaaatacaaacaatactaaactgtaaaataaatgtaacaaagtccaataaagtttttatttttttctcatgatgataactgatattaatttgaagtaacaaatgctctttaaaagtcgggaggcagtgtccctgctttgcttggtcctaccttaagaagtagtgaagtctgcctcttagtaggaaaaccagtagtctaatcaagactcaagtgaattatacatgtgaatgctgaattatatacaagcatgagtaagacagcattctgaataaggccaggatcatcatttaaagcaggggagtattttgagtcatcagatctcagggtggcctttcattccagatgagtacctttatgtttcatcactatgaaagggcttgcctagccttggggaatgcgggttggggccctggctttcagatcagggacatgctctaggaactcatcaaaggcaatagcagtggctgccacttttacctcgttaaagccgggagaaagcttctaggtccatgctggactcctttattttctaggttggtcttgcgggttatctggttgggaagtaaaactttctcttggtaatcaaagaaactgcctgccaaagagtagccatggacctggttctcagtatagaggttttgttctttttctttttggctagccaagtgaggaatggagaaggaacaaagaaatctgtaactggttcttttttctttttttagacagagttttgctctgttgcccaggctggagtgcagtggtgccatcttggctcact

SEQ ID NO: 101097 - DNA, 2733 bp, Homo sapiens
tgatatgtgcagtggcagaaggaagcctaggaagctgtgggaagtcggaggagtgtcttgtaacctagccagtgaggggtgatgtcagggaaggccttccagaggacatgacagcaagtcagagaagtgaaggatgagtaagttagttggaaggaggttggcacgtggtaccttccaatcatagaagcggcacttgtgaagtcacggaaacagacacagagagcatagtgtgttttatgaaactcctaagcaattaagccatcacatcaagtagtaactgatgacagtgacgtcagtcttatgatgacaggcagcagttcagaactttaagcaggatcttcagaaagctttcagtctccaaagtaggaacagctcagcagtaagtgtcttgtatacaggccagtggcagcagttcattgtcatggcccctttctgatttgtcttccttgggatcactttccagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacaggtaggagacacagacaaaacagacagaagaccataaaacccttggatggcctataaaatctcatccattgtcctgacctcagaacccttgctcttacccatataatgaagttgggttaaatactcttgactttatcccctctagcatttaaaacccattggaattctttgcaatgcaaatcattgggagctcttacagagttgagttaattgagagagaaaatcatgacataaagcaatctgacccatctttgttcactaattttctgtgtatagagatggccatgtcagagcattctggttcccgtaataatgtactaaggaaggaaagtttcagggaggctatctcaatctagacctttgccagtaactaggaacatttaaagaactttgccctgatagggtctttcatgctggcaagaagaaaagtcatttgagaggcagagtcaatgagctgtttagttcttggtcataagaactaaaaatagcagcttcctctggtccccttcaaccctactggggggtagtgccagccaagtttcactggagaatttcttggccttggctggggggctgcaggaggctgatagaagtcaggtagaccaggcttttctacctgactctctcttgttttcttagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggtctccttcaccgaaaacccatataccttttaagtttgtttcaactaaaatattaagtgaatgctttgcaagtttgactgtatgcaggtttatatcagaaggtgagattgaataatgcttgatgcagaatcgaaacttctcatttatctgtatattatgtttacttctaaggatatagcacaaagggaacattttttgtttaaagtgaactacagctgtgctgtgaagagagttctttataaagcctgtaggttcttttaactttggtttaaaatgtaagataggaaaatgttggatatttgaggccatgcttaatatatttatattgcagtatcctttaaaagcaaaaaaaaaaaaatgcatttatattacagttttcctctatgaaagtccttacttatatgatacaagcactgtgttttgtgcttaaactcttcagcggggtagcatcaaagttcttggggaaggatcgtatatgtgggtcccttccctagaagaatggttgctgatatggctactgcttctacatcttgagttttttaatttactttttttacactgtagcattgagactgcttgattcaagtctggtgctttgccagatgtattaatttccataaatgctttgtgagtttggttaaaatgaagattcacttgggaaaacactgcagctttagtctgtgttactatcttgttatgagtatgtaaaagtaaaatgcatgtgaatttatcatatttgcactatgaaggtatttggttaaaatacaaagacttttaagattttaaggccctttcttccaacagcttttatagttagcagccattctttattttctggatagccaggttttatcacgcttctagtcaggatgctcctattccttctaaaaattacggtctgactagtgagcaaagtcttgaatttattcaaaagtcctaaataccttctctaggtaagacacttggtagatgagagacggaaggcattgtcaagaaccattttcatgagaggtggtgtgcaaaaaggtagaataaaagagttctttcaacaaagatttactgtctattctgtactagaccctgtaggttttggggtacagtgttaaacatgatagaggctctgccgtcttggactttaatagcttagagaagagagcaaatgagctgacaggtggttataatgtgaattagtgctgtggtttaggaattggagagaactcaaaggag

SEQ ID NO: 101098 - DNA, 2044 bp, Homo sapiens
caccactgcactccagccggggtgacaaaagcgagactccgtctcagaaaaaaaagaaaaaaaaaccgtttaaaaaaattcatggagttatagatatgaaatatgaaaattctatctagacatcacctttccttttaaaagtgagaaaacagaagtctcaaagaagtgataggcctctcccagctactaattagttgcagagctgatcttagatcttttcactacaccaagggagtggaaaatcaaagtccttgtgtgatgcacaggaatttctaggattgtgaaatgcgttgagaaccagtagtacttgcttggtctttctgggttcttttgcgagctaactgaacagaaggttacttgtcacctttcaactctcaagaagaatccgaaagttctcagttactgatagttgaattaactccagagaagtgcactgcattttggaaagtcagcccttggcagtccctgtgccactgttttccttttgattccataggaacaccagcctcgctccggcctcttgcagtcctccctcatcaccctctacactatgtacctcacctggtcagccatgtccaatgaacctggtaagggaatgtcaataacacattcatttgataaaaagaaagtaggaaatcagcctttacatagttggtacaaaaactagagctagagcaaatgtgaaacaagcaaacaaaacttaaacgtacagtgttcactgtaggtttgtaggtatttacctttcacattttagtccccacatctattgatagctatttataactgacagtctaaagggtcagagtcctttagatggtctaggctttacctaacctaggctgagtcaaactagttaagagctgtggtcaagggctttggccctttgttgtgactgaattttagtttgatgtcacaggctgtagaagaaacagctgtaggaaatctccttttgtagttattataggattgtttctcagtaggatattctatgggcttcttttaaaggaaaacaatgcagaccccccttccaccaatgataacttatattttgttcttaagtaactatgtaaaaaccaaaatagagataaacttctgtgcttaaaaccttgacacttaaagaattaaaaagatttgtcaaactacaaaaccaataaaatcaataatgatgtttatgaaatttgacagattctgttgttgttttctttttttttcctaattctgtcattgattgtgaccaaacgtgttactactgactgctaagtttcagattttttaagtaaagcattcccatgtttcacatcatgactgaatgatatgtagggaactcctcaagttctttcttggaacaagatgagctgtaaccaaggataatacaaattttctcattttcagatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctaggtaagttaaaaggtacttagaacaagattttcatggaggttgataataaagtgaagaagctgttttgctttcaaaaagcagcatgagaaatttaaaaacttcactctctttaatgaaaagttctttacttgcttcagttacagagctgtgtacatatatatttttttgagacagtgtcttgctctgtcacctaggctggagtgcagtggcaggatctcagctcactgcaatctccacctcctgggttcaagcagttcttctgcctcaggctcccaagtagctgagattacaggcacctgccactatgcctggctaatttttgtatttttagtagagacagtgtttcaccatgttggctaggctggtctcgaactcctgacctcaggtgatcctcctttctcagcctcccaaagtgctgggattacaggtgtgagccaccatgcccagcctgtagtaagttttgaaattagg

SEQ ID NO: 101099 - DNA, 1661 bp, Homo sapiens
acatgcaaaattcattgagataagtagaaactagttttcttaatctgggctttgacttgaatacaagttagctgagctcatcattcttgcagttggtctgagtgtactgtatgtgctgtttcatgttttctaattttcagagctacacagctaattgttttgtttgttgtttgagatggggttttgttctgttgtccaggctggagtgcagtggcaccatctcggctcactgcaacctctatgtcttgggctcaagcaatccccctgcctcagcttcccaagtagctggggctacagccttatgccaccatgcctggctgatttttgtattttttgtagagacagggtttggccatgttgcctgggctggtctggaactcaggctcaagcaatccagccaccttggcctcccaaagtgctgggattacaggcatgagccaccatgttcagccaacacagctaattgttgatttttagtgtgaatggaaaagaccattactttagatattaaaaaatagcaaatgagccacttttccagttcagggacagtcttattgtttgtgatgggaaatggatttagatagccaatggctgcagaggaaaaaactgtcataaaaagataccagtgtgtgtattctgttttcctctaacaccatcctggcatggagcttgctgtgaactgggtcattttgagggtaaaggaatcatttaggttcctaagaaaagctcacaatacacattaattaacatataggtagcagtaaactctagctggaatgatcaaatgtctggtaatcaacccatgaaatcaaatcaggtaattcaggaagtgaattcagttgcttggtggattttggaatttaacatcaagccaattgaatacaatcttgatactttaaccttgagacctctgtaattttactgtaaattaccccagaaaagtgacataatgtctcctcatttttatatggagtggaagaaaattggccttcattattagtttattatagttgtggtcattcatattggtttccctttctccagctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggtatgattgtttactacttctttctcctgtgaaaggtttttaattctaagcttaaaatctaggtaccctttcttatgaatttatgtctaagtttatccacttgaacatttttccatattataaagtcttcataattctatttcatgcctatatcataattaaatgaatttcactatcattaaaaaaaaacccaggtaacttgaaaatttatagtgcttttttttttttttttttttttttttgagatggagtctcgctctgtcaaccaggctggagtgcagtggcacaatctcggctcactgcaacctctgcctcctgggttcaagcagttctctgcctcagcctcccgagtagctgggatcacaggcagccaccaccgggcctggccagtttttgtatttttggtagagatagggtttcaccatcttggccaggctgaactcttga

SEQ ID NO: 101100 - DNA, 1114 bp, Homo sapiens
attaatatgtggatttaggtcaggaggcattcactgcacctctcagattttctggaaccatatgttaatcttttggcaatatcttaatagtttgtgttctcacttgatggaatacaaagctaatcagagagcctgtcaaaataaggacttacaactcttgtgctcccctatctctgtcttaacctacttcctaagcatggcatcaggtgacatctttagatttctactgtgatttaaaagaaaagacttatagtatcatttggaactcaggtcccaggcttcccttggcacaagctaaaacatattttaaaaggtctgaaacccagtagaaagcttttaagaatgccgttgagtttggaatcttgctgtactgctggagacagaatgtctttaccacctctgtcttgttttaattgaaatccgttcagaatgttggatcttctgaaatgttactctatggtagagaataactttgttctcttggttcttgtagtctggtttgttgttggcatgataggggccgccctcttcatcctcattcagctggtgctgctggtagattttgctcattcttggaatgaatcatgggtaaatcgaatggaagaaggaaacccaaggttgtggtatgctggtaggtatctctactcacctatgttagccatactgctacattaagcacggtgtacaataaaaatcatcattatagtcccagcagctatagtcctcagggacagaagtccaaggtgggagaatggcttgaatccaggagttcaagaccagtctaggcagcatattgagactccatctttacattagaaaaaaaaaatttgccaggcatggtggcatatacctatagtcctagctactcagcacgctaaggcaggagaatctctggaatccaggagttcaaggctgcagtaagctatcatcatgccactgtactgcagcctgggtgacagagcaagaccctgtctctaaaaataataataacattaaataaaaggaaaaaaatccacaatttccagaatttggctctgaattatatgcatcactggaagaaagtagcacagataatataaattgttcgattttcccaatttatgtattttgagag

SEQ ID NO: 101101 - DNA, 2202 bp, Homo sapiens
tgatccacccgcctcggcctcccaaagtgctgggattacaggcgtgagccaccacgcccggcatgttgctttatgttgtaatatcagctttggtaacttggattcgcagtaagcagcaagtggagttaggtttatatttttctcatattttaaaacaaatgatgctctcagaatataattaacatttattgaactgttaatgcattttaggtagtgttgagtgctcatttaatacagcagagtctgagggaggaaaattccattattgagctcattttacaaatggtcaaatggggttagagtacgtaacttgctggggtaaaaagcggcagaaataatatttactccagagcccgtacttttaaccacttcctcccagccatgattctctgagttaaaactataaagcctgatttgcctcgctttctcttctgcgacatctgtgtcataaaggagtatactgaaggcggtctcaggtgaccatggtgtgctcattccaggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaaggtaagaagtaacagtgcccttaaggtattggttatttttatttttatattctgcaaaattctagttttatttcgtcgttgttaatcaagttggttgtaatttggagattttttacttatatgggggtgtggtcaaaacacagaaatatgaggacattagtccttttccagaaatacagaatgaacatctgggctccagtcgaacaactgagagaaaacattaaaagggtggctccaaaacattttctttccttatgtgttaaaggtcgaagcatctaaactggactagttcttcacctttggaaggactcagtcgtagctggaaaatctcacaggaaagtggcacacagcctcttcatcctaaaagggcaaagaagagagaccatatttttttgaaactaagactcactctgttgcccaggctggagtgcagtgacatgatcttggctcactgcaacctccgcctccctggttcaagcaattctcctgcctcagcctcccgagtagctgggattataagcatgcaccaccatgcccgggtaattttttgtatttttagtagagatagggttttcaccatgctggccagggtggtctcgaactcctgacctcgtgatccacccacctcggtcccccaaaatactgggattacagatgtgagccaccgtgcccagccgagagagcatttttatttttaaaatgcatgttatttatactgtttggtaacaagattgtaaatgaattggaagacaaagagaaaaattccatagtcagtcttgcagttgttgaagtagttaattttctaaatccaggctttcctgcagtgggttagagtctctgtctaaatgtagatattctcgtaacattgaaattgcttttttccagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggtatgttagatttatgattaactggttacattatggtgtggctcttccttcccttcagcagttaatatagccattctgatgaaatcaatggaatatgtaaatgagtggctcagatgcatttctgatctattatgcatgtgaaattgttttaatgtcattttcagttagattgctgtaacatggaggggatagggggtcttgtctttttattttcttctattaaattcctttgcttcatgttcttagatttttattgaacacctgttaaatagttgaagcactatgctagatactacgtacacacacacttttttctttctgttgtttaaagataaacatgtacctgataaatttaaacagtgtacaaaagtcagtgaatatatatgtgctactgatttacatattctattgcttctgactcctgaccaccttttacctatgtttctaattctctcctttttt

SEQ ID NO: 101102 - DNA, 1074 bp, Homo sapiens
agttcgcagattaaaaaataaatccttcagagaagccttccaagactactgcccagctaaattactttccccttacaataggaggcactaaatacacctttattgaaagcctattcccccatactacttcatcgtattcattacattggggcacggtgcatttatgttgtcagatctcctattaactagagaataaattctgagcgtactgtgcctctctgtacacttctgtaacttccagatctttgcacaatgaatacaaatgatgtaaggaatgacaccttcacagttcctgcaaccccaggatggtttagccccaccttccccctcagccaatgacaggcgcccccctctgccgctccggtcgcggacggtgggcggggccacgccgtgacgcatccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggtgagttcggggtcccgagtcctcgccggacctgcggtttgcggggaaaggcctcgagaccagagctgcacgggccttggctccagaggctctcgggatgtcagcaggccctgggctacagagggtctccggggccccagacgcaaatccgcgataccctcaggtccagcttaggcggctcgccctccgggttcctcggggaacggaagaggctaggccgccattgtttacaattcggatggctccgccctgcgaggcttcctgactaggttcctctggagctggagagggaccaaggaatgacagctcccagcgaggggctccggttcctcccgaagcacctcttaaggtgccatcatttagttctaggtggctcaagtaatatttttatcccctagcacgggatttgccaaaactacagagtgtgtggcaaagctggggttttagcggaggcttgtctgcagttcaggtgcaagggaaagaagcccttgtggattgttattca

SEQ ID NO: 101103 - DNA, 1126 bp, Homo sapiens
actggaacttaaagatcaatattgaaagagatccatccagagaggttgacaaaaaaaaaaaggctgagattattcagggctactgcattgcatactcttggaagaatgagccatgcacttagtctacactaaaagaaatggctagagaaacaggaacaggagagaaaccagcaaagtatagtaatgaaggccaaagggagaggttggttggcctttgtagatgttgctgagatgtcgagtaatacaagttaaaaattaaaatgtgtccttttgggtaaataaatatggaggtcggttgggacctcattgagcagatttggtgaaatggttggggcggaatctataatatcagcagctttcaaaggttcaatataatatatcagtgggatgagttaagagtgggatgtgagaaagacaaagtgtaggcagctcagagaagtttggctgcgaagggaggtagagagaaggctgaggagcgattggggaataggtgaagtttttttgagcatgagagagattaaatgctgttggcaaagagccagtggagagagagaaaggctgagaagacacaggatatgaaagggagaattgatagtataactttcctgagaaggtgggagtggaggagctccacagtacagatccttcaataggagtctgatgcctgttactttttggagacgtgggaagccaggttattcctgaaaggagtgcaccagtgtaatgcaacaaaaataaataaaggtataagtgtggaaggaaagtcacaattttcattgtcggcagatagcaggcatttattgaactagtattgtgttaagtacttttcatgcaccattcttttttttttttttgggacagggtatcactctgtcgcccatgctggagtgtagtggtgcaatcttggctcactgcagcctctgcctcctgtgctcaagcgatccacctgcctcagccccccaagtagctgggaatacaggtgcgagccaccacactcagctaatttttgtatttttagtagagatgaggttttgccatgttgaccaggctggtctcgaactccagacctcaagtgatccacccgcatcggcctcccaagatgctaggattacaggcatgagccact

SEQ ID NO: 101104 - DNA, 1119 bp, Homo sapiens
ggagagcttcagctaccctgacttgagatgaccaagggtcacatgttcaccctctttagttatcccacgtttggctcccacccctatgcaacctgatgtacagtttcataaacatgcctctgctctgatgagtagcgctgatctaagaagattcctggcaactattaaaaagccctggggccccatggctgttgactgaagtagatttaggaagcacagaagttcttttttcagggcagaggcacgcatggctcatttctttctttggaactaagtagagtggcactggttgtcagaactgctgcaggctgcctgtgccagcaactcatctgctctgtgccaggcaggcaggctgctgacatttcaagagtccctttgaggactccagcaacatgctgtcattagagcaactgaggacagtccatagtttattagtatatttcctttggaaaaaatgtctccccctctctctctctttaaaattcctgctttagctgcattgctgcattcatgtgcagtgactcttatgtcaaatgcctatgaggagattatgactaatttaacattttgttgttgagaggacataaggaatggtagaaggagtactagattaaggatcaggagcctggattcttgcgcaagttacgtaacttttcctagctttgatttcttcatttgtcaagtaaagatagtcatgtccctcctgtttcttggggttgatgagaaaatttatgtaaaggtactttctggactataccgaacaaatggaatgcaaaggagaagtagggtaatggaaggagcttggtgtttgagtctcacaggcctcgcccacactgtgacctcaagcaagtggctaatgtctctcagcctcaaccttttcatctgtaaaatgggaacatctatacttgccttgcaggagtgttagaaggattagaaataacatatgtaaagcactgacaaatggcaaacaatagttgaatagcaataattgttattattacacttaatgtggatatattcactctgggtgatttaggattctaaacctaaggaagtattcagtttatagatgtagagattagcaaaaggccctgctagtaactgatagtagcaactgat

SEQ ID NO: 101105 - DNA, 1008 bp, Homo sapiens
gtgtatgtgtgtgtggttttttttttgagacagattatcattctgtcacccaggctggaatgctgtggcatgatctcatctcactgcaacctctgcctcccaggttcaagcaattctcctgcctcagcctcccgagtagctgggagcctcctgagtagctgggactacaggtgtgcaccaccacgcccagctaatttttttgtgttttttttagtagagacagggtttcaccatgttggccaggctggtctcgaactcctgacctcaagtgacctgctcgcctcagcctcccaaagtgctgggattacaagcgtcagccaccgtgcttgaccaagaacattgttttaagtgtaagtgtggttccttctctggggccttacaccaggattgtggtgagacgatgtattgttctcctttcttttttcctgttcttctgtattttcttatctttttacaataagcaattatgattataattggaagaaaacaaaatctacttttattcgtaaatctcaatcaatatacttctcaattaattgtctagaaaaagcatggaccttctaactgcatggcacagtgaataagtgagttggaaatggtatgacagctgaaacctgcctttgatgggtgatgagcgattgcactgtacagcagctgtgtggactagaaagtgggtagtggtggccagaatttctttattcatatactccttcaacagatatccgtcagttgctagctgatatagtttggatgtctaactatattggtggatagctgttggatgtcatgttgaaatgtgaaccccagtgttggaagtgggccctggtgggaggtgtgtgggttatgcgtacagatctctcatgaatggcgtgatcccctccctgctgtaatgagtgagttcttgttcggttagttcaagtgagaactggttattttttaattaaaaaaaattattttggccgggcatggtggctcatgcctgtaatcccagcactttgggaggccaag

SEQ ID NO: 101106 - DNA, 1998 bp, Homo sapiens
tagccaggatggtcttgatctagaactactaatttcatatctttcctccccactccacctctcttctgagctccagcctcctagttccatgtacctagcctacctctccccttggagggctcacaggcatctcaaagttaccgaataggccaaacaggactttatgccctcaaatattcctcctttgttcttccatatgtcagcaaaccacacttctgtccacctacttattcacaccagaaacctaaattacctgtcaatccaacactacttcttgttggttcgatttccaagttatatctagaatccttcccactgcccccctcctccacccaccatcttggcacctgaacttcacaggagcctcctaacttgccccttcccagcactgctgtgcccggccgccacagtcacctttgaaaatgcacggctgctacttcatggccttgcctaaagcccctcaggaaccaagttccagatgtggtctggctcctgcctacctcagcagtgtccttggtgtcattgtccctcttctgccatgctcccgcctgctggctctttctgtccttccaagccctcatgcctccctccctcagagccttcacacatgctgttcccctctctgtagtgctcttcccctcactcttcatctgcatgacgcctcgtcctccttggttctcagctaaaatgtcactttgtgacccccagccttgatcaggtcccagtgatcactccagcaccctgcattctcccttgaagccttgagcaccaaggccatgacttaggtacgaggtgactttatgccacctgtagtagatggtaagctctgtgaggccagggaccatggccagtttgttcatggtggtatctgtgccagtgcctggcgcatggtattaataaatgtgtgtacatgtttgtcaataattttatttaaagaaaagtctgagcccatgttctttaaaatgttgatggtggttgtctgggtgtggaattatgagtgacttgttttgttctttgtacttttctgtgctttttgctttgttttcaataagaggcaataactgtcattttgacagaagccactgtgctggggaactggagctgtcctctctgcagaatgcatctggacttacctctgcccccttgccttctgtccccacaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcaggttagagccagcaggtccttggcactactgcatgccagaggccctctgccgggccccgggctagcctccaagtcctagactgcccatactttcttagagaagaaaccacatttaagtcaggcctgccccatggtcagtggcagagtccagcaatctctaggttggaagatgtttgagtctcaggccccaaggactcctctggacaggcatccgggactcttcctgtccccctgccccctagcccaggtccctccacttctcgctatccccacagctatacctggctctggccactcacagctctcacctggctgactttagcggccggcttccctgggctccctacacccatctccgcccttcctgttcagctctatgcagcagccagcagaccccatttaaaccattctgtccatcatgcttctgccaaaaaaaaaaaatcccccagtggcttcactgagtgaagctaagcttgtcacattgccctggggcagtcctgctgtaggccgggccctgcccaagtctcacccggtgccactcctctccctgacaccctccagctacatctacctttggtctgtttctcagtcaagcctctccaaggggccttctctgagtgctagatcagccttccccaatcacatgaccctcatcactctctg

SEQ ID NO: 101107 - DNA, 1082 bp, Homo sapiens
aagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtgtgactggtttaagattatttctccttaaccttgcaaaaacaggggttgggccttattttccccaagtccacaattagccggacttgccccaggcttctagaacatacgattctgagaagatgctggcgttctgcagaggccagcaccctccaaggccagtgtctgatgagccctcttccatctcatctgctctcaccccaactgccagcttcaggaacccaaaaggaagctttactccttaaaacctagagttaggaggggctgagagttcagggaatgtttgagcaacaaccagagaagccttatttcttctggaaggaggacagcctctggacccctcttggcccacagcattgggatctctggcctggcattcacagccacccttaggctcaggccctgctgctgagcaggctgacccagctc

SEQ ID NO: 101108 - DNA, 1132 bp, Homo sapiens
tttctggggagagggttgacagctttcactggattctttaaaggcactcaacccaagcaaaggatcaaaaacctggtcctaggtcaggacgtcaacacaaagatgtcttctctgtggaaagtgtctaggttgggcttgtcttggactgttgaggcagactcactccctctctccaaagattccaggccccggactggacctgtagataccatactcccaaacccgagtcaaggccagtatggctcacacccactcaccagccttttaaactcctcttcagtaaagcccatgtcccgtttggtcatctggtaatcagtgtccagggtggacttgaagatgagcgggtcatctgtgttgagcgagtagttagcctggtcatttttgagcctgcagaagagggaggaggagagaatcagcctccttttactcttacataaatagtcagaacacattgacgttcacccgcctttgatcctcacagcagcctcaaacagatctgaaagatctgatccttgtgcagagggggaaataaattcagaacttaggtgacttgttcaagtctatgtaaccagaaagtccagaatccagcccatcctgaagaccagagctgggcaaaggcagcagaggggccagacatgggaaccaggcagaatggcagccggtgggggcgtgggggtgggagccaagaaagcaacatccccctccggctgccaccctctccagccttcccctctgcaccctaccctgcttgttcctcagtcccactgggagctggctactccaacataccatggaagctgttcttggcacgatccctgaccaccatcttgttgtatctaatggatctttcctagctctgaccataatcgacttgcatagcagaatttcacactgttgactgtttcttgaaaccttttccctggatttctgtgacaccacacttttgactttcctcctacttgtctcttttgctggtcccttaaataccattgtccttctgggttctatcctaggcccttcttgctccaccacctcctggggccactgcttctccttcagccaccatatctgtgcagatgactcctggatctttttccagcccatggtatacccacatgcctccaagaacctc

SEQ ID NO: 101109 - DNA, 1030 bp, Homo sapiens
aggcaggagaatcgcttgaacccgggaggcagaggttgcagtgagcccagatcacaccactgcactccagcctggccgacaagcacgaaacttcatctcaaaaagaggaaaaaagaaagaggagtggagggtcaccaggcctccctctttaaaaccaataaacaaaaagccactgcctttgagatgtgtaatttaaaaccataaataattaaaaataaaaactgggtgacagagccgggagaggaaaggtgggttagggtatgtgaaccaaattctcacatttcagagatataatagagctaagctcttagaatatataatattatcgtatttataatatattgatacatattaatatatttagtaatttattattatttgggcttactaaaaaaggaactcaaaactgaacgaggcaaagtggctgctctggaatgtgggccgggggtgggctagagatggagaaaagacagttacctcccaccgtcccactataaatcttcaattttagagatttttgttgttgctgtgttgctttttgaaaattatcacatgaatgtgactttctaaaaaaggcaactgaaaagaggaggattgatttcataaatgctgctgccacccacaagaggtagtcacgtgttatgggtcaggtgcacggcatctgcaacagccccgccatcccctttttgctgtgtgactctgagaaagttgcttaacttctctgtgtctcagtttctccagctgtaaaatggggacaataagagcatccacttcatagcgttgtgagaactacttgagtttgttcaagttaagcagctgtagcagtgcctggcacatggtactatatcagaggtagccgttattatccctgtgatggaatatgatatatccatttaaatacataggaaaacaccagtgagttcaccttatggataaaagcaggataagaaggtgtatttccaactcgatctcaactaagtgtgtccctatgcacgtatacaggtatatctacacatacacatgcatacac

SEQ ID NO: 101110 - DNA, 1061 bp, Homo sapiens
accatccccagctggtggccctgtgcctgggccctgggctgatggaagatggtccgtgcccaggcccttggctgcaggcaacactttagcttgggtccaccatgcagaacaccaatattaacacgctgcctggtctgtctggatcccgaggtatggcagaggtgcaagacctagtcccctttcctctaactcactgcctaggaggctggccaaggtgtccagggtcctctagcccactccctgcctacacacacagcctatatcaaacatgcacacgggcgagctttctctccgacttcccctgggcaagagatgggacaagcagtcccttaatattgaggctgcagcaggtgctgggctggactggccatttttctgggggtaggatgaagagaaggcacacagagattctggatctcctgctgccttttctggagtttgtaaaattgttcctgaatacaagcctatgcgtgatcttgtgtgtcaggcctgtgttttctgagaaagccctcccattatccggggcagaattcaggggcagagttctctgtgaacctcacaaggtgaaatcacatggtcttaaagaaagccagaagacaggccttcaagtgatccaagaaacccaattcatattaataataattaacttttttatttatttatttttttgagatggagttttgctcttgttgcccaggctggagctggagtacaatagcacgatctcgactcactgcagcctcccgggttcaagtgattctcctgcctcaagactcctgagtagctgggattataggcgcatgccaccatgctcggctttttttttttttttaaatatatttttagtagagatggggtttagccatgatggtcaggctggtctcgaactcctgacctcaagtgatccgcccgccgcctcggcctcccaaagtgctgggattacaggcgtgagctactgcgcccagccaataattaacattgcttgagcgcctgctatgtgctaggcactagcactttatacagaccagtgcttcccagcgtttttgaccagagaagagcag

SEQ ID NO: 101111 - DNA, 1126 bp, Homo sapiens
acatgccagctttgtaattatgggcaggttcattaacccctgagcttcagctttcccttctgaaaatgaagacaatacttaccttcactggtggttgtgaagattacatgaaatgatgagtgctgagcacctctcataggctctggttcaactcgataaatggaaattcctgtctttatgtgggaagatgattctttgagggtggaatttcaggcaccagcaagccagtgggaaggaattgtggtttgaaaacaaccacagatagggatgcttcgtagttctaaaatctcccttgtgagccccacctctgccctaggcaggcccagtcctctgtgctcagtcagcaccacggacagttcctgcacacgccagttctttgctgtggacttaatcgcattttagaggccttcagttgcaagtcacaactttatataccaccaagggagctaaaacatgtcagaatttaactctgacatgccactggttgccattcacatcttaattttggagatgttgaaaaaatgcttgtcttagaatcgatgaaataatgagtttactagaggtggtatcagtgagcagttgaccattgacctttagagaggttaatagtaatagccagtatttattgaatgtcaactgtattacaggccttttcccctccttcctgtcctgttctgggtgctgtttgccctgtatacacattctcttaacaaagattacatttggggaatataaatgtgagccagatatacagtaaatcaacaggctttccaccatctttttcctcaaaatcttccaatctttagcctcacttcttcagaacattgcttcctgctgaatgatagtctaacgtgttaacctttccagttcacaccgtggttaatccacctaaaaggcatttcaaatgcataccctgtaacccagcagctgcactcctaggtatgtgccctgaagaactgcacagaaatggtcaccaaaagacacatacaagaatgtttttggcagagctatttgtaatatctcattactggaggctacccacccagatgctcatcagcaatagaatagatgaaaattattttgatatattcacacaatgtactacaataagtcatgagaatgaatg

SEQ ID NO: 101112 - DNA, 1287 bp, Homo sapiens
aagaaacctgggtttgagatctcatttctgccagtttgccaactgaccctgggcaagtcattcccctctttgaactttgatttcctcattagatgaacaggttcacagctataagcaggaggtaacctacaggtggtttaatgatactgcacatatcaaagacacatggcaaggctctgactggggagtgcgggaagggtctcaaaccaaggctgacctctgcctttgctgaggagacaatgtgtgtgcagggaacagctttaaattagggctcgtctgtaaaatgggcatgatgacacttgccctgctctcctagtttaggttttcccagaacagagcctgacacaaggaatcaagtacaagtattagggcaaaccacctgaaactgccattttattagtggaagcagtctaatagaattttgtatgcttcatatggttcacaaaggtgatggatgaaaccccaggatgggagtgagaaagtgaggcagagaaagaagtcaggagactgtgtattatcaggcaggttaacccaagcaagggcaactggagtttagtcttgctggggacttctggggagacagtgtagcacagaactcagcaagctgcttctgtaaagggccagacagtagatattttagtctttgcaggattacagtctctgttgtaactgctcaatcatgaagttgtagtgagaaagcagccccagacaatatgtaaatgaaagggtgagctgtgttctaataaaactttatttacaaaaataggcagcaagatggatttagtccgaggcccatagtttgcagactcctggggtagaacacgcgctttagttatcccacccaggaaagagggagctcaggtatttatacagcagttcccatcagtaattggttaagagctgctagggaagatcagagagttggttattgcctgtttatttccagcctgccatgggtggtagccctcaggcagagaaatgcaggtgctggcaataggagactgggctaggacaaggggttaggacatgaggaatgacagcattgctcactccagctcagaggaatggcttgtttgactatttggagaatgtactagaaaggcacaggatgaacacaggaaacaagtgttgtatagagccagattagttgacttcatatttacagctcttccaagcatttgttccttccaggcaaaacccagcttcttcatatttgacagtcttgtttgagttttctccctccatgcctcacttaggccatttcctcagctggggtgcctgatgtct

SEQ ID NO: 101113 - DNA, 1144 bp, Homo sapiens
tcgggaaccaaaagagaaaggtgaagcacttataagaatatgaaaattgtctgcatttctcattctgtcagttcatgtgaagccagacacagatgcagtttgtagacctggacactgcagcttttgcattttcatttggaaatgtgtataagtatttgttcttggtgaatttcttcttgactgcttccagtgtaccctatttcttacttagggatatctcatttgtttgagccctcatttttcttggatccctgtccttggcaacacacggtgtgtgagtgtaaaacctgtcaatcttattggacctaagttagaaatttaagtgtggctttcaaaatggaaggctaataatcctgtagcaactgcagaattattttcctggcctgtccttccaatgagataagaaaccattcacctatcttgcagatgaagtctttatgagaaatgaggtgatttggcctagactatacacctagtttttttcaaactgaatatcctcattcatcagtagcaaatatttatggattgccagcccctggagtatgacgcctaccctgtaatcttttgtacatttcacatcttgcagtgcttgttatattgaagccattttagaattggagcgctatagatcagggaggcagcctctataaaaccaggctgagcaaattcccatgatgctggttctctaggcagagtctccagagatttgggccgctacaaaaagtgcattttgcccattcggctgtggatagagaagcaggaagagcactggacttggagtcaggtaaatttggttgaaatcttgcctgcaatattttctagctttctgaatcttcagcatgttaatctctggttcttggttttcttatttccagggttatcattaagccttttttataaactgtaaattgttaaatataagcttttggtttgttttttaatcagagttcactattaatggctttttctctccagttaacatctgatgacactaaaccctgctttgtacacatgttgctttcaaaaaatggtatattattataggactttattttgcatataggcaaatccagtctttctgaatcattttctcgtctatatagcacaaatggtaatgcagcttttgatatatttttgttgcgac

SEQ ID NO: 101114 - DNA, 1083 bp, Homo sapiens
ggcctgtagggatgataattgctagcatgcatcaggaagcaagcttgtgaacaatccagtttttctagtacttgcttcatactagggagaaagtcatcagttactttggcatagaattttaggttcttcatctaatagaatttgattgtgaccattaatttttgtttatcttacgacttcatcagtagatgttcagatttttctcattttgttggcagggaggaaatgaggaaatatatctacgtaaatagagagaaacttctaaattaaaacatcctgttgtgctacctgctctttcggtgtcaacaaactgagttttcctttaaatgctggtaccttagagaatgaactaaaatttccttgtagagatacttttaagttccttgtttctacatttttctagggaaagatgacaattcactagttaaggggcaagaaattatggttacataatagcaacctttaagctttagaatccttttgatctctatgtgaatatgatcttagcagtcatctgtattgcatgatggagaaactaacggttggagctggattctgagggaatttttctaaggggaatacttgaggaaacagactaaaagtgctttctgtctcatgatatgtgtgctgaaggccaatcatcttactgctttctcaactaaaagattttctaatagaggtgtggttatatgtatctgatacttgtaatgagatgtaaatgatcagtggcctcaagtcattcctagcagattgtaggttagttaactttttttttttttttaaattctggccagttctttattatgtaagtttttcccgtactggttagtttattttattgttttccctaaaagaaccaacaggaggttatttctgaatggccttgaccaggacaagaagattgaaggctacaataaagtagatatgagtcctgtctattattattatttgccctcagctaagagctttcctttaaaatttgtttgacattttggtaagtctttggcatgtttttatgctgtttttaactccttgattttgtttttatttttaaagctagataacattagcttaataggccag

SEQ ID NO: 101115 - DNA, 1886 bp, Homo sapiens
ctcctcggcctcccagagtgctgggattacaggcgtgagccaccacgcccagcccagatttgcctgtattatggatgagaaaacaaattcacagaggtcacatagcctgtggacttggtgtgcggtactggtaaatcagactgataggcttcattatgtcagtgggccccaaactgtagaaattattcataaggtcaaccaattgggctgtctttatggatcagaattaacatagtgtcttttggattgattacttaagccaagaagtcaatttattgtcatatctaccattaagtcacatgtgtaaccttgcgcctgtcacttaacaccctcagtaagtttaatcatggctaattggacataattagcaatgatatgcaacagctgatgtgaaagagggaagggattttgaaataatagaaatgcagtttctctccaaattcagtgttcactggacttagtgctaatgactttgtattacagatatgctgtgttttgtttcctaacaaagaacctgcaaatgtttgaatggaattaaatttattacaggactctaaattttatatgtagaatggcacacagacagttttatagtgggtgttttttagtgagtagttttctctgagagccaggagtgtttaactttttctgggtaacacccactaaccacctggtcccactgactttctcagtcccttctgcagtagcttggcatctgatttttcttcagcagagagactccagaactaaaacttctgctgtacagtgctgtggatgctctatctggaatggtacatctgtgaatgctgttcagaatatgtgatcagttccttaccccattgaaacattcgagcctagatttttcagattttcttgtcagttttcttccttattctcatttctttatctgctttggcctttgatttttatctcatctagaaaaacatacatgcactttattaataacatctctttttaagtcacgacctagctacctttaaacctatttcctctagttctgtctggttggctttctaaggagaggcattgtaacccttaaacgtgtgctgtttttttttttaattgatgtgtaatagatatacatgtgctcttttcttgtgtttctaccactagagtttaagctctctgaggggaggactacactgctttcttttaaattcctctcaatgaataatccaaagagttcttagaaatttggtagtttttcattttgttagttatttcaacacacattggattatatgtgttacatttttgtgaggtagcttaagaataaaaaataagaatggcttatgagcctttactctaaccagcactatatgggcattttatgttcattatcttatttgatagctattaatgtctctttttaacactgagaaaacagattcaggtaagttataatgtggaaatgtagaaaaatcacctactttctctttagaagctcagatgtgtatgtaaggcttgctaaaagcagaccccaccgtatattttatatgtatagagcttgggtaattcctgacatataataatggagtcttcatctgaaatttctaacaaattattaaattcaaagcttattattttcgaatcgagcatgttctttgccttgaaaacaaaacatagctgaaagccagtgcttctaaaggccacagctgtcattttcaaccctttctgtctttgcactgcctttatttaaaaaaaaatggattagcagtaggtagtcttctttttcttttctttctttcttttttgattcttctcctaggatatctgctctagccactgggaaataacttctcagtattttgaccctgactagaaagatgtcccttggggaaggaattgggatagaggggctaggc

SEQ ID NO: 101116 - DNA, 1033 bp, Homo sapiens
agcttaaatttgatggagtagccaaaagggagtcattggaagttactgagtaaggacaaaggcaagactagaggtaatttaggaagagtaattttttgtttgttttgagacagggtgtctgtcacccaggctggagtgcagtgatgcagtcatggctcagtgcatccctggcctcctagcctcaagcgattctcccatctcagcctcccaagtagctgggaccacaggcatgagccaccacacctggctaatattttattttttgtagagacaaggtcttactatgttgcccaggctggtcttgaactcctggtctcaagcgatgctccagctttggcctccaaaagcactgggattatagattgatctgccatgcctgactggaagagtgaattactctttgaatttcagagggcacagaaattcaagaaactaggtacaaatgtaatgaagatttaatatgcttgtgaggctaataggtgctttgaattatttgagaaaagggagaactctaccaactctgcagttttatgcttacatttcaggatcagtttgttcattcagcagatatttgttcctaccaattatgtacaggatgctgtgggagatatgtccaaaggagcttatggtgtaggaagggaaataggagacactatgtaagtaattttagtactgaagaaacgtggtaagacattgacaggtatcagcgaaatgctttgtgagaatatattcattagagcaatgccgtcccataggaatagaatataagccacatgtaatttaaatttttctggtagctgcatttaaaaatttttttaaagtgaaattgattctatctgtttttacttaacccattatgaacaaaatatgatttcaatatgtggcactagccacattttaagtgaatagccacatgtagctatggctatggcttaaacagcttaagaaaggcttcatggaagggatggtatctgagccacactgtgaagaatcttgtatgcagagtaaatttgggaaaagccattccaggtag

SEQ ID NO: 101117 - DNA, 1280 bp, Homo sapiens
tggtctcgaactcctgacctcgtgaattgccctcctcggcctcccagagtgctgggattacaggtgtgagccactgcacccggctagtaagcataaacttctaaagaaatagttattaagcagtctgtatgtgccaggcaggtgaattaggctaatggaagaaaacaaaagctctagagccagatagatgtgagctggagttctggctctccaccatctatttgcatgttgctctgggcatatcacttgccttccctgaccctccatttcttcacccataagaaggggaaagttgttgttatgaacatacctactctgggactgttgggaagattactggaccaaaataatataaaggccttagcaaagtacttaaccctagaggtgtttgatatatcatcaatattgttgatggcatttggaatgagatgtttcacatttagtatgctgctttccagatgggttggaagaagattcacacacgtttcctaggccccgaaacctgacatttgctctttctttttctcttgctcttgttctagggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggtaagaggccagtgcttctgttttgaacagtggtttctaaatagtattaatttaatgtataaatgcagactctcaaaacagcttatgagagagaggtgtctgaatatactggaaagctgccaggtatttacaactaatttttaagcatatgatataatttgtgtcacctattgcctgatcagaggttgtacatcacttctgagatactttcctctcctatcaaaaagacctgtgaaaaacagtgacattttttcagcctccctccatcttttaaaattgaggccagatagacaggattttaatagatacagctacagataggctattgtgtatattagtcagagtagtgatgtcatcgccagtaggggagggagatgaaaaagctgagctgcctttcagcctctccccagtcatgccttcacactgtaaagtcct

SEQ ID NO: 101118 - DNA, 2324 bp, Homo sapiens
ctaacaaatgtataattgaatggcagagacactgacacttcatttgataggtcattgctcctgcccagtttgggactgagaaaataatttgatagttggtccaatgtgtgatacctatgaaagaaccgagcctttaatattttcatctttatgttacagccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggtgagaaagaccctttgtgatatctaaccatagcaaaacagtgcttgtgttattaacttcattttattcctgaacatactcattgtcttggactttttttgaaagattttctgggggtgggagtgtatcttttatgagataaatacagatctgttacttttttaattcattctcaataccttctgctgactttgtttgattactgttttttgcgggtggttgtagaaagttccaggtgaatgtagttagttgtttcttaccaagctttgggccttggttatacattgtcattctcatgccaagatttgaggttatagttgtataaaagaaatacacagcacattcttgttgtgtgttggattaccttccatattcttcctttggccttctctacatattttttatagtccctcaacatgcacacaactttttaaaaacatttttattcgggaaaggtgccttaaagttccgtcacttaaatcagatttagtgatgtgagtttccagacattttgagttttagtttaaataaataaataattttaaatagaagattgctagaaaagtctttggtaattaaaaaatcacacgcgtttgcccagaatgactgtgctagggttagcagtaatactgcttagttattaggtacagcaaagttcttaccttggagtttctgtcattgttggttggtgctttgtaaatatgccttatacttctgctggaaacagctaacagacagggtaataatagcctaggttcccccaaagtactgtacaagaagataagttatattcacctagcgggaaaaaaagtgggctaaactagctccagagaacttgtgaattctttgctaaaggctctttgttttaggcatttgatgaagcaattgctgaattggatacgctgaatgaagagtcttataaagacagcactctgatcatgcagttacttagggacaatctcactgtaagtactacttccacagggtttatagtctctttcctattcacctacttaataattcactgttatcttcaagaggggatttgtaccattaaatgtagttacagttttaagttgttaaatttgttataaatgactgctgaagttttgacctttgcaatcatccctgtctgcagtgacacaggaataattttaaactgtcgagtgagataagattatacatactgggccacttacctagggaacttttagtagccctgctttgattatacttcctttctcttgcagctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaacc

SEQ ID NO: 101119 - DNA, 1391 bp, Homo sapiens
ttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttagttgcct

SEQ ID NO: 101120 - DNA, 1057 bp, Homo sapiens
ggggaatagctgtggtgaggctgggaccagtgcagatgtgtgagaactgcaggggaatttgggatgtgggggctacagcttgcatgtgatgggcacgctgagggatgggggtacctgggtgctgagggagacggggagcaggaggctgggctggtggggctccccatgccccttgtacctgcgtcagttccctgatctccccaaggcagttggggcttggaggagaaggggacatccagcagtttcccttccatcccagggtgtgaacttgtatgtgaagaatctggacgactccattgatgacgacaaactgaggaaagagttctctccctatggagtaattaccagtgcgaaggtgaggactgggggcacctccgggggacagcgttcccctccatcctctcaccaccatccccccacaaccccacccctccaccctctcgcccagcagccttcagggggttggtgccggctaccccttctggggctctgctgaccccgttggagcttgtagccatctgcagccttgtctgggctggaggggaagagggtagaaatatagtcccagtcacacagctggacttggggctcactgtcaccttggcatttattgagtgcctactgtatgccagattccagaaattcatatcttagtatttccattgacttttgttgtctggcctctgccagtgacattaccctcctgggcctccgttttcccatctggaaagtgagagggctggacttcgtcattcttcatttgttcttccctatttctggagcaccaattgtgtgcccaaccctgttaggcccctgagatgtggcaactggcccatcagcagctctatgagctttagcagatgttgtcttatagataaggacactgggctcactggatggctttccgaccctggcttctcattacaaccccctgggcaattcttaaatacacacacctcagtcaggcatagaatgtggatccccggggtagggcctgggctttttattttttttttttaaagctcccagaggctgggcaatatggctcacgcctgta

SEQ ID NO: 101121 - DNA, 1056 bp, Homo sapiens
aacacaacataagcttcctcatccccatcactcatctttgaaatttaacatcattcagtcttttccagagatgctttgaggaataaaacttctgcttctcataggttaatgtttctaggagagggacacacagctatcaatgtgactgtcttaatggtcatgatggaattctaccccgactcccagagaaggtaaaacaccgttacgtgggaatgacagggcagagagcagatcatgcagggtctcctaggctgtgtaaagtagtccttattctaatgatgggaagctactgcaggatttatgcaaggatgagacattagagaggcattttgaaagaagccttaggactgcatggtggaggacagactgcgggagggccagggtaaatgcagttaactggcagaaggcagtgagcgcaggggttgagcttagctcaaattagtggatttattccactaggtagtggtagtggatttggatctggtaggaggtcatgttggtggattttctctggaagaggggaggagagaaagtggtgtggcagcagggctggggaaaccctctgattttggcttttgcaacagaatggtggggccatttatggagacagaacactggaagagagaatcagagaataagaccgggcacggtggctcatgcctgtaaaccccacccgaggcgggtggatcacctgacgtcaggagttcgagatcagcctgaccaatatggtgaaacctcatctctactaaaaatacaaaaattagctgggtgtggtggagtgcacctgtagtcccagctactctggaggctgaggcaaaagaactgcttgaacccaggaggtggaggttgcagtgagcagaggtcacgtcactgcactccagcctgggtgacagagcgagactccgtctcaaaaaaaaaagaaccaaggaatgaaaaagaaagaaacttagttaaatcataagcttgaatttagacatgagtgttaccaagataaccaggagctgatggcaggtaggcggtggaatgtaagagaggtgactcaggtgctcttaagag

SEQ ID NO: 101122 - DNA, 1171 bp, Homo sapiens
ccccatgtcagcattatatcattagagttcagtagttgttgggtttttttttcccccttaaagtagataattttttaatctgtcaagggaaaagtttcaggaaaccttttctttgcttgaaagagctcagtataggagagcgcagtacagcatgatagaactagatgagatcaggatctggagtcccatgaacgaacgcccgcctatttgaatcctgggtctgccccttaatactggcggtacctggcccaagttcctttacccttctgagccagcatgtttcatccatgaaaagggctaggattgttgtgaggatttaagaagacataaagtaaccagcacagagtaggtgttcagcaaattggagatcacttctcaaactactgcgtggcatgtgggtggcccataagacgtgactgaaacctctgaaatggtctttcccttcagagcactctgctatttggtcctgaagcagtacacagaagcagtgaaggactgcacagaagccctcaagctggatggaaagaacgtgaaggcattctacagacgggctcaagcccacaaagcactcaaggtaaaaaaaaatcctggccaaaaggtcccaacatagctacagagatttatgccagtgtcaccatttacagggtgtagccaagctgagacaatatctgcagcttttccttctcatcctgggcccaggataactcagagcaggcctgtgggctggggtttgaaaacactttgctgcctcagcagctatccccaccccagtccgggaaccttcccccacactcctgtcttttcttctattaggactataaatccagctttgcagacatcagcaacctcctacagattgagcctaggaatggtcctgcacagaagttgcggcaggaagtgaagcagaacctacactaaaaacccaacagggcaactggaacccctgcctgaccttacccagagaagccatgggccacctgctctgtgcccgctcctgaaacccagcatgccccaagtgagctctgaagccccctcctcaatcccttgatggcctcccaccctgtaagaggctttgcttgttcaaattaaactcagtgtagtcaaacacagacatggttgttgcaccagaaaggtccccactagagctaagcgtgaagctgaagctctgtcc

SEQ ID NO: 101123 - DNA, 1108 bp, Homo sapiens
gtggtggcctcagagtagttggcttcttccctgtcagttcaaggctccaagagcgagtgtttccagagaccaaggtggaagctgcaaggcctattatgacctaaccttggaagtcacatcgtgtcccttcctctgtcctctgttggtcagagcagtcacagagcctgcccgaattcaaagagagagagcagatacacctccgcctctcagtggaggattgccaaagaatttgtgcctgtcttttaagttgttacaagaagatttttctctccgttaatttatgaattccatgcaatcacaaaggactagtagaattttcttctttaaattcatgataagtcagaaaaaaatgagaacaacgacatgagagaatctggtgtataataaagtctggggcaaagagagattatttaataagaggtgttgggttggccaggttagagttaaacttgaatcctaccttgcttcttattttaaagtaagttctgagtggatcacagtttggaatgtaaaaagcgaaaccattaagttctagaagaacacatggattaactatcttgcagtggggaaggtattcttatgtgaagggaaaaaaatgttacagaagtcgttaaaggaaaagttagagaagtttgatttcaaaagattaaaaacccttattaaagatgttcagctttacccacaactaagcagctaaggcagtgagatagtgttttattccatattggcatacatgaaaatttaagacccaaagttggtacagttgtaggaaaataggctctgtcaataactattcagcttttttggaaagcattttggcagtaacaatcagattttatttctttttttgttttgttttgtttaagagatggggtctccctatgttgcccaggctggtctcaaactcctgggctcaagtgaccttcccaccttggcctcccaaagtgctgggattataagcatgagccactgcacctggccagtcaggttttaaaatgcatgtatctttggatacagcagtcccttgcacaaggatgttcatcatggcatcacttatttacaaactggaaacaatgaaaaatacctcttgataggaaattggtaaaat

SEQ ID NO: 101124 - DNA, 1227 bp, Homo sapiens
tgctccatggtttttttcctcttctgaatttgtatctagtgccttctgctggggatgtggagaaagccagagttctgaaggaagaaggcaatgagcttgtaaagaagggaaaccataagaaagctattgagaagtacagtgaaagcctcttgtgtagtaacctggaatctgccacgtacagcaacaggtatctcctatacagctgctggcctggggcatttcaggacatttgttccatagtcttctcttggactgcaatgggcccttcatccctagcatttagtcaagtatgttatggctgaaaacatgcatccacgttgtgagctagccatgaccagtggcattcattctctcaaaagggtagaaactgagggatgccaaatggtagcctgggctttgttggcccctgtccccagaattttcataagcatgcaatgtaactaaaagcagtgtgcctgctctgcaaacacaaccctaacacaagtctcttagcctgtccaccccaccacgctacgctgctccctacccttctccaagaccctcctgttagaaattctggcaccatttctgtctgagagtactggcccagaagccaaaatgtgaagtaaccattgcctggcatgagagcaggaaggatgggtacagtctagcctgaaaggttagacttgtgggcctgtagaaagtcctgcaccaggagctgccgtcagtgaccactgactgagaacctgggagccagggtgcggtcccttcactgtgtaggagtgattgttctccaacaatgctcgtataggtggtctttctgttttagtgtttagaaaattgaggctcagagaaggaagggttttgctttaaactcagccagccagtaaatgttggcacaagaattggaatctgacttcaacaagatcttcctgttacttttactctcagaagcttgaaacattcagcaagagaccatatcaaaaccaaatgcttagtataaaacattataaaatgttagaaatctgtttatccttccctaccagcatacacatatcactctctagttcaaaaatcttggatctaatatagacacattgttccttattccaaactcttgagataaaatgtgttttccagccacggtggctcaatgcctgtaatcccaacactttgggaggctgaggctccgggaggatcacttgaggtcaggagtttgagaccagcctggccaacacggcaaaaccc

SEQ ID NO: 101125 - DNA, 1066 bp, Homo sapiens
tctattctggtcttcatggtcacaggccattccctgaagtacacaccataaccggcggatgagattttgtgattaggtcaccctgaggcacctgccccacctccagaactagagggtgatgcttcccaggagcatgtacactgtgtgaatccctggagaagcatgaagaagagaaaggagatccaagcagccaaaaacaggagattcctcacctcaactgtatgaaatgaagaggccatttgtcaggcactaggaagctcttttaatgctccaggggaatggtcccagcccagcaagctagggattcaggctagaggtgcagaagggatcagagatggagccctgccatgtgtaagtgacctataggtgttaggggaggacaagagttactcaccttctacaggagaatgcctctctggtcatgggtagcattcactctggtttgtgggagcctggtaagtgttccccactcttctctaggatgaaaatgtgcggtgctaatgaacctgatggcatcagtgccattgatttcattctttcaatcagtgcacctaccattgatttcattctttaaatcagtgcacctaccattgatttcattctttcagggtcactgagccatgtgttccaagccatgtgtatgctaagcagtgtgacacagaggacagtcttggccctcagggaactctccctcagttgagggactgagacatgtaaacagtgtcttaaaacacaaggaggaggaacatgtgctttagagtcttagtgtttgaggacttcaggatagaaactgacttaagtgcatgagggagtcggggaaagactcagaaggggtggcaatggaggtggagccttgagctggaccttgaagaaggtcatcaggtgggaaggaaggagaatccttggcagagacagtggagagagttggagaatgaaagtgcatggggggaacagtaggaataaggatgactgcagagtggtgtgttgcagggtgccagtgaagctgaagccctacttcaagagaaacctgtgtgcatgtgcacagggagatgtacccacaaatgtt

SEQ ID NO: 101126 - DNA, 1973 bp, Homo sapiens
gaaacagggcattgatgtcccaagggaaggagtatttcaagaaagatggagacatcattagtgtcaggtgttccaaggagcttacattaaaggtttggcaatgaagtcaccggtggctctgatggaagctggtcagtgggatcaggagccagagggcaatgctttcagaaagtcaggcttgaagagaagctggggagtatacctgtgatggcaaggggtgtccagtatggttttattaggtgaggaaagagttaaagggacttaaatgctgacggttggagttagtagagaggaaggatgaagatgtgggagagggaggtgctgcctgggtgtggtccctgaaagaggcaagaggagatgggatccagagcttaggtgggtggattggtcccattgtctcttctgttgtgacaggagagaaataggaaggattgggcacccaggcaggtaggtttgtatttggggtatgaggaagtttgctctaaaaaaggggaagggccagggaacaggtttgaggagagcagaggtttgaaatagcttggccgccaggaaaacagcctagccagagacatcttggaatttgtagtgatacagtctgtggtttttattcttgtaatataggaaacatggttgtaggagcagaaaaagtatacagttagcattattcactcattcaacacataactgattgggccttggtggttgctaggtgacataccaggtgctggagatcagttgacagaatgaacttggtctctgggtggcattttaagctgaaatctaaagaataagttggagttagccgggcctggaaggtggcaatctttttccaaaatgaaaatggttgttctgggtagaggaaaaagcatgtgcaaagtcttgaacagaaggatcagaagagaatgtggctcacagtgaagggggacaggaaggggtggggaccagatctcacatgccacattagcctagggaattgggaacccctgaggagttgtaagatttgagaatgacataagctttgcattttttaaaaagcctgagcattaaacaaatgtcaggtgcttgcatggttgtgtacttgattcattgataaaatatgaaacaaaatgtatgattctttcttggagaaactatagtctttttggatcatggtttaagtatccttaacaagcaacagatcaccactttaaaggtaacatagtttgaccaagctcaaggaatgtcatggggactgatctgagatggtgtttatgggttcctgtattgcacgtgttggaggagctaaagaggtggttccgaccagggggagggtggcagctctggctcttctgaaaaggcctacctcccatgggtgtgtgaaaggagaaatatcttcttgacccagctggaaacctccctgcaatcctgccttcttttccagaatgaccagagctctcatggactcgcttgggcctgagtggcgcctgaagctgccctcaatccccttggtgcctgtttcagctcagaagaggtggaattccttgccttcggagaaccacaaagagatggctaaaagcaaatccaaagaaaccacagctacaaagaacagaggtgagctgtgactccctgcccagagtcttgcaatctcccactatccattttctttagagtagtcctgcaaaaattggcattgtttagctgagttataaaaataatcttaggaacaaagtataaaacaaaatacaagtcttcacctcttagagactgttttctcagctgtatagtgagggtgatgataaagtcttcctcacaaccatgaggactgaatgacataagacatgtaaaactcccagcctggcacataggcatgcagtgtgagttcccttctctttcctctggtagcacttgggatgtagtacttaggatgtttttggttgcaaaaacagaaagctcaacatggtaaacatagtatagggaatttattggctcataaa

SEQ ID NO: 101127 - DNA, 1025 bp, Homo sapiens
taatattcttttatcatcattaaactctcacatttacctgaaatgtgttctcagatctgatgtcctctgacattgctttagattcctgccctggtgatagccaggagagcaggaggggtgtgagcatactcacagagcctgtgctgaattaatttgtgccatgccttgtgccagatttccctctttgagtgttcacaaccaatctgtggggtacggttaccatgtgtcccaggccagaacttggttgctgagggttggggcagtaaagtgatttacctgggtcacatagttagcagcagaggtggaattcagacaccaccccatctgactccaaagcttgtttgttattcccactagaccacaactgtaaaaaaacatagtagcatgaaagccatgaggcttttgttcttgattttgggggaactgaaactatgaaaattgatgcatgtgcacacacatttaacaaaattcatgtttctctgccttctttctcctcctcacttcagtctacgttgaaaaatccctgttctgaggtttggcgtttttagccatgtctctcggccagaaattacttcctgtacgctgagtgctccagataaccctgcctggaagaaactgtagggaaaccctggtggctcagcagccagccagttgacatttttgcctcctattctagagcactggccttggttcccttcagcattaagcccctgctgcggcgagcatctgcttatgaggctctggagaagtaccctatggcctatgttgactataagactgtgctgcagattgatgataatgtgacgtcagccgtagaaggcatcaacaggtgagctccattcccagcaggtggtctccacggcaactccctgtccttcttgattggctgcgggccattgccttgtctgtcttctgaggggatccctttggctacacttaaaaaactcccgatgggcatgtaggggaagctgagaaaggaaaatctgcttttttatttagcaggttttcagggagtcaattactaa

SEQ ID NO: 101128 - DNA, 1017 bp, Homo sapiens
tgctagttttgcaagtatgacagcttctaatggaatggaaatatttttatgtgctctgcatagacttaaaaagttttatgttactttcacattgaaacagttcatgagcatctatttggcagttagagtattgtactttgacatagtaggtggcactgctattttgattttttttttcaccaagacagtgtgaagatacagatgtgttgggaaatatgaaagacagtttactcagtattatttcactgacagctgcccaggattccaatgaaaatgttatctgtataaagtgatgatggtatctcatttgaccatcacaaatgagataccatcacatcttgtaaggtagtttgtattattgtcattttacagatgagaaaattcaggtacaacaaggttaataaggtgtaaatgatagctaaatgtagtgttggtaggactcaaatccagcttctttactttcaaaatctagtggatctgtagcctccaaattgactagatacacaaactttattttgatattaagctgttaagggaagatggagtaggaagcaaagagtgtgtgtgctgtgtttacctgatactaatattaaacaggcttagattttaattagtttccataatattttaagtattattgtaagtaagaggagcaaggacagaaagatcttgtggtactagagtgaatacaataaaacaaagactgccacttccatattgtaccccagtatagatggggagacaacgtaagctttgttttcagacacacccgggttcaaatcctggactgataacacaactggtttcaaatcctggactgataacttatgtgaccttgggcaaatcataaacccctttgaacctttttacatttacctgtaaaatagggatagtcatctcatcttcattttttgtaggaatgaattgagatggtgtacagtctctagcagatagcaggcatgcagtgcatggcagctactatattaccatctcataagaatacattcattacagttt

SEQ ID NO: 101129 - DNA, 1028 bp, Homo sapiens
ctgagagtacctacgtatttatttttgaggaactaagatttgtcaaatgttgtaagcaggaagtcagaccaaaagacaaccacagaaaaccacgtggtttgctctgaaattccatgacaacatgggttggtcactgatagagcaggcttccccagcactatttagattagagacaaacacaaagttaggggcaatgccagctctagggagctgaagatgggtgagaaattctctcagttgaagctgcattcattcttctgaaggctttttggtcagcagatcaacttagtacctgctgtttgcaaaacttctacattagggtttaggtggggctacctaccaaaaaattagtccagaagcctttcagtctcacagacttgggaatgtagtcctttcttttttctctcccttctttttttttcccttctatttttgtgattactgtctactagataaaatccccatttttcttgattggattgaccagatgaaggtggcagttttccatttgctcctttttcagatacattttggaagttctttccatttggcaaattgggactttgtcactttcgatagactgtgcgggagctgtgttccaaacagagtatggaaatgtctttaattaaagaagagatattttcaagcgtctactctgtgctaagcactgtaaggaatacagtgaaatacagagcagagtccttgtgctttgggagtttatagactaattggacaggctaagtatatatatatgtagaggagaatctagccaacagtgcaagtctatagagaacatattccagtagtaaatacttgatagtaatggcctacagtatttaactcctgtcagtactgtattacagggagagtaaatgtgttgatatttaccttagacacttttttcattaatatttaatgtgtgtgtgtgttttgctgtccttgtcactggcatgtttcctaaggtttgaagaggaaattgtaagagttctgagttaatgaagccaatttggttttaacatcagttgtta

SEQ ID NO: 101130 - DNA, 1260 bp, Homo sapiens
gcttattcttctcccagtgcttcctaaaacacttttaaattttactctttgcccctcttttactcaatttaactttttattttagagagagaatgctcaggtctgggacttggcttttcatatccttttggggaatctgggatccatacttaacatgtagcttttacatttatagacttcttcacaaccctgagattccaaagatgttcacatgagtttcttagatctatgtcacaaaactctattaagaagagtagaggaagaattcctttagggttagatacactgcttattatcacgtggataaatttgtcttctttgcttaagtaacagcgctttcatttctggaaggtgagtttaggacctgaataagtgttaaatctcgaaatattttcactaagacaggtagtagttattcagaaaactcaaagtcttttgtcaaattagccccaatttgagattgtatccttttacaggaagaggatgaaatggattctggcacgatggttcgagcagtgggtgatgagatgggcactgtccgagtagccagcaccatgactgatggagccaatactatgattgagcacgatgacacgttgccatcacaactgggcaccatggtgatcaatgcagaggatgaggaagaggaaggaactatgaaaagtaaggctctgagtaaattcactgacttcttagaccaagcatacatatttcagagaagacagattctcatggttcatgcaggcttagccttgggttctttcttttgtcacaaccaaaggagtagaaaacttggaagtttgcgatggggacaggaggtttggtgagggggaaagctggcctgtggagtcaaagtcaagaaagcatcaacagtgagaaagaattttgcttttgaaccagagcagccattttctcattgaatgttgttattattttccttccttaccttgatctttggaggcaagcacatgcattgtttgatgcataattcctgtgaaggtgtaatgacattctgagttatttactgtacatacatcttcagtttattttcatgacagtttgggtctaacccaagtttaccaatactgtcagtcaatgaaagatgactgtacaagttgaaaagttctatccagtttcttctagtttaaactcatctctgcttctgtccgtatctggctgatccttttttgcctgtgactaggcctaacatcttgtgttcagctcctatcttagagtgaaattcttgtgtcattcagtgct

SEQ ID NO: 101131 - DNA, 1145 bp, Homo sapiens
atgagggaaatacatttttcaagagagggcagtagcataatggtaatgaagaacataggaaagtgaatcacaaacaatatactttggtccttaagcctaagaggcagataaatctttcttcatcagttagtggaatatattatttctctgttgctctaagcttgctgttctgaccttcttttgttcagcaagaaaatggagatacatttttaaatatcaatttaagtggatctataaagaaaaagcagatgattcttttcaaatgtttatgctctataaatatcaatttggaatcagtatttgtttataatgaatatttaataccaaccaagaagcatttattaaatagtcactatgtgtcattaacatgtagagtatgaaaaccaaatgaggcattcactgctttcagtaacttatatattaaaaggggaagatgacatttgtcattatcattatctaatacttatggcatgtgtactgttctaattgttctaattccttatgtgtatagagcattactctaggcgcttcaaataatagtatttgataatgatgcgacgtaggagaaaggacttctacatatgaaggtaataatatactaagacaaatgctaggtaagtggtacaggaaagcgttaaaggatttgtgaaaaggaaggcaatgactcagatatgcaggaaggctggggaaggatgttacaggcaggtgcaaagtcagaaaggtagaaatgtgttttcattattcaggttggccgaagcagatgtgggtgttgactggattttggaagactttgaatttgaaagtaaggagtttgaacctgattctcttgttaatagggtatctgaagacactttgactaggaaagtgataaaatggagtttcaaaagactgtaaaaggtgagaccaattaggaaattcttgcaagaaccaagatgtggaccattctcacctgtgaacattttttatctttttagatgtgctgccactattgctctagttagtaatcctttgaattttggatttagctctctttgaatttatatatttcagttcaccagaattaaaacagctagagcaccattgcccagaaattaagtccattcatatagaggcagttactgaaactgcttaactggaagagttat

SEQ ID NO: 101132 - DNA, 1012 bp, Homo sapiens
tctagttgtagcatgttttagatgagaggcatccagtatcataatcctactagagataagaacttcttcttttgaatagttattaataactgagcataaatatgttttcatatgctactgccaagtcataaaatcacggaatttttcaaagctgcagggaacattagatataatctggccctgtgtcttctttttgcagattgggaacctgtggttttaccaagatcgtgtagtcagaaccagaatctaaatctttgaactgcaggatagggattactttccatttttttttattgtggtaaaatatacataacataaaatttgaggagaggaatttttccgttcttctgtctccaaaatcaactttagctttttggcaatctgataaatgtaacattttaactaatcattttgctataattaaatttctaatacatatgtgcattttacttacagcttatatctgaatatgtggttagataaaaaaaattctctttttatttcactttagtttttggaacttcgaattctaataaatgtcaggtataatcaggtccctggtattgatatcagaaggtaaaagcaaatacattttagatagactttcttatttgtggattttcattgttgaaagagacaaagaacagttggtgttttaactccaaaaattagaaatttttaagtgggttggtaagaaagaagaactcaaatatgaggcaagcagatgttctcactttttcatctgaacagtgacagaaatagacaaataattatattctcacttaacagacatttctttgatttttatgacatggtttagaattagaccacagaaatgttatctttagtgtttcatcatccttggtttaaagattcaatttcttaagtccacctgtattgcaactgaaagtaattaatgaagaaccatagaaatatattgttttattgttggatataatacattttaaaaaagaatgacgcccttatggtttttgtaaattccattggagaa

SEQ ID NO: 101133 - DNA, 1112 bp, Homo sapiens
atttagaaagagggaccccagggaaatttctgaatgtattttaggggaaatcttaactcctctggaattccatgagaattttttgggcaaggatttgtgcattttttgtagtttcactagattcttgaaggagtcctttatctaacagaaatatccactgatccagagattgtagcccatctggagatatgtctatttattaaacttacctaaaatttagaatgtttcttttcatttttcatttttctttgttttcaggaagggatgagaccatgcagcctgcgaaaccatcctttcttgaatattttgaacaaaaagaaaaggaaaaccagatcaacagctttggcaagagtgtacctggtccactgaaaaattcttcagattggaaaataccacaggatggagactacgagtttgtaagtagtgttggaagtaaatggttatgtcttcaggggaagttatttgaaatatcacacattagtgcccaagcattttcttgtgcattttgagtctcctaaaccatccctgacagtgtctactgagctgaaggacagtattttgactgatgtttgggcagttctctggtccctgattagtggcatctttttcgctttcgaagtccatattcagtttttatttttgtccagttagaaattgttcatggtgagagaagtattcaatcatcaaatgaaattgcaactgtctttaatagtttatttggggttttgattttatatttaagaattagattggagggcaattgacactgttttgtggtgtccttgttgttttgctaactattctcctaattttaaccctgctgaaaggattattctcagtttttttcagaggatgaatgtataattattccagtttcatatgaaaaactggatgtgttttcctttctctactgtggaacattttccctcaaccatagacacttattaatgttcataggcatttaaggagtagagcaataaaaattttgggaaaaagtaagctaaggagtctgcattttcttcttgactattactagaaaagatttttctcttcaggagctttttatttttacattctaaaattctgaagtttgatcctccatctgtcataat

SEQ ID NO: 101134 - DNA, 1027 bp, Homo sapiens
tctagaggagagatttttaggcagcaggaatagcagatgcaaagatcctgaggcagggacttggctggtatgtttacagaacaacgaagaaacagtctgttttggaatggcatcaataggatgtgcagcaggaaatgatatcagagatataatggagagcgagataatgcagggctttttgtgtaataaaaaggactttagcttttactcttgagtggaatgaaagaccattggaagggatgacttgaccttatttatatttaaaaggtattattctagttgctgtattaatacattataggagaactgtagcgtttctgaacacaggtgcagtgtttttatttactattcaaaggtggcaaattatggggcacatctgctactattctcctcttctaggcctttggcacccatctgttccactgaatcagggttcagcttcagaatccttcttaacacagcacaccaggctgccactgctaatcatagtagacttacgaaatttgaattattgtgcgtctgttccatgttgcctgtatagttgtcttcaacatgtgtataaggactgatttctcagtttagccagtcttcaggcaaagatgtttaactactgggtaccaaatcacatcattattgtgatagaatgcttgagaatcctcaaatctgtagtacttctaagcttagtttccttgtttttaaatgttttagaagttagcgattttggctaggcgcagtggctcacgcctgtaatcccagcactttgggaggccaaggccggtcaatcaccttaggtcaggagttcgaggctagcctgaccaacacagagaaaccccgtctctactaacaatacaaaaaaatcagccagtgtggtggtgcatgcctgtaatcccagctactcgggaggctgaggcaggagaatcgcttgaacccaggaggtggaggttgtggtgagccgagatcatgccattgcactccagcctgggcaacaagagtgaaactccgtctcaaaaaaaaaaaaaaaaaaaag

SEQ ID NO: 101135 - DNA, 1662 bp, Homo sapiens
gctaacatgtttccctcacagttgcttttttttttttttgagatggagtctcactctgttgctcaggctggagtgcagtggtgacatgatctcagctcactgcaacctctgccgcccgggttcaagcacttctctgcctcagcctcctgagtatctgggattataggtgcctgccaccacacccagctaatttttgtatttttagtagagacagggtttcaccatcttggccaggctgatcttgaacacctgaccttgtgatccactctctttggcctcccaaagtgctgggagtacaggcgtgagccaccgggcccagcctccttcacaatctcttacagactttctgatttctaggcagatagtatttaattatgaaaaaagataattctgtttcctcctatgaagagaattgctgctttccaatgacctttttgcccaaaatggcaaataggaagtaatttaatcaggagtagccgaattttgtactgacaaaacttcatattttcatctgaaactgaatatttgtctcatttctaaaagtgaattgcctgtttgccaagttgagaaacccctccaaaaatttctaatagtgtttaagatacatagtgattaaaatataaaaggtgcttaaaaatgcaatagtctctaaaattgatatttcatattctattagcagatcacttttttggaaaaaaatgtaatattttgtgagaattcagaccttcccattttgccattcataaagccacaaacagctgtaaacttaaatccaatttggctcatgaatcttccaaaaacacactgtaatattttagtttaagatgacccaggctgggtgcagtggctcatacctgtaatcccagcactttgggaggctgaggtggaaggtttgcttgagctcaggagttcgagaccagcctggcacatagtgagaccccatctctattacaaaaataaaaaaaagatggcccaagtgccaacagtggtgaacaaaacagaccaggcccatgttctcatggagtttacagtgaaggaaatagacattaagccagtaccctagtaggtatcagttcaggtaataatagcgaattttttttttttttaaagcacagttaagagatattgtgagaaaaggcctgtggagagacaggacattcagctgagacatcagtgaagaggggaagcaagtcacaggaaggtaggggaaataagtacagagactgtgaggcaagacatagactatgtgtaaggaaggaaaggagtccattgtggctggagccgagtgacacatgggatagcagtttaaatgtaaatgcatcagtaatcacagtaaatgtgagtgcactaaaatctcctattagaagagaaagagtctggataaaaataacagtcaaattccggctaaatgctgtttataagagatgtaacggaaagaaaatacaaccgaaaagtttaaaacagaggaatggaaaaagatacactaggcaaatactcactaaaagaaagtgggtgaaacaatattgatatcaaatgaggccaagcatggtggctcatgcctgtaatcccagcactttgggaggccgaggcaggcggaccacgtgaggtcaggagtttgagaccagcctggccaacatggtgaaaccccatccctactaaaag

SEQ ID NO: 101136 - DNA, 1034 bp, Homo sapiens
cctgtttttttttctcacacgaactcttgacaattcagtaatccttattcctgggacatgaaatgttgagaagacaaaggagatttatgcaagttttcccactccatccaaagaaagggtctctattagagctcttgaaagtgatatttgcttatgtagcccagtgcctctgaaagaaaaaacatgatgcagaacttttctcattatctaaggtgtgttcctggtgtcatttccctctcccaacaggaccacttttacctaatacaaatctggatcctccactactcaagtgaaatacaacgcaattagcatcttttgtctttgataacacacctactccaagcaccagtaatgctggaatggaaagcatgtttcatttcctttcttcatttctctgttggagtttgatgctgatattactgagatttctaatggacagtgtagggaggagaaggctgattgatggtaatttattgtactgctactgagaaaaaaacacaactcagggtattggttgttcgatacatccagattttttgactgaaaatgttagattttactttttcttttttaaaaatttccaacttttaagttcaggggcacatgtgcaggatgtgctggttttttacataggtaaatgtgtgccatgttggtttatggcacagatcatgccatcacttaggtattaagcccagcatccattagctattcttcctgatgctctccctcctcccaagcccccaccctctgacaggccccagtgtgtgttgttccccaccatgtgtccatgtgttcttatcattcagctcccacttataagtgagaacatgcagcatttttttttctgttccgtgttagtttgctaaggataatcacctccagctccatccatatccctgtgaaggacatgatctccttcctttttatggctgcataatattccatggtatatatataccacatgttctttatccagtctatcattgatgaacatttaggttgttcattacagcactattcacaatagcaaagat

SEQ ID NO: 101137 - DNA, 1387 bp, Homo sapiens
ttgtttggcaatgcttacagtgtttctgtgaggtagcagggtggggtttcttatcctcttatagtttgaggaactggagcccagagacattttacaaaggcatctttcctacttggtgccagaatcaggtctggaacccagacccctaagtggcttcctgtctgcgttaattcataagtgtgtgtgttttctcacatgaaaacaaaaacaaaaactatgcttacatattaaatacccaatgttataaaccaggaaaaagaatcttctttcaaataacatgtgatagggactacagtaaccaggaagaatgatttcaggtttattgcatcttcctgggaatttcgtgacattagaggagtatttattattaactcacagtgttttttttcatgcttattgagaacacaatgcagattgacaagctttgtatttcattaattgtttatgcaaacaattcttattggagcaatttaatttgtactttcttttgctgttctttcttatttactttctaattatgggttgtacagtaattttgctattgtcagaaagtgtcttttttttttgtttgttcgtttgtttttttgagaaggagtctcgctctgtcgcccaggctggagtgcagtggcccaatctcggctcactgcaacctctgcctcccgggttcaaatgattctcctgcctcagcctgctgagtagctgacattacaggtgcatgccaccatgcctggctaatttttgtatttttagtagagatggggtttcaccatgttggccgggccagtcacaaactcctgacctcaggtgatccgcctgcctccgcctcccaaagtgctgggattataggcctgagccaccgcacctagccagaaaatgtcattctaactaaaaaggcattattattttaagaacatttttggttttcgccaggtgcaatcccagccctttgggaggccaaggcaggaggattgcttgaggtcaggagttcatgactagcttgggctacatagcaataccctgtatctacaaaaaaaaaaaaaagaaaaattggctaagtgtggtggtgcgtacctgtagtcccagctactcaggaggctgaggcagaaggatcgtttgagcccaggaagttgaggctgcagcaagccatgactgtggcactgcactgtagcctgggtaacagaatgagaccctatctcaaaactaaaaggaaaaaaaaaaaaaagcaaatataacctctgaaaacaaaggtatctattgtggaggaatcttaatggatacaggaaatatttgatatattttctggttatatctctgtcacagtgtgcttgtcagtctcattcaggcacttgttcctgaatttttcttctcttctactctgttatctatt

SEQ ID NO: 101138 - DNA, 1122 bp, Homo sapiens
gtgatgaagtatcagctggagcttgccagtggcactctgggccaattatgcagccgactttgaaaaatggtatgattcagaatgtcagagttgctaaggtgatttatgaagaaatcagttcccatcagccttcattattcatagagatgctgggaatcaggactttgcagtgacctggcccagaggaaataaaccaggtgggtatgatttagggtttctcacatagagttcaatagaggtgcctctgtgtatgtggtatgtgtcctgtaccgtgttgtgagctcatcttagagcaacagcagctattatttacattacatacttcctccatttcccaaaaaaggatataaggtggtagccttcacttacccactttctttctggtggatgcatgacattatgttatataccttaccaatacctccaaacctcacaaccgctgttgtagaacgaataatgtcctccattgaaaaatgagaaaattgaggcacatattagatgatttatgcaaaggcatccaactaccaagggcagaactcgtatagaacccggtccatctgacttaacaccagtgctcttgcccctaacctgagctgcttctctgacaggtgtattgccctttatattcatgttgcccagcagtgttcctggcctagcgtagctgccaataaaattgattgatttgatttgaatcatattcagcaccctggagtcactgcacgtcagcagcagcaccatgtgtgtagtaggcacttggtgcctactacaaaaggcacaaaagcagcaaagtagatagcatacccattttacagatgagaaaacggaatctcagagaggacaagtaacttgcctaaagtcacccgttaccactagtggcatttctgaatgtgagggccatctgatgtatctaatatcagctaaattcataattcttccagtcttccacatttttcacaaacacactcccatttccagaaacccttcatgtttcttccagttgcttgttgtctcttctaattccttgttgtatcacttaaattattttcccactcttatcctcagtgacctcatctctaaaaggaggataatgatgatacctaccttacagatggattaaataaa

SEQ ID NO: 101139 - DNA, 1077 bp, Homo sapiens
aacagaagttcttttttgtttgaataaacagtttaaatggacatgcctttagagataacttagccaggactggagccctgcttcttatcagacattacaaaacacagacattctcattaagtgaacagagatttcctttgatttcaaaagaatgttaaggggaattacttttaagtttaaaagctccttgagggcagaacgcacttcttattctacactgactcttcttagcacccatccagaaccttgttgcatatgatgatgccccatgtaagcttgcttcattggtttcagtggcttttgttcttagttgactagaaatgaaggataatttattcatttcttcaaccagtattacgtttagcatagtaaacaagacaaggtcaatcccttacagaacttatatcctagtaagagagacaagtaaaagaaaataaataaaaataattacaaggtacataattgttttgaagaaaacaagagtctgagatagaggataatggagaggaggcagtctttctagataagatggtcagaaaaggcttgcctgcatcctctgaggagttgacatctaaactaaaacctgtaggttaaggaagaacagggcatgaaccatgcaggcagaagattcattaactctgtaggccactgaggctggaaaaagtatggcctgtttgaggatctgaaataaagtgtagctgtagggtcctgagcaaaagagggagtaatagattatgaagttggaggggaggcaggggccagccatatgaggcccatgtagccactcatgagttggattttattctcagtgcaataggaaagaaacctaagggtgaggtgattggattcatttctgtgtttttaattatgtttgttgctgtgagatgatggcagcctggaccaaggtagatggagatggaaaaaagtggttgggtttgagttataccaatatttcagggacaaaattgataggactgctaaaggattggatgttggcaggaggcgggggtgagggaaaaggaaggatcagggatgattttgagcaaatggaagaatgatgataccattcctgagatg

SEQ ID NO: 101140 - DNA, 2862 bp, Homo sapiens
cctgtgtcagtcttggttaattgttccagggaaccttgctaacagaaacttgctcttgccttggctcttcagtagatgacctggctgtaaagagattccctggacgagccagatcattcagtttcagcgagtccttgagctccacaacatctaccagatatagcagacaagcacccatggaggcaggtttcgggcctgaagcagatcagagggctttgcaaaagacagcatagagccatcttcctgcaactttacctctttccctcagatggggagccatgactgggttgcacctcaggatactgtaatttgactccataattgcttttgctcctgaaacctgggaatcaatggaaaggcagggaatgtgcctcttctgtggccagattctgttatttgcaattaaagcaagtttttaaaaaatgcaagaggcagttgttagtcttcagggcttggcaactgaaatagctatgtggcggatacggaaaacagaggacaatttgaggatcttgctggaataataaatgacagctaccatttgttgagcacctattatatatcaggcactgagctgggtaggctctaaacttcacaataaccctgtgacttaactactttatctccattttgtagttgaagaaataagttcagagagaaagattccttcccaaggtcatgcagctagtaaatgatagaatcaggattcatagcatcactatagggggtcaatatttacacaaaaaaggaaagtcacaagcctgtttaaaatgaagtgaccaccttttcttgcatagactaaataactcgaactggcatttttaggttggaaagacagctgaattagtagttaagtctgatagccaagtaagttttaaaaaccaaagcatccaggatgcacacccctgcaccatttgctgtgcgaattaatagttctgtctctctctctctttcttttttctttttattctttgagatggattttcgctcttgtcgcccaggctggagtacaatggcacgatcttggctcactgcaacctccgcctcccgggttcaagcgattcttctgctgggattacagcatatgccaccatgcccagattatttttttgtatttgtagtagagacggggtttcaccatgtcagtcaggctggtcttgaactcctgacctcaggtgatccacccgcctcagcctcccacactgctgggattacaggcatgagccaccgctcctggcctctctttcttttttaaacaaagaactttgcacttggccagagaggaggagaaagcccattttctcccttcctaagctagatccaaataaaagaaagttcagttttcccccataactattcttgggtcatgaactttgatctggagtttgttttgtttcaggaatgtgtgcacccagcttgctgatccaacaaagtctattgcttaccagtctagcttgatgaagccttttggccagaagtcaatttgttttggatcagagaaatttcctgacaaggtatatttgttttctagtgacagaaaggcaaaggaacaagtcctagttgttgttgttgttgttgaatactaaatttaagatatgtcagcttgctttcaatgagccttgggcttctgttattgcttgagcatttggaactcgagcttccagagaaatttgaggtcctcgcttgttctctgccttcaagaaacaatgacctgattctgtctttaaaaaaaaaaatctcagaattctttttttgtttgtgtttttttttttttttgagacagagtctcactctgttgcccaggctggagtgcagtggcgccatctcggctcactgcaacctccgcctcccaggttcaagcaattctcctgcctcagcctcccaggtagctgccactacaggtgctgcaccaccacgcccggctaatttttgtatttttagtagagacagggtttcaccatattagccaggtgggtcttgaactcctgaccttgtgatccacccgcctcggcctcccaaagtgctgggattacaggcgtgagccaccttgcctggccaaaaatctcagaattctttaagactgttttaattgctccatcagtaattttgaagcactttcctttttttttttttttcccctttttgtccctttccccaagccaccaattggatggatgaatgtttgacggggaagaggaagggtaggaggatgcatggatgagtggatgagtggatcgatggatgtattgataaatagatagaaccagtcatctgaagcaacttaagaattgtagccttgactccttgagactgtagatttcgatccaggaaacatttatttagcacctgccagatgccagaaatttataccatttaaaactcagtaagtcttttaaatatcaggaaggagagaagcgacatcatgatacatcctatgggtattaaaaagccaatagaatattatgaataattttatgctaataaatttaacaacttcaacatcataaacaaattccttgaaaaataaaaagtaccaaaattcattcaagaagaaatagataccagcctgagcaacatggcaaaatcccatctctacaaaacatcaaaaaaaaaaaaaattagtcgggcatggtggtgcacacctgtaatcccagcttgtcaggaggctgaagtgggaggatcacctgagcccagggaggtcaaggatgcagtgagccatggtctcaccactgcactctagcctgggtgacagaatgagaccccgtctcaaaaaaaaagaagaagtagataatctgaatagccctatatctatagaaacttaatagtgctgggagatataggtattattatcctcattttacagat

SEQ ID NO: 101141 - DNA, 1034 bp, Homo sapiens
gccgccgcctctggctgaccatggagaacccgggctactcgctgccgagcaagctcttcagctgcgtctccatcagcgtggtgctcgcctccatcgccgccatgtgcatccacagcctgcccgagtaccaggcccgcgaggcggcggccgccgtggctgcggtggccgcgggccgcagcccggaaggcgtgcgcgacgacccggtgctgcgacgcctcgagtacttctgcatcgcctggttcagcttcgaggtgtcgtcgcgcctcctgctggcgcccagtacgcgcaacttcttctgccacccgctcaacctcatcgacattgtgtctgtgctgcccttctatctcacgctgctggctggtgtggcactgggcgaccagggcggcaaggagttcggccacctgggcaaggtggtgcaggtgttccgcctcatgcgcatcttccgcgtactcaagttggcgcgccattccaccgggctgcgctcgctgggagccacgctcaaggtacggcctctgaggccaggttggagctggggtgggcgggtgtagccatccggcaggttagcaggtgaacttacaagcctgccgagtccaggcttaacgttcaactgagatgccgtcctttgtgccaggcacagggctgcacaccaggtgtacgtttcacatgcagtgtgactatcccaacagccctgtgaagaagggcttaccgttatctctttttcctggggagaaaactggggcatagctttgcttgtctttctttttcaaaacgaagaaaaaagacaaagatcacttttgatatatctatcaaacatcaaattatatatatcacaaagatgcgcaaagcaggatgctaactggctttctgctagagcctttcttctggcactatcagggggctctgataaccataggtcactcttaataggtaaagtctaggaatagccccaggagctaacacttactgagcactaaatctgtgccaatttcacatccattatcaatttagtccttaggagaacttcctcaggaaga

SEQ ID NO: 101142 - DNA, 3079 bp, Homo sapiens
cgcctgtaatcccagcactttgggaggccgagatgggcaaggtcaggagttcaagaccagcctggccaacatagtgaaaccctatctctactaaaaatacaaaaattagccgggcatggtggcacgtgcctataatcccagctactcaggaggctgaggcaggagaattgcttgaacctgggaggtggaggttgcagtaagccgagatcacgccactgcactcagctcgggcaacagagtgagacttcgtctcaaaaagaaaaaggagtggccttaccactagccctgtggtcttcagtgacttaaaatgccaacgacccacttcttataactggggtcatgaggtcaacttaaataaggcatcagcttgcctggcacaggcagtggtgatggtgaggatgtctggttgtaagagaactgacagtgggggaaagaggggttcatccttaggtcctgatgaggagctctcacccccgcctcttctctctcctcctctccagctctgattgtgggtggcatcgtgggcatcctctttgccgtcttcctgatcctactgctcatgtaccgtatgaagaagaaggatgaaggcagctatgacctgggcaagaaacccatctacaagaaagcccccaccaatgagttctacgcgtgaagcttgcttgtgggcactggcttggactttagcggggagggaagccaggggattttgaagggtggacattagggtagggtgaggtcaacctaatactgacttgtcagtatctccagctctgattacctttgaagtgttcagaagagacattgtcttctactgttctgccaggttcttcttgagctttgggcctcagttgccctggcagaaaaatggattcaacttggcctttctgaaggcaagactgggattggatcacttcttaaacttccagttaagaatctaggtccgccctcaagcccatactgaccatgcctcatccagagctcctctgaagccagggggctaacggatgttgtgtggagtcctggctggaggtcctcccccagtggccttcctcccttcctttcacagccggtctctctgccaggaaatgggggaaggaactagaaccacctgcaccttgagatgtttctgtaaatgggtacttgtgatcacactacgggaatctctgtggtatatacctggggccattctaggctctttcaagtgacttttggaaatcaaccttttttatttgggggggaggatggggaaaagagctgagagtttatgctgaaatggatttatagaatatttgtaaatctatttttagtgtttgttcgtttttttaactgttcattcctttgtgcagagtgtatatctctgcctgggcaagagtgtggaggtgccgaggtgtcttcattctctcgcacatttccacagcacctgctaagtttgtatttaatggtttttgtttttgtttttgtttgtttcttgaaaatgagagaagagccggagagatgatttttattaattttttttttttttttttttttttactatttatagctttagatagggcctcccttcccctcttctttctttgttctctttcattaaaccccttccccagttttttttttatactttaaaccccgctcctcatggccttggccctttctgaagctgcttcctcttataaaatagcttttgccgaaacatagtttttttttagcagatcccaaaatataatgaaggggatggtgggatatttgtgtctgtgttcttataatatattattattcttccttggttctagaaaaatagataaatatatttttttcaggaaatagtgtggtgtttccagtttgatgttgctgggtggttgagtgagtgaattttcatgtggctgggtgggtttttgcctttttctcttgccctgttcctggtgccttctgatggggctggaatagttgaggtggatggttctaccctttctgccttctgtttgggacccagctggtgttctttggtttgctttcttcaggctctagggctgtgctatccaatacagtaaccacatgcggctgtttaaagttaagccaattaaaatcacataagattaaaaattccttcctcagttgcactaaccacgtttctagaggcgtcactgtatgtagttcatggctactgtactgacagcgagagcatgtccatctgttggacagcactattctagagaactaaactggcttaacgagtcacagcctcagctgtgctgggacgacccttgtctccctgggtaggggggggggaatgggggagggctgatgaggccccagctggggcctgttgtctgggaccctccctctcctgagaggggaggcctggtggcttagcctgggcaggtcgtgtctcctcctgaccccagtggctgcggtgaggggaaccaccctcccttgctgcaccagtggccattagctcccgtcaccactgcaacccagggtcccagctggctgggtcctcttctgcccccagtgcccttccccttgggctgtgttggagtgagcacctcctctgtaggcacctctcacactgttgtctgttactgattttttttgataaaaagataataaaacctggtactttctaaactgcttgcctctgtcattttcgttcataacaagtcatcctttttgggctctgtatccccttgatctcagtggagcatgaagaaactccccggaccaaatcccctacggggtgccagacatgccgggggtgggcagagggtgggggcagagaggtaagaaggcaggaaggggcctagagaagagggaagacttcagaacatgcaccctgatggcctatgcagcatatcacccctacttcaaggttttgtttaggtggcactgtgtttaaatagcaaacacaaaaatctttgcgtcagttgccatccatagaaatcaggaggtttctcataaaaatccagatttctcacttttcttgggaaaaagaaataaaaaaaattggcaactgtcagcctgcatggcaacaagagagctgctgagcggcaggcacccatctagatgtgggctctccgca

SEQ ID NO: 101143 - DNA, 1186 bp, Homo sapiens
agtccatagagtaaagtgaaagcaagtttattaagacagtaaaggaataaaagaatggctacttcataggcagaggagctgcagcaagcatcttttacacgtagtctctgaagagctccttacaatagagtttccagggcaaaactgccaccttaaagggcaagcgatgtctaaggttttgccaaattgcttccagagtggttgctctagaataaccagtggccagcagtgcaggagagcacctgcttccctgttcccttgggtgcattcatttttcatttgggacagatatactaaaaaagttggggataaggattttggcagcataattgtggagacagtgttgccaattcctgctccaggaccatatggttcagctgaatatggcagaaccagattctctgcctggctgaatgtccctgtcccctgccctgagtctcttccaaaatacgctgagtgtctcttctcctttccgcccatccaggtgcctctagataaccatatccctgagagggcagggtctgggagccaagtccccaccgaacccaagaaactagaggagaatgaggttatccccaagagaatctcacccgttgaagagagtgaggatgtgtccaacaaggtgtcaatgtccagcactgtgcagggcagcaacatctttgagagaacggaggtcctggcaggtaagtccccatgctgcttataagatgccttgaaggtggaatggggctcagcgggggagagcacctgcaggcagggatgcctccagccatgaggctccttggtgccccttccttttgcctattcaggttgccctagaacattgaaagactacaccttccttatggggtggctctgactgtgcagcctggtggagggagaggaaaaagcacctatcaaagtcttctggaaaataggcattgagtcattcttctgccttaagtctttctcatttattttgcaaaggactttcactgtataagtttggcatctgggagttaatcattaaaagttaatttcccttgtaagtctggaggctccttcgaattgggttagcttcccctccccctactctatcacttggcagccttgtgaccttggctgagaagctttcgaacttgatgagcctcagtttccttatctgtaaaatgggtacagtgataccttctggggttgatataatgag

SEQ ID NO: 101144 - DNA, 1001 bp, Homo sapiens
tttaagcattgtaatggaaagatgttaatgatatattgttacgagcccattattgggaaaaatgtatttaggaatacgtatggagggaatttatttatttatttttttgagacggagtcttgttctgtcgcccaggctggagtgcggtggtaccatcttggcccactgcaacctctgccaaccgggttcaagtgattctcctgcctcagcctcccaagtagctgggattacaggcgcgtgccatcacccgtggataatttttgtattttcagcagagacggggtttcactatgttggccaggctggtctcgatctcctgacctcaagtgatctgcccgccttggcctcccaaaatgctgggattacaggcgtgagccaccgcgcctggccttgaaattctacatttctaaccagctctcaggtgttgctattggtttttggatccacactttgcagagcaagggtttagagctgatgaagcctctgcccagctgccagctcacacattcctgtgaaagagccagggggtgggtctgaggagccccattttacagatgagatgactgaagtaggggtggggaagctcgcttgctggacattgagcatttggaagctggttgtaaggtggagctcccaccagtcctggctgaaggggtcattttcctggggtaatggacctcactcacacagctattctgaccttacagatgacttggaagactccatgatcggccctgaagttgtccatcccttggtaagtagctacatgcttctgcctcttccactttgctcctctatagcagacctattgggagaggcagaaaatacagcccccataggcagaataagtgaggggtcttaccccactatgcgggaaggctttttaaaaatctggccctggggtgggcatggtggctcaggcctgtaatcccagcactttgggaggcttgaggtcaggagttcaagaccagcctgggcaacacgatgaaacctgtctctac

SEQ ID NO: 101145 - DNA, 1051 bp, Homo sapiens
gcaacggcgtgatcctggcttattgcaacctccgcctcccgggttcaagcaattctcctgtctcagcctcccgagtagctgggactacaggcgtaagccaccacgcccagctgatttttgtatttttagtagagacggggtttcaccatgttggccaggctggtcttgaactcctgacctcaagtgatctgcctgcctccgcctcccaaagtgttgggattacaggtgtgagccactgtgcccagcctcatgtactatttttatttgcccagaatggaaagagacttgcctaaggacacgcggtgagttagaggtagagtgggatccaggacgcaggtctccaggccctggcctggtctctttctagtttctgaatgcccacttcactagcttttgggcatcagctgtcatggagcactggggatgttggctgatgtgtctcctttctttatcttagatccgagagactgaggtcatcgacccccaggacctcctagaaggccgatacttctccggagccctaccagacgatgaggatgtagtggggcccgggcaggaatctgatgactttgagctgtctggctctggagatctgggtacggaaggtgtgctgggcaggcgtaggcacaaagctggagggagtggtggcttcaccagccaggagggtgaccatgccttgagacttggatttttgtgggacttttcctagagtgcccttcttccttctcaaaaaaaggggaaacaaaagtaatggattaacctattccatccctgagagcccctggggacaagctgtttgctgctttgaagtcattggtagctctgggttttctgagctccagcctgaacgtgtcctcataagctcttctcttttctgcagggcatggtgggggtggggtgagggtaggatgggtggcaggacagggtgggagtggggaaggaggacccatagagtgttttcctttttttgaaaggaaaagttccagcctgggccacatggtgagaacttgtctctacaaaaacacaaaaattagctggatgtggtggcatg

SEQ ID NO: 101146 - DNA, 1029 bp, Homo sapiens
cagacaccctcctttgtcaatggcagtctcagctgagtgaaggactgcctggggtgtccgaaacagagacctgacctctttctatcctgagttatgtagcgaacgctctgtgtgaccttgggcaagtccctgccctgttccgggctcagattcaagttgtgtgaaacgggaggacaggagctccttgggtcctggcattctgtgattctaagcagacccccagctcctgcagttatggcgtctggagaagatgggaatgtctttcagcgggaggggcatggtgtattgaacttaatgaaaaaccccaactctcctggcaaatactaggcactttagtgtttgaattaattagtagaataatgaactttgctcagagctgctgttctctgggcaaacagaagcctgagcccagaagctggaggaagggtgatgggcatccaaatgtttcctgtgctcttgagggtacattgttcccactcggtggagctacaggatgggagcagggtaactgatgtactgtagggctgcccgggacctttgacactttcttttggcaagcggtttggtgggagtggacctgagactctgtcctgatcagctgtgtctccacagggtagtggctgagtgatgattatgggtactggagtggatggtctgtgagggtagggattgtgcctctcggtgtctgcatggtgctggcagcagagtagatctgtgggagatgtttggaaggcaagactgaatccaggagtacactcctgagtcatcaggtctgggcagcgccctgacctgaggctgtcttagggtgtgcgtgaggcagccctgtctgtcccggcccagactgactcagctgggaaaagtatcctggactgggcaagaccagaaccaggagcccactccctgtcctgtgtgaatcagctgccactgcatcacagagccctggagtgtagcatcccagggccctgtgcatggagactcctggctctgaagtcaggcagccctgcgtatgcaatcctcgctcttccatct

SEQ ID NO: 101147 - DNA, 1076 bp, Homo sapiens
cttcagactagactagtttcttttttggaaactgagtataaaaatgaagggttaaggatgaacaggtgcccacaaagagggctgaactgggaataaatcttggtttcagccttggttttgctgctgacttggctgcaagatcttcacgccccactttcgctcatagccttcatttctctaatgtaaaacggaggtaattcctaacagccagtgggcatgctaatcccatgggttgttttgaaatacctcttagcactttcacatactgaaagagaggctggatgcataaacaaccttccatggctcctgggggcagtgaggggtgggaaaaggtctctcagcctgagacaagtctcctgatggaactacagcccctgttgaggactttgacctggtcaacagctggccaaagtgtaccattctttctttctcccggctagattgacccccctacttaacagggctcccttggagcctggggcaggctggtgaccccgtgtacatatgtgttcatgcgtgtgtttatgtgtttgtggttaaatgtccaggtcagtgaagcctgggttctggcccagtgtggctacttcctgcttgtgtggccttggacaagtgactttacttttctgagcccttgtttccatctctgcaaaaagggactattaaaaggacctagacaggctgtgtgcttggttaaggcctgtcacttgggttcttgggggatttgccacaggagatggaggtaggagcacagggaccctgcccttaggtataggcacttgggcagccatgaggagccttcctcctgctctgccaaaccaaagccacaggcacgggctatgtgcgggggcttgaattccagcaccagcagcccggcagctcctgattcccgagtcatgaagtcatctctgagcagcacttaacctctctggctttccacccccacgggtgccaagcgttcagcattctccccactccccgggagagagtgattcctggccactgccttccttgtggcctgaccccgctcccttccgggaatccagcattctccctctgtgggggtggaagagggtgca

SEQ ID NO: 101148 - DNA, 1529 bp, Homo sapiens
atccttcctccctcccccacttcccagccttgttcttgcctcctgcttcccccaacccccaccttcagcccagaccttcctattcagcggcccccaccccttcaggctgcatctcacccctccccctgtcctccaggcccgggagctcggctgctccagttttctctggcacagtagaagaggctgctggtcaggtgacacctggggtaatggaaaggggaggcagggagaggctggtatgtgtggaaacagtgacttggtgaagcccagcagtcagtggccaggcctgcggggactggcggtgtcactctagcctctgggcgtgggggcagatgtggcacatggctggcccggctacccagagtggggatactccttgccttggagaagccctgccggagccgtctgtgggacagactgacctggtctggaggatggcttccttgggggtcggtgagggaggctgggaagaggcaggaagccagcacccagggctgatctaatcagctgagataaggctgcagcgtgggctctctactctgctctgagaacacaggaggtttgtttacatcccgagagcctccctagccctcggatccagcagggatttcggatctgctgcctagattacaagctccaacttcaatgcacctctgtctctgaggccctgagggagccagccccctcctggctgtctccaccggtaatcggagcaatgcccagcttggttactgggctgggacagagggaggcttgtctctttgagacctgtcttttacagattggaaaactgaggctcagagaagggaattgtccacgatcatccagggagttagtaacaagggtgctgggtcagctcctggcagggagacatccagaggctcctgaacccttcccccatttctagctggcaccctaggatcctggagttcttgctgtgggaatgggctgccctgaggcttggtgaaaagctggttgcaggcagtgccaggcctggctctctcctgagtgattgtgttcagagtaacccgaccttgaaggcgacatttgaaccctcactccacccccacccccagacctggtttaaccattcaggcaccagagcaccagaccatggattggtgtgtagtttctttttaccttctagatttttatttatttattttgtccctggggacccaggtccccaagtagaatttcaggtgtttctggtcactgtcatttgcaccttcggggaaaataaaaatggtctttacctctgtctgcttaggacaggtggtcaaagctgtgtgaccttgggcaggtctctgactatctctgtatctttttttcacagtctgaagggacctgattggttgttgaaaagtctctgggctcagaagcaaaatgataacctattatagattatattcctttacagtttgcaaagcaccatctccctgtccccaggctagcttccttccagcaacagaactgcctctgcaagttttcccaggcctctgatcctttgagcactgatcccactggcc

SEQ ID NO: 101149 - DNA, 1489 bp, Homo sapiens
tagagtactttttatatgacagatctggtgcattttgtcctcacaaaaagacctgtcacatggggattctattatgcccacttcccaaatgtgagaggtaaaatggtactactttgggttagtagagggcatccaggaccccaggatctctgactagtagccctcccattgtgggtggtgttcccccgactgttccatcattccccttaccacccccatattttggaagggaacccaggctcagtacccagctgtcctctcctctgtttggctgggcttgctatactaaaccagttcttcctgtccagctgggagcattccctgatctgccttcctgccactccctctcaggccaattaaaggcagccttgttttgggagtcccctccacccaaaggtgttcctacccaggggcacagcctactgacttggccccgggcccaggcggttgtggggaagtgtcccccacctatcacctatcaagtgtactttagcttaaggacatttctggtcttctacagcgtcctcttcttgattacatgggagtaggggtgggggcggaagcctaggggcttctaggacccttgagtgaacagtgagagctcttgggacttcttgagcccagggagttatcaaacacccacgaaaatatttgggccatgatttggagggttccatgaggttggggggaggcctctttccccgctgggctgacatcccccaccttaaaatgaaaggtttgaacagggtagcctccagagtcctttccatctctcaatttgattaataacttaagtacctactattcaaaagaggtctctctcttgaaggaattaacttgagggaattaacatactccaccaaatgctgaatccctccctctctccccccgcacactgagggcaggaactctgctctatttgtttttgtgaaatacctgtcccctagtttgtactcaggaaatgcttgtatgaatgaataaattcgtgcatgtaactttattctaaatggttcattactgttatttattgctagtatgagtatctcccagtactgcgaggtaccattttctctatttttacaggaaattgatgctcggaacaatgcagtggcttcctaaggtcagaaccaggtccttctgatagggcaaggtgtctggtttgagtgtcctcagaatattccagatgaggaaatttgctgggtttgaaggtagataccttaggtcctacttctgcgttgctgggtgaccttgagcaaacatgccctgtctctgggtctcagtgtccccaactctaaaataaggaggctggaccattgccttccaagggtccttcctgcccagagagcccattgatgaggggaggggccctttgctggcctccttggtgaagagtctaaacaaatcccagtctcagaagagaagttggggtggcggggggacattcagctcctgccatccccagctcctagaaacagagggcttttccaag

SEQ ID NO: 101150 - DNA, 1026 bp, Homo sapiens
aaatggggttagccgcagtgatctctggggacctgcctggcagtgggtcaaataaataaagggagttggacctcccggagggtaggactaggggttgagtaggagccggcgggctcgggcagggcgggtcccttggggtttccaactccgcgggcgggcgcagtgccccgcaggcctcgcttccactggggaattccgggcggggtgcgggcggcggggcgggggcgggccggggcggggccggtaggccgcctataagatgggtggcgcgcccgcccggggccactcgccgcagcctgcgcgccttctccagtccgcggtgccatggcccccgcccgtctgttcgcgctgctgctgttcttcgtaggcggagtcgccgagtcggtgggtgcttggaggttcccgggctgggggcgaagcgggggcgcaggccggtgcctcctttgttcgtcggagcgtgggatgggggggggcagatcgggggtacgctacccccaaccggacaccgaggcccgggaaactttgttggaaactttgctccggggtcacgggccagcctccgggatggcttcacgcgccgtgcgcccctcgcctgttgctcttcccgcctccccgggcctcagccccgccgcgggctacgggctcgttagtgactaagccggtgtcaactcttcaactcccacaccctcgtcccttccctggtgaccctggggcaggcttggagcgctgaatcccctcctcgctctcggggcgcccagagcagacagctttaggatccgagatggccctgggggtcggggggctgcgtgtactcggaagggggagggttttagggttgtgcgaggccctctttcacacaccaaggagaactgagccctaacctcagttctggccccagctctgtcattgacttgtgacttagggcaaagtcctgcccttctgaatctcttcccaatactgcaccaagggtctgagggaatggggcaagaggggacactgcgttagggtttctagaaagttggggac

SEQ ID NO: 101151 - DNA, 1133 bp, Homo sapiens
cttgtacctggttcaggaggttcaggcagaggttgcacccactacgcctgcgcaacctcagccccgcccctccgctgctttccccggaaacgtttctttcctacgcagccgctcctgccgccgtggtcgctggagctttgcctctctaggccggcagcgcctctcctccatggtcctgtctgtcagcgctgttttgggagcccgccggtgaggccgggccacgctcagacacttcgatcgtcgagtctgtcactggtgagtagaccccagaggagctcgtgtacgggcgggggccgcgcaggcggaatgggctggatttcccctcactctgagaatgggtctgtctgccccgccttccccctgactcttggaatgggctcaccccttggttccagtccctcctcccgggcggggcgacgttgccatggagacaggccgctggctgaggcccggctcgtgtccctgcagggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgaggtagggtccccggactggggcgggtggggtctcggcctccccgagtaggctttgtggtccatcactactgtgctgtagacgtggctgggtcaccttctttctttgtagccctgggaaagggatttcacctttctgagcctcagctgcctcatccataaaatggaatgacagcagaggctgattagtacaaagaaaagggcctggatgttaatacaataaacacgtctgtgttccaggcaactctgatacatttcctttctgatactctgggaaagtgacttgatttctctgagctaggttctcaggtgccacatcggagagaggggtggataaaagagcattcgtgcgggtacagtggaaactgcctggactttggggtcagacaggcgtccgtttaagatccacttactagctgtgtgacctggggcaaatgtcacctctgtgaacttgttttcctgtcttcaaaaccatgagactagttgcagagaggtcgtggactg

SEQ ID NO: 101152 - DNA, 1022 bp, Homo sapiens
cctgagttctagcctagggatcagcaaacctttcctttaagggtgaagtagtaaggattttaggtcacaattattcagctctgccattgtagcacagaaggctgctatagacaaatatataagtgaataggtgtggctgtgtttcaataaaaccttatgtacaggagcagatgccaggcctatggagccatagtcagctgaacgctgttctagactttactcttgttgtttattactttgggcaacttaacttgtctgagtttttacgtcctcctttgtaaaatgagaataatccctttccacctgctgtgagaaacaaatgaaatcccataatggatgtctatgaaagcacctattggaaataggctgccgtacagatgtagggaggtattatcttctgtgctctgggaagaatgcttgttccttaggaggcttgctgagatcctggggctctgccaagtcacttctccagtatatttccatttgtgattccccctcagatcctgggcttttccacccctccaggccggctctccatgatgtccttcatcctcaacgccctcacctggtgagtatcaccagttttgctatccagcttttgggctcttagtgctgggactaacttcctaagtttgaacatgagacaggctggcacttgtttctggggagtggtggagtaaagtgggtgacagaggccagttctgggaccagctgtataatgggcctccttccattgctgttttgacttacctggaaagctcttatgtcactatgtttgtgctgcctgcaagacaacttccatctcagataacttccctgatgtggagtgagctgagaaaggattcgaccgagaggcaggagaactgggttctgttcttggtttgtgtgccattggccaagttacttgccatgggcctcaggctcctcttttgtccatgagggtttggactcagtgatgtctaaggtcacacgtaatcattgcctgtctcttaagaggcagtttagcatagtggtcaaggtgt

SEQ ID NO: 101153 - DNA, 1031 bp, Homo sapiens
agttgaaaatcaggctattttatataaaaatccagatttctggcttctcttgaataatggaatgactgactgattccaggccaaccttctagcatgataagatttgcctagatgcaagtagctactgcccccctttagctagaacatgtatgcttcagggtgtcatgatccccaccaattcctaggatcccctagtgacaattgccatcgatcatcaagctcatactcagtcagcttcactcttgacattacccgccaggttcttctaggcgtctggtatcataacccttgcttcacacttatctcgtcacttctgaccactatgctgccgtcctaattgtccctaccctcccaaataacctaaggccaggacaacccagtgacaactcactgctgtcctctccccacagtgccctgggcttgctgtacttcatccggcgaggaaagcagtgtctggatttcactgtcactgtccatttctttcacctcctgggctgctggttctacagctcccgtttcccctcggcgctgacctggtggctggtccaagccgtgtgcattgcactcatggctgtcatcggggagtacctgtgcatgcggacggagctcaaggagatacccctcaactcagcccctaaatccaatgtctagaatcaggccctttggacatcctgctgacacttgggccccttaacaccttgggctgctcagaccctccagatgaggtccagcccagatctgagaggaaccctggaaatgtgaagtctctgttggtttgggagagatagtgagggcctgtcaaagaaggcaggtagcagtcagcatgacagctgcaagaatgacctctgtctgttgaagccttggtatctgagaggtcaggaaggggacctctttgagggtaataacagaattggaaccatgccactcttgagccacaatacctgtcaccagcctgttgttttaagagagaaaaaaaatcaaggatatctgattggagcaaaccacttctttagtcatctgtcttacccccc

SEQ ID NO: 101154 - DNA, 1154 bp, Homo sapiens
tcattacccaggctggaatgcagtggcccaatctcagcttactgcaacctctgcttcctgggttcaagcaatgctcatacttcagcctcccaagtagctggaattacaggttggcaccatcatgcttggctaatttttgtatttttcatagagacggggtttcatcatgttggccaggctggtctcgaactcttggcctctcaagtgatccacccgcctcagcctcccaaagtgctgggattacaggcatgagccactgtgcccagcattggccagagattttcagatgatcttaggaatgtgggaaatctatttccaaaggataaaggaaggtacctagataagagagtactagcccactactgagttggcatatctcttaactctccaggtgtctgaagttgacctccctttttcccacccaccacctgaactctggccattcagagagaaaagtggagactcctacatagctgatggtcagaatagtttataacccttaaaggaggacaggaaaggaaaaagggatgtctggctcagagggtacttctaacccctcgctctaggcagccctgtccatatcagtgccaaatgagagccacgatggcagccagcagacatcagggggtacaatgggaagctccaggactcccagcatcctggagggtacacagctcaaacagtctcccctggacaggaatccccttggactccttcctcagcaactcccaggtcagagtagcttccttctgccagccccagaaggcagtcagtgcacaggtatgcaacacctccttgtaccggcagcccagggaccacggagtctcagaggtagggccctggggacctagggcagaggagtagggatggaatcaaggtacaagagaactcctctgtggagagattaaaaaccactgtcttaaggttttctgttgtaaagtaataaagggtggtagaaatagcattgaggcaggagggagtagagggagctgagggttttaatccctgccctgccgctacctgggcaagtcacagtcataggtccaattctggaaggctttagagagctgcagtggagtgcaaagtcctggagtcccattactagctgtgagatcttgggtaagctatgttacctcccttacctagatttcctc

SEQ ID NO: 101155 - DNA, 1040 bp, Homo sapiens
agacaattattaggctaccgtcccccctatccattttacagaacagggacatttttcttctgagcctgtgttttcaaatgttgggggataggcttgccagtcctctaggtaccactaccaagtattgagctcctatctggcatgtactgcaaagtgatttatgtgtattcttactcagtccaataaggtaagcactactatttcccccattttgcagacaaagaaacagaggattgggagtaaacaactttttccccattacaaagttggtaagaagctaggcctgtctgcctcatctgcttttcacgttccagttatgtttatgtgtgatccagacaattgtgagacggacagtcttagggatctaaatgccatattagcaaaaggttgtgaatgtaaacgtacgtttggcttgttaacaagcagctagttccataaaggtgagtagttaggtagctgctgataagtgagaaatggagccgggactgactggccacagggctttattatgatggccgtggtgtggcgtgggaaaaggccaaacatttgttcaatgccccacaaactggcttctcctacatcaagcttgatttgcttaaacccccctgaaacagacattagtatcactattttataaacatgaaataggctcagagaggtcatgtgacttctaaaaagtcactcaatataaaatcagattcaaacacttcaattttttcccagttaactgttaagcagccatttctagggtggcctcctccccaaatctgtgttactgggcccagaggaggagctttaggttgaaatggttaaacaaagagagggtggtagtggggagaccctggttgtggaattgtgggaggcaggtggccagaggcctaagtgccggggcaggtgggatgaggtggaaggatgtactgctgggattccctcactcccagacctgccccttgctgccctggccatgctgggtccccgccttcgtatacagccctcccatatattcagtggcgttcccagtgggcaactggggcccaact

SEQ ID NO: 101156 - DNA, 1041 bp, Homo sapiens
actccagcctgggcgacagagtgaggcactggaggaatcctcctgaactcctccatgtgcctcttcatttggctgagcatggtttgaccaatcctaggctgggagttttgtcatcttggtctggggacagaactgggagaccattttaactctcctgacctcccttcacccttcaccttttccttttctcccatgctggaaagcccctttccttggcatggtggattctttgttaaggtcccctctagggactcacccccagggtctagtcccaagtctgaccttggaaaccctgctgttcttgggcctcttctttgctgatggactcatgctggggctgtgagacctcagagatgaatggagcaacaccagtgccaggcaccaaccctgttcctctcagttcagccagcactcaggctgggcatcagatggtggtgctggctctgtaccacctgcagctgtgacatcactgaaatgtgacagtagcagggctgggtctccaaggagtgtatgtggcagaggtgaggggtagagggtgagaaagaaatatagacaataggcgacagacagctgtgtgcattgtcacaacctccctgtggggtaagaggattatcccctctttttaaatgaggaagccagggttcaaagaggttgaataatctactcaaggccacactagatctagcccagctagatcatagtgggctggaaacctaaccaaggtctgatagtcaacccatgaaaccagggattcccaaaccatgctcatccattcagtcatgtcgcctgttttgactgggcgcctgctacatgccaggtgctttttcttttctttctctttttttgttttttgttttttgagacagagtctcactctgtcgccaggctggagtgcagtggtgagatcttggctccctgcaacctccgcctcctgggttcaagcgattttcctgcctcagcctcccaagtagctgagactacaggcacccgccaccacgtccggctaatttttgtatttttagtagagatggggtttcacca

SEQ ID NO: 101157 - DNA, 2385 bp, Homo sapiens
catctcccaggagggacctagtaagatgcttggatggtcagaaccgtgactgcacagaggagactgtgcttaaggagggcaggaaaggcttcgtggaggggaggtaagcactggagccggatcatgaaggtaggcagaaagaagttagcaaaggcttgcaaggaaggaagaatcacctgagcagagacccatggggatgcagagatgtccagaggagagtgaggaagaaggggctgagtaggatgagacccagcaagtgggctggctgggggcagcaatgttccagctccatcaactggcccgtctaatagttaagaatacagcctcctcctatcataggtttagcagccagctgtggactttgaaagagggagcagaggtagccccaggacagtgagtggatttgtgtctctatccagtgtggataaatcttggaaggagctcagtaatgtcctctcagggatcttctgcgcctctctcaacttcatcgactccaccaacacagtcactcccactgcctccttcaaacccctgggtctggccaatggtgagataacccctacagccctttccttcttcctcttacctcctgcccaaacctttgcctccttttccctcagtttcctgcttcctcagcctgggctagatcctaagtcccctgtgtgtgcaggcccccaatactgtgccatctctgcatgccttttcccaaggagagaagggagtcctactcccagttgggactgtccagactgtggtgctagaggtggtgtggggagcaggagggtcattcccatctctggaatgtggatcccgaggggtcagagcccaaggcccaccccagacagacctctgtctccctcagacactgaccactactttctgcgctatgctgtgctgccgcgggaggtggtctgcaccgaaaacctcaccccctggaagaagctcttgccctgtagttccaaggtgaggccgcagagcctggcagccgggggcggggggtgtatagagaacctgcgccccatgccaagtgctccatacagggcttctcttatctctttccatctcctccaggcaggcctctctgtgctgctgaaggcagatcgcttgttccacaccagctaccactcccaggcagtgcatatccgccctgtttgcagagtaagtcatggggagtagaggaagctgccatccaggggctcagagaaggtacatgtaaagcatgtggtcagtgtctggctcaggctgagtgagtactgagtggtagatgtgatgacggttattcagggcattggccaagcaccaagaaaacagtggttgcctagcaagcactgaataaatatttgtcatggaaaatagtggttcagaacaatagctatgcgggtgcaattgctagctcagtcacttgccagctggcgtaaccttgggtgaatcatttcattcccctgagcttggtttcccaccctgccacatgacattgatagtagaatccactcctagggttgttgtgatagtttatcaaactgatgcacatacagctgtcagcacggggtctggcacgaggtcaagtgctcaggagtgggtggtagcaaatcgatggatgtgaagatacatagatgagggattgagtctgagtaggagtctttttgggggctgtgtggtgagagtgataccccctcactgctgccatctggcccttgtgatagaatgcacgctgtactagcatctcctgggagctgaggcagaccctgtcagttgtatttgatgccttcatcacggggcagggaaagaaaggtaagttaccttggcaactcatctgtacccacccatgccagccctgccttatctatgtggactaggcctaggcctggcccctgctcagccctgcgctctgtttctcagactggtccctcttccggatgttctcccgaaccctcacggagccctgccccctggcttcagagagccgagtctatgtggacatcaccacctacaaccaggtaacaaggtctccagccacacacacaaacacaccgctggtccccaggaccagcctaccctctctgcttgcttcttagccctgcctttgtgtccccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatggtgagtgggtggttggttggactgctgggttgcaacggctacagagaaaagactcacaatcccacgtctttgccgttagatgattgggttgtatttagaccagatttccagagtcatatgctgc

SEQ ID NO: 101158 - DNA, 1549 bp, Homo sapiens
attggatgagatgatgtgaaaaatggagttagttcatgcatttgcttaatcaaccaaatacttttgaattcatactaagtgccaggcatagagtgttgaataagacagaggacactgcactcaagaaatataagtctactagctagggcaggtgtcagttaattaattacagttgtgttcagttcccttaccaagggaaagagcagaatatcctgagaggacctggattgggttcgaagggggcacggtgttcgtcacgtaagcacttcaatactagcaacctattgtcatcatcgcttgttggctggggaagacagggatgattccagaacccagattgcccagtttcagtggcagggctgttccccatctactcactggcttgggactctgaacatggcctgggcaggtggggtggggagtgattcttacctttggcagctgttaactgttgatatttctttacacagaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagtgaggacctgagtcctgaaccaggcccccagcccgccctctcatgtcctctccaggtcccccaaactctcatttcccagggtagttcctgaagtacctctgaaaagctacacaggcataaagagtaaggaatagtttctcaaaactggaacgggagcctcactgtgccaggttcagaagtaatttataaaacagcaataattaaaacacataatactggtgattcttaataggactgtacaaggacagtagcttcctttttcacttacttttgcctcctttctggagcattgggttttgtgatgattcatagactctttaaggtagggaaagggtttggcaacgttaggcttttgaagctaggaagatagcagagctggagtagatggtgttttgcttccttgggaggggtaaagaggtacagttaattaaatttttttatttctatttttattaaaatttatttttattttctattatttttctaaggagaagataatattagtgcttcctattaggtgccaggcatagcactaaagcacttgcctttctttggtgtagggggagactagtagtaaagtaaaagacctctgaggaagaggttgtaccatatcccaaacggccaaacttaaaaacctttcagtactttagttgattcctatattttcaaacatacggtgaatagtttcacttattttcagcaccattatttgtaccaccttcaaaatctctatttcagacatcctaactgcatattctataggtttttctgttattattcttttaaatcttctcctttggaaaatttcaaacccaaacccaaacagaatagtgtaataatcccctgtacacaccctgcagccttttttttttttttt

SEQ ID NO: 101159 - DNA, 1015 bp, Homo sapiens
tcctaccctatgcctgcaaccccctccacaaaaaacaaaaaaccctacctcctcccacctggccggaaatttcttctcctgatctgctccccctgtcctccccatccccatctgattgtgattcccagaactccccgggttgtttgggagtgtttctgaaagcataatccatggccatggaaatgaatcatcctacttcttgggggcattgagagtcagtccacatcagcaagggtagagtggagaggtgggagggctctgggtggtgggtctctaactgtagtgtgcatcagagtcactgggggcacttgtgaaaataatgtatgttcctggggtccagatcctactaattcagttggtctgggtgtggcccagactttgactttttagcaggcttctcaggagctcctgctgtgctctgtcctcagaccacccccaggctttgaagccaggctcattggattgaagcccgccccgcccacctcccttgctggttacataaccctggatttctgtaaaacaagcctttaggcggttgcctcccactgccctcatcttctgtcttttcctctggcacacttggcatcaactgtgtgttatttgcagttccccccacctcctaccccactcagttctcccatcatagtggtttggcctagaatgccctattccaccaaccatgcacacctctcaactgcctggttccctcataaaaccagatgaggctggccgggcacggtgtctcatgcctgtaatcccagcactttgggaagccaaggtgggcagatcacaaggtcaagagatcgagaccatcctggccaacatggtgaaaccccgtctctactaaaaatacaaaaaaaaattagctgggcatagtggcgcgcgcctgtagtcccagctactcggtaggctgaggcaggagaatcgcttgaacctgggaggcagaggttgcagtgagccaagattgcgccactgtactccagcctggtgacagagtgagactctgtctcaaaca

SEQ ID NO: 101160 - DNA, 1741 bp, Homo sapiens
atgtgctctgtatcactaccctagccctccatcaagagggatctgccctctcatctggctgaccccaaatcgaaccctttaacccgcatgctctactgcctccctgcgggccctgccttatcctcctcaaccgcccactggggacactctggagaaacctcggagtcttggaatagaaacccaggagccctgagccttggccctcaggccccaggagggaggtcaggagggaggcgtggacaagggtccggccgtagctggtcccgtcctggaagctgcttaagttcctggttcccaccggggccaagagtgatacctgatcctgggggattgtgaaatgacctcatgtggcagcccgcccgcggtgcccgcaaagccctccaccctccccttccccgctcggctccacccctaccccacgccccctcccgcgcgcgcggttaaatccccgcacctgagcatcggctcacacctgcaccccgcccgggcatagcaccatgcctgcttgtcgcctaggcccgctagccgccgccctcctcctcagcctgctgctgttcggcttcaccctagtctcaggtgagtggggcggggagaggcccggcgcctagaggggccgagccacgagcgccaggatggagccaggcggaggcgtagcctctggaggctggggaagtgggaattccgggggcggaagtggcggggacccttggagcctagggtgtggggtccaatgtgctggaggtggagagaccactgatggctgcaatttgggaggattctgtgctgaacgcggacactccgtggctgcagtgggctgggggtgggggctgctctgcctcgacctcggaagctccgagacgctcagctgtgcggcgtcccctagggctgagatctgagggccccgacgccaagggttagggagctctcgtactcccaggggtcagggactcctggtctggaagaaggagtctctgggggctgtaaggggactcctagggccagagactgagaattccttggggttaaggtttggagcaggaggtgggcatcctctggggctggcgctacgccccaccctcgactgtcccgggcctcccctcccaggcacaggagcagagaagactggcgtgtgccccgagctccaggctgaccagaactgcacgcaagagtgcgtctcggacagcgaatgcgccgacaacctcaagtgctgcagcgcgggctgtgccaccttctgctctctgcccaatggtaaccccacggcggccgagcgggaacggggcggggccgcgctgggctgggaggaggtgggagggcccgggttccgggaacaggggcgcccccggacccggggacccccgggaaagtcaaggcggttgaaaccagatccgtcagtcctctccctcgcacggcccaggggtagacaaaggcgtcgttgaaacgcagccaagggggggtccccacccctagctgggattcgagtctctggtgcatgacgggcttccgggcacgcacagccgggacattgttccccgcggcctggggacccggggccgcagtttccttctcgaaccggccgaagcctgccctgcgggaaagcccggagcctggggcgctcacctctcctcttggagtccctccctgggggcctcccccagccctggggaaagactgggagagcctggcctggcaagattttccccaattcctctgtccaggcggaaaggaactttacagatttagg

SEQ ID NO: 101161 - DNA, 1140 bp, Homo sapiens
ccaaggtcacaccgccatcccatggctgctggagtcatagtgagggttcagcttttgcctttcaggccaactggctgagtgattcgaagaaagtgaggaatcctccctggacactgtatcgcccttcgtcgtctttcagtcaatctcttccactctaaggattgagtgagcgcgagctggggactctctcaaaggtgcttgctggagctgcagtctccaccaggctatcagaacagggggtggcttaaacagcatggaatctcagctttccgttctccagaggaaaatgctgaggattagaggcagggataggacctggagagaaccaaggtactgtaatgatgttctttatccagaatacagcccctgtgacttttcctctctgttatttccttgaagatgccagcacaggctgggaaggtttgtaatacggtgacccaagacaccgatcagcagggaggtggtaagtggagggggactggcagcccaccaagggcagcttcaaggtcatgagtcccctcctctgggccagggagaggaggaccagaaggagagaggaagatttggagagaaagcaggcagcagccagatgagagaggtggaggagcaaaggagggagtctttgctgtttgatggatgaagaatttgttcccttatctcagatggacagactgaggcaggaagagggacaaggtcagatggcctcctgagccagggaggcagcctggaggtttgaatcctagttctgccattttctagttatgtgatcctgagcatgttgtttacctctctgagcctctgctctaagatgggaataattccaaactctataggattggcatgaggactaaatgaaataatgcatctaaagtgtctattagtgagaagatactccatacacagtggcttgttttgatcataaatggttccctatttatttccagggcagcccaatattacaggttcctactcctttcaagagaatgaatttctttgtattaggaagtcaagactgttggcaacttaacaacatttttttttgtatttatgctttaagttctggggtacacgtgcagaacgtgcaggtttgttacataggtatacatgtgccatggtggtttgcttcacccatcaacccgt

SEQ ID NO: 101162 - DNA, 1051 bp, Homo sapiens
cttggttcaaatgttagctctgacacttacctaaccttctcacctccctgagtcacagttatctcgcttataaaatgtagctaaataagatctaattgatcagataatcccattttaacctaaagaagaaggcatggcagaacttcctaatagtagaaggattcttggggagagaaatggccatgacccctcaggaaggccacagtggacatctgggaccacagtatacccaggtgcctgctagggatggtctgaccacagtatacccaggtacctgctagggatggtctgaaggagaagagtatgtctagaacctgtagaaaatgcaagcagagcccccagaaggtgaggctttgctgtgtgggtgtgtgggatggggtggggtcaaggagctggtctaggatttaagctgcaggtactcctgcctagtctaatggatattgttgttgatggtattgttataattttcttcctccagctccagccaccaccaggctgagcagtgaggagagaaagtttctgcctggccctgcatctggttccagcccacctgccctcccctttttcgggactctgtattccctcttgggctgaccacagcttctccctttcccaaccaataaagtaaccactttcagcacgttctgtctctgtctcccctgacttgggttgaggtgggtgggcaagtgttaagggtgtgaccagatcatccaggcatgaagtccagagaaggatcatctggtaggtgttagcattctcctggtggatccctgcatcaaccctatgaatctggtcattattcctccaggaggatggatgagaaaaacgaggctcagacaggtggtggggtgcttccaaagtcactcagattcattgctgggggtgctgataagcagcagcatgcaccaggtgccagacacggtgctgggaggtttgcttatgagatcctctgggtcctcaaaacaatccccagagcagttaacaacatacccctgtcatagacctggactccatgaggttacttgccagtggccacacagaaagatggcaa

SEQ ID NO: 101163 - DNA, 1096 bp, Homo sapiens
ccccttccttgcacaatttacaaaaattaactcaagatggattaaagacttaaattttaaacccaaaaccataaaaatcctgaaagacaacctaggcaatgccattcatgctattttcctactgctatgcaattaaaaacatatgcataaattaaaatttaaattatttactgtgaccatgagactccaggaatcaaattttttcttatgaattaatttttaaaatccatttgttatttcaatgatataataataatgaacatgtaaataaacacattgtaaaaattgagaaacacaattttattgataaatacaaatctataggaattcatcttttaatatgtaagtgtacagggacaaaaagttttaagtatgacatttggttctttgaacttctagtaagttgccaaatatcacatgatactcataatcaaaaattattttaaccctccctctcctaaagggagaaggatggcaggttgaagatgaaatccactgaagaggtaagacctgggtctttagcaccctgtgtgccaggccagaagtggccctgtgaaaggtcatctgcagaccccctgaaaatcaagcaggattggatttggaaattctcaataaaggaagagttaaaggctgatgtgactataaagagatgatgctaagtagctgatagatcctgtagttcaacttgatacctacatagaagctggattcatctgataccagagaagtaaaatttcaaggccaaaaccagatctgagtcttactgtttcagtctggtcctcttcagtgctgtaaattctagatatacaatggatgatgactgcatatttctttcatggactattttcagcatctggagacctcactatcctattatgtctttgtgtgaagacatgttgttttgtaattatcgagagtgtcacattgaactctctggttatgcatgggtcaccatctgctctcacatcttctgtgatcagcatggcagtggtgacttttgtggttcacctgctatctgtcctgcctgcaacagtacactttctggaaggctagatattgtccgcactgaattcaggaatataaagctatggtattg

SEQ ID NO: 101164 - DNA, 6717 bp, Homo sapiens
tgggttcaagcagttctctgccccagcctcccaagtagctgggattacaggcatccgccaccacgcccagctaattttttgtatttttagtagagacggggtttcaccgtgttagccaggatggtctcgatctcctgacctcgtgatccgcccacctcggcctcgcaaagtgctgggattacaggtgtgagccaccgcgcccgtcctgattttttgcactatttacacctcaatctgttgggcacccccacgattatatccgtaagagggggaataaagggaggaggtcaagcctgaaatgtgaatctaaatctggctgatcccaaagccctgctcataatcacttttcccttctgtatgaagctaggataaagacttattttatattcagtttccttcaggttgatgcacattaacaggactctgaccttgtcctctgttgtgctcccctagttcttccagaaggcagcactgaacgtgcgagacaatgttggggaggaggtggacgcagagcagctgatccaggaagcctgtcggagctgcctggagcaggtgagaccaaaggggacaagagatgcaggcacaaggtttagctctcgagcctctgataagaaatgcgatcttaagccggacgtggtggctcacacatgtaatcccagcactgtgggaggccaaggtgggcagatcactcaaggccaggagtttgagaccagcttgggcaacgtggctaaaccccatctctacaaacaatacgaaaattagctgggcatggtggtgcacgcctataatcctagctgcttgggagccataggcacgagaatcgcttgaacctgggagacagaggttgcggtgagccgagatggcaccactacactccagcctgggtgaaagagcaagattctgtctcaaaaacaaacaaaaaaagaaatgtgatcttgtcatcagtggtattttggggaatgcccagcaagccacatattgagataggcttgaggctgttgctgacagggaaaggaagggaagtagctactatatgtcaggtaccaggataaatgcattatttttttttatgtctcagaagaaactatgtacagaagatatcttttaattactattttatagatgaagaaattgtgacttagcaaactcatagaagcagagagtagaatggcagtagctggaggggagaagtggggggatgttaatcaaagggtacaaacttttagttataagatgaacaagttctgggcaatctgatgtacagcatgatgactatagtttatctctattgtttacttgaaatttgctaagaccatagatcttaagtgtccacacacaaaatggtagtggtggatgtgttgattgatttcattgtggtaatcatttcactatgtatatctatgtcaattcatcacattgtacaccttgaatatataccatttctgtttatcaattatacatcaatagagctagaaaaaaatttttaaaagcaaagcaaaaaaaaaaaaagaaatggcttaagacacataataattagaatagctaagatctgtctcacccctgcaggtgcgtggtggatcaagttatcatggccccatttggtatcatggggatgagcaccctgctgcctccctgcctctctggtgtggtcaggaagcatgacatcaggtctataaatgactgttcccaagatagtagagaacctgtttacatgtgtcagctgctgttattaggaggaattgttgccatcaccattttatagggagacatcaggaaaggtcgccaatagtcgctggctcactttctcacctcctattcattctcttcactttgttttcgcttcagtccccactacttcactggaacccctcttgtcggggtcgctagtaacttccgtgttgtcaaaccctctggtccctaactgtcctcaacttactcagcttctcagtgacatctgtcacaatggatcatttcgcgtttcttggaatgctcctctgttggctagagtgccttgactttgctccaacctcattgcctactcttctctctcaccccccgcctctaactgttggtgccttcccaagttcagtcctcaaaccccttctctttcatggctcactgttttcataggtgttttcatctagtcctgtggcttggaagccaattcagccgctcataattcacacatttatatctcagtccagagttacattcaccgttacccagttccaatccactcttctcacagcagccagactgatctccgtaaagatgaattagatcatgtcactccccattttaaaaacccttcagtgactttcctgttgcagggagaataaagtcttaatgccttaccatgatcctgctgggaaaactggctagccatatgtagaaagccgaaactggatcccttccttacaccttatacaaaaattaattcaagatggattaaagacttaaatgttagacctaaaaccataaaaaccctagaagaaaacctaggcaataccattcaggacataggcatgggcaaggacttcatgactaaaacaccaaaaggaatggcaacaaaagccaaaattgacaaatgggatctaattaaactaaagagcttctgcacagcaaaagaaatgaccatcagagtgaacaggcaacctacagaatgggagaaaatttttgcaatctactcatctgacaaagggctaatacccagaatctacaatgaactctaacaaatttacaagaaaaaaacaagcaaccccatcaacaagtggccaaaggacatgaacagacactcctcaaaagaagacatttatgcagccaaaagacacatgaaaaaatgctcatcatcactggccatcagagaaatgcaaatcaaaaccacaatgagataccatcttacaccagttagaatggtgatcattaaaaagtcaggaaacaacaggtgctggagaggatgtggagaaataggaacacttttacactgttggtgggaccgtaaactagttcaaccattgtggaagtcagtgtggcgattcctcagggatctagaactagaaataccatttgacccagccatcccattactgggtatatacccaaaggaatataaatcatgctgctataaagacacatgcacacatatgtttattgtggcactattcacaatagcaaagacttggaaccaacccaaatgtccaacaatgatagactggattaagaaaatgtggcacatatataccatggaatactatgcagccataaaaagtgatgagttcatgtcctttttagggacatggatgaagctggaaaccatcattctcagcaaactatcacaaggacaaaaaaccaaacaccgcatgttctcactcatgggtgggaattgaacaatgagaacacatggacacaggaaagggaacatcagacaccggggcctgtcgtggggttgggggaggggggagggatagcattaggagatatacctaatgttaaatgacgagttactgggtgcagcacaccaacaaggcacatgtatacatatgtaacaaacctgcatgttgtgcacatgtaccctaaaacttaaagtataatttaaaaaaaaatgccttaccatgacccacagagcctaccctcgactggcttctgcctgcttctttaacttcatttcatctcacctcttttttattgactatactctggctgttctgaactcctttctgctcctccagcacaagcttaggccatttcacttgctgttcttagtacctggggtactctacccttaactctataaagccggctccttcttttcttcagatcttagtttaaatatcagagaggtcttcccctcgcactcctacctctgctaaaatcttgagctttacaagagttgaggcctaatcttgttcaccactgtattcccagccctggaatatgactcttagtatgtgtacagagtttgctgaattattgagtaaatgaaggaacaaacaaatgataaatgaacaaacaagcttcctgctctaatagaacttaacagcctacttaagcagacaggtgtgaattagattaccaacaaatgtgtgcataattacacattgagacttgatcacccttcactggaaagggacaaagtttggaggagaagagcatgaatccaattatggattagcagctttgagccatccaagcatagacatggggcagactatttggtatataagtctagagctcagaggataaccttttgtctacagttgaattatggaatcgtggtttatagatgttaattgaagctgtgagaataggtgagagcagatagaatatgtaatgagagaggatagggaaaagaaccagattgagaaggaaaagccagcaaagaaggctaagaaagaacggccagagaagtagaaggaacacaggaagtgtggccacaggagcctgtagaaaagagtgtttccagaagggggagccctcagcactgtcaaatgccactggcagaggtcgggtgaacccaattctccacctgctgcaccatctcccctctgcccattccatccttttctttgtcaaatgagccaggtgttcccacctttgagcttctgcactcctccctgctgctgaaacacttctgcccagctttttttacagcctccttcacatctcaactcagaggccaccttctgagcaaggccttccctggccattcccgcaaagtagcccttcccctctggtggttctctgtcacatctgcctgggtttttttctttttttctcacagcatctatcatgatccacagttaccttgtttgtttctgtgcttattatccagatcacccacaaactataagctccacaagagcttgtcctagttactgctgtgtccacagcacttaggtcccaggtactcagtatttattaaaagaaaaacagcaggccaggcgcactggctcacgcctgtaatcccaacactttgggaggctgaggcgggcagatcacgaggtcagaagtgtgagactagcctagccaacgtgataaaaccccatctctactaaaaataccaaaaaaaaaaaaaaaaaaaattagctgggtgtggttgcacgcctgtaatcccagctactcaggaggcagaggcaggagaattgcttgaacctgggaggcggagattgcagacagccgagatcgcaccactgtactccagtctgggcaacagagcaagattccatgtcaaaaaaaaaaagaaaaaagaaaaacagcagcttactgaggagtatgtgttatactaatgtatttagtttgaaaaaacatacagtatgtatttacatgggaaaagcaaggaagaatttacattgaaacattaatagtagtttatgtaatgagattccaggtttttcttattttgcttttttacattttttaatttttccagccatgatcattaattcaagtttttttaaaaatagatatctatttctatgcatataaatatatatatgtgtgtggctgggcgtggtggctcatgcctgtaatcgcagcactttgggaggccaaggcaggtggatcacctgaggttaagagttcgagaccagcctggccaacatggtgaaaccccgtttctaataaaaatacaaaaattagctgggcatggtggtgggcacctgtaatctcagctgcctgggaggctgaggcaggagaatcgcttgaacccaggaggcggaggttgcagtgagctgagatagcaccactgcactccagcctgggcgacaagagtgaaactccatctcaatttaaaaaaaaaaaaaaaatatatatatatatatatatatatatatatatatatatatatatatatatatatatatatatttggaagtgggccgatcacttgaggtcaggagttcaagaccagcctgtccaacatggtgaaatcccgtctcttccaaaaatacaaaaattagctgggtatggtggcgcacccctgtagtcccagctactttggaggctgaggcatgagaatcacttgaacccaggagatggaggttgcagagagccaagatggtgctgctgcactccagcctgagcaacagagcaagactctgtctccaaaaaaaaaaaaggaagtaggtagggtgtgcttacccaccaaaatagtgactggtaacacttggtctttttcccttcaggctaaactgctcttttcagatggagaaaaagtaatacccagattgacccatgagcttccaggaataaaggtcagagtcactgtgttctcgggtattggagcgggaggtccttcaggctgggaggcaagtgaaatatgtgggcccagggaggttccatgtacttccatttgtaggaccaggcccacacagcatcatgctggatgggcttctttggcctgggtcagagcggggctggagagctgtagtccagggctgtcttctgcaactccagaagacctgcagctcccaggcactggccttccactgactcccttcccttttcttttagcgtggccgtcaggcagaagaagaatgtgcccatcgaggaagcccccttcctaaaaaggtaaaccatttccttgttttgttttctggctgaaaaaaggcttgtcaggccgggtgtggtggctcacacctgtaatcccaacactttgggaggccaagcggggaggatcacttgagctcaggagttttgagaccagtctgggtaacatag

SEQ ID NO: 101165 - DNA, 2013 bp, Homo sapiens
ctcccaaagtgctgggattacaggtgtgagctcacgcacctggcccaaactctaatttacagacaaccaaatatggtagtggttaagagctcaggctttggtgaggacagacctggatttgaatcctgactcaccatttctagctgaataactgtgggcaagtcactcagcctttctcaacctctgattgtttcaaatttgtgaaataaggatggcaatacttattttttaagataatataagtgtgggatttaaaactgtgtttggcacccagtaagcatgcaagcaaagtagctgttattactgaggcacagaggtgttgagtaaatcatgaaagggaaaggtgaatggcagaggcacaactagaacccagatgtcctgactccaagatcagtgtttgttctaagcttctctgtgctgagtggagttcccagtctactcccaatgcaatggcctgctttcctcccagcagtcacctaccttaaagaggtgtgggtgcttgatgtagattcttcctctggtgccccccatccccagggctctgaaaagtaaaagccaagtggtcaagattccagaaagtgtagtcctactagtgaactcctgagctgtttcctcaatcagtgccaaagctcttaaacttacttgttggctcgagatcccaacacaaaggtggtagattcattcaggcgagctgggtcccactgtgcaaaaaatagagaagctcgtgagggtgaagtttaatctgatgggtaggacagaaacactcctccccctacccttttctaacccttccccttgtctattatttaatcaacagttgacccaagacactgagtactcacaatatgctaggccctgtctgtgctagatactggggataaagagatgaataagatacagtctctgttttctaggatgccaccaacatatgtacagataattacaccattgtgcgatgaggcaaggacacaagtgagtgcagggtctgagggctgccgaggggagggtccagccaggaaggcttccttagagaggcatttcccaagttaattctgaaagggtgagcacaagttggggtaaagggggtcaggaacaagggcattccagacagggggcagcatgagcaaagacaggtgagaggcagcttggcctgctggagaaactactagtaattctgtgctgctaacagagagagtacaaattagggagtggcagctgatggggctggagagagaaacacagaggagttggaggtcttaggaggttatgttcaggggactgcattttatttcttctgtaggcaatggggaatcgctgaaggcctctaaacagggagtgagagtcagatttcctttaaagatagcttagtcttctagcaatgtggataatggatttgaaggggcaagactacaggcagggagagcagtttagaggccgctgtgataaagcagttggaaagctgctaagggcctgagctagggcagcagtaaggatgaacagaaggaaataggaactgcaatatatttaagaggaagaattgtccaggactcgactgggtgtagggaggtaaggaagaggaggaggaggcaaagatgattaagataacgaatgtaaagaagggctgtgaggaaagattctaatttcatgtttggatatgctgagtctgaaatgcctatgaaacttccagcagagtggtcaagcagatagtaggataaacaagttttaaagtagaaagaggcatgggatggacaaagaggtatgggagttttagaacatggtggtccctgaaaccataagagtatatgttttagattatccagagagttactttagatggagaagtgggccaaggagagaattctggggaacaaccatttatataagtcactgctgaggaagaactcaggagagagagggaggcaacagaggctaatggttgagagcacagactctggtgtcagcgggtcttgggtttgagactcagctcgatcacttacgagttatgtgactttg

SEQ ID NO: 101166 - DNA, 1004 bp, Homo sapiens
gggtaggggcgctgccagactccttccctggtgggcctagatgaagacgctcaaggaccctcgtgacttggccgagacaggggaagggagaagttgagtcgggcaaggaagagatgctaaagcctggggaattaagaacatgccagaatcatcccgagggagtctggaattagggagggtgaggactcgctaggatcgtcctgtggatctggtgagtataccctgagctgagcctgaccttggtgatgtggggagcctccatgacggctccccctgagattcaggtgggagaagatgcaccgtctggaggcctggcccatccagactcccaggtaaccccgaatactcttttttcaggctacagcaggagctgatgaccctcatggtgagtgattaagtgcccagaaccccagccttccatccaattttcagtagcctccttttttccgtcagcttttttgctagacataggggtaatgtaatttgctccctcctgggaaagaagttcatacaccccacctacaccatttcttccagcagtccctcctcccaattccatccccccacacgaagttatctcgaacacttccctgaagtcatacaagaccctccctatccagtgtgtccctacttcctagccccaaccaagctttacccacacccaactccccgcccttcttggtatttctagcctatgaatttggttgctttattttggatcagagtgatgagattaaggggaggctgggcgcggtagctcacaccttataatcccaacactttggggggctaaggtgggcggatcacttgaggtcaggagttcgagaccagcctggccaacattgcaaaaccctgtctctactaaaaatacaaaaattatccaggcatggtggtgcatgcctgtaatttcagctactcgggaggctgaggcacaagaatcatttgaaccgtggagacagaggttgcggtgagccgagcgcaccactgcactctagcctgggcga

SEQ ID NO: 101167 - DNA, 1142 bp, Homo sapiens
gtgcagggagaatgccgggctgggaaaccagcccctcctccacctcctccgacctttgcatccctggtccagctgcctcttgcccaccttaattcatcctgggccaggcacagtggctcatgcctgtaatcctagcacttggggaggccgaggtgggtggatcacatgaggtcaggagtttgagaccagcctggccaacatggtgaaaccccgtctctactaaatacaaaaaaaattaaccgggtatggtggtaggcacctgtagtcccagctactcaggaggctgaggcaagagaatcacttgaatctaggaagcagaggttgcagtgagcagacatcatgctattgcactccagcttggtcaacagagtgagactccatctcaaaaataataaatagtaaagattaactcatcctgtctccatcactcactgagacctgcctgttctcttccagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttagacaagttgttgcgttgtaatttcactagggttggaggtactcagggtaggcagaggtggaacttaaggatgtggggccaagcaatggggtgacaaagatttattcccttgtaccttattttatgactctgcatctgtttcttcatctataaaatgagtgtcacaataatgcctcctgtctatggagtcggtgatgtgtaccagcaatgttagtgaatgttggagctccctcagctgtgttgcagatgaggctgagccagaccttaggctgaaacctactcctatagctgtagaaggaacaagcgtgtgtgttgggggggggatcccaacacacagccacccatgttctgtcctgaagaagaatgcttaggtcaccctaagcaggtccagggcctggggagacagccaggaaaaaagccccttccctggcaggactcaggtc

SEQ ID NO: 101168 - DNA, 1067 bp, Homo sapiens
gagctccttggaagcctcaccctgtcctcactgccagcctcaatccaaagcctctgacccagatggcctggcttggatatgacgtggaaacccctgcagaaatctcactttcatgtcaaggcctccatcacattcggccccccatgaggggccttttctccaatgactgaatcctaagaaggaagctgacagcctccgactctgccagttctctgaggggcgggatgatgtgtcttttatctcttctttgtggttccagtgcctgatctgtggcctgacatgcagcaagtactcaataactttgtgttgcattattatttatttgagaacaaacattttattgagcaactattaaagtaccgggcaccattaggagctgcagaaaactggaaaatagtgctggaatggtgctagccctttacaaagccctttcacacccctgatatctcatccctgaaaagctacagagaaaagatgaaggcacgctaattgacgtgcctaaggtcactggggggtggggggggttcccgacttggccttcaattgacaagtgagaaggccttgggcttaacttgttgtctcctctcttttgctcaaaactggggtcacaggctgcgcgcggtggctcacgcctgtaatcccatcactttgggaagctgaggcaggcagatcgcctaaggtagggggttcgagaccagcctgaccaacatggagaaacctcatctctactaaaaatacaaaattagccgggcgttgtggtgcatgcctgtaatcccagctactcgggaggctgagggagaagaatcgcttgaaccccggaggtgggggttgcggttgtggcgagctgagatcgtgccattacactgcagcctaggcaacaagagcaaaactccgtctcaaaacaaaacaaaacaaacaaacaaaaaaaactggggtcaggccgggcatggtggctcacgcctgtaatcccagcactttgggaagccgaggtgggcggatcacctgatgtgaggagttcaagaccagcctggccaacatggtaaaacctcgtctctactaaaaataca

SEQ ID NO: 101169 - DNA, 1037 bp, Homo sapiens
ctcgggaggctgaggcaggagaattgcttgaacccaagaggcggaggttgtggtgagccgagattgcaccattgtactccagcctgggcaacaagagcaaaactctgtctcaaaaaaaaaaaaaaaaaaaaaccaaaaacaaaaattagctgggcgtagtggtatgtgcctgtaatcctagctactcagaaggctgaggcatgagaatcacttgaacctaggaggcggagggtgcagtgagccgagattgtgccactgcattccagcctgggtgacagagtgagagtctgtctcaaaaacaaaaccccaaaaaaccaaaaaacaataaaaactaaattggaatcccatgggtctccctcaccctttggcaccctgcctgcctgggggaggccttatttagcttggcccagccctgctgagctttccttgggaatgtctatatataggggaagggggcagcccagttgccactgtccatctgcattccttggtgtccagcccccctttcctggccccagagcctgctatcggttgtcttggtgctctttctgtccacgtagccactgtctacaagccttgcctactccccagtgcccagcctgcaccttgtggattctcaggttgggctccctctggacttggtctgcccacccctttactccccagatgaccagatttcttcactgagctctaggaaggggccagctgtccttttaccacttaaagaaccttcccctgcctactccttacttcaaaaaaagtgaatccaaacaccctttccctggagaaggtaactttcagagaaggatctttgctttcaatgattatttctcctccaaatgcacatcctcctctcctccatccctccatacatttttccatctggacaggtgccccaaggactgtctgtcccaacttccctccagtcaggattaataataagaatcatcaacatgggtgggcatggtgcctcatgactgtaattctagcactttgggaaaccaaggtggaaggatcccctgagcctaggagttcga

SEQ ID NO: 101170 - DNA, 1042 bp, Homo sapiens
cacctcttggctgtgtgaccttgagagagtcttaacccccctctgagccaagttttcccttgtgtcaagtgggagaactcactctcatctcagaattgctgcaggcattaaatgtacagggcttgggatccgaatggaaatgatgtattaacgatattttgagggtggagctattaatttagcccctactgtctgccaggcacggtgtttggctcctcggtgcctctctgtccctcagtttccatttctgtaaaaagggggtaagtcctgcctcacactgggaggatgagtgaggccacgtcagtggttgatgtcgaccctggccctaggcccattgatatgactggtcatgtgtctgcagaacggagccccccacctgatgggcagtggggcagtcagctcctggcgcggcagctgcaggatttctggaagaagtcccggaacaccttggcaccccagcggctgctcttcgaagtgaccagcgctaacgttgtcaaggacccgccctccaagtacgtggtgagtgagggtctagaacccctgggctgtgagtccagaagtatggctaggagcaagtagggaagaccccaacttcctgaggggtctatgtagttataaatggttaccttgtttacaaatggggaaactgaggtcagaaaggggatgtaacttgagcaaatcctcacacaagacttagtttccttgagactgactgaagtggggattaaggaccttcctcttaacctggttttgagactaagagaactggtgtgtgcacttccccacccagcccacaaggtttttgcaaattgtagcaagatgtgagatacagagagacagatgttatctgggtcaaacttgagatccaagttgcatgggctggtagttaaggaaataggctttcgatccagaccaatcttgactcccacttatttccagttgtttgactctgggtgagttgtttaaccttggtcatcttccgtttcctcattatagcaatggggaaaatgcagaagattacagcaggagttaaatgagacaa

SEQ ID NO: 101171 - DNA, 1015 bp, Homo sapiens
ctgtcaactggggttcctgtgggaggagttacccctcaatgacggtccataataagctcatgaaggggcatttggagcagccacgacactcagtgcacccttgtgtggggcagccctgccctgggccagaccctttgcaagaagtccacttggaggttgggcatggtgatgtgcgcctgtaatcccagctgctcaggaggctgaggcgggaggatcccttgaacccaggcgcttgagaccagcctggcaacttagtgagactctgtttcaggaaaaaaaaaaaaagtgtatttggctgttctgaagcaggccatcatcacccttcacctcacccacaggtggctctcgggggctggtccatgggcggctgtggcgtcaggatggagtcctagctgtgacctgtgcccaggagggcgtgatccgagtgaagccccaggtctcagagagcaagctgtagccagaggtaccagcttcgcctggggcttcaagaacctcccatctatccccattcctgagacaggagttacagtcccttttggccctcacatccaataaagagactgataccactggagtggctggcttttaattcccctgggccagacctgcagccttgccttcatcccttaactccaggactccaggggcagagtccctggccttcagccaagaggccttgccagcttgggggcccaccaacaagggaacattgccccaacctgtgccacagccccccggctgtttataggctggagaggctgtgtcagacttccctgtactacacaagggcaaccccagccaaagctcaccctgagcctagctcaacagaagtttccttgatctgcttcacattctcttttggaacttctaggggctcccagcaccctctgcagcctcccagctattctgttctcatcaggtccttcccctgccttctggggcaacccctctcctcacagtggccttaaatctaggcaagggttagtccagcacctccttgatgagcaattctttg

SEQ ID NO: 101172 - DNA, 1814 bp, Homo sapiens
cgaccttgtctctaaaaaaatagaaaataatcatactgtggacccagattgcctgagtccaaatcctgtctctccaatttttaagcaagctacctggactctgtgcttatttcactgatgaaatgggggtgataatagtacctatctcacagggttgttgtgaggaatactattgtatgtacaatgcttagaacagtgcatattacagggtatgccttattactatgatgtgttggttagatattcatgatcttgtcttcacagtgttggttatgaggtaggttactatcattatccacattttgcagatgggaaaatagactcagattactaattagcacgagaccacatggctcgtaagtggccaagaagggattcaaacgctgcactatcctgcctgccacaggggaggggagctttggggatatcaggggtccctgtggaagaatgaggggagtcagaagaggcaatgcagatgtgactccctctcttcctgggtctcaccccgaccctcttccctttactttcagggaccctaacctccaaaagaggtacccattggcgctcaaccgaattgctgctcaggaggtccccattgagatcaagccagtaaacccatcccccctgagccagctgcagagaatggagcccaaacagatgttctgggtgcgagcccggggctatattggtaagagtaccccatggatgggaggaaaccactctccaaggggtctaccactcatttgctgtgtggccttgggcacatgagttcccttctctgggcctgtttccttatctgcatgatggggaagttggcttagcttctcacctgggccctctcagccctttgcatggggagaaggtggagatgactataatcccgacacaaggcctttctgaggaaggcaaaaggcacctcgctggggttgttgtccagctttgctgctaactataaagtatctttgtgcaaattggaagaagacaccccttttggggcctagagtgggagacttgggtggtgaagactgaatttcagtccctgctcacccctgccctccccaagtcgccatctcacttctcccctatcacacacacacactgtaggccaagcgctcttgtgcagcaaccagtctgcacacccatgcacgggagtcccttttccccctacctccgtgcaggtcctgagctggaaagcccaggagcccagggctgatggggacctgttgcaggcgagggcgacatgaagatgcactgctgcgtggccgcctatatctccgactatgccttcttgggcactgcactgctgcctcaccagtggcagcacaaggtgcacttcatggtctcactggaccattccatgtggttccacgcccccttccgagctgaccactggatgctctatgaatgcgagagcccctgggccggtgagtgtggggccgtgtgggacaagggcactgaccttgagtggcaggagcctgctttcttgggtgatgctgatttcccgacttcctgtgtggcgctgcacaggtcacttcctttccttccctcccaggctttggcatcttcatcttcaaaatgagagggtgaggccgggacacctgctctgctctaaatttctagaatgtgctggaaatgtgattcaccttctcccagggacccagttctagtcccaaaaccagttcagattctttgtattacaataggcaaatcatatcttccatctgaacctcagtttcctcatctaaacaaagagggttacattacagcagtggtatccaaacccgcagtccatcagactgccatttggggatgcc

SEQ ID NO: 101173 - DNA, 1766 bp, Homo sapiens
caggtgctccagcccgacatgctgccggctcagtggacggcaggctgtgctaccagtctagacagcatcctgggcagcaagtggagtgagaccctggataagcacctggcagtgactcacctcaccgaggaggtgggtcagctgttgcagcactgcaccaaggaggagtttgagcggaggtatagcaccctgcgggaactggccgacagctggattgggccttatgagcaggtccaactctgattattctcgatgcccagagatgctcatgcacctgtgcacactcacatccacccatacacacacacacacacacacacacacacacacacacactcccttacactgttgtacttccgtgggccctccttccagaacaaggacaacaaggacaaggttgaagggtcttctcatctaccatggcctgctacctagcatgtgtctagctcaatgagacaggagtcagcaaatcttaatctgtttagtttactcaggtggccacatacagtctctgttgtatattcttggttttgttttaatattttttttctttttttttttttttttttttttgagaaggagtctgtctccgtcacccaggctggagtgcagtggcgcaatctctgctcactgcaagctccacctcctgggttcacaccattctcctgcctcagcctcccgagtatctgggactacaggcgcccgccacaatgccgggctaattttttgtatttttagtagagacggggtttcaccgtgttagccaggatggtctcgatctcctgacttcgtgatctgcccgcctcggcctcccaaagtgctgggattacaggcgtgagccatcgcacccggcctgttttaacattttcataaggtaaaaacctttcttagctcaaaggtctttaaaaaagcaggcaatccagctgggcatggtggctcacgcctgtaatcccagcattttgggaggctgaggtggacagatgacttgaggtcaggagttcaagaccagcctggccaacatagtgaaaccctgtctctactaaaaatacacaaattagccaggtgtggtggcgggggccctgtaatcccagctactcgggaggctgaggcaggagaatcgcttgaacctgggaggcagaggttgcagtaggccaagatcctgctgccactgcactccagcctgggagggtgagactccatctaaaaaaaataaaataaatggcaacccctggtctaagataagagataaaacatcaggtggtgaggttgaggtttggggcttggtagcagttgccccagtcatgagatgactcacttaacccgtctcctttaagtgagctgggctgggaggcttcctacaggggaagaggcccctctggggagctgactcagccaggctccctgaacttttttccttgtcccatcctggggtcaataaaactgaatgttgcatattctagcacttgtctagttttttttttgttccatagaaggcagtttagggtatatcatggagagaatagactttagagtgttatacaacatgtgaatcctggttggttccttccctgcttgatttttgtgcctggttctgccttttactagctatgagacttattaggataagttacccctctaaacctcaacctgattatctgtaaaaatggggatctccacagggtatgttcacagagcaggcatacctagtgggtgctcaattaagtattaattttccttccttgcctatggtcctatgacctgccttc

SEQ ID NO: 101174 - DNA, 1788 bp, Homo sapiens
gatctgcgaggcccgcggaccttgacccggcattgaccgccaccgccccccaggtccgtagggaccaaagaaggggcgggaggaagactgtcacgtggcgccggagttcacgtgactcgtacacatgacttccagtccccgggcgcctcctggagagcaaggacgcgggggagcagaggtgagctggcaccggaggctggaggggatccccgagcccgggatcggtgcgcggcagaggaggctcgcgggtgggagctggcgctggggccggggcttccctcgcggaggcgccgccagcaactccccgggggctgctgcacggaagcgctgaggagcgagtcaacagcccctctgctgcctcccgtagatgatccgagccgcgccgccgccgctgttcctgctgctgctgctgctgctgctgctagtgtcctgggcgtcccgaggcgaggcagcccccgaccaggacgagatccagcgcctccccgggctggccaagcagccgtctttccgccagtactccggctacctcaaaggctccggctccaagcacctccactactggtctgccgccctgccttctgggcgggattgggagaagagatgacggatgagggatggggggtagttctgcagacccctgaggatgcctgggagccgggagggctggaaagggcccctccaactgcgccaaccctgccctgacccccctcccaggtttgtggagtcccagaaggatcccgagaacagccctgtggtgctttggctcaatgggggtcccggctgcagctcactagatgggctcctcacagagcatggccccttcctggtgagtggacagcagggggaaagcacagttcccaaagtaaaaggctggggaaagcgagagaggggctttgtgattttccaaaaagtttccttccttctaagcctcgggattttcctctatgccattggctttgctgcctgtacctctcagaggttttacccacatgtaaagtgcctctcatggtggccctttccctccacccagctggcccttgggacttactcagccatctctttcctcctcaggtccagccagatggtgtcaccctggagtacaacccctattcttggaatctggtatagctggagctgtgggtgtgtctgggcacttggatggggtggcatttagctaatttttccctcccctctagattgccaatgtgttatacctggagtccccagctggggtgggcttctcctactccgatgacaagttttatgcaactaatgacactgaggtgagtctggtgcctgcccatctgccccaggctccccggtcctccatccatggcatgatgctgggagagagagcatggccttggagtctacttttcgctctgtcatatgctattgtggtatggtggccagtcacttcctcttgcacaaatagggtgggttaatgtcattatctctgaagttctttccagttcaaataccaaagcttcctgattccctctgtcttgctctgccatccccaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggtgcagggtagctgcaggagggaagggaggtagcttgaggctgtggccttacagttagcaaggtcagactgactggtcaatgtccccatccaacccagcttcctgcata

SEQ ID NO: 101175 - DNA, 1031 bp, Homo sapiens
ttctccgtccctcattgctttcttgcacctttaagcaatttagtgttctctgggacatgtgtctaagtgtgtattcccaccaccacctcctatggtggcaaatcccataacctccgtgaggagaaaggacttcttcacatttatcaaacacctgcaacgtggcaggcactgtgctgaactgtgtctatgtagattatttaagcttcaagattccccctcaaatgagatcatactacccacattttccagataaggaaactgagggctatgaattttgaaatcactgtctgaagtcacagtgttgggaggcagtgatgctaggatttggacccaggtctgggaagattcctgccactgagcctcagtttccctacctgtgaaaaaaagtgggtgaagaggtgaaatccaagagcagtaaatcttgggacaacttggtggggtcgtggagaggctggggatctgtaaagcatggtggcttggtgtatcattgcagcttcaggaagtggcccgcatcgtgggcaactctggcctcaacatctacaatctctatgccccgtgtgctggaggggtgcccagccattttaggtaggtgctgctgggtgcccctggagccaaccccagccccatctggaggctccacacccattcccccacctcacattgcaggtatgagaaggacactgttgtggtccaggatttgggcaacatcttcactcgcctgccactcaagcggatgtggcatcaggtgtgcgagggcgtgggcttcctcctggtgaggtgggggcagggggaggggcagggaagcagaggccctgacccactgtctgtgccttccaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaagtgaggttccgtggccacctgtgacttggggtggtgggttgctggggcttgtgg

SEQ ID NO: 101176 - DNA, 1434 bp, Homo sapiens
gcctgggagtggccagctggctgcctggctctggcccacagagggcaagtgtggaggaattcccagccctaaggtcttgctggtagctgtgagcaaggatgcagctgctgtaggctgatgtctttcctggtggggcagatggaggtgcagcgccggccctggttagtgaagtacggggacagcggggagcagattgccggcttcgtgaaggagttctcccacatcgcctttctcacgatcaaggtagggactgggcctgctgagagataactgggccggaggcaaaggagcaggacccacccgtcctttccctctggctgccttttaggctgggtcatgggtcaccatctggcccctgtatgggcaagtttttttggagaggggtggggagggttctgggaagaataaagggtttgggatgaaggaattgcccccgagtgagcagttatatggggaggagggaatggtggggtcaggagctcacgaacattgctcctcagggcgccggccacatggttcccaccgacaagcccctcgctgccttcaccatgttctcccgcttcctgaacaagcagccatactgatgaccacagcaaccagctccacggcctgatgcagcccctcccagcctctcccgctaggagagtcctcttctaagcaaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagattgattatggaattaaattgggtacagcttcaaatcccgtcttctctgtggcactgggggttagagggggcactacaggctatgaatgtgggaaaagaggggctgagaggggttggggtcctgaatgacagctgccagcttggggattgagggctcagacagctgctgtggacggtgtgggggcagtggacgccctgacatcagcaggccggttcttctcaatcacctctcgcagccctttggcaaagtggagatcagccccgatggtgaggaatccctgtgttggggagaggggagcctcatttattcattcagttattgaggccagagtttagagatcaagagacagagtgtttgtctttcaggaactcaatctaatggataattccatgtcaaggtgttaaaatgaggctgtaggagtgtagactatgggtgtcaaggagggcttcttggaggaggtgacctctgagctaagacctgaacaattagtaggtattgggatgggagaagagtg

SEQ ID NO: 101177 - DNA, 1181 bp, Homo sapiens
tttattttatgtaacaaaacttcacattgcttagttcctgtcagacactaagcatatttattttctttttttatttttatttatttttgagacagcgtctcactgtgttgcccaggctggagggcagtggtgtaattttactcactgtggctttgacctccagggctcaagtcagcctcccacctcaggcttccaagtagctgggaccacaggcgtgcatcactatgaccaactaacttttaaatttttttgtagagacaggatctcactttgtagctcaggctggtatcgaactcctggcctcaagcgatctacccgccttggtctcccaaagtgttgagattacaggtgtgagccactgcacccagccaacgtgtttaaaaagttaatattagtaaactgttttaaaatacagtaccaactggtttagtcctcaaaacaagcccaaggagtgggcactattaggatttgcactaatttatagatgaggaaaatgaggccctgcaaggttaagtaatttgcctgaagtcacacagctggaaagtgtcagaagctgcctctagaacctagggtcctaacctacattatctcctttaaccttagaacagcactgtccagtcagattttctgtgaaacgttttgtatctgcaccgtctactatggtagtcactagccacatgtggctaatgaaatgtggcttagtgcaactgaaaaactatttaattataattaatttaaatgtaaatagtcacatgtggctagtatctaccatattggatagcacagccctagaaggcagatgctacttttgcctgtattaaacacatggagaaaatgaggcctagaaagacaaaatgggctgggtgcggtggctcacgcctgtaatcctagcactttgggaggctaaggtgggacgatcacttgagcccgagaattggagaccagcctggacaacaaagtgagaccccatctctacaaaaaataaaatagtcaggcatggtagtgcatgcatgcagtcccagttactcgggaggctgaggctggacgatcacttgagcccaggaggtcaaggctgcagtgagctatgattgcaccactgcactccagcttgggcaacagagtgagactctgtctcaaaaataaataaatacaataaaataaggccaagcacagtggctcat

SEQ ID NO: 101178 - DNA, 1043 bp, Homo sapiens
atttttagtagagacagggtttcaccatattggtcaggctggtctcaaactcctgacctcaggtgattcacctgccccggcctcccaaagtgctgggattataggtatgagccactgtgcttggccttattttattgtatttatttatttttgagacagagtctcactctgttgcccaagctggagtgcagtggtgcaatcatagctcactgcagccttgacctcctgggctcaagtgatcgtccagcctcagcctcccgagtaactgggactgcatgcatgcactaccatgcctgactattttattttttgtagagatggggtctcactttgttgtccaggctggtctccaattctcgggctcaagtgatcgtcccaccttagcctcccaaagtgctaggattacaggcgtgagccaccgcacccagcccattttgtctttctaggcctcattttctccatgtgtttaatacaggcaaaagtagcatctgccttctagggctgtgctatccaatatggtagatactagccacatgtgactatttacatttaaattaattataattaaatagtttttcagttgcactaagccacatttcattagccacatgtggctagtgactaccatagtagacggtgcagatacaaaacgtttcacagaaaatctgactggacagtgctgttctaaggttaaaggagataatgtaggttaggaccctaggttctagaggcagcttctgacactttccagctgtgtgacttcaggcaaattacttaaccttgcagggcctcattttcctcatctataaattagtgcaaatcctaatagtgcccactccttgggcttgttttgaggactaaaccagttggtactgtattttaaaacagtttactaatattaactttttaaacacgttggctgggtgcagtggctcacacctgtaatctcaacactttgggagaccaaggcgggtagatcgcttgaggccaggagttcgataccagcctgagctacaaagtgagatcctgtctctacaaaaaaa

SEQ ID NO: 101179 - DNA, 1091 bp, Homo sapiens
ctgggcaacaagagcgaaactccttctcaaaaaaaaaaaaaaaagaataataacatttttaaaaaagataaaatggcctcaaggtcacaaagctgtgttgtgctgaggtttttgtcaaaacccatgttctgatctttgctgtgtgactgtgggcatgttatttaacattgctggacccatttgttcatctctcataatacctgccctgcctgcctctgggacatgtgagaatgcagaggagtcagactttaccaaagcactttggcatgcattaacaaagacagaccccagctctcagtggcttacaggtatcactgtactttaagcgcaacatccctgtggacaggtgtgattgtcctccaatcactgaggtgcagggaagtgcgcctgcctacctgcgcaggtccagctgcgtgcgcagggccttcccccggagagccatcttggcgctgagacgggcgtcctgcaggaacatggggaggaggatgttactgacccagaaggtcagtaacccacagcccatttttccctgacccccagccagcagcccccactctgggacccgtaccatagtcatgctggacagctggacctcaggctggtctggtgggaccagggcaatggtgacgctagcagtgacagagatggtggtgccagagggcttgatggtgcagcgcggtggggccaggacccgcagctccagcttcaatggggagtcaatcactgctgggctctgggggatgagcagcaggggcgggtcaagtccctgccatttcctttggagcccccagggaagaaggggaaggaaggcaggtgcagcttctgtcctctggggactctcatattgcaaatacagagggagctctggcttccaaaactctcacatctgcatctagccttcatgcctttgccacacaaagaaacaggaatgtgttcttctctttctgcttcctaaatacatctcaatattcaggtctatctccaatccagactctttgtggatgtcctttttgcattagtatctcagcccttgccatgtcttctgtttttgatatggagtctcactttgttgcccaggctggagtgcagtg

SEQ ID NO: 101180 - DNA, 1050 bp, Homo sapiens
tcaagcgattctcctgcctcagcctcctgagtagctgggattacaggcgcccaccaccatgcccaactaatttttgtatttttagtagagacggggtttcaccgtggtggaccaggctggtctcgaacacctgacctcaggtgatccgcccgccttgacctccctaagtgctgggattacaggtgtgagccaccatgcgcggcccccccatgccatcttgtttagttatttttttgaaacctctatagtggtagtaataataataactaacattaatgagcacctaactacacaccaggccctaagtgctttccacataaaactaatttgaccctcatgacaaccctgtgaaggatgtatcctcattttatgggtgggcctctgagcctggagaggttaagcaccttatcccacatcacacagccgtgagtgacttgagccccttcctgcagtgcgcagttctgtggacgagcttgttggcattgactattccctcatgaaggatcctgtggcttccaccagcaacctggacatggacttccgggtgagctgcttgggctggtgtatgacctctgacttcctaacaagacctctttctctgctaagttgcaagattttacttcttaaagcacagctctgatgaggccactcccattactgagaatgctatggctccctgttactacagaattaggttcagcctcctgggtctggcatttgagcccctgttaatcttacctggccccaccttttatatctcatcctgtttctttgcagctgctctttcccaaattggaccctggcttcccacctcagggcctttgctcatgcacggcctttccccaactcccccgaaggagctggacataaatttctatacaaataatctcatttcattctctcacaaccctgtgagtcaggtactaacatcatcctaattttaggaatgtggagacttactcatagaggtgacgtcacttgcccaaggccacatagccagtgtgtagccactacctttggtctcccagaggagtatagcagtttcagagt

SEQ ID NO: 101181 - DNA, 1523 bp, Homo sapiens
cgatcttggctcactgcaacctccgcatcccgagttcaagcgattttcctgcctcagcctcccgagtagctaggactacaggcgcgtgccaccacggtctgctaagttttgtatttttggtagagacgggtttcactatgttggccagactggtctcgaactcctgacctcaagtgatccgccctcctcggcctcctaaagtgctgggattacaggcatgagccaccaccgcacctggcaaacaaacaaacaagacttttaagcgatggggtgaagctcatttttaacacctggatcaggaagacctcctctctcagccacccaagttcaactttgagccacccaagtctaagttgggcacttgagggacaatggaagaattcattccacccactcccgcttccccaggcctggacttgaaaggggagcagacaaatttcctgtcgttgggggaagttccctcttcttggccctggatctgaccctgaggcctcctgtagggtgaaggtcacagagctgcaactgacatcttccgagctcgatttccagccacagcaggagctgatgcttcaaatcaccaatgcctccttggggctgcgcttccggagacagctgctctactggttcttgtaaggacccagcaccctcaggggagtggagagtgggtcaggagggctggaggtgctgtggggctgtgggcagcccccttagccttcctgagtttccgtttcttcatctgtgtaacagaaacaggcatatgcatttcatacgagttgataggaaggtttggtaggatgtgtggaaagaggtgaaaccttattaagaggtatggtgatgcatgggggcactgaagactcaattgagctcctacctggagtgaatattaacccccctggcagctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagtaagccccagccccaaccccagctcacccttttcgagccccacagctcatctgcctagcgcaatgcaaagtgcataggcctgggaatcagaccaactgggtccaaagctcagctctgtcacttcctggctgtgtgaacgtggccaagtcactgaagcttggtgcctcaatatcctcattttataagatcctattttataagatcgttgtcaggattatttgtgttggtatatgtaaaaaatatttagaacaaggctggctgtggtggctcatgcctgaaatcccagcaatttgggaggtctgggcgggcggatcacaaggttaacagatcgagatcatcctggccaacatggtgaaaccccatctctactaaaaatacaaaaattagctgggcgtggtggcacgtgcctgtagtcccagctacgtgggaggctgaggcaggagaatcgcttgaacccgggaggcgga

SEQ ID NO: 101182 - DNA, 1221 bp, Homo sapiens
cgcgaggcctatgagaccgcaagccaccctccaagaatgcgcgtgcagtcgttgccgtggcaacgtgcaagcctgcatgggcccaccgctaaaggaaaggggaggttgttgggggtgtgggggctggtcccctggaggtccaaactcatcacgcggcggtagcacgagggaactgggaacgtcccctcccccgtgtcccaaatcctctgggagccagaacgcaagtcgcatcgcctctctgagcctcagtttccacatctgccatatggaggcaagattattggttccaagttccccgaagagttatctggagggtaacgatccaggctagttcccacttatggttggacgtccaaggaatgggtttaagcggctcagataactcctgcgaccccaccccacccccaggcccgctcgccatggccctcttcggggccctcttcctagcgctgctggcaggcgcacatgcagagttcccaggctgcaagatccgcgtcacctccaaggcgctggagctgggtaaggcgcaggggcagacagggacggacgggagcggacggggttggggtcgccccaacagtgggcacgggagctaagtaagggtttctctgctgcttcagtgaagcaggaggggctgcgctttctggagcaagagctggagactatcaccattccggacctgcggggcaaagaaggccacttctactacaacatctctgagtaagtggggggcggggcctcgcgatccggggcggggcctcggcggtggaggcggggcccgagaaatctcagggtctcgggagactggaggctgagtgggatggggcgtggccaaatcgatgaggcaagacttaagaaaccggatggggccgaaaagataaaggccaagccagtcatcataggcgggaccaggcagatgggcgtggccttgaaaatgtagagggggccaagaaggaagcaggaccagtggatgtgaggcgtggtcgaagaacaacagaaaggtggagtcaaggaacttcccaatagatgagagtggagtctcgggcacggggtggagttaatcggaggggtggagaaactgaaggctctaagtatggtttaggatgagggagggggaataaggaattgagatgtgagacggagcttaggtgatggaggcaaagtgaacggactctattaaaagaccgggtgtagcaaccccagggtgtgggaggggagggg

SEQ ID NO: 101183 - DNA, 1050 bp, Homo sapiens
cgcgcgcgcgcgcgcgcaccttcccctccccctaccccagcgagggtgggctgtttggcgcgcgcgcgcgcgccggcccatctctcgggctccgccccccgccccgccgcgcgctcccgcccccgggctgaggcgactcagagtcggagcccgacacaaaggcggtggcggcggcagcagcggaggggccctagagcccgctccgctggggctctccgggcccacctccctcacttcggccaccggcgcggccgcccacccgcgggtctaagatggcggcggcaacagagacagggcaagcggcagtcccgagcagaaagcgccggaggggccgccgccccccagcttcggatccccagaccctggcgcggctcgctgcgggaccatggcttcctgggactcttacctgcccggagcggactggaggggacgcggctacacgttctgctcgaccgcccgttttgccgcctccgcctcgccctccccagcgccgctgccgccatcttgtgtcccgggccgggactccgcgctgcgcatgcgctggtaccgcctctgagggacctcgccgcggccgcgccgccatcttgagtgtggcagggtcggctggctcctcgcacccagcttgctttcggccccctccccttcttcccatccgtccctgctgttccttgtggcgctgaggaaggggagacagctttgtaggcctgcgggtggactgaggaaggaatgaattcactggcacgtccccgcctcagtttccccctcgagcacacacgcaggagccggatgttcgcggtgggcggtgcgcggcggggttggactgagcgtgcgcactggggggcgtgggggctgtcttagaacctgcgggggtctcgggttctgccgccggcccaggggaggcatcgtggtgacgtaggctccggacgtagcaaggacctgggtcctggcacccgcgcggctctgcctcttccagccagtctctttccctctctgggcctttgtgctgcgtggtgtccaaatgttaagaagccctgccccatgcccgggcta

SEQ ID NO: 101184 - DNA, 2014 bp, Homo sapiens
gggcaaaagtttgatttcttttgggtggtgtgacctactgaaaacaactttagcatcaccagttctatctcagttagctcccagttgtctgacagccccaggccagaagcactttggctcctgaggctgttgctgggtgtgctttgggtgggggagtagggaatacagatctgaaggaactggcctccttgctggtacttacagtaaatattcacctggggattatgaaggagtcaattagatagtccttcttggttgcattggttattttagcaatagctgcttcctgccatgtagtgtaaaataaggtgaccaattagattccatgcccttccctagtgtgctttgttccttttagattttactggatgagagcagtaaaatcccatctccttctgggagttgttactattccttcttgtaggaatcgcttctcaagggcagaccctgttctgtcttttttgctgctcttggtgctttgtaaatatttgcagaatcagtagtgctcctgttgggtccaggtcctaggcctgagcacaggagagagctgaattggacgcagttcctatttctggaagttctgacagtttagtggggagacaaacccagctgatagatgagaccatctgagtgctacgacagaggtgttcacggccctgaggaggagctctgaccacctggcctggggaggggagagtcaaggaaggcttcctggaggatgtgaacccagtagcaagccaggcagagaagagggggaggggcatttcaggcagaggaagcagcaggagtgcacccattgaacagctggaattgcagcttagatcccagggctgctgtgtggcaccatgctggccctccaggataggacctgattggatttctccacatcggtgggtggtcactggggccctgggtggattgtaattggcgggtgagggggtggagctgacactctttggtcctctgtgtggcaggtcctgtgtgggtgtggagatggccaatgagaatcacggcagcccccgggaggaagcgtccctgctgagtcactccccaggtacctccaatcagagccagccctgttctccaaagccaatccgcctggttcaggacctcccaggtactgagggggagcagtagtggggtggtggggtaggaagggcaccctgggagcagtcctgaccctggctgggctccgtgcctgtttgcagaggagctggtgcatgcaggctgggagaagtgctggagccggagggagaatcgtccctactacttcaaccgattcaccaaccagtccctgtgggagatgcccgtgctggggcagcacgatgtgattgtgagtgccagcctagggtgggggggtctcagagtggcctctggcacctgggccttccccaaatgtaccctgagcagccgttcagtgcccagccctgtgctggcacctgcagatacaatgacaagcaagacagacacagcccctgccctcatggaacctacactcaaatggggtagactgacaagtaaacagatgattgcatggctgctgcacggtgggtgctgtgccgcgaggcaggaatgaacaaggcagacttgctccctacggtcgcagagcacccatgggctgccaggtgacagcaggattacacttgtggtccgtgtatgaggaatagtgttagaatacatctagatcctgacatactctggggaaggcaaggagatgggaaaagctctgagaatgagtgtttaaggtgagagagtgagtgagtgtggggaggaaaagaacattctaggatctgacatgtcagtacgacgggaagtacaggcatgggctgtctggtgggaacatgggcttttgggtccttctcagctggggcagcatttctttactgggcacagttgagacagttggcatcttcattttgcatgtgaagacactgaggttcaaagatggggaacgactggcacgagacctcacagtaataggcagagcaggacgcacacctgatgtgagttcagg

SEQ ID NO: 101185 - DNA, 1065 bp, Homo sapiens
ccccccaagaatgtgtgagggtcttgagggcagagaaggctgaggcagctggagctacttctgggaccacactcccctccctccctccagcagctccttctcatggcccctgggccttcactctcccatctggggtcccacacagctgggtccctggtggcctctgcctgggctcaggaggtccgaagagtccaaggccctgcatcccctatctccaaactcccccagcagggcctgtatggatacccctggggatcagaggactgggagctgtgcctgtccccaacccaaaagccagactcttgctggccctggatccccacagtgagcgaagagctgggtgtgcctcacagtcaaggctcaggagagcagcttcagaggatctgtaggcacagagcgtgtgctccctagggcccagggaggaagcaggtctgaaggtgcttgctggggctctcgctggttcagccgtctctgaaccagccacctctctcattgccaggcctctgcagcaagggtctgccctgctggtggatcaccggacttaacaggggcagggcaggacagggcacgctgtggagccaggcagcctccacctcacaagacctggcctggtacaggctacagcagcaagcagacaaagtaagctgttcaggactggactccggtccctttattgagactgacaggccagtgggtccacccaaacaaaaataaatttctctcccaaagcctgcctgcaggctggggcacccagcatgtcctggctggggcccatggctgcccctaaccccaacagcacaggtctggctccctgggaatgagaggatgctggctatccagtatctggagatcctaaatgaagagggaggtgagtcctggtggccccctacccccaggagagctggccgcaaatccatgatctgtgttgggccctcggggctcagtcatcggccagggtgatgacgtcgtactcgatgccctggtgctgcagctgttgaatgtgttcgggcactgtctcgtctgtaccaaacaggccctgggcttgggccatggcagcatcagcca

SEQ ID NO: 101186 - DNA, 1236 bp, Homo sapiens
gggatgaagttgttgcacctcagttcatcagatattagttagattcttagaaggagtgtgtgacctagattactcgtatgcacagttcacaatggggctgtgctcctgagactaatgcagctgctgtgacaggaagtggagctcaggcagtagtgcttgcccacctgccgctcacctgctgtgtggcctggttcctaacaggccatggatgactaccagtctatggcccaggggttgggcacccctgttctagacgttcgagtctccctagccatgcctctgtcacacacttctgtgcctttgctcctagaggcccagcttggccatcccttctgtggcattttccccagcacacacaagttcaaatgacctgctctgtgtcctgcacccttggttcacactcgggacactgtgtctggcattagtcacgttgtgtgtggtttgcctccccaccagaccaactccctgagagctgggaccttgcggagtcatctctgacccatctcatccactcagaggagagcagaggatctggcttgaaagggcactcattaaaggtttgttatacaaacgagtagcccaatgaatgacagcagagacacaggagcaaccagcacctacccggacctcgggccactggcgggcactgaaggggcagtcggggcacttgaaggcaccaggcccagcgtgggcccgcttgtgactctccatctcagctcggccagggaaggcctcggcacagatcttgcaggaaaacttctttgatgcagcagtggctgcagatggcggtgacgggggcactgccaggcccagggctttgctggttgcaggaggtgaggaggcagagctctgggagtcccctacgcagtgggtcttggctggagatgggggctcagggccgtctctgggcagtcccccacactgcagcaggggccatttggcaccagaggccagagcatctggacttgggaaggagatggagccatctgcggtgagctgtagagagacagggagcatgaggtactgagaaggggagggaggtgggggagtggttggcatccccaagcctcacctcaatgtggtgcaactgggtaccatcagtagccatgatgtagtgggtgccagcttcttttagggtgtcactcacaaccacagcctgggctgcctctcctgcgggctcctcgctgtgggcatggagaaggttctaggagaagatggagggccacaggagccccc

SEQ ID NO: 101187 - DNA, 1026 bp, Homo sapiens
ttgcaccacattgaggtgaggcttggggatgccaaccactcccccacctccctccccttctcagtacctcatgctccctgtctctctacagctcaccgcagatggctccatctccttcccaagtccagatgctctggcctctggtgccaaatggcccctgctgcagtgtgggggactgcccagagacggccctgagcccccatctccagccaagacccactgcgtaggggactcccagagctctgcctcctcacctcctgcaaccagcaaagccctgggcctggcagtgcccccgtcaccgccatctgcagccactgctgcatcaaagaagttttcctgcaagatctgtgccgaggccttccctggccgagctgagatggagagtcacaagcgggcccacgctgggcctggtgccttcaagtgccccgactgccccttcagtgcccgccagtggcccgaggtccgggtaggtgctggttgctcctgtgtctctgctgtcattcattgggctactcgtttgtataacaaacctttaatgagtgccctttcaagccagatcctctgctctcctctgagtggatgagatgggtcagagatgactccgcaaggtcccagctctcagggagttggtctggtggggaggcaaaccacacacaacgtgactaatgccagacacagtgtcccgagtgtgaaccaagggtgcaggacacagagcaggtcatttgaacttgtgtgtgctggggaaaatgccacagaagggatggccaagctgggcctctaggagcaaaggcacagaagtgtgtgacagaggcatggctagggagactcgaacgtctagaacaggggtgcccaacccctgggccatagactggtagtcatccatggcctgttaggaaccaggccacacagcaggtgagcggcaggtgggcaagcactactgcctgagctccacttcctgtcacagcagctgcattagtctcaggagcacagccccattgtgaactgtgcatacgagtaatctaggtc

SEQ ID NO: 101188 - DNA, 1028 bp, Homo sapiens
tgtcacccagtctggaatagagtggcacaattacagctcactgcagcctcaacctcccaggcttaagcgatctttctgcttcagccttccgagtagctgggactacaggtgctaaccagcacacccggctaactttttattatttactaatttttttttgtagagacgatgtcttgttatgttgcccaggctggtctcaaactccgggccttaactgatccttagagcttttaatatgcaagtaacattttgtgattgacagacagaaagaatgtaccatttcacaaatatatttgagtgcagaatatgttatttacagcgtgccccttagcgttttccccagtgaactccagctggggaagcactattctaagagaaaggggccttggcagggagtaggctcatagctgaggctgggtctgttcagtgtgagagggtctagagtgggcttggggaagctctggtctaattcctcggccttttccccacaggaagaagaggccagatccggtgagtctggcgtgctggcctgggaagggaacctgcccgggggttgtttatgggggtgaggacaagaggggaggttttatcctccctcctccacttctttctccatctggccccttcttatgccttcctagactccaaagctgagctctttcccctgccctgtgtgtggccgtgtgtaccccatgcagaaaagactcacgcagcacatgaagacgcacagcactgagaagccccacatgtgtgacaaggtgggtgggagccagggctggggctgagaggagggcctcccctgggtgatggagggtgatcgccatctcactgctctccacccctcacagtgtggaaagtcctttaagaagcgctacaccttcaaaatgcacctgctcacgcacatccaggctgttgccaaccgcaggtacatccccttggaggcccctggggacgggagcagtccccagctcattactgagcttccctccctctaaccgcctccaggttcaagtgtgagttctgtgagt

SEQ ID NO: 101189 - DNA, 1034 bp, Homo sapiens
atggagaaaccccatctctactaaaaatacaaaattagctgggcatggtggtgcatgcctgtaatcccaactacttgggatgctgaggcaggagaatcgcttgaacccgggaggcagaggttgcagtgagccaagatcacaccattgcactccagcctgggcaacaagagcgaaactctgtctcaaaaaaacaaacaaacaaaaaaaaaaaaacggttcctttttctccttaacacaagctaccatgtggcctgcagcagccctgagccttttatgcagtaactggataattaaatccttattgcagcccaatgaggtcgtaggtgtccatagtcccattctactgacccccaggaaactgtggctcggcctggccaatgtgcaagttggcagctgtgggagagggtacttccgggcacggtggtcagagcgagcccctgtgctctgtgcacgctgtgctgtgggctgttatgtgggttctgcagagaagatgtctcgtgacgcagtgggagaggtggaggctgcggcgccatgctgcctggcttcagctccaagctctgccatcgcaaggtccctccaccctgagactcaggttccttctttgtcaagttgtgagccagcacagagcctggcacagagtgggtgctctcgctggggacagtccccgggccttcctaggttttgacccttgcgtcggggtgtgttgtccacatgcctgtgttctgtgagctgctcccgcagcaaccctaagactgtggccacaggcatggtggggacggggatgggagaggaggccaagccccagcccaccatccttttgtctgtctcccaggagcacatgttcaaccacgtgggcagcaagccctacaagtgtgacgagtgcagctacaccagtgtctaccggaaggacgtcattcggcacgccgctgtgcacagccgggaccggtcagtgtgggggtgggagggacctgggcaagagaggccaggttgggtggggaagtggaggcccgggataaccatggttcccacttacc

SEQ ID NO: 101190 - DNA, 1053 bp, Homo sapiens
ggatcacaggcgcccaccaccacaccgacttaatttttttagtagagacagggtttcaccatattggccaggctggtctcaaactcctgacctcaggtgatctgcccacctcagcctcccaaagtgctgggattacaggcgtgagccaccgcacttggcctattgtattctttagtctctatttcaaaaaggcctttttaccgaggcacatatgtatggaaagttacacatattctgcccaggtcaatgagttttcacaaggtgcacacacctgtgtaaccaagcacctgtataacccagtcaagaagcagaacattacctgcattgtctgtattgttaatttgtctagtacatatttaatatttaaatactgtcaatgtttttgaagaggtaacagatttagattgtccaaatggtttgcaagcatggaagtcacatctccctccttccctcccatcagccctccagctgcctgacctccctggggaatgccagtgttaaagcactcctattgcttcccgagccttagattgttctgtgaagtcaccaaagccgccattctggcctcccttggataaatggggcaaatgagactccgggagaggaatggctttgtctgtaggtgcacagcatgtcagtgacagagccgtgcctggaacccaggtctcctgactgggaggtcccagctctcgccgttgctctaatccaggccaggtcctactgtgctgacagaatgtcggctgttgggcggtagtatccatgctgccctctaaccacaggctgtctgtgtcatgtgactcaatgcacccatcagtggtctgtgatgagtgggtgggaggatattttggctggcctctggcccacttgtccacgtctgtcctggtgtgtcagtggctggcttgtgacctggcatgtccgtggcaggtgtggaaggagagcctctagtgagttcccagagtggacagagccctccagagccacaggatcccgaggctcccagctcctcaggcccaggacacctggtggccatgggcaaggtgagcaggacccctg

SEQ ID NO: 101191 - DNA, 1064 bp, Homo sapiens
tcatcataacaattactggtgagttttggccgggcacagtggctcacgcctgtaatctcagcactttgggaggctgaggcagatggatcacaaggtcaggagatcgagaccatcctggctaacacggtgaaatcctgtctctactaaaataccaaaaaaaaaaaaaattattggtgagttttttaataccaattttttgaaattcattattttacacttaattatatctcagtttggactaggcatatttcaagggctcaatagctacatatggctggtggcagctgttttggatagggcagccgtagagtttgtggacttcaatgtttatttaaacttttttctaactggctgtacagtgtctggaggaagggttgccttttccctattcacatgaaggtgctttatgagctagtggtaggtgccaggaagggtagagaaagaacttcaggggctcagggcaggaacgccaagtcagccagaggagatcaggagggctttctggaggaggcatcgctgtgggcttggaggaggagtatgcaggggtagggaagtgagctgggcaaggggtcagggctgaaagggcaggtcccgccactcactgttcaccaactttactgtcccccacagaggatagcgactataatccagctgaggatgagccccgaggccggcagcttcggctccagcgccccacccccagtaccccaaggccccgaaggagacctggccggccccggaagctgccccgcctggagatctcagacctcccagatggtgaggcttggtcttgggaggggctcgtgtgggtgggtcaggagtggcctctctccctgcttgtctctgtggagttctggggactgagtgtgccctgcagggcagctgtctcaaaccgggtcacctgcaggcctccagggaaaggggaaagccctcaaagactcaagctcaagaaaccctgactcaggaaactctctcagctttatggaaatgcctttcaccacaatttgtcatagcaaaagagaaatttgggactttatcactgaatgcgtaagataagttttaaa

SEQ ID NO: 101192 - DNA, 1029 bp, Homo sapiens
gggttgcagggccggtggtacagcccgctggccccctgggtcagtggttcgctcccccccggttcccctgcggaggcggctgacagcgacggtctcggggcctggcgatttggggctgtccccggcgctgcctgtgctccaggcccgacgccatcttgtggtggcgccgggtttccgctcaggcaagtgcgagagcgactaaagggcctgggaccccggggccctgttcggacagccccgccggcctgggacctcgcctccgggtatccccgcagtgtgacctcactccacggcagggtacggtggggccgcctaactctacccgaagctcacccgaggctttcgtagccacgttcctctctgactccggcatcgacgaggtcgccatcctctttcctccgctgcggaggaacccatcggcctattgtaggccggaactacttcccccgctggccccgggaaagacacattttcagtgttccggaaggtcgctccgaggcctcaaaaccataatcgggtctcaacagactctgggactttatacgtcgcccggtgtttggcactgagcccactatggtttggggactactttatctcggcggagtgttacgtaggaagtggttgtgacgtcattctggtcccttccctaggccgcagggttgggcgcggcgaatgcgcgccccgctctcttggggcgtggctcccagtggggggcgtggctcccggtggcttggccgcgcccctcctacaacagcccggaagagcgtgtggccgcgggcgactttggcttggccaaagaggaattcatgttgtcagtcattttacctgactcattacttattacttagcgcgctgctgcaacccaatcgagctctgcccgttaggtttgatgtgttttgttgggaagggaatgtataattattgtacagatagggaaactgaggtctgggtatgggaagggctggtccaaaatcacatccaataaagggactcaggagctaagtacggatggcaggagtcggggaaatg

SEQ ID NO: 101193 - DNA, 1078 bp, Homo sapiens
ctcctgcccttggggggtactttgaaccagatacctccctcttctgtcttccaggcccgatttcccgccaaccactcggggcgacctcgggtgcctcgctgaagacacagccaagctcccaaccgctccagagcggccaagtgctcccctctgctacacccactccatctgcaccccccacctcccagcaagagcttcaggccaaaatcctcagcctcttcaatagtggcacagtgacggccaatagcagctctgcatccccctcggttgctgccggaaacaccccaaaccagaatttttccacagcagcaaacagccagcctcaacaaagatcacaggcttctggcaatcagcctccaagcattttgggacagggaggatctgctcagaacatgggccccagacctggggctccttcccaagggctttttggccagccttccagtcgcctggcacctgctagcaacatgactagccagaggcctgtgtcttccacaggtatcaactttgacaatccaagtgtacagaaggctctggataccctgatccagagtggccctgctctctcccacctggttagccagaccacagcacagatggggcagccacaggcccccatgggatcttaccagaggcattactgaagctaaatctttcaactctccccagtcccctcatcccctggcctcctcccacttacttgttctaaatagagctgtttggaggatgttctctgcgctcccaggccggcatcgagtgtcatcaatttctaccacctgctctctcttctgcccaaggctgtgttgcttattccttacaaagtttatactgcatttggggctgtatctttttttgttttttgttttgtagaaaataaatatctccgggggcagtacaggtgtctgggcttgtatttgatggggtttctccggtccctgtttctactggatttggagccaggcccagctagccaagtttggaatggcatttgtcatgtcagtagccaccacctttgttcattgtgaacctaccaaggctttccagcttcatacacattgaccagagctcaagctcctgc

SEQ ID NO: 101194 - DNA, 1129 bp, Homo sapiens
tcactacccagtaaaccatgttgcccatgggtgaggagaggaggttatttagggtcacagtttgatcttaatctatgacttttgaactgatgaattaaaaaatggtaggccagctctgtcctgaggagcacagtggagagccctgctttccagaggggcctgttggcctcctgctgctggtctagaggctgttgggcctgcctcccatggctgttccccacgtggtctgtttgaatctgtgggaggatgtcatgtttctttggtttttactacaagtctgtgatctaggaattcccccaaagaaccagctgtatataaaggtgcatctcctcaccaaaagtgttcgttcacttcccttcctggccttcatctctccccccacaccaccccactctcaatctcaaggctttttgtcaccaaaatgattttcttgctggtatgaggttaggaaagacttgacagagtgcagcaggtgggcacttaaatatgtcatggaagaaaataactcatgtcatttcctcctacagagcatcgcaacatgccccaagcagatgccatggtgctggtggccagaaattatgagcgttacaagaatgagtgccgggagaaggaacgtgaggagattgccagacaggcagccaagatggccgatgaagccatcctgcaggaaagagagagaggaggccctgaggagggagtgcgtgggggccaccctccagccatccagagcctcatcaacctgctggcagacaacaggtacctcactgctgaagagactgacaagatcatcaactacctgcgagagcggaaggagcggctgatgaggagcagcaccgactctctgcctggtgagctacgtggcagggccgaggtgaagttctgactctgcatttctctaatccccaggctctgttgggagggtgtcaggcccagggctctttggagtgggtaagggaactaagtccatcccttgggttctcccgtgggccacccatgctgatataatgttaataataactttatatttgggtactgaatgctgatccctatagttaatgtggtggattgactagtattgctggctccgtggtagccaggatggatgcccttttgttttttagcagttctc

SEQ ID NO: 101195 - DNA, 2805 bp, Homo sapiens
tggtgaactagggagagggtgtgacagggttagagaagacaggagccaagattatacaggaccttcatggcattggtagaggttgtagattgaattctaaatactgtgggagcctggcacagtggcacacatctgtagttccagctacttggtaggctgaggcaggaggatcacttgagcccaggagttcaaggctgtagtgttccgtgatcccacctgtgaatagccactgcactccagcctgggcagcataggtgagatctcatccctataaaaataaatacatactgtgggaaaccagggaagggctttacatacgtaacagatcactgtagagtgatctttctggagaaagatttggaaagaggcaaaaacagaaatgaggagactgctttagaaggctcttgctgtggtttgagggtgagatgattatgcgctggccttcagttttgccaaagaaggtaaaggaaagtgggcagaactgagaaagaatggagaaaatttggaaatgtggttggaagggaggatgaggctttaagggaaagatgacatccagtttcgtggcttgagtaactgagtagttggatgtgccatttactgagatgggaaggactggaggaggagcatggttgttggggaagatcaagagttcagggcaggttttacggagaaggtaatccttaaagcgggtcagacataagacattgttgtaaaagggtaaatgccagatcaagatgagtaatacagatagaaagtgccctgagctgagcagaagagatcagcagttaggaagggtagggaaggtttcttggaagacatgggacacgaacttgcctgtgtggattggatggtacttggattagtgcaggaaaaatattccaagtatagaaatcaaataaataaaactattgagatagattatatcttgtgagttataagaattaagtagaactgaggaggttgaattagaaatgagagggagataatagctgtcagatttattaggctttctaacatagaagttggcattttaggatagttagtgtatttatgtgttgaatgaattgaaagcaagtaggttgatttttaattttgtgttttggaaacctgttggtgtcagaatagaaataagggcttggattggacttacaaatccaatgggaatggaaagaaaaagtgaacgggacacaagtgactttattgggatgggggaagaaaaagcatagttaatattcaagaacttaaaacttgataagtggaaagatgattttgtcaaaagtggaaaagtggggaatgggactgatggggttggggtaagaagtttttaattttaaatatgttgaagaggagtttccagtgggttgaaacgtctcatgaagaacattgagtcagagcagacaaagcatatctgtgacttcactgttcaggttgtttttttgttttgttttgttctcttttttttttttttaaaccatcttgagcaaaatggaatcagcttctacgtaaaccctcagattgagagataccaatactcaatagccctgacaaaacagagaaacagattgttcttggtcctttactgtatgtatcttatagtaattttttccccttaattttattatcctgccaagatacttcaagtgcattttccgtactttaaggacagttcctttgatcacttttataagattgtgccattcgctctttttttcttcatgagtcttgcctccttactctgtcactccaactttttaccccttgtaaagtctctttcaagcaagtctggtggaaagacactttcactttgaaagcctgatgaatactgttatccagtcaaaaccttcagtttttggtcatgcattcttttgatgtcctaatcttttgagattgtggaacctctagactatttgctgaccagatggatgactggccttaaatgttgagtcatgttctgtttggctgccctgttttagagaagaatgcttggagggtgggggttttctcatatgaagagctgatgggttggctactttcaatttctttgtcttagcattttcttgctacctcccacagggatccatatggctttggagacagtcgagattcaaggcgtgatcgatccccaattcgaggaagtccaaggagagagcccagggatggcagaaatggccgggatgcccgggacagcagagacattcgagacccccgagacttgcgggaccacagacatagtagagatttgcgggatcacagagacagcaggagtgtgcgcgacgttcgggacgtgagggatcttagagactttcgtgatctaagagactctagggattttcgagatcagcgagaccccatgtacgacagatacagagacatgagagactcccgagatcctatgtacaggtacatacgtagttactctgcttgttttttcctgagttctttttatgtatgttctgctaaactaattgaaagctctgtaagagcagtcattttatcagccttttatttctggtgactgtcaagtgatagatgtgctgctgctcaataaattttgctgaatgtatgaatgattttcaacatttttaacagaaaataacagtgttggaaaggtatggagaaattgaaactctgagaaattgtaggtaggaatgcaaattggtatagccactatggaaaacagtttggcagttccttaaaaagttaaacatagaattaccatatgatctatcagttccgctcctgagtatacactcaaaacaattgaaaagagggactcagttgtacatgaatatgcatagcagtact

SEQ ID NO: 101196 - DNA, 2912 bp, Homo sapiens
atcacctcttcagatgtttcagtaaaccacagttctgctggctttgctctctattcaataatatgactccctgatgactccagctgtcagtgtgtaattctgacaatattggcccagccaagcacagaactctgcatgaggaatctctgctctggatcacatttcagcctgaattcttatcatctaactcttgagggccacttcattgaactcctgtgagtaccttgcatagttaccatgcaagttgtcaagcatcgatactaagcattagtccttcttcaaagacaggatcatgattccagttgtgccttagatatctcagttaccatcttcagctcaacaccttgacagtccagatcttgtagcatatctttatgcagatgtggcctctaggtacaagaagtaagactgtacttctgaatgacttaaagaagaacaaatagaattaacttgtctgcatccaacgctctgcagaggatttttccccatatatttgtgaaagatgttaaacctggtatctctttggtgaaagtcattgggtatcggctcatcagaaataacctggctgtagacaagtttcttatatgacctgaaatgctttctgcttatccacagggccctaatgcttttgattattgcttgctccctggttgtgagacagcccttgctctaggtgggccacaaagaaattccaggttgtgattacctctgcagtaacacttgaagaagtcatcagttctcagcagctgccacctctaccaataagaaagttctgtttgtgctggagaaggttgtcagtgcttcctaaggaaaagcatggacatgtgtaaaatttgggtctgtgaggtgtgatatctcattgcacgtccatatcctacctccacctaatggcaatattctggacaagtctgttgtctccatttctaacagtagcatgaagccctcctggtggaggatcaacatcatacagcagccagccatttagatgatgatatttgtggacagtatatctgtgacagaagtttgaagagctaatgaaggatttttcagggtcagaaagaggctggccctcccaaggaagacattccggtgaacagaaaggaagaaaggagatgctgacctttgcagaaaagaaagaaaaagacaggggtcttcctccctgaccgtctgtagaaccaaagccaaagaaaaccatcttggatgtgaagtttcagtctcttgccaaagagaaattcaaagtccatcacagttttccaagatgatcatctatcagttcttactctgtaggctgtcacatgcctggtgctctgcacacccctttagtcctcaggaagagacacattctaccagaagctcatcacttgccaccagagccattgttttccccttcacccctttcgcccttacgtctcaaatgtttcccagcagtgtgactatattcccctcaaggcaaagagtatttgcctttttccccctcctgaatagatgaggaatttacagcagaattttagttgtgtttgccacctgccttcagtttgtggactccagtgctgaaatttaaccactgttcagtttctttttatcctctagtgatgtagtacctgagggtatgctgcatttggttcctttagtaaaacacctctggtgctgtgggatgatattgttaaccttattatgctccagaaacctgattctaacccacttatcatctgaggtccagcgtctcccacaggaagctttgtcttcttgcactttgattcgtgcatactactgcccttttgttagctgtagtcttgttttgaaaaatatgttggggccagcagcaggagcccttttgttctgaggagttctttgtttgggtcctaaagcaaccctaaagggttttttgttttgttttcgtctccagaagaacagcagtctaccatagtgtttatcttttggagaaaggaaaaaaggctttgcctttccttttgagaaaattattatcttctttgtccctacttccaccatgcctttggttctttttccttttgtgaatatcacctcttctacatttttaccctgaaggcacttgagagggaattagtagttttgttgcacatggacttcaaattatttgagggaaagggtggggcttgccctctcagactggaagattgaacccagactttgcgaatctagagttttagtcaacttgcagggatggactttgacaggtaagtaaggtttttcagtggattcaaaagaatgaggaccaatcataacataacacttataatactccgaaggtggtaaataacatgctatgacatgccccaccccgatttccaccagcccaaggctttgtgtgtggtctgtggtctgtcaggatcatgatatctcagccctgattgccaagaacacttgaaattggattccacctctaatgactacttctaactgctccccaaggcaggtttatctgccgatcattaatccaaaaatactttgcagttgtcctttctctttggatcttgagtgtttgcccacattacatgctacatcagatgttacatgttaggaagattatatgatgtaataaggaaggttgaagtaagaatcttggttagtctttactttattctaataagaaaaataatgcttagctattctcatttaaagtccctggtctatgatatgtttgctctcacaagtcaggaatgctggtgaaccttagaatatataacaaatatttttcatggaagcaaaattggcatttaaattgtttttgctgtgcccgtgtagctgaggtgaggttttccacaagctgatgacatcatgatgaatacctaacgtgtgtaaccatggtagacgacaaaagtatgagcaaaacatgctgcctgctcttgagaggcttacagtttagtagaata

SEQ ID NO: 101197 - DNA, 3097 bp, Homo sapiens
taacaggaggccctgcttcatgggatattggaagttttaagacaatgaaatccagctattacttcttagtaacataaaatagaattatttgcctttgctcttttgttttttaaactctccttatcttcccccccactttcttcctcacaaaaagaatcttacagctgctttctaagagtttagaaaacaaccttttcctccccttggagggaatgtgtcaggtctaggtcttggcagcgtgttaaagcattgacgtaattagtttaagacaaattacgtgttaactagaaaacgaagggacatttcttaccaagccgtgacaatgtactaccttaactcaataataaaaattgcccaagtgacagtgtgtctctgctgaatggcttttcttacaccatctggttgtcattgtagtttttgttgttgttgctttcatttgaaatgtgctgatgatcttgtttttattccgtagcattgaacagatgggttgattattcttttcagatattaataaggcagcggaaagaagaaatatgaatacggctccatcaagacccagccccacacgaaggtaaagtaccctgaagccgtgagttaccttgggagagttgggctctggggagttaagcccagcttcgtacaccaaaggtcttttcttccccccaacaagtgaaacgctcaagcaaacaataagaacatgaaccctgtgtgaagggccttgctgctttttttaaacatacatcaggagatacagaggaagctttgtgttttcggtggcaaatccagcaagttcagcttgcaacatgagttgcaggcaattggaagaggataaacctctgtctgtccccagctcacgtgtcattgggagcctccagagcagaaggagtgccccagagtcattggtgtatgccatgctgcactgcagtgggcagcagagattcgactcttcattccaaatggctgccggtccagatgttaacccaggtttacggaaagtgctgcttgagagattgccgctgtgcctgtgctgcagatcccctgtttgcttacatacttgggttatctgtttgaggggaaataaaaagggcaaaacactccagctctcgaaggtctccctttttcttagctttcacggaaatcgagggtgttttcccaatgtattcttccttccggtgtatacaaaagagataatcctggtgtgtaccctcaagatacacattaaattggtccctcctctcaaagaagagctttattaatgataccatttacaccaaaaataaagatactgtattcaattgttctggccccataacagcacacaagtggatgcagttttgtgtagagggcagacagatatgatatatttcatacgaatgatatatttcatatctggtgtctcttcaaggcccaaatggattaattgattttgccttgcctctaagtaaaaaagccagttttccccagaaacataactaaactacgtaccacagtaaactgcatttcctacagtgaactggacagtgctgcatacagtgaatcctcgtctgtactggtagctccactggtcaccttgtgaacccaactaactgagcattacgcataacatacagctgtcctgcttttggacaaaaacacctgtattttgttacctgcttatatgaaagaatgtccactgtgtgtttcatgtatatactcctacttggatgtgaagttctagctaccgggaatagattacgcatgcccactctgcagtttaagcagaccctaagggcaagtaatgctgctggtttcattcagttggagtctttgtccactctgcctgtgcagcagagttgaatccaataccatagctacagctatataccacagctgtcgtgtggattccctggccattcgttggtttcactgcggaagtgggcatgtaaattggtattctgtctgttctctctaaagaatgcttgcagcttgcaggtaaatactctgttggttgatttgtgtgtatgtgtgagtatcctgaagaacataaacaaatcctgcagaacttcagcagttccgtataatgtctgctttcattagccttcatctaaccatgccacagatcttgggcagtcctatctgtgttgctccttattgtcccagcacagaatggaatacaggtggataagagttgcatctaatcttcagaagtacagggttcccattggaatctttagttgccaggtggcttgaaaggagataaggtgtgtatccaatttccaaagagcgctaacgtgtgtgtttcctggtgacttaccaggagtgtggaatttgtaactataaaagacactgactccgctagtaaaatcctacccctctctgttgtctccatgatacttggtgatctctggataatgtctgtgtgtttctgcaggcaaaaacaacaacaacaaataagccacattgcagaatagagaatagatcctgtttctgttatggattgagaagggtattttatatcatcctgttaatgatacttaaccaaatgcttttaacatttctagttgattgtagatattcaacaaacattgcagtgttggggaatgaccaacttccctggttgaaacccagtaatagccgttgccagagcattaaattaaaaatattaatttaccccaatctagaaatagttttatgctttttttaaataatagtccccgcacaaacaaacatacagacagcactggagagggccttataaaatgagcttctagccaggcacagtggcccacacctgtgatcccagcactttgggaggacgaggtgggcggatcacttgagctcaggagtttgagaccggcctgggcaacatggcaaaaccccatctctacaaaaaaatagccgggcgtcatggctcttgcctgtactcccagctactggggaggcattgaagcgggagaatcacttgagtgcagggggttgaggctgcagtgagccgtgatcacaccactgcacttcagcctgggcaacagagtgagtccctgtctcaaaaaataaaatgagctccttaccaactatataaatatacaggtcacctttgtatgccttttaaaatatcacc

SEQ ID NO: 101198 - DNA, 1864 bp, Homo sapiens
tcctagtcctcattgttttctgtggctgtagcttatgaactataaaatctggttttaaggtgaaaagagttgttttatgattgtacaattaaaaaataagtagaacaaagtagtttttggtactgtgagtgaaagaaacatgcatttttatttatagcattatccaaggaccattttgtgacccctgtctggcatattagtctaaaataaaattgtggattagatattgtatattttgggagttcttcaccccatccttttgtagtttataatggttctgccatttccagcatgttttctagattattttccagttcttttccttgtatgtaaagctctttttcttgtctaaaaattcttaactgagaagtgcttttaactgttttcagaccaccacttggacactatagatattcaggccaagataaagcacttcatggtgattatgatgattttgaatggcattcacattgctagtataattaacaaagtatagaagtatcacccaaactgaagtggagaagacactgagagatgacttttggtcttaagggcagttggccagaataaagtatagcagaaggggaaagaagtaccgtttcttcccttttctattcagaggagacattagacctctccttggaagagattcccaagttgccacttccctcttgttgattaatttttctccaaccagagttccccatctgatgtccagaaagatctccaaattgtctttctacctttttttcccttctttacattaacaccatttctatttgcttggtgttgattatatctctctataaggatttaggagaaaataatctgattatttaatacaaaataaaactatagattagatactgtgtctttctttgggaattcttcaccccattcttttgtggtttaaaacagttctgtcatttcctacatgttttctggattattttctggtttcttccttttatgtaaagccgtgagttggtgctttagcattctcaatatttgcattttcaaagaaaatcttttttaaatgaaccctctgcttccaactgacaggttttcaaattctgtgacaaaaaaaataggatgagggaagttttttcttgacttcttgaatctttgctctccgtgattagttccttaaagttatttattcttctgtatttctgaactcatggatttcccaaaagttctatgtgcacatgtgttaggattttttgggtgtatggggattggcagtaatgttggtggttgtgtttttacaactctcactgaaaactccccagccctaccctaatctgagcaattctattagataggaaaaaaaaaaaaatccaggtctcattttctccatacgtcagcccagatggaaatttaaggaactcttaaatagagatgaataaacagatacttgacatactacactaaaagtttactaaaccctaaaatgagacaattatctgagaattcttgtttttgcagaagaaacatcccatgctgtcaaatataaatactttggactacccaatgaaaatagatactacgaggcaaattacaatcaaaatggtttaaagatataatcttgaatattctttaatcttttaagtaattacaaaacgattccaccagcttcaaagtaaaatatttatgtccttcattctaactagaactggttttgttccaaagatatagtatacatgaccatgtgatttctccagttctgtatgtagatgctcacgaaactggctataattatacagtgtaatattccttttcatatgtagagagcaaattattggtaatagaaacctaccaattaaagtaatactatatgtgttgtactcttaacctgaatgtt

SEQ ID NO: 101199 - DNA, 1722 bp, Homo sapiens
attttaaaattttaagcagctcagactctttttttgtagtttagattagctcaacctttgcaaatccaaaatcattttttctcagctgatttttctccttgagtcaacatagctaacacaggcagaatatccattttgtcagaaaggaaatatagattcagagaaatcaaatgactggagtaaatttcccaaagtaaggaccacagctcagatttgctatccccagccaaatgccctttccttaaaagaataagaaaggtaggaaattaaatgttgataatttttgtcggaagagttgtggtgaatgttaatagcaaaccccagaaacactgtagtttgaggtaatagaaactgaagtcgtcattgaataagtaggttctaccctgttgggtgtctctgggtcatttaagcaatggagtgtctagcatagactggaccttttccaggttccatcagtatttgatcagggagtcctagcaagaatattctaaatggaaagcatgtctttccactccgttggaggcagcatagcataatgtttaagtactttggtgtaagaaagacctgggtctgagtctcagctctgcctcctgataattgtgtggcctgtcacttaatttctctaaacttcaaattttctcatttgcaaagtagaaattatagcagtatttaattccaagagttgtaaaaggattgaatgaaataatacacataatgttcttagtacacaggctcaggaacaaaataagcattctgtaagtataaactattgtttcccccatttctgttcccaggaataatattctaatacagttaaagatgtaataattattttagttggagaataaaggagataatcaaatatatagggaaagtatagtattcaaagtgaacttaaagggttgatttagaaagagcaagcataacattctcttatccctgacttgttacaatataactcattacaatatccctgatgttgcaatatatcatcaaagttgtcttcataaatatagtttagcgagaagtcctgtcatttcccctcccaatttgggggatttaatgtgtgatattctctgtcttgtcagtatggttttccaactggcattatctttatcagcatgtaatgccactttagtaattcttgattgttagttggttttcaactaagccttttagagagttttatgtcatttgtagtcagttattaaaacagtataggcttctgggttctttgaacagctagtggtggtactgtcactaagtgttgtagttcatgtggctgtcaaaagacaaaattacagcacacttagtttagagatcttaattgtcttttatttgcaactctagaatagggcaacacctcattctataaaatagaacaagtgttccaatgagctgagcagaggcgtttggctttataaacagagaagggagctgaggaaagcagagacaaggagcaaaaagcggattggtcatttcagagttacttttcttgtgaagggtaaagcagtgcagacttccttttcatgctggctaaaactggcctatttgtggttttggccattatttatctcctgatttcgcagaacgtcaggaaaagatctttgtcttggcttgatagcgtggaacttcatcatgaatttggtttggtctttgggcctagttcaggagctcagtccaaagcaatggcctcctggaaattttctttgacaccgctct

SEQ ID NO: 101200 - DNA, 3052 bp, Homo sapiens
gcagccgcctgtctgtgcacgaacggtcggtcactaggagtcctcaaggcttctctggttgagccgcacatcccgcaccccctgtcgaaacggtggagtcgctcgcccgcgggtcctcagcgagtcagtggcgcagtcgggattcgaaccgggcccaaggcgtcccgtggcaccgggcgttctccaggcgtgcagcgccgagcggtgtactgagcgctgtcccccgccaccgtctcgcggcccctgaccgcattctcggggtgtctccttgtggtgtgacaccccacgcgttttgtaggcgcggacctcgggcccagagaacggggagaggaactgttcccgggtttaccacgtagctcagcgccagcgtccgatccggccggctttccaagctcccggcgcggggcactgtccgctccccgccagcgggcgaggggcttctcttaggacggcgttgcacacgtttcagtctcgcgttgcacctttatgtccgtggaccatctgtactgctatttaccaaatgttacattttttaaaaaattcaaactgactctttttttctccttaaatatatttaaggcggcaacttcaatcacaaaccgggtactggaaagccagttatttttctaatgcttataaaaaaaataaatatctgtctgttgaaataaacagtgcgtccttgttcctcctgaaattattctgcgttccacactttgggaaacgctgcccgaggagtagctgattaattgtggttcttctggcttgcactctgtgcacagaatttttcctgaggcaaagcagattctatgaatgccctgggctcttcagggataatgtaacagctttcttgtaaactgttctctttgttgacttaaaagtgttagtcccagggaactgcaagaactgtgttcactcaggtgcacccggtgtgcctgaattttcttacagcgttgtgatgtcgtagccccctgttggctcataaaaagatgtttctacaaatgctggggaagcttttgtgagttttgacaactcttaatttaatgttttctctatgagtcagtctgggtgtgaaaactaactttgtgtctactttttgcaaccagtaaagcccatgctttgcattgtggatattagaaatcacttggctatttgttaacatccatttcttcctttattgtgatttctttgcctttctttgagctcatctgtcactcttcagattgcctttgaaacctctgacacttctcttaacctaaaacttagaaacactgattttccttgtagaatgtcccagcgaatccatattgcaaggctcattggaaggagtttttctagattcagtttgctcaatgttgcatacctgtgaacaccacaagtttaaaggaggcattgacagattaacttacttgtaagttaatagtgtgttcataagatctgtttatgtgaatgtaagagcagatttaatttaaatcattgacaggaaagtcccataagtcagttcaggcttattcaagttttcttcccctcccctcaaaggctgtgtaaaaaaatatatatatatgtatatgtatatatatgtgtgtgtgtgtatgtatctctccccctgttaaaaacatgtttctttggggttaccttggtatgatcacaatgtagaatttacgtaaggctaaggtcattttcttcacatttctgagaatttgatttaagcccggcgtccgtttcagaacttcagcaaatggaaactcatctaccagtgcttgagagctaagaaaaaacaacttgtttgttttggttttgtttttgttttttctgagacagagcttcactcttgttgcccaggctggagtgcagtggtgcgatcttggcccccgggttcaagcaattctcctgcctcagtctcctaagtagctgggattacaggcgtgcgccaccacgcccggctaattttgtatatttttagtggagacggggtttctccatgttggtcaggctagtctcgaactcccaacctcaggtgatctgcccgcctctgcctccgaaagtgctgggattacaggcatgagccaccgcgtccaaccagaataaacaatttttggaaagactttcgtagtctgatgagaaaagatttattggtttgaaacttcattttaaataatcattgcaagcagtccatgtttatgacctgcagatggcagtgcctttgtgtaatgttttactactgtgaggattaataaaatttagttgtgcttttaagaatggaaaatcttcacaagaaatatattaaactttttcttcccttcagtttaggttgttctcttgtttttgactccccacgtgaagaatgaaacgtctattcctgaagtcactgttactcttagtgtagtaatgataataacatacagccagtagtgcatatggtaaatactaaatcattgctcctgcccgtcatcttatgagactgataaactagtttgatcttttttatttatagggaaatgatgactcaaagaggttagatttcttgccccagatcacataattagtagaacatattcaagacatcattggagataattgatttcagggtcaagcaaaattgggaaatgttgagatatagtggtgtccttactccaaaacttctcagaggcatttatgtgctaaatatgtgcaatgtcaatatctgagagaggaagttatcatgatgcctttctcctgctatcctctcatgaatattttgaagtaatagtgttcctcagaactgactactctttctactacgctgtatttcctctctgtaccttgtggtttattaatgattactgcatatctttaagacagctgcttttaaagctcaatatcagcttttttgtgcaaaaatagttgtcctgtgaatagcacatatatttgtttagaccattctgcttaagcagagttaaactgtcaaaaagttaaaagagcaatgactaacagaattatcctttatgttactctcattaatgagagtcattaatgacaggatcagggtaaagccactgtctcaagcagcagtaca

SEQ ID NO: 101201 - DNA, 1043 bp, Homo sapiens
tgtagcatcttgtttacatttcacaataatcaagggggcaggcatctgcctgctttacagatgaggaaaccaaggccctcagcagtaaagtaaattttccaagttcactcagcatgggaatgatagacacaggtttgtaatccaggtcttgttgacatcgaaacctgggatgctagtaaccctaccctgctgcctgtcagtcctgccaggctttccaggacggcccccaccctgagccacatccccaggaacactctgccactccctatccccctcctgggctcataccatgaaagccccatgcagagcctgctactctagagggatatatattatctaaatttgataagacaactcaatttcactccgtgtctgttaccggcgataaaaccaggagacttttatgacccagcatcctcagcaagattgtcaggaacttattatacaaggtctaactggatttctctctgcagatggctgggagccatgggctggaacgcaattcggcaacacatttggggaaataaatgcaaaatgcttgttccagagacttagataaggcagcaggcctccaagctccccaagaatcggatctgcttttcctgggccctgaagggcgatttggggaggatttacgctgtcggaggaggagggaatggcgggctctttctcccctcatcccttgactcttcttgccccagggaaggaatgtgagcgcacctgagacttggagttcagcaactgtaattccctgagaggtagcaattcagagtagacctgggggtgggaggacaggatggtgggcagtggtgagaccaaggttatgaggactgtgtgcattgaaagaggggtgcaggatgatcaaaacgatggggaactgggtcttcactagctgctcgggatctgccatagagtcactccttactgccctgagaggcccgcgtccttcccaaacacacctctaggactggtgtggcccccataaactgggttcccaaacagaccccattccttggatgtgagttcacatccagattcagatg

SEQ ID NO: 101202 - DNA, 1061 bp, Homo sapiens
ccatgctgagcctgtgcttcttatcggggggtgctaatgggtgaccctctgatgaatgagctccatggctgtgtgttagctctgaccgtctaaagacactgcctatagcaacgaaaaagccatgtcgtggagctgcagggacctcagctacatggtgggggagcgatctgattggcaagagtgaccttccaggagactcacaggcaggtgcctaccctgtgtatggggtccccccattgctctcagaatcccccacccccgacttctccagcagcaaaaacagccgtgtcctgcctccagcctgttgcctgggaaatcaggatgcagggaggcaggcggtggcctggcctaggagtgagtggtggactctggagccaggccatcagtctgctccctgagccatcaccgactccgcagagacaccctaggcgccactgctggagtgggcggcaggagggggcctgagagctgggggtgggggagattaagcagcccaggggatgagagcaaatgctgtgctggagtccccgggctgagtttgaagcctgattctgctgctctgtgaagctgggtttctctgggcctccaattctccatctgtaaaatgggctcatctaacagttaaggatgaacggagatcaaaagactgaaaatcactagtgcttaaaaaagggagattctagagctggaccccctgagcccgtatccctactgaacgatactagatgcatggccttgggaaagttaccgaacttcttggggcctcagtttctcatctataaaatgaacgattacagcatctcagagggttgatgaagggatcaaatgagttaatacgcagaaagtagttgaagggtgcctggcatgtggcaagcactttatcacaagtagtagctattatattattatcctctggaaaggagctgaaggaactgggcattttgtctatcctcaagccctcaatgccaggtaaagagcgggtcattatgtgcttgctgagcaaaagaaggactgttgagggcagatgttggaaggcagagctcaggctgataggcacagat

SEQ ID NO: 101203 - DNA, 1076 bp, Homo sapiens
ggcccatccaccttatgtcccccgcctgcctggtgcctgtcactctgcccatcacacacacaagcgcgcgtgtgcgtgcgcgtgcacacacacatacacacacactccacctccccagctcccctcccctactctgcaagcactacggtgacaacaaagaatatggggcggggctttctgcttttttgactcgcagaggggtctgtggtgttaacatctggaccaactttccagaggccaaaacagttctctgccatccagcatccttcccttccccagggaccccccagtcccctcttcgctggccccaaggggcttctacttgaggaatctggtgagcgccacacgactcctgccaaaaacgtcccagtggtccctgaagaaatcatcggacaagagcgtgaagatgtgtgtacaaggatgttcatggcagaattgtttgtaatagcgaaggactggaaacaacccaaatgtccaacagtgggggctggttaaatgaattatgggcagccacacaatggagaaccatgcagctcttgaaaaatgatgatgtagatgtatatttatcgaaatggcaagacattcacaatatattatagggtgaaaaaaagcaggttacggaggcatatgtataaagcaagatgccatttttattttttaaaaatctatatatgtcaagaaggatatgcactgaaatggtagccaagtggtggtaaaattatggctaattaaaaatgctttcatatataaaaaggtacatacatatatacatatatataaatttacacacacacacatacacacacacacagagagagaatcactctgtattaaatacttcatatgagccccgtgcagtgttaagcgctttgtctgtattacttcatttctccagtccttggaggtaggttttgttacaaccattttctagatgaggaaacagaggctcactcagctattaagtggcagagctggaacttcaactctgctctgtctggctccagagcccatgcacctaatcagtaggttgtcatgtttctcattttctcattttgtttatctgtaacttgcctatt

SEQ ID NO: 101204 - DNA, 1099 bp, Homo sapiens
cctgctgtggccttccatagctccctgtcttgcacaagactcagtttccccttatgtacaatggagaggggctgacataggtgcaggcctaagatcttggcttggacacttggcccaaccctgggaagcaggcaggcccccctatcatcaacccagcccacccacctgcctccctccctcgggggacatatttgctgctgggaaagttaatccattacagtttaaaggctccgttcctcgctggcagtaaattacctgctttgcattttgcagcaacaacttaacggtattaatttattgtgctctgtctttaacaaacatcattatcatattgccagccaggattatgcaaatgggagggacaagggagaaagaggctgaatcttgtccccaaagtcaccttgatttattaactttggggccctgcaattggccaggtctgggaggtgcaggtgagtgcagaggccaggagaacccacaaagtctgggcagagagagtcctgaggccagagggggactcccaggggagggcacccttggagggaagggctggctggggcttagagggattcccttgtcaggtgactttggacaagtccattctgtcttgggcttcggtttccccacctgtaaatggaggttgaattaagaggtccctggagctcataacatatgaacttgagattcagcaatacattgtgaatgagtgagagagagagagagagagtttatgtgtttgggcagggtgggctgagtagagaagaagccacgtggtcctggggctgcagtgcccccatgccgggctccctggctgctgcggctcctgagcaccaggctagtcatggatgggcacatggtgggagatgggtgagctggggctgagaagagaggggtctaagggaaggggctacttctgggctgagagtctaaaggctgacggcaggggtcagttcatgagagggtctgagacttttaggctatacaccaagatgctgggttgggaaggggaggcaggaccatgccaggctgggaggcagcaccctttagctcctgattttgcatctggcctgggggctgggctggctggaggtctactcat

SEQ ID NO: 101205 - DNA, 2378 bp, Homo sapiens
ctcgtggcccgagggagatttagtgccagctgtggggtctggaagggaactcaaagtgtttcaggatactgagaacccggtgctggccagaggaagtgggaaaaatgagaactgagagggtgggcaggggtcatgtcctggaggccggattccccgtggaggagtttgtgttccatcctgagggaaaagggtttccagtaagggatcaaccagatcaggttaatacctccgctcagggggctcgccggagtgtttgtggaaaccataccggcccagccagttggaatgggccccagccctaatgctagagcagcccccgacctttgggggccagatattaaccctttagttgctggtggaaaagaaggcccaagggccccacaggaggcaccgggatggttcagaagtgggggacactcaggtgcctcagggtaccagcccaccccagcagagtgtggacctcccaagctgtcctgtgggtgcctgtgtcttcacagctctggcgacggcgcttgacgtgggcttgtccaactggagcttcctgtatgtcaccgtctcgctgtgagtactggccatgccctgctgcctcccttcaggctgaagctgtctgtctgtccagcggggtgtctgcacacccggctgctaggccagccactccaccactctgggaccagcccttgctctctcagcctctccctggcacccagcagctctccgggaagtcgccagcctcttccgtaagcccagcgcagaggagatgctgtgcccacctgccaggcagcgtggggaagccagggagctctcccagaaccccatcatcagagcaggggaaggcaggctgcaaggccacagacaggtggccactggtgggtggtacacgcagccgcagcagagccctatgtggcctgggggctacacaagagtttcttcttccctctgatgttttgcttcagagagcactgttcctgccttcttgtcctcctacttctcatccttccttcccgctcctgggctctgccgagggttaggtaaagaacaggactcagggagctcaacgtcagacctgtaacctcttctctctggtgataaccagaggcctcttagtcagagattccttctgattaaaggtcgcttatcactcagatgacagcccagctctgtttggtcatttcgctcagtgatttgtgctcctgctcctttctcggtgatgggtctgagccctgagctccagcagtgcattgtgggtaattttgcttccaggtacacaatgaccaaatcctcagctgtcctcttcatcttgatcttctctctgatcttcaagctggaggagctggtgaggccccagcgtctcttgtgtccttcctgcccccacagatgctaagaataaagtgggagtctgagcagtggcttgtcctgctgtgtgacagaggagacaagcccagtccaggtggcagtagatccctttctgagaagggacctagacatgggcaatactcagaatatttagaaaccagtgtggcagggtaatgaccaaaggtgaaagcactgcaggatgagggtcccagcagagctgggtctaggaagcaccctgctgtgggaggcagtagccctgtgtgttaggcccagggaggaggtgggaccacttgggggcctaggacagccgtcagtgtggcagagcaagcagggctgttggcataccagctgaccgtcagccctacatgctgacattggtgggcaaggactgtccaggaccccctgggatggagctgaagggtggaaggatttcttgccccaggggcagccaagatggctgctgaccccaggctccaaatgtgatgaacccttgaccctcaagacccccgagttagctgccactgctccccatcctaccagcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggtgagcacgtgccactcatcctccagagagaggaaccccggcacaggcagggcggaggcagggcagggccggaccagacctgatggtgcctgtcccccgccctgcaggcctccagaatcccatcgacaccatgttccacctgcagccactcatgttcctggggctcttccctctctttgctgtatttgaaggtacgttgggccttccctctcaagggcacctcagtgcagcagaccacagatcctcgccctgagcccaacacagtggtagctgcagagattattgagatcaaagatgcagtccctcccctggaagc

SEQ ID NO: 101206 - DNA, 1034 bp, Homo sapiens
agaaaaacacaggtttgatgtgtttgacacgtggcagggggccgctgtggcgggtgctgggaccagtggcagaagaatgaggttacagaggccttccttgtggaccaggctgaggagctgggcttagccttagggcatgatctgtttcgtgtgccatctctctggctgctttatagattccaggccttaggggcgaaagaggaaacagggagaccagttagaccagtggcagtcagcaggtgaaagataattgtggcttagactgtggtagtgggaatggagaggaagagaagtagaggggtcaagaagtgtattgaaagtggaactgacagggcaggatttgagaaatgacagaaataagtggtcaaagatgacttcatcatagatttttggttttggcttaagtaaccaagtgtattatgctggcatttactaaatgactttgggatagattgggagcgtgagaaataattacgaaatcttcttagggcatcttaagttttagatatttggagtgcagctaccaaataggcagttagatatatgagtctgatacagaaaaggtcagggctgatgtaaagaatttagaaatcattggcaagtggattgggtaggatgagattatgtagggtaagatttaagagagaagagaagccaggttccaagctttaggcacccaatttttatagattgagttgacaagaaggtgccagcaaaaaagaccaataaggagtccagaaaagcagaagaaaaaccaggagaatgtggtatcgtggcacccaagagaaggttttttctaggaggaggaagtgatccattgtgtaaggtaagaatagagactaagccggcccggcacggtggctcacgcctgtaatcccagaactttgggaggccaaggcgggcagatcacctgaggccgggagttcgagaccagcctgaccaacatggagaaaccctgtctccactaaaaatacaaaattagccgggcatggtggcacatgcctgtattcccagctcctcgggagcctgaggcg

SEQ ID NO: 101207 - DNA, 1031 bp, Homo sapiens
ataggaaacgagaataaatgctgattcttcttttatgtacttactttcaaaataatgagttagttccttggtatcatgcaacagtgaccaattttgtgtgtgtgtgtgttttgttttgttttttaattgttaagacattcctatgccaaatacagcacgatagaagttgttagtcatcttggtaatataaaaacttttaggataacttacagtcatggatcgtgaccttccagggttctgagtgttgaaaatgacttttttccaatcttaaaaatatcacaacatctttgatgtgacttgggcagggagtgggtaagttaaggttgatttatgctgggcctcatctccagccacacttgtggccgcctaggagcattgatgacattcatctgaatcagcatgtttggtgatgatgccgagtcactaggactttggccaagatcttgatgtgcagaccccaggctgttccatcgctctaatttaaaccctttctccttcaggaggtgttggaattggccttctccatcctgtatgaccctgatgagaccttaaacttcatcgcacctaataaatatgaggtgagcagtgtggcgctgccttagacaacagagctatttctgtaactcttcagttggtggcaggaatgagcaaaacaggaaagtcccctgtggtgggtggctgcagtgtatattgaagcctaggaaggctttgagaagaaggtggcatttcaataggatgggaatgtctcaaaggaggagctgtggttgggggggcacccagatgaagcagcaggtatcattacataatgctggacctgaggttcctccaggcgcattgggtggctgccaaggatctgtcacactctggattgtttatctgtgagctgggctctccacattactcttcagcagcagccataggttgtcattacaaagataaggtcaactaggaatgagtcatttacctgggactgggaaaattctccccttttcagtttctctgtggtcagctacccaagagaacttgacaga

SEQ ID NO: 101208 - DNA, 1060 bp, Homo sapiens
ccttggtttcttctcctgtaaagtgggaataatagccacactttcctcctaagaggattgcatgagtaatgtatgcaaagcacttagaagagtggttggcaggtagtcagcataactgttagcagctgccactgctgttggcgatgatggcatcatcatcgccattattgtgaaggagaggggaagggagtcaccaaggtcccgttccttggggatataaatccaagagccctgaagtgaccctcagttagctttgacacagcctcactgggctgtggtctacaggagtgaccaagacggagggaacagtacaaggccatcctccccaccaccctcactgagctcatacagcagcccttggagtttggggctgaggcttcctatgcatctgccccagtacctcccttccagcactgatgtaggcactgaccagcttgcagcatgaacttccagagactaattcccatcatttatcagttcctgttgcagacattaaggccattgtcactgggaaagattgtccccacatgaaagagaaaagtgctctgaaacagaacaaggtgagtagagaggccagtttgagtagctggcccagtgatacttggagagtgccattggtggtggttttttccaggtgcattcttggcatcttcccctctctattcctgaatgttttattaagaattttgaacatacacaaaaatagatggaacctctgtatacacatcacccagactcagcaaccatggccagttctgcccatccacttgtttctctcctttatcgctttgaagaaagtcccaagtatcacactgtttcatctgtaaatatttagtgtacatcgtatagtgtataacattgccaccagtccattagcacacataacaggaaatgaaagtagttatttcagatcaaatattccactgatggtgactttctaccaattgtcttataaatgtcataatttctctacagatatataaatgtttatatggatacacacacacacacacacacacacacacacacacacacacacacccccatacccatcttgtct

SEQ ID NO: 101209 - DNA, 1041 bp, Homo sapiens
aagtaataaatatgaaatattattaataagacattttacattttcttttttcctactaaggcttcaagatccggtatgcatttacactcacagcacctctcagtttggcctaacatttcatgggcctgggggctaccaaactggacctcacaggtctaaagagattgatctagagtcagagcaaactctagggagagctgatccaaagttagaaggagctttaaaaagatactgagtcagatacctctctaaagtcagagcgctctagagcattgctattcagtagaactctgttaatggaagtgttccgtatctgcattgctgtagccgctagccacggtgactactaagcacttaaaatgtggctggtgcaactaaggaaccaaattttcaacttaaatttgttttaactgatttaaatgcaaatagctgcatatggctagtggctgctatactggacagcacagccctagagacagagctactgagtagggaaattgaaggacatagtggtggtacatgtggaaaatggaggagagcctcatttgggcaagaaagaaccaagagggacaggattcataatggtgggtgagacagagggagtgacaaatacaagggagcaagaagggaagcaggatattgtgggagtgaggacaggatggtgagagacaggaatgtaatcaagggttgatcagctaggacagaccgagggagacatagcatgcaagagaaagacagagacagaacatgagacaggaccaggggacctaaagtggggtgtgggcatcagagggacaaaggaggaggtgatgaaccgacaggggaatgtgggggcacagagacagtggggagggagagtcaggagggagagggacatggtgtgggcggcacagggagcagggacagagtgataggagagaggagaggacaagtgagaggaaggaaggaaggagagggccgtgggagggagctggtaggagagtgaactgttcctcctttgtgttgctatctcagtatcattgaaagaaaatggcctttccc

SEQ ID NO: 101210 - DNA, 2226 bp, Homo sapiens
gaccttctggcctggtaggaaagactagtgatcatagtggggtgtgatctgggtttgtggtctaggaaaggatggaggaggaacagtgatttctgccttgaagaagagtgtttccggaaacttttagaggaatgtcttcaggtgacccttagaggatgagtaggcagaccgggaataacaggaatttcagtcagagggcagccagaacccagaaggagtgtgtgattaggcacagagcaaggagcaagtagatgaggaggctagagaggtagcgaggaccagatcaggaaaggttagtctcattcctaaggacagctgagggcatttaattgagcttgtgaagtaaccagatttgcattttagaaagagcacatgaaagacatgtgtttgctaaggggtacctgagggaggagagcagagcaggagctggcagggggatctggaaagaggtataaatccctgttaccacctgtggggtggagtagggctgatgttgggaggtggggccggtgggagtggaggaggagagccaaggatctgaattaaaaggaggcaactttggccggacgtggtggctcacacctgtaatcccagcattttgggaggctgaggcgggtggattgcctgaggtcaggagttcgagaccagcctgaccgacatggtgaaaccttgtctttactaaaaatacaaaaattagccgggcgtggtgataggcgcctgtaatcccagctactcaggaggctgaggcaggagaattgcttgaaacccgggaggtggaggttgcagtgagccgagaccaggccattgcgctctagcctggacaacaagagcgaaactctgtctcaaaaaaaaaggaggcaactttatcaactgtcagaaacaagggaaacctgggagaccacagtgaagggaataaaatgaaaaattagaagtcaagtttaagacttaagctaaacatggactttggagtctgccattttccaatctttgatcttgagcatttcacataacttctctggacttcagtttgctcatctggatatgaggactaagtgagctaatataatactgtgcttagcagggtgtctggcactcagtaagcactttgctcgtattggcagaacaggatgcagaggtgataggattgaagaagtaagctctgagcacttgtgaagctgagcagtcagctgctctaaaatgcagagtctgccagacttcaccttgcagaaccagcttctccctgctggctgcttccctggtcacacccagctaccagcctggcaggaggggccccaagcccacaagtgacaggagtacacaggttcccacacattcctgcctacactcctgagcagctgtcctggtcaccctcttctgcatgtgtggggatgagtgcgcccttctgaaggaaatttaattatgtttgagacttactatttaatcgggttagaagttcaactcatttctggacaaaccttgtgaacaagtaaagatttcactatagaaggcagttcagcatcaggactcaggacttaagtggcctggcaggaaatggctaatgcatggtcactgaagtccagggatttcactgagtcaagccagagaactaagaccctgagatacttgacagtcaagtgagacttcaggtaaaacctcaaactgtcactcatcagactggagctgtacttctttaagccattgatgctaggataattaattaccttcctgccctgatgtttcttaagttggagaaagagaattaaagagaatgaaaatcagaatcacattaacttccacctctattcaaagctgttttataaattagggagaagagtgaggagagaggaataggatagacgaaggtagagagagggagcagtggagaagaaaacctcagagtgaggcaaaggaagaggtgtgaaggggaaaagaagtggcgatggcagggaagagcccctggccatgagagagactggggggagtgggaaggaagggaagttatggggcagggggcacagagcagagaacaagagagtaaggctagagagatgaaagaaacagtgagactgagctaagaagagcgatctcacgcttaagagacagagggcgtgcctgtgacagggcgggagctacaggactggacatgatcaccgattcagggggagggagggatgcaggcagaggcctaactccagcatgttagcatgtgctatggaagtgctgtcc

SEQ ID NO: 101211 - DNA, 1613 bp, Homo sapiens
tgtagttcaactagggcagaccagactcagaaacagctcgtaactttgatctagacaataccatggatgcgtcaccttcttacttgctttagtggaagagaaaaggtatccgtgccctttttggactcttactagaccgtgggaatccgaaaaggtttagacaatcgacaaaagggaatttggatgctcatttcttcattatagggagctttagagaggtcagctttgcgaggagatgaaaggggataagtgcctccccctgacaccacagagaagcttttggtctaagacctttatattctagctgcagaccactgtcaattacccaccttatgagttgtccacagcaagatttaatctcagtcgacctcctatagttaccagagaagtttctaggccactgtcctcctctgctagccagtatgtattcagagaatgcaaagtaaaatttaatgttcctggcagcattagccatttggaatatggctagaaatccagaagtgtgacagaggggcctttcagctctgagaaaaatgacacagagctcacagatactactccataggagaggtgtgacagctccctcaggcccactgatttaggattctctataaaattaaatgaaggcagcagtttagaaaatgaagtcatggtaattaacatcagtaagaagtgatggtcgacactggaaggaggagacaagaattatgaaaagctgtcagaaaaattaaaggcattgtaatctgggaccattttgtttatgggaaaatagcttcacatctcagtagctcctcagggtatcacagtgtcacaacacagaataatcactgatgttctttttgatgaagccgactccttagcagtgattaaattatcactgtagtcacttcagaaataaatgtatataatatgtctttaaaagatttgcataagaatggtcaaaataatgattctgagagaacccttaaagctttgctccctggaagattcatttatgtaggaaacttgatttcctgggtgggctaaataaataaagcataactatcaaagtctggatcaaatattataaaaaaggtgagcctgttataaaaaattacccaaaacaccagactcattgttctctaagccagttagaacggaatcctagactacttactgttgtagagcgtccagaccccagccgtctgctgtagggtgggagggggttgctggaccaaagcccttccttgtttggagtcagtgcttcactagagttccttctagccttagcagtggggtctacctggcacgatgcatgtggcttagaaaccatcacactgctctgtgtccatgtgcaatgtccttgtgacacaagcgtctcatcttcaagcagtcctcatctctctttgaagacagtggagttgattgtgccattaggaaaggaaatcctatttgaattaatttgcactcacaaaaatagggaatgttgcagagtgtaaaatacatctgatggtcagtggattttcgttcattcacccacttttcatttgggaggaaaaaaatttaagaaagcaaaaaaggcccagaattttgacatcaccttcctctcgatagtagtcacaggtgtgtgcctg

SEQ ID NO: 101212 - DNA, 1022 bp, Homo sapiens
ttaacgctgtgagactaacttgattttacagaggaagaaattgaattttgaaaagataaaatttgcttggttagtaaggtggacaggaactgaacccatctcttgcactctactgcctcttggcccaaaggttaacatggcacttacacttccttaggttctcccaacaggtgttggagtttgacaaaggtccaatgtcttctttggtcttgggaaatagataagtgattctgtgtccctgggatgaagcatatggagaaggaagatctaattacccagcaacatttttttttttttttttttttgcagcgatagatacctgggctgaatctgctctacactggctaggtgtgcacacaggcacttacagttacagttgcatcgactgatttcccatggggtgttcacattaaaattcatcttttttgtggctgccctcacacctgtgtttcccgatctgaatctttgtctattttgtgtgtgtgttgcacgtgtctcagctacagtgagatgctggcattcaccctgactgccttcctagagctcatggaccatggcattgtctcctgggacatggtttcaatcacctttattaagcaggtgaggcctccaacattctgtctttctctcctccctcagctgccagttcacaaggcttaaggggagatacaggcaatatcgccattctggtgagatcagctttatattccctggggccagatttttcatcctcaagctctagtcttctgtggcttctgaaagatttgcattttgttatattctcagggcctgcactgagatggaactggaccgtcagaactaaatatgatcaaagtagaattagattgtcagtgagactggggataaagccagccagtcaaccagtactagccctgagtcttttgaccgacttcctgagctctctcttctttttgtatatatataaaaaaaatttgcatttcatttgtaaatttgccttctatttacaaatctgcaaggtagcctgtttggattgtcagact

SEQ ID NO: 101213 - DNA, 1367 bp, Homo sapiens
tgggattacaggtgtaagccactgtacctgaccaattttattttcttttttatttttgagagagagtcttgctctgttacccgggctgcagtgcagtggtgcagtcctagctcactgcaaccttgaattcctgggctcaagcagtcttcccacctcagcctcctgagtagctaggactacaggtgtgcaccaccacacctggctcattttaaaaaattttttgggagtcagggtgtcactctgttggccaggctggtgtctaactcctggcttcaagcaatcctgccttggcctttcaaagccttgggattacatgcatgagccacgcacccagcaagacagcttaaatagaaaaccttcctctattaaaccagtatctgtttctctgtgacttaccatcgttagtgggcctcccagatgcctccagtattcccttggtaggaattttttaaatccataggccaaagcggtacagaaaagatgcagataactacagattggttttggcatactaataactccctgattgattccacaaacatttatttagcaactcctaagctgtgtgaaaaaactagttctgcctcaggtttggatgtccacagaagggcctctgtgagctatccacagagtagtaacctgctccaaggagcagatggcacatatcttgtccctggcctcctagtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccagtgagtatgactaaggtctcgttccaaggacttcgacgatttactacatcccacagggcatcctagtctcatttcccttgagtcaaataaggagtttattgaataccacctgtgtgcagagcagtgtgccaagcactagagtccataccaagatatataattccatattgtgattctaaatcgtgtagtctatttgggctctcacaaattaaataacagtacaaaacagtactgtgccaagtgagcagtgaaaataggggctagagaagtcaggaggagagcagtcacgtcgtgacagacctgttaattgctggaaatgtttggtttgatgagggttagtgagcagatggtccagtatctcccaggtgtctgtttgtaatcatcccctgctcctccctcttcagtcacctcccagcccatacacacacacacacacacacacacacgccttcctttgtgtttaccacaggtgtcaacctacccattcaccatctccctgc

SEQ ID NO: 101214 - DNA, 1071 bp, Homo sapiens
ctttttgtatcaggaaatagtacaggaaaataagtctgtcttggttctcaccacctagtggggagtaaacaaatgcaatagaaggcctgtctcaagggtcttgagagaaagttgcttagggagctgtgggaactcacaaaggggaccacctaactcagcctggagatttccagaaagtcttgccagagaaggcgtcacttagctcagatgttaaaggatgagcaagaattagctagagaaataagaaaaggaaaagtattccagtcagagaaatcagcatatgccaaggcacagaggtatgctgtgtttgggaaaagcaggagtgctgggtggctggaggcttgtagcagtcattgagaagccagatattcaaggttccttgatggcctactcgtaggtttcaactctgtccagaaggaaactggggacattgaagaattttaagcaggaagatatgttatgtttagattttaagttttagaaagatcactttagtgaccatgtggaagatgggccttaagaagaaggttggtggtagtaggaacctttgaagaggctaataaggaatgttaacagcccagtgaaggcaagtggtaatggagatgaaaggatggatatgaagagtatctaggaggtaagctttatgagtatggtgatatgctagatgtggaaggaaaggggagaatggaggatgaccctgatttgtgcaagagcagcccttaaaggtcactaaggaagcaaccagaagggtagaaagaacaccaagaaggtgaagtgactgaggagctttgggcagggagagtgtcaggactgaggagagtatggtctgcaatttttaataagcagagagatttagtaaactgagagcagaaaagctgtctaatgacttgggaggttagaggacactggtgatactcacaaaaaagttatggtggggaggccaggtggccacactgaagtggtcaagtaaaagaaaggtaaaacagtgaggactttgagtctactgctgtatcaagaagcttggttttaaaagaaaacacagagaaggtgataatgcgaaggggacgtgga

SEQ ID NO: 101215 - DNA, 1034 bp, Homo sapiens
agagacggggtttcaccatgttggccaggctggtattgaactcctgatctcaagtgacccgcccacctcagcctcccaaagttctgagattacaggcgtgagccacggcgcccggcctacagccccagttcagcaattgctcactgagtatctaccacgtgaccagcactgttgtaagccatttttggtgattgggcggtgtatgtcatagccttcatcttcaggatgcttcaggtatacttggaaagacaagactggatcacataaaatgactagatggtatgcaaggcatcatgaggtgtaatgaagagccagaatcagtatgggctggaggctgcaaagtggctgtcttggccaagctgcatgatgtgtttttaaaaatgttggatttaaactcctctaggcaaggtggtactttgcagtgttacagaccctacatggaggctgcttgttttatttacttacctgcttggctgcccaagacatttgaatttataaccctattaggcatgctatgctggtttcatgtgagtcactagaaaatatttgttgagcacttcttatttgccaggcattgtattagctgctgctttggaactgatcataacattttccaaagttcttccactgggaaatagtaataataatagtggaacaccaacaaatgctttgccttttgtattgactttcctcccggactgccttcacatatgctctcttattttgtcaacaatacacaacatacctgcctagcaggtagggcttactgtgttggggaaacgtggtttcagagcttttgcagtttcttcaggttcacacggttagaattctgctattatgcttagtgctttattatcccacttgatgctcacaacagctttacggggtagagttgatgctaatccccattttacaggtaagaaaatcgttagtgctaagatccaagttcaggcctttcccactccagaacacagctcctaacttgttaagctacacttcctcactagaaggccaaagttggaagaaagctcaaa

SEQ ID NO: 101216 - DNA, 1047 bp, Homo sapiens
cagatttacctcttccttcttgtgtgttttgataataactgaccatctttctgatatctgttgtacctggtctcactgtatgactatctttctctaagtgcttacttgactcttgtctgttttattcaacactccatcagccacacttccagcatactttgtgtactattccttgtgactatttactttttccactcaatgtttagtagtatttgtaaagtgtcaaaggtacttgtattctttgctagtttcctcttcctttccccctgttaaatagtggctggtatggatggatttgcttttttgtattttttgtttctgtatttcttcaaatcaaccaagtaagagatatttgcacttgaaatttgtttaatcttggaaggcttggcctgaagtctaacccctaaaacaatgcatttctaaggaattctcatttcatagcaaacatataaaggctcaccaattaccgttaattgtgttcctttttctagacattgatgatgccttagagaagaacaaggaaatccaagataaacatttgacacaaactgtattcttcagcaacaaaacactgattacagaaagagagaatgtatttgggaaaacacttaatctgggcatgaatagtgttccctcaagaaaaatgccctataaatgtaatccaggaggaaacagtttgaaaactaattcagaagtaattgttgcaaagaaaagcaaagaaaacagaaagattcctgatggatacagtggatttgggaagcatgagaaaagtcatttgggaatgaaaaaatacagatacaatccaatgaggaaagccagcaatcaaaacgaaaatcttattctgcaccagaacattcagattttgaaacaaccgtttgactataataaatgtgggaaaaccttcttcaagagggcaattctcattacacaaaaggggagacagactgaaaggaaaccaaatgaatgtaatgaatgtaggaaaaccttttctaagagatctaccctcattgtacatcagagaattcatacaggggagaaaccgtatgt

SEQ ID NO: 101217 - DNA, 1052 bp, Homo sapiens
tataagaagaccactgccatggctaatggaaagctatagagagatgtaattgtgggagggcagaaaattaaaaatctgtcactgtgttcattttttaaaatgaattttaaaaatgtgctgagcttataccatgtcctggagctattccaattgcctggattactaatcacataaaatactaatcttactctttaggagcatacattctgacagggtgacaaaaatagaaatgtacatctttaaagagcaatgctggacatatacacaagatgaagggtgatcacaaaagaagaaagcttgctccatttttgttaccccttccttgagagcataataattttagtcctgaaatataaacagtatgttttataggactgtagccattaagaatatacacagacacaaaacacatatggggagttcgagaactacaatctctccacaggaaaggttagtgaggagcgggacagaggtcagagaatagaggaactcttttctctaattagtagtcttgaaatttagatagtacggcacatcagtaaaacattcttgcatatacgctaacgtacatttacttaggaattgtagtatatttccaagtgagttccagctatacactaatatcaataaagcttaattattttttcattcttttggctgaaatacaagaatagaagtccagtgaattgctggggtgctccctatcctccactttggagatcactgttataaataatggaaatccataaagagttatttgtaagcaaggactggagatttgtgaccaaatgtgtattttgaaacaatgctctagagcataagagttggcaaacttcagtccgtgggcaaaatctaggccactgggagccaaacgtggtcacgctcatttgttacacacagtctatgactgctttcatgtcacaacagctgtgccaaggaaatccaacagagaccacagggccagcaaagccaaaaattttgaccttgtcctctaaagaaaacatttgctgtcccctactctagaaaaatggaaactggcttaaaggtcaaat

SEQ ID NO: 101218 - DNA, 1054 bp, Homo sapiens
gctatacttataaaacaagttctagagggaacaattcaatattatattctgtaggtaaaacttcttcatgtgcctgtctcatttcaacccacttgatacagtctggtgtctgcccccaccactctgatggatctgttctggaaaaatttagcagtaacctaaatattttcaaacccaatgagtatctttcagttcatactttaccaaactctttgttgcatttgacagtatgactgccccctccctaataggcacctctgataatgtctgtggtatcactcacatgattctctttgtagctctgtaatcatgtcttttttttttttttttaattgagatgaggtctcactatgttgcccaggctggtctcgaactcctgggttcaagtgatcctcccaccttggcctcccaaagtgcactgattacagctgtgagctgccacacccagcttgtaatcatgtcttctttatatcttttatacaatcttttgtttcatgaacattgctatgccattgttagcccattattctttctgattttttttcatgccctttgtggttttaacttgtgagtctttatgctctgaggtatttctgcctctgaggacctcagcttgagattcttgctgaacatctctgtaaggatgtccagaaggcacatggagtcctcatatccaacatggaaataatacttacaacttgctcaatgtgctgctgcttcttttttccctatcagtgctgcttccatctgaccagcgagacaagccagaaaatgaaggccatctttttttttttttttttttgaaatgggctctcactctatcacccaggctggagtgcagtggcacgatctcagctcactgcaaactctgcctcccgggttcacaccattctcctgcctcagcctcccaggttcacaccattctcctgcctcagcctcccgagtagctgggactacaggcacccgccaccacgcctggctaattttttgtattttttagtagagacggggtttcgccatgttagccaggatggtctcaatctcctgacctcgt

SEQ ID NO: 101219 - DNA, 1011 bp, Homo sapiens
gcacccggcgctggaggcgcggcttggcagacggcggacggtgcaggaggcccgggcgctcctccgctgtcgccgcgctggtaaggtgggccgggatcccggcgtgggcggccccgaggctctggggcctgggcgggtgagggactcccctgcgctccgaagctggatttccctcagtttctccttctgtgccttctgcggtgtccggcctttcggaaatgttattctttcatcccttttttcattcgttaagtcttaagaaaccacgtggccatgcagcgtcaagcttttgtcctgaggccgttctgcctggttcaaatctgggatctgtcattattgctcaatgttgaacatgtttaacttccctgagccttggtttccccatttgactcgtttcaattttcgatcattatctttccatttattagttttaagaaacatgtaatgacaagtacttgccccactggagccaggctccctgggttgaaatactaactctgctgcttgtgtagcctttcaacaagttatttagcctctcagcctcggttttctcacctgtaaaatgggagacatagtagcagtatccatgtcatagggatgttgtgaccattagaggaggtatgtgtgtcacgtattatgttcaaatgtgtgcctggcacatagtgcccaataaatgttggatttcattaaattgcctattttttcattaaacatcattgtgcgccagcaccataaactttgtcctcagatgagaaagtgacactcagagagaagtaacttgcccaaggttacacggttactaagtggccggtccaggccctcagctccttatgcctctgactcagaagccctggctttttacttttacgcttcttgcctttcttttatcagtattttttaggtaccagtgggtaccaggacattgttaagtgctgggagatctgggtgggggatattcagtagccaacaagcggacacattgctgccctttcagagacttaagatttcatg

SEQ ID NO: 101220 - DNA, 1532 bp, Homo sapiens
cattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacgatttaaaaaaaaaaaaaaaagcaaccaaccccaacaacaaaaaagaatgttttggtattggagaagggatggtcagttagcctgtctgtcacacgacggaatggatactgggcccggggaccactttcatactcacgtcctcatccttggatacccaggggagggcgaaccgttttcgctcgtgtgtctgtacgcagcatgttgggatcgggagtttcggcacagactatcccatcaagccgttggctcctttcagctactacgttaccacgttcctaaaacgcaagctctccggaccagacggacacagggagaagctagtttctttcatgtgattgaaatgatgactctactcctaaaagggaaaaaacaatatccttgtttacagaagagaaacaaacaagccccactcagctcagtcacaggagagaacacagaaagtcttaggatcatgaactctgaaaaaaagagaaaccttatctttgctttgtggttcctttaaacacactcacacacacttggtcagagatgctgtgcttcttggaagcaaggactcaaaggcaaggtgcacgcagaggacgtttgagtctgggatgaagcatgtacgtattatttatatgatggaatttcacgtttttatgtaagcatgaaacacaggcagtatgagagaaagcaaggcccgtcatgctgtccgtacactacgtatgctgtagagccattttgtatgttgtgtaaaacaaaaagcattgatgaaaaagcaaaaggtgatgtatgtatatgagaaaattaattgtacgatatcattccagtacgttttgttgtacattttagtcttgtttactttctcttcattgttaagaggatgcgaactgtacagtttccagctagttacccatattagagaagaaataagagagtattagaagaaaacaggagagaaagaacatttgtgaattgcagttgtcaaaaaaaaaaaatagcctagctggccttatttgtgaagcataattgcttttagcatatggaagtattttttcacattttctttgtataaaatttgtattaaacttaaatatctttttgatggtggtgtttctttgtgactgagccagtagactcacactatatgcttttttgggtttgcccgttccttcccccacccccccagttttttcagatttctttacctttttttaattaaactgttttggaaaaatgccgtggtcgtcctcg

SEQ ID NO: 101221 - DNA, 1033 bp, Homo sapiens
tggtttaactgatagtattacctagtcagaggctagcatgaattaaaagcggactgacagaattttgaagtaatgtactttctccttggatatggcaaaaatctggagggggttctgttagtgagtggagtttaggaaacagtgaatgttctagggtacagtgaggggccactctggtgctgcgttccagtctgttcagtgtgggagatggtacctggggtttggccacctggccgccctgtgcccatcactcccacctgaccgtgccaggcagaggacactgagatgctttgggggcagcgatgagcacccccatgactccctggatttccctgtgggggcgacagtagcctcagtgccttgagtccatctttttctttttgtatttctagacccttgacctttctggctccagagagacgccctcctccattctcttaggctccaaccaaggctctggtatgttgccccctggtgggcgaacggtgctttcacatttcagatgggcagatggggagccattttgtcagggagaatttgaagggtttattccaatggtttccaaacgattatggatccttaggggtgcctggggtgggtcagtgggggtgagggggtagctgagcatgttaactttcaggtacctcttcaagctgatcggtattacctattgtatttactggggatccacataaaactccatttggacagagggttctgttgctgacctggggtagggtagaagaagtgcatttggattgggaagttttttttttctctctctctcagggaaatgagaacggtaaatgacactgtgtaagattttattctgaggttctgacacctgcatatggtggatgaaggcgctcaagcctttgagaattgaaggcagtgcttaagtggatgatctttctgttaaatcctttccttttggagaataacctggcaggcaggtttggggaaatttctgagacttgacatctaggttttttcttctgtggggtttgagctgtcttccttccttagcccaaag

SEQ ID NO: 101222 - DNA, 1034 bp, Homo sapiens
ggtcttgtttgcctcattctcccctagaggtcttgacttgtatctcagatgtgggccggcgctcagtaaaggaggccgctgctcgcggagatggaagacgccgcagaagtggcctcagcgttaggtgagaatgtactcctccagcgcggtgtgcttggcacgtcgaattggttcggcattcctggctttcataggttttacccagaacttggtggcgtcaagaccgtgcaggtgaacctgagtgaaatccggtttttgtttgttttttcttcatgcattggctagttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaagtaagtttcaaacgtcctcccaaaagtggcacatgcagaagatgcagcgtcagcagcagcagcagcagcagcaaaaccagcagcagcagcctcagtcttcccaggggacgagatatcagaccagacaggctgtgaaaggtaccgagcctccccttctgttctccgtggcgcccgctcccattttgccacatcgacaggagaaagtcattgctcttttattttttttttttagttctcgtttgtttccgggccattgtatcttgaaggccttgcacattccatttggcattatttttaaaaattgttttgctacttgcttttttactttcaaaaagttttttttgttcattttataaatgatacatgcatatattctccttaaaaagggggcagaaagttttacataaaagtctgttatcccgtttaccttccatttcattctcttcccttccacagtggccagtatcaaccgttgtaaaagcttttctatgcatgtatgcatgtat

SEQ ID NO: 101223 - DNA, 1007 bp, Homo sapiens
aaaaagggtgaatttttttttaaagggtcagcacctgagaagctgccctatcaaattaacctacttaattcctgaatttgtcactggtcactgtttttcatttataaagcaaggactttttaagagaaaaattagcatcccctttgtagaaggatggaaattactgatgtgccagtgaaagcacagcgaagagtctaagtgtgctctctttgcttctgttctgaggttattagctataaaagctgttttgccatctgaagattcatattctacccataagctgcatccctagtggaaggtaagctggaggtcacaacagcgcaatccaaaatgcccttcacttactaaactcttaagtgaaaacacatcattgaaaagatgctctctagcggagtctgacacgagaatttttcaagacccaaaccaccatcagctctgaatttaagatcaattggttttgccccaagccttaggaagctgctctaactgaactgtgttttagaatcatcttcagcttaattgtccaccatctactaaagcttcctggagaaattcccttcagacatcaatgtgaggaaaagttctacttcttttaatcaactagaatggttttttgtttttttggaaagtatgagatcttctaaggtactgtgtttcccattctgctttcagagccaacttccctaactctgaagattgaaatagtacagatttctgtataaaacctttccccagaccacttgctattctaccttcattttccttttacatggatgtctttattttcatcttgtttcatatggttatgtatccttgtcaatctgttgcaaattctttctggaagaggtaggggcacaaaaccaatcaatcaaaagatctgttccagaaagaaagaacagtataaatatgtcactcataggagcactgccatctgcacccaaatattcctacgatcctcatgaaataaatgctactcctattgttctctgcaacaacagagacagtct

SEQ ID NO: 101224 - DNA, 1029 bp, Homo sapiens
ctcaaggcccatccctgacttgctttaagccaccagacaatggaaaccccaaaggacatggagttacatcttattcaagggtttcattgacaagttagctcctgatagaagttaggcacagtcaagatttaaacctggctatcccttaagtcactcgccacatacataaggttttatggctacaacctgtaatttgtcctggggcaatgtttcttctgggcccttagttaattcttcagtatctttattgagcatgttgaatcctctaacctaattgccaagccaactcaaaaatgtgctgaatactttgtcagtgggaaggacatccttccaatcattcccacaccccttttgttgggcttgttaacatgcccaggctgcactaggctgtggggtagtcactgctggttcagaatataaccgtagcctctgagactcaggggatatttggcaatatttgattgccacatttgtgactgccacaactgagcaagtaaggttgccatctggctggtagaggccagggatgctggaaaacatcctccaatacacaggactaagaattagccagggcaaactgtcagaagtgcaaggttgtgaaactctgagctaagttaaatgcaaataagattaaaagccagtaaggccagacgcagtagctcatgcctgtaatcccagcactttaggaggccgagctgggtggctcacctgaggtcaggagtttgagaccagcctggccaacatggtgaaaccctgtttctactaaaaatacaaaaattagccaggcgtggtggcaggtgcctgtaatcccagttacttgggaggctgagggaggagaatcacttgaacccgggaggcggaggttgcagtcagccgagattgtaccattgtactccagcctgggcgacaagagccaaattctgtccgccccccctccccaaaaaagccaatacacatatccaccatactccattttctagtgccctaagaagcactcagtattctggcaccaatcacccaaatactgtc

SEQ ID NO: 101225 - DNA, 1032 bp, Homo sapiens
tacagtagtaggacagtatttgggtgattggtgccagaatactgagtgcttcttagggcactagaaaatggagtatggtggatatgtgtattggcttttttggggagggggggcggacagaatttggctcttgtcgcccaggctggagtacaatggtacaatctcggctgactgcaacctccgcctcccgggttcaagtgattctcctccctcagcctcccaagtaactgggattacaggcacctgccaccacgcctggctaatttttgtatttttagtagaaacagggtttcaccatgttggccaggctggtctcaaactcctgacctcaggtgagccacccagctcggcctcctaaagtgctgggattacaggcatgagctactgcgtctggccttactggcttttaatcttatttgcatttaacttagctcagagtttcacaaccttgcacttctgacagtttgccctggctaattcttagtcctgtgtattggaggatgttttccagcatccctggcctctaccagccagatggcaaccttacttgctcagttgtggcagtcacaaatgtggcaatcaaatattgccaaatatcccctgagtctcagaggctacggttatattctgaaccagcagtgactaccccacagcctagtgcagcctgggcatgttaacaagcccaacaaaaggggtgtgggaatgattggaaggatgtccttcccactgacaaagtattcagcacatttttgagttggcttggcaattaggttagaggattcaacatgctcaataaagatactgaagaattaactaagggcccagaagaaacattgccccaggacaaattacaggttgtagccataaaaccttatgtatgtggcgagtgacttaagggatagccaggtttaaatcttgactgtgcctaacttctatcaggagctaacttgtcaatgaaacccttgaataagatgtaactccatgtcctttggggtttccattgtctggtggcttaaagcaagtcagggatgg

SEQ ID NO: 101226 - DNA, 1467 bp, Homo sapiens
gaacactcctaaccgtttgagacttgtcaaaagagaatgagatgtctgtggaatgcagcactgaaggaccatttgacaagatccaaatgttaacaaacactttggggaaataaatgagcatattggaaaagaagctgctcagactaaaaatgacttggtcactaaaagtaaccatcattttctaacagacttctctttctgtactcaaaatcaatcatactggataccgagcaggttaaaggtaggcaggcccatgtttgagtccaggtcctgttctatgactagctaggcaaccttaaaccaaacacagcttcactgtgcctctctctcagtgtgttagagggtcacataacttctgatttgtttctttaagggtcacataacttttgatagtaagtgtacgaggtaggattctaaaccaaattaagaaaactggaaacagatacaatcacttaccatcctgtttgggagatggttctttgggttccttcttattttttcgaccctcccgcccagaatggtcttctcctaaatctatgacaagttcgctctctgaatcagagtccaggcccaaatggactgttggggaatccgtctcatcttttcccttcagtttatcctttatggggtgaggtgaaggttttgccttttcggaaaagtccttctcaggctcagggctggccttgtccttgactgctccagggtctgccttctcgctggctggtgacgtgcttttcagctcctctttaatctccactgggtttgtaggcttgggcttttttttaacagcagatggctctttgtccatctgacaaccttctttgtcctctgtgtcttctggctcgttcttagacttctgctcatcatcactgatatactcactatcgctactatctgacttctcagaatcctccgaatcgctgtgctctacggccgtatagacatcttccgagatttcatttatgcctaaattcaaaaagaaaacccagcatgtggcgtagtcacaaaataaagagcaggatgaaaaatgcaaacatttttccacaccaaatgctggaataagaaaagcacgtttcaaatcgcatcacattggcctaaatggggccagtaataatctcaagtggcaactggctacggctgccaagtggtacttgccttgggagagggttttggttgttaggagacacaggacctaccaacggagattttaaatttatatggcactaaacatgtggtgccaaatttttgcaacgttgataactaattgggattattgagaatgaagagggctggaagggaacagcagggacaagctgttcaaactgatccaatttacagattagaaaacagaggcccagggatatcacctgccctaggacacaagacagaggccaggccagaaccccgggttcctggctccccaccaacactcttcccttgggtttccaaagggttaaagttcttgat

SEQ ID NO: 101227 - DNA, 1002 bp, Homo sapiens
agccaggaacccggggttctggcctggcctctgtcttgtgtcctagggcaggtgatatccctgggcctctgttttctaatctgtaaattggatcagtttgaacagcttgtccctgctgttcccttccagccctcttcattctcaataatcccaattagttatcaacgttgcaaaaatttggcaccacatgtttagtgccatataaatttaaaatctccgttggtaggtcctgtgtctcctaacaaccaaaaccctctcccaaggcaagtaccacttggcagccgtagccagttgccacttgagattattactggccccatttaggccaatgtgatgcgatttgaaacgtgcttttcttattccagcatttggtgtggaaaaatgtttgcatttttcatcctgctctttattttgtgactacgccacatgctgggttttctttttgaatttaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatggtaagtgattgtatctgtttccagttttcttaatttggtt

SEQ ID NO: 101228 - DNA, 1703 bp, Homo sapiens
aaatacaaacacccagatctggtataattctgggatcctaggcttgtgctactggtaggtaatgattggaaacaagaaggaaaagtgtaagcacatatgtgataggaaaagcttgggtactgcagtccaaaggacatgaattcaaatcctgcttttctgtttttattactggtgtgaccctgaacaagttatttatctctctgagcctcagtttctctatccgcaaaatgggactgataaaagtatcaacctcccaagacaatctatatgcagtgcttagcatagtgtccaaggaaacactcagtaaatggaaataataaaattcttattagcaataaaaacaaatcaagagttgggccagctgcatggaaggacccaagaggattatttaaatggcatgccaaatttcacccatgccacccaatgtcctcaccaaacaggcaacccaacgggagctgttgtcctctggatagccccagatgggtccctaactctagctgctttctcacctgaagatgcagagcacccactgacactcagaggagcttgctctccagaggcccagccatcccccacttctttacaaatgccctcctagctttacttacttattcaacaaacattccagagcatctaccatgtgcacagaccaagtaccatagagaaggcaaatcctcataaaacggcctccctgccctcaaggagcttccagtctagattgggagggacacccccacacaaagggaccattgctacttccgagcaatgaagtaccaaaggaggagggcagatggggagggcagtcaggggagacttcctggaggaggtgagatctgagctcagcctcacagaaggcaggattcaggtaggcagtgtgaaggcaggcagcacagggaagaggaagaaaggcaacagctacagaagcagggtttgcccggtggggaggagaccagtctggagggaaagggtttcgtgtcggacacctacagaacacactcactactcgtgtggagacactgatgcgtactgaggagagcagaggcaaaactcagaggatcctcattctgcttgcaaaccttgatgattcaaacctgtatctcgagtttccagactgctttcaccaaagaataaactgatgagttcaaaaagccctgaattaactagcaagtctgaagtcttttgccatgagtggaaatatattttagctgagcaaatagttgaaagttaaagcagctgctaaaagcagccaggattcaaccttgatttcatccaggtggtatccctaccagtaatgataacaatgatactgctggaaaaaaaaaacaaaaccaaaggtatacctaattgtgctttgcaactctctatggtcttgtcaagattcagctggaacctgctacgaatctggcgcttgggagagatgagaggaacaggggtggactgttgctggaccgactcgctcagctccttcaaatccatctcagctttgcttcgatctgaaagaaaccatcacaccctcgtaagatcaggcacacaccatcctcatcacggagcttcgtccttgcaaagtcagagcaaaacacacattttagaacatgggggagggggagatactttttttgtcattcatcccaacaatatcatctgctcaaccaaatggggtgacatgaagataatggcccacgtgaacacgtttggcaggttta

SEQ ID NO: 101229 - DNA, 1561 bp, Homo sapiens
ccaggcatgatggcacctgcctgtaatcccagctgcttcggaagctgaggcaagagaatcacttgaacccaggaggaggagcctgcagtgagccgagatcacaccactgcactccagcctgggcaacagaatgagactccatctcaaaaaaaaaaaaaaaaaaccacaccaacaataaacttgccaggtgatcctaattggcagctaaggctgagaacccctgtatcagaccaatcttctatgtgagtaaagaaaactcactatttgccttaactcctgtgtgtgtgttaacaggacaacctttctaaaccttagggtccataaaaagagacctagacctcacctgaataactgagctctgtgtgtgcacctgcgtgtctacacgtatggctacagtaaatgcgacccattaactttagcctaaaaagactgagcactggaatgttcataatcaagaaaaatgcaaagaaggtaaattccctcattttacaaactgaggtttctctggtcagtaagctgctgttatgtttattcttgttagaataaaccaccaaatggctaggggctgggcccaggccctggaagctgaccttcaggagtttagccgaatgtaatgatctttatccaaacctgcagctgcatttgactcccccctcctccgcagagagaaaacagcttcactttctcatttagctcatgtagcttatcgggacttcttccacccctgcccttctatatcgggaatatcttcagaatccacccttgctgccaacattttgaacttttcagctgatatgaagacagcttaggctataaatggaaaccagggatgaaaaatactcacgctagagaaaaaggcacgatcttacatttctggagggagcataaatcagaaccacctctttagagggcagttgggcgatacctctcaaaatgtcgccgcatgtggcctctgatgctcaattccacttctaggaatttatcctatggattaccctcccacgtgggcaaaagggttcttcattgcagttgtcttcaatagcaaaaatggaaagaagcgtagcgtcagtaagtaaggcgcctgaataaatgttacagtttacctttaaatggaattaaatacagctgctaaaatgaaatgaaggccgatttctgtgtgttgatatgaaaagccaacctgtttcatgaaaaagcaaagactggtggagcaccttagcactgctgtaggggagccaagaaggaaatggaaaatcgctgggaaggctatatattctcagggtttctcaacagtggcactattgatatttgggtcctggataagtctttgtggtgggggtggggtggggtggaggggctgtcccgtgtgttgtaggatgttcagcagcaccctggcctctaccccctagatgctattagcacctacacaccagttgtgacaataaaaatatctccaggccaggcgcagtgcctcatgcctgcaatcccagcattttgggaggctgaggtgggcagatcactcgaggtcaggagtttgagacaagcctggccaacacggtgaaac

SEQ ID NO: 101230 - DNA, 1893 bp, Homo sapiens
ttttaatttacagacagcaaaattcacttttgggagaatacagtcctatgagtcgtaacacctgcatagattcctgtaaccaccaccacaaccaaaacacagagcaggtccatctcccgaagagttccctcccaatgtgtaggcaaaccctcctgcactccaacccccagctatcactcatctgttccccatctctgtaattctgccttttctgatatattttttaaggaaatcctgttttgttagctacaataacttcatcattatccagggtgctccctttcattgtccctgtctggggaaagtcgttccacggctgacagacagaatcaagccctataaagcatttgttcagtccctgggcagtcactggagaattccttaacattgccctgcttgttctgatctcctccccacccacggcacttccatcggtccctagctgatcctcttcccgttaggtcattgcaatcccagcccacaaaacgcccacattcccaatgctcttgttcctgctgacgaagataagaaatgtgtcctgaaccggaagagctgccaggggagacacaagagggcctcggttcccctggtgctcacccaccaccatgcccacccaccaagacacacaacaggaagaaacctttcactcccacaacagatcaagccaaactgaaagacccacagtgtcacgaggaagcccaatgaccacccagtttcagcaaagagctattcttgacaagcatgactggcagagaggaaatgtcaccgtgagaacgcctccaaacagcatttcttttcagggtgtggaggtggaaggagggtgtgagaaagcaaaccacagatttgggaacaatgaatgttcccaaggaagcacgtgtgtcccttttcactcaagtgaggaaccaactggttggtctgaatgggagccccgaaagcaactgccctgaccatcctattacatcagggctgtactcacaggtgagccaggattggagccaggctgtgctccagccctgctgcctctgggatcctgggcaccccatgcctcctctccagacctccctcagtttctccatctgaaaatggcactgtaggacaagatggacctggagggcgccaaccaccaaaggcgtggaattcacacttaagcgtcactgggcacaggtggccgccctctctttctgaaacccccatactggaggctccagggcaacacactcccctggtgtggctactccaccccttgcttctcctcctcaaccagaactccacatcctcaatgtcccaggggcctcactcctgctcaatgctctacccctgactcgcaacctcagtaagccaatggggctggagtctttgttgagtgaggctgtcctatgcactgggggatgtttagcgcaactctggccaccaatcattagatgccagcagtgtccccatcaccccctcaaagtcatttcaagaactaccactctaacccaatcccacgtacacgtcaagattcccagaattacacctcctgcctgaacctggccacagggaaccctaattcctgcctccagctgccctattgacctctccacctaggggtgtaacagctgctcaaatttacataatctaaactagacccttggcttctcctgccatacccagatctgtcagcacaattactgacacaatctagaaattctctgttgggggccctgttctacattttgtaggatgttgggtggtatctccctggcctccctccattaggtgccaggagcaccccaaccccaggtgtgacaaccaaaaatgtctccaaacattgccagtgggtggggaagtgttacaaaattgcccccagatgagaatggttgactgatatggactatttgaaacacagcaccg

SEQ ID NO: 101231 - DNA, 1728 bp, Homo sapiens
gaattagaagaagagaattaaggaatatcagagtatgctgcacataggaaaggtaagtactgattcctcctacttgcttctgtgccatgggtataatttgcaaatagaactgggttaatgtggtcaaggacaactgaggtggaaacactggcctggataaaagcactttgggccaggcatggtggtttatgcccgtcatcccattacttttggaggcagaggtgggtggatcacctgaggtcggggtttgagaccagcctggccaacatggtgaaactctgtctctactaaaaatagaaaacttagccaggtgtggtggcatactcctgtaatcttagctactcgggaggctgaggcaggagaatcacttcaacccaggaggcggaggttgcagggagccgagaccgcacccttgcactccagcctgggcaacaagagcgaaactccatctcaaaaaaaaaaaagtaatttgtatgtcaataagccccaagaaatcccttacttattcttttcacagatcttttctcaccttcatcctctgaaacttttgcattttttgcatagagaaaagagttgaaggttcaagaaccacatacacaagaggatacgtcatttgcaaaaatatccacagttgccacagaaagatactggcaaaaattctgactgacccaggttaagattcaggatgctgccggtggtggaggttttgtccgttttcgtcgtgataggagctgacagttgaggagagaagggctttgggctgccggataaactccctgcttgtcccgtcttggtggaggctggtgaagctgaaaaagtatggcattgttaaaagacaggtttacaaataaacaagtagaacgtgtaggtgtggtgtagggagagaatggagagattatgaaattgtgtttgatttcagcaaggccgctacagtatcacgaatggggtggggtggagcatagcaggttggccatttattttcagcaaagggctttaaccggatgtgaaaccgttaaagccacaaatgaagaaggtctccccagttactctattaagcacaaagctctaagacaaatcggctaagctgccactgaaattggtttggcccattcacggatataaatctcaacataaatagcgattaaaccaacccccacatggtccagatgtggagaacgggagccaggcttacaaatgcgtatcatctgtttgtggaaagacaccacggccagctcacacgcagccactgcacctgccagggaccaacttggccccttgggaaatctccagctcccatttcaaaggttcttgaggctatgtaaagccaaacccagtaccagatggagtgagggagacgttggtaaattatgtccttctttactgtatttcaaactttcacaggaggagagagaactgtacctatgcctaaggcttttaaaaataccttaaaatgacctacgacctgcttctcccctgcctcatttcacagggttaggacaataaaccacttacgtttaaaaaagcaagcattcataggggccaacaagcgtcctaaagatccttcaaatcctgcccctttgtccttgcccctccatggtactgggactgtcctgttaatgcctcttgggcccatttaaaaacagctgggactaaaggcatcactaacaacaatgacagccaactcttccaagatgagcaagaaacattctgagttgatctggtgctgga

SEQ ID NO: 101232 - DNA, 2415 bp, Homo sapiens
atccgcccacctcggcctcccaaagtgctggaattacaggcatgagccactgcacccagccatcagtgactttaaattctgtaataaagaactaatttatgacaaaaacatattgatttcacaattataaaaaaaggggggggggagtaatatgaaacctctttttttttctttgagacagagtctcactctgttgcccaggctggagtgcagtggtgcgatctcggctcactgcaagctctgcctcccggattcaagcaattctcttgcctcagcctcccaagtagctgggattacaggcacatgccaccacgcccagctaattttttgtatttttagtagagacggggtttcaccgtgttagccaggatggtctcaatctcctgacctcgtgatccgcttgtctcgacctcccaaagtgctgggattacagacgtgaaccaccgcacccggaccctctttcctttcttaaatggtaactcacagtgtagctaccagaccaaaggaccattagcccagagggtggtgaatgtcaggccccccgactctgaccctaatacatattaataacttacatcgagatcgcgcaaacaaataccggtgaaggtaaccattctggccaggaggtctatataaaggggaaactacaaaaatcactcagaatattaaccacttaggccacctagctagcaagattataggacactgtgagttaaagacttctggctgagcaaagtgcttcttagaaagctaaatatccagttctaaggattataggcacacagctctgagttctccaatcttctaaacaaaaacaagatttctacactgttgtacaagttttatgcaataacatttcaatctgtagttttatgttactggttacaaaactttcactggtgaggctactatattattttctattctatgacatggcaattattttacacgattttgggtgaactactgtcttatctcaattatattatcctgactgtggaagcattttaatacaaatttcccatctccctccactaaatgctattatcactgctaacagcagatggcagtagggtgcagagaaaggaaacaggtatggatgcagaatctggctgtggggactttcacacctcccttacactctgcatggctctcaatttgccttctgtaaaatgactcagtttcttctaatcctcttagtctgtaatagtggttggcaaactatagctcaagggtcaaattgggcatatcacctgttcctgaggggcctgcaagcgaagaaaggtattttaacatttttttaatggttggggggaaaagaattaatagctcatgaaacatgcaacttatatgaaatttaaattccagtgtctggacacctcgggagactgaggcgggtggattacctgaggtcaggagtttcagaccagcctggccaacatggtgaaaccctgtctctactaaaaatacaaagaacatctgggcatggtagcgcatgcctgtaattccagctactcaggaggctgaggtgggaggattacttgaacccaggaggtggaggttgcagtgagccgagatcgtggcactgcgctctagcctgggcaacagagcaagacttcatctcaaaaaatataaaaatttaaataagtaaataaattccggtgtccattaaaaaagtcttaactgtctacggctgctctattttcttctatctagctagctgtttattgagctagggtctcactctattgtccaggctggagtgcagtggcacaatcacaggtcattgtggcctcaaactcctaggcttaattgatcctcccagctcagcctcctcagtagctgggactacagcagcttgtggctacgttactgcaacaatgactaaatagttgcagagttggaaaaaagacccaaaaagcctaaaatacatactatctagcccctgacagaaaagggggcaatttgtaagagtaaaataattttcaatatcactctctcttcctacactacacattggctaattcatgattagtaaaatgacctaagcacataccagcaaggagattatattttaggaaagggactttaaagtctactcaaatgggggattcaactaacttctcacctaaaaagcactcaaagaatgaggtatatttttccaggaagtctgatgtcatttatctttctccttttgtacctcccaagggaagacagaagctaaattaaacacattatccctgttcttatattcctataaaactgaattttttgaaatgtggtgcaggagaaccaatggtcatatatatgccatgtttcattttactagttatgtattaatttcacatatattaggaaaagccacaacaagcaatttaaacacacgagcctatacattgtgtttagcttaggaca

SEQ ID NO: 101233 - DNA, 1065 bp, Homo sapiens
gcttgttaaatggatcattaattaatccttcaaaccaagtttttttttttttttttttaatagaataagaatcttggcaaacatgcttggctaatttggttcacatcaagaaaaaagcaatcttggaaattactgaagttgacttaaactctctttatcttttgcccttctagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacaggtcagctccgtgcgggggagcggggaggaggccccttggacacgggggtttcccatgggtgcacacttggtgggcccaagcaggtgagcatcaagcaatcgtggggaactgtagggggccacagagcagattttcaagaagtcaccagtggagttcttgctgctagtaacccagaaatgagaaaagtgtccccaaaaggccacctggaggttatacctagaagtagatggagatggccagaaatcttgtggagttctgttcagatgtcgctgcattttggattattgactttccataacacaaataattttgttttagttgaaattgtatttttctgtcaaaaccctacattcatattaaacagtgcaaatcttagagaaacacatatgataaaaaataatacttgacca

SEQ ID NO: 101234 - DNA, 1417 bp, Homo sapiens
ataacctccaggtggccttttggggacacttttctcatttctgggttactagcagcaagaactccactggtgacttcttgaaaatctgctctgtggccccctacagttccccacgattgcttgatgctcacctgcttgggcccaccaagtgtgcacccatgggaaacccccgtgtccaaggggcctcctccccgctcccccgcacggagctgacctgtgctcttatccaggaagtccatggactcctcgctcgcactgaagtggctcgacgtggccttcttctcagcatcctgctccacgtcggagcccgtgtgcacagaagagtttgtgctcatgggggagcgcggcatatccgacaaggaaatccggcggcctgtgcccccactcagcacaggcttgctcatcaggatcttgggggatgccgtcatgtcaaagttgagcttgaccttctcctgcttgtctatcttggcagtgccggcgctggggttggtgggatcgagcagcatttgatactggctgttgggtgtgtagggtgtcctaaatggagagtaattaaaaaccccaaacttcctgcggatgttctccacgtaaacctccatctcttgcatggcactgttgaagatgctcttagtctttttcacagaaaaaggaatttctttagacatgaggtagcaattatttattggaacccaggccctagaagggcaaaagataaagagagtttaagtcaacttcagtaatttccaagattgcttttttcttgatgtgaaccaaattagccaagcatgtttgccaagattcttattctattaaaaaaaaaaaaaaaaaaacttggtttgaaggattaattaatgatccatttaacaagcatgttctaccataacagaacatgaacaacaaaacttcggcgaaaacatttaaaagtgcaacagacttagtcattgtgagccactaaagaaacaatcctctttggttttctcttagtagagaaaaataaatcagccactgcatctgacaacacctctgaaaagagacttattcctcaggttacactcagacataaaaagcttccttttcccattgccatttgaaataggaacagaaggaaactttggaatactgcatccctaaaaggaggtacatgtttttgaatgtaagataattcacacagaaaatcactgaaaaaggagcccattcgcctccaggcgtgcactttccacctcccatcccaggccagttccatcttcctaacatccatatcccacattccaattttgctctgcaaagacccatgacagcatgtttttgcagaacaaacaatgccagcagcagcttttctggaaccagagccagtggcccccgggggaggtgcaaacaccacaaccgctgctgcgggtgaccacgcagctgatacagg

SEQ ID NO: 101235 - DNA, 1135 bp, Homo sapiens
gctgaggcacgagaattgcttgaacgcaggaagcgaaagttgcaatgagcccagatcgggccactgcactccagcctgggcagcagagtgagactctggaggaaaaaaaaaaaatggtggctgtggctgctctgcagggaatgtctataatgggggtaaaagtggaagtgggtgacgtggggagttagctgttgcattggtccagagagaaaggacggtggcttggactgggtggaagcattgggagcgatacatagtggttggattcatctccaaggtgttccctctatgggactttaaaacatcttaaccttcaaaatcatcaagcattgattgaggtccacaagatatccacccctggggtgacacattctaatgtatttttgctttacagatgaatgaaatcgaagtatgtccagaatgttatctagctgcttgccaaaaacgagataactggttttgtgagccttgtgtaagttggatttactttgcttatttcatttactgaaccctgtgccttggatgactaccctgagacagctttttccaggtggcttattagatgaaactttggatggagttttaagataattttttgctgataaaattatggcagaaggaaagtaatccaggtaggataaacctcttaggctgaaagttcatgtgccagagatagcatcatggcttcctgggttgattagcctgggcagactgcaaggtgcagcataaaagagagctcatcagagatgtgggatgcagcaaagcttttcagataataagatgagcttaaatcagtgtggatttacaaatcatgttggttctattttaagaggtttgaaaatacttccctggattaactccatagtccctccaaaacatgattcttgggggaaataaagtcaccctagtttccctgtggatctgccttctccaagctggggttctgcagagagaagtacattgttgggctgcactggtgtgtgtgttgggggtggggttggtgggttggagtgggtttggaggcaagattaggcaaggaaagttgagaaaatatactttgcatctcttcgtgcttttggagattaacaccggaatagctaagccttcaataaagaataaaggtagcaaaatactg

SEQ ID NO: 101236 - DNA, 1401 bp, Homo sapiens
agcaataaagatgtggcttcttagaatttgacttactctactgattaggttttttcttgaatgcctgaaggttttaaaagttcatgctaaaattccacgctgaaaattacacttggaacactgtagattgtgcacattattctgatgctgattttccaactatttgcagcaaaatatgggcagtgaaatgcatccacgaggaagaaacattacttcatattgtcttccccaataactcccaaaccataaatccagtctgtttttaggaaattgcacataccttcatggtgtggtggaaaaaaggaggcattcaaaagagatggagttggaaacctgactttatattaattaagttaagagctgtggaactttagatacattccttaacattactgtatctcagtttgcctttctgtaaaatgggtatgataataagtacttcattaaattattgtgaggtttgtgtgagaccatatgactaataataaataatgtataaatatatgaaataccctgtttggccgggcgcggtggctcaagcctgtaatcccagcagtttgggaggctgaggcgggcggatcatctgaggtcaggagttcgagaccagcctgaccaacatggagaaaccccgtctctactaaaaatacaaaatgagctgggcatggtagcacacgcctgtaattccagctattcaggaggctgaggcaggggaattgcttgaacccgggaggtggaggttgcagtgagccgagatcacgccattgcactccaacctgggcaataagagcaaaactccacctccaaaaaaaaaaaaaaaaaaaaaaaactaaataaataaactatcctgtttattggaagaagctacatgataaatgacagctactataagatgagaaaattccagttattgtgttaaattcaaagagtgcatttttatagggttatagatctcaaaaataaaagcattctttagtcggggtgttgtaggttaaaaagaagcatcttgggaaatgaatagaagaacactaattgatttggcaaatgactgctacaaaaattatgtggggacacaagagtcactgactgtggcttgtctagactcactgtgattatgctccatcgcttttcttcccagaatgcgaaaaagaaaatgtatggctgcacagaagccttcctggctgatgcaaagtggattttgcacaactgcatcatttataatgggggtgagtggcttagatgactcctaagaaagagtatgctgtgtatgtgttgcacaaattcctgtccttcatgaaaaatcaggctcttaattcatattgagaatacttgcgtatagattgtgctaatatatgtgaataggaggcagtgaccaagttcattttaaggtatgagctgacatct

SEQ ID NO: 101237 - DNA, 1115 bp, Homo sapiens
ctgggactacggatgcgtgccaccatgcctggctagtttttgtatttttttgtagagatggagtttcatcatgttgccaggctggtctccaacactggggctcaagcaatctacccacctcagcctccccaagtgctgggattacaggcgtgagccaccacgcccacctggcctttgctttcatatcccattcttgaaacctaaaggttataataatgatgatttttcaggcccctgtttagccacatcttttctcagatcatgtcgtcttcctgagctaaaaatgcttcctgataaggaaatagattgatacgctttttaatagttacccactgatctggtacattttgttccaggagtctttgctaagtgaaacaacaagtctcattgggatgagaattgctttttgtctgtcagttgactgaaaaaatagaaatcagtacatggatggtaatttcttttttctaaccggacgtttatgtatgactttgactttgtagaaaattacagtagcagaatgcatcgagacccagagtaaagccatgacaatgctcaccattgaacagttatcctacctgctcaagtttgccattcagaaaatgaaacagccaggggtaagaagaaagttcctcttggtatacgcgtaaatgaacgtaatgacatatgttttgttctgttaatagcttagctttttaggtacctgatgtattctttgggcctccttgcatccccaaattcaagtatgtgtaaatcacacatgaggtatgatgccattcagttaattctctgtcgtagtaagcactgtatgtcccagaggagtttaattggtacattagtctgttttcacactattgtaaagatattacctgagactgagtaatttatgaagaaaagaggtttttttttttgtttgtttgtttgtttttctgagatggagacttgctctgtcacccaggctggagtgcagtggtgtgatgttggctcactgcaacctctgcctcccaggttcaagtgattctcgtgcctctgcctccccagtagctgggattacaggctcccgccaccgcactggctatttttttttttgtatttttagtagagatggggtttcacca

SEQ ID NO: 101238 - DNA, 5224 bp, Homo sapiens
tatgattttcagtcaataaactattggaactgtctatatatgaggtctgtattagaaatctgacagcatttctgtctatcaatgataaccgtttagtaaatccccattcgtagtatcatcaaaaagtatgcaggatctcaccaacgtagaagatatttgtggaggaaaccatcatgttttactgaaggacagaaaagaaacatgttatacagtgagatttattcgagggtagggaatatggttgtggctaaactattctctgtggttttattgccagggaattgaggctcaaagtgggttgagtcactttcttaaggtcacatagctagttaccaggtctttttgaatcttcccacaggacttacatgtgtacttcctaaataggatttcgtatttgtttctgatagacattttcattatgagtttctcctgagtgagtttttgtgttcaagtgtggctttgctggattccataatataccataatattccataatataccaggaagaggtcgacctcccatgagttggccacccatctcatctttctgccattgctgatgtcaaataagagatatgtctccctagcaaaaacaaggacctaccatgctcaagaattatggctttaggaagcctcttgttggctcataaatgctttatgtattgggggtaaacttaaaaattagataactggccgggtgcagtggctcacgcctgtaatcccagcactttgggaggccgaggtgggcagatcacgaggtcaggagattgagaccagcctggctaacatggtgaaaccccatctctactaaaaatacgaaaattagccgggcatggtggcacacgcctgtagtcccagctactcaggaggctgaggcaggagaatggcttgaacccgggaggcagaggttgcagtggagccaagattgtgccactgcactctagcctgggcaacagagcgagactccgtctctgaaaaaaaagaaaaagaaaaagaaaaaaaaaattaggtaaccattttttggtgactgaaaccctattgatctattctctaaatgtctgccatttgaagaatcccagggcaaactactatgcttttattggctttgtaaattgggacttccataagttgggcttccaaccacattagcattgttagtatggtggcattttgataaacaggcatacattatatcaccccatttaatagcaacacagtaccatgaagtgttaggcattatcatctccattttacagatgagaaaattgaagctgagaggttaagagacttgtccaaggtcatgcacctggttaatggtagagttaaaatctgaacctaggtagatgtgggttataggcaatgtgccattctgctagggctgccttgtaactcttagataccagcttttaatcgtggcctcttaaaatagaaaaaagaaaaatcctcataattttaacaacttgctaattatatatttagtagagtaacctaagatagtttggctttttaatgaatttgtgaaatgctgttattttcttttgttgttattgatgtacttgttcaaattccttttgagaatgcacatttgttttgaaaccaaacctgtctttttgcctacatttcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgaggttagttcctgatgaatgaatgcattacctgcctcgtttcctctcctttctctttcttccttttatttttaaatttacaaataatccagatagatggaaaagagaaatttcttgctttccacctgttctatcctggtcacccccttcttgaccaacaccggcagtggctgcagtactgcagctcttggaaagacaattgcacggaatattatttctgatttctcatgagtccttggattccttggagatctgtagtcgtcatctctgcatcttctatgatgaactttttgaaagttaactcccaaatcatgaacggctcacacattttgaaaagatctcattctgttttctccgtcttggatgttgttgcctgccgcatcattgaatcatcagcagtagccaagctgagaagaccacgtttggttgcatgttccctgtagtggccgtctggtgctttcttttgtgcaacaagtatttcttgagtgcctattaggtgctgggaattcgacagtgcacaaaaacaggcatggatcatttttttttttccagcagaaaaggacaaaaaccaaaataaataaagttccatataatgaattaaaagaaaagtgctgtgaagaaaacaaattcaggatgggaataggaggtccaagggagtgcaaggtgttttcattttgaatgtggtggtctgggaaagcctcactaaaatttgagaaagacttgatgaaagagaggagtgagccatgcagccatttgggggacaacttccaggcagacggccggaggcagcagtgcatgggcgtagtcggggcagtgtgtatgcctcctgtgtagcaaaccccaggcaccctttattaagccaactattagggtttccactgtttggaggtggctcctgttcttggagacccccaactctgatgtttttttggaattgctgaaaataaaaatgtcatctccacaattatttaatgtggaatgtctcttggattcaaagatacattggaggctgagcgtggtggctcatgattgtaatcccagcactttgggaggccgaggcaggagaattgcttgatcccaggagttcaagacctgtctgggcaacatagggagacccccatctccacagaaagtttaaagaaattagctgggcatggtggtatgtgcctgtagtcccagctacttgggagggtgagcttggaggatcacttgagccgagatggttgaggctgcagtgagctgtaatcatgccactgtattctatcctgggaaataaagcaagatcatgtctcaaaaaaagaaaaaaaaaaggtacattggagtttgatctcaaatgtggaagctttctatgtgtgaaatggaaagatcatccagatgtctttagtagggaaaaaagccagctataggacagtgtctgtcatacttttgtgtagggagaggagaaaaataagaaatacataaaaagaaagtagacatgaaatcaatatgatgacgatgatattgtaatggtgtcctctctaaaatggcaaaaggcggctgccgttctctttgggttactctagatggagaaatatgtagggtttgcattgtacagcggcgccctcctctgcacgcagaggctgacctcattctactacatttgtcatgggatctggaaccttcaccaattttctttagtcttggccaacttttcccaattgtttaatgatattacaaagatgacagcagctctgataggatgcttttgctgcaaataatagttcttttatttttatttgagacatggtcttgttctgttgcccaggctggagtgcagtaacgagatcttgctcactgcagccctgaccacctgggctcaagcgatcctcccacctgagcctcctgagtacctgggaccacaggtacacaccaccacacctagctacttactaagttttttgtagagacagggtcttgctatgttacctaggctggtcttgaactcctaggctcaagcgatcctcccaccttgacctcccaaattgttgggattataggtgtgagccactgtgcccggccaacaaaatatagttgttaatgcaagcactagttcctgatagaagggggctgaaacaatgtggatttattatcatcagaacctagaggcagggccaggccagagtttattcagagccagactctttccatctcattgttgaggtgacatgttctccatggccataagttgactgctagggttcaggtattatgtgtggatagacaaaaattctcccaaaaggaggatgtctctccttgcatctctttttatcaagcagaaagattttgtccatcatcccccagctgatttgcccctgggctcattggtcagtattgcatcaccagtccttgtacaaaaaagccttgaaaattgcatatgtggtgctttttgtgttgtgggaaccaggcactgccagccaggaagaaggagtggggggtgagagggaatgaatgatagttgggcaggcagcccaagtgtttgccatggataagttacctggaaacaaaccagaatcaaacaaacaggtgctctgtgtctaagattcggggctctgaatttcttccagggatgagttgttacggcagtcaactgggaagactgaacgttgcaaggctgtggtagctaagcaaatagatgcatgcgtcatgcactgttttcagcttctgagtgactcttgtgttggccttttcctcgacaaccaacgagacacatctgagagttccttttggaggccccagagatgtgaaaaatggaaacagaatccaaattaattggagaaaacttttctcagctctccctacacagatggttaaagagtgtttcctgacatgatcagaatttgctatttttgttgttgctgctacataaggattctgaagccttaagatgtagtaccagatttacatagcagaatctggtttcagacgttcctttgggtctcttctttgatgggaatttcccttaggagctgatatctattacccatggagatagacagttaggttaggttgtgctccttgtgtactttgacacagtgccttaggtgggttcaaagtaagggagatggacaatgaagtcatacgtattattagtccactgctttcccttgtaatctttctgcagggaagtctgtccctttccatcagtgatgtcattgaattaatgccttgtcagtttcctgaatgacagcccagaaccttaagaggatcaggataaatggttgataagtacccatcctgtgaagtaatcaccctgaaatcatccgtggcctttactttctttttttatacatacatatttttgagacagggtctcgctctgtcacccaggctagagtgcagtggcac

SEQ ID NO: 101239 - DNA, 1054 bp, Homo sapiens
agttttctcatctgtaaaatgaagggtttagaggctgggcctggtgactcatgcctgtaaccccagcactttgggaggccgaggcaggtcgatcacgaggtcaagagattgagaccatcctggccaacctggtgaaaccccgcctttactaaaaatacaaaaaaagttagctgagcatggtggcatgcgcctgtagtcccagctactcgggaggccgaggcaggagaatcgcttgaacccgggaggcggaggttgcagtgagccgagatcgcgccactgcactccagcctggtgacagagcgagactctatctcagaaaaaaaaaaaaatgaagggtttaggttctttggtaagaggcattgccaggggcaggcttaggtaattggtcacagttccttttcgtggaagcacagaggattctttccagagcccaccctcccttggcagctagcaccagtcagctagataggaaaaatccgttcaccgtttggatcttttctaagggacattctagctttagaattctctggggcaggctagatactcttcagattacaaaaatggagaggcactttagtggacttactggtggattgtatctatccccctggactatgaggtcggatctcatagcactgaaggaaacagtgtcccgttggttctgatgccacttgttcttcagcagtgattcctagggatgcattcatccactttgtgcattattgagtagaggagtgggccctggggatggaaagttgaattaaacgagattgttgctttcatggaaggagacctagcaacggttaaatacccaggcctgtgagaggtgtgtgtttctgagcatgaatctattttcactctcaaaattacatagtgaaatgccagccctgcttttgctccgtggctgtgggcaagttaacctcttttgtgcctagttttctcatctactgaaatggggataatgatactaccacaaatttcacagggttgtgaacattgagctaaatgccataaatagtgatattaaaaatgaaacataaagtcagtttctctg

SEQ ID NO: 101240 - DNA, 1026 bp, Homo sapiens
aggccagaagggaacttgcctcaagccaagcaaccgcttccagacagagctgagaactagtcctgtgggcatggcccaggaggggaaaactcctcaggccacatggggaaaacagtcctaaaagcatgaaaaaaaaaaaaatacaaatacaaggaaacgccccaaaccctaaagaattatataccctcatctcatctgggtccctgctctgtccccgaaacagatctgaaaacccactggaaatttctacacaggcccatttttagccatctttttttgtccaaggcaaatgacagccagcgcaaggcagctaactaaatccaagaaagccggcgcttacaaggatccagaggttcagcgctactagctggcctctgtcccaccagtgaggacaccgttcccagcggctgctttacctgctccttattgttactgttcagtaagccaggtttctttttctttttaatggggcttgttgatgtgtcctgcggcgagtggccattggaagaatgtggagggctggggaactttcttttctgggctgttctctctgcagagccaggatctgaaagagatacaggaccacaggttttaaagcagtcagggaggcctgggccccacagggaggaggtgtggaggaaccaagtgtgggaacagagtgcattctgtcccccaactcccgaagccacttcagtgttcctcctcccagaatatacgtgcccccttcttcactgtctgcttcaacagtcagacaagtatttctttgacctatgtaacatttttgtaaaatcttaacttgttgccaagatacaaaaatcaggaaatttcatgtaataacctagatttttcacttttcttaaaaaaacagattaggagggccaggcacggtggctcatgcctgtaatcccagcactttgggaggccaaagtgggcagatcacaaggtcaagagttcaagaccagcctggccaataccgtctctactaagagtacaaaaattagcctggtgtggtggcacatgccttta

SEQ ID NO: 101241 - DNA, 1022 bp, Homo sapiens
ctgtgggctgtacccaaagcacttgaaacagacgtctgcaaacagaggactggttttaccatgttggcccagctggtcttgatctcgttaacatggttttaccatgttggccaggctggtcttgatcttgtgacctcaggtgatccgcctgcctcggcctcccaaggtgctggggtttataggtgtgagccaccgtgcctggctgaagtgtacatgtgtttaaatgagatgctgaaagatgaaaagaaggggtgcatgaacaagagtggggctggtgagaatccacaaggatgtaatttgtattgatctttttggaggagggtctcaaacacgaggcccagaggcggtgggagcacgggaacttcccggtgggtggggtgtgttctttccacacaattacagttcatagcctattaaacacgaataaatgatgttgttttccacaaaggagaatgtatgccttcatttccttgaagtatggccttcctggtctatcttctttggtttcctgcttttgcaatcaggcatgggcatggacaagtcgtatttctttggggtaagaacaatactggtccctgtgtgatgactgttggcaggttggcctcggtctcatcagcagggacgtagtggggaagagtggcgattgcacatgtttccatctaaaagtggggtagctgttactcagctgtatctggtgctataggggcctgcaggtcctaatctgtttttttttttttttttttttcacgtcggaggcttgccctgtcccccaggctggagtgcagtgacacaatctcggctcactgaaatctccgcctcctgggttcaagcagttctcctgcctcagcctcccgagtagctgggattaaaggcatgtgccaccacaccaggctaatttttgtactcttagtagagacggtattggccaggctggtcttgaactcttgaccttgtgatctgcccactttggcctcccaaagtgctgggattacaggcatgagccaccgtgcctggccctccta

SEQ ID NO: 101242 - DNA, 2776 bp, Homo sapiens
tacgtgaattaactcattgacttcttcgataactttacaaggtaccacttgtaaagtggtaaactctctgaggcacagagaggttaagttgcctttttacggtcacactgcaggggagagcacagccaggttctgcatgcattttgacgccagaaagctgattccccaccactgtggcatcctgcctctctgtcgtttgcaacctggcccatgagagcatatgccttgacctatgtgtcctggtttgcccgggacccagctaagcacatggttggttgccctactcctgtggcctgtcatgcctgtctcagcctgtggaccaagcttctcttttcgttcaggccccagcaggcttgctgtcgacatcattaaggaaattaaacacccacaaaaacacaagaagctcccggcctttcagctgcggccctttcccttgagggaggagacaattccctgtaatggtgtgtcatttcctagcccctggagaacggcatgtgctgtgactcaggcaccggatgtgggggcaggagtggggtggagggcgggtacctgatgtggcctgctggggaggcctagccttgatggaggctggaaaaggggaggtgagttggccctggagcccccagcctatttcagggactgatgccactgtttggaaattgggaggtgaatgtgctttctggggactgcctttgagagaacggtgtcatcagtgaatgacacgactttccaccttttcccagttcctgaaactgtttgttggaccttctctgtccctatacttccatctgcagtttaggggaaaaaaggcaaaatgagagtgtgctcttaaatcatagaccctaaattagggagtcctcttgctacagggctgaggatgaggccctcctggtacaaggccatgtggtacagagattagaagctggccctcggagtcccactgcctgggttgaaatcccagtactgctctggccctcggagcctcactgcctgggttcaaatcccagcactgctccttggtagctttgtgatctcaggcaggtgacttagtggggactacaggaaatgcattttgaacattgcctagaatatcacatataataaaagaaactcttagctttctttctttttttttttttttgagagcgagtcttgctctgtcacccaggctggagtgcagtggtgcgatcttggctcaccacaacctccacctccctggttcaagcaattttcctgcctcagcctcccaagtagctgggattacaggcgcacaccaccactcctggctaatttttttgtatttttagtagagatggggtttcaccatgttggccagactggttttgaactcctgacctcaggcaatctgcctgcctcggcctcccaaagtgctgggattatgggtgtgagccaccacacctggccgaaactcttagctcttcatactcttggctcaggaaagctatgagcctgtgttatcttgaattaagatgccccttaaatcaaaagacatccaggaagtgctgagctccaggatgatttctggtggatcacaggcttgggaaggatctcctcatatgcttggttccttttttttttttttttgagacaaagtctcgttctgttgcccaggctggagtacaatggcatgatctcggcttactgcaacctccgcctcctgggttcaagcaattttcctgcctcagcctcctgagtagctgggattataggtgctcaccatcacattcagctaatttttgtatttttagtagagacggggtttcaccatgttggtcaggctggtctcgaactcctgaccttgtgatctgcccaccttggcctcccaaagtgctgggattacaggcgtgagccaccgtgcccggcctcatgcctggttcttaatacccagtagaccttcccatattgttacaatttcagcaaaatgtcacaaggagaggaaaattctgctgctttccgctccatgccaagctgttttcctgagtcactgctctgtcctctccataaggctgcattcctccctcacccacgttaactcattcagaaccactcatttttgggggatgggtgagaggcagagggttgtgagtgagccagccgggcggggtcacaggtcctactccctcagaaaaggcagcagaaaagtctttcagatccagggtgaaccagtggttcagtcgacagtggctgtttgtcattgttcaaagtttatagatgaaatgcactgggcaatacatccttgtcagaattaaatcattaaagaagaaaaaattgactcagctttctggaaagggtccttatggagcctgggtaccacggctacagtcaggtgtacacccaccagtccatcatcaccagaggcccagcccccactggagtggggggcatttaagtaataatgcccccctgctgtctcatccctccgaaggataccgaatccagcaggcatttcctaattcttctccctacaacccttcattgaaatctcctgctgttgactgatgtgtctgttgtttggaacctatcaaatttcgaccccttggatacagtcactgaactctcatcaactccagggggaattggtgtttgtaacagcaaacagaattggggtttttatgttttgctgaaactagaaggtttggaatactctcaggtgtgggcatgcttgggctaggacccacctccccctacctcttgctgagcagaacctcagtttccccctttgtttcctggtgggcttgggtgatagtcccttgcc

SEQ ID NO: 101243 - DNA, 1201 bp, Homo sapiens
gttgtcgtttttccagagggcctcatcccagctggggaggagaaagggccgcggttgctattgcctctagttgttgagggctaaacactgaattcaattgtaaatcagcctcttttctgtagattgaagcaatttctgtcctgccaggcgagtttggaagttcgccttttacatatgaatgtgccctttaatcaccacttctgcattattgagagaagggtggaggaggctgtgtctagtgggaaaggattatacctcaagtataaaagatgggttttctcatttctaggagaggggcatcagaactggagaatctgaaacaattactaaaaatgttaaaaacaacttcaaaatgcaaaccacagctgtttccctccccccaggctcccttctgatattgtcacctcggccagcagaacaactgcagttcctcgtatttattcacaatcccacgaaatcaatggctcttcggtgcactgcaccggagactttcagctcagccgagctgctgttgagggtgataaattataggcgaaagcccggggacatgaaggcaagtcgctgggtttcagactgcctgattgcaaagaggtgacagtgtccttgccccgccgggcgacctaatgcgtacaagaccggggctggcctggtaagtggtgactcttagcctgttctctttgcttcttcctcctccccctgggagaggccgctgaggatccggaagcaggaatgtctgctgtgggtgagcctctgttctcttttgaacaagagaggctaggccctctgagcagccgcactttctcaatggcaggtaagtgcctcctcttggcgttccctgcccctcgcatgttctgcctccgaggtacttgatgttcctggtgaaatgccattttccccaagttgagagtgacctttcattccacagcctcatttccattccagccctccctatcccggctctggatgagaagttcctgttgatttgcagagattctttataagcacagttcaggccagtgcagtcctctggaggagagggctcagcccggcagctctggcaggcccaagtcagccagggtgcagaccggtcctcgagtttctgtgggtctaagagacggtcagcgttggaggaaataatcatttgctaatgcgagcggttttcatttacaagttcctcctggcttaggcattctctgctgcg

SEQ ID NO: 101244 - DNA, 1795 bp, Homo sapiens
tggcattctttttttttttttttttttgagacagagtctcgctctggcgcccaggttggagtgcaatggcatgatctcggcttatggcaacctccgcctcccgggttcaagtgattctcctgccttagccccccgagcagctgggattacaggcgtcctccaccaccacacccagctaatttttgtatttgtagtggagacaggttttcaccatgttggccaggatggtctcgatctcttgactttgtgatccatcagcctcggcctcccaaagtgctgggattacaggcgtgagccaccacgcccggccaggtttggcattcttaataacacttggcagatgactaggactctgaggctcagagaggtgaagtaacctgttgggacacacagccatgtgagccaggaccagctctctccctagcttgatgagcctcatttgagtggagaggggagtgcagttggaggagtcctgggggaaggtcagtggaggtggggtggggctgggattgtgggccatctggagaattctgctttgattttcaaggaagttctgagccctggagggattttgagcctggcttccttgagctcctgacagcctgagggggtttattgtgaatatttgtgtttctcatcagtgaaccctttttaaaaacaggcttggaagaggtagtctggtgaaggtacagaaagatttgggggccaggtgcaacagctcatgcctgtagtcctagtactttgagaggctgaggtgggaggatcacttgaccccagaagtttgagactaggagatcccatcgctacgaaaaataaaaaattaagtggtcatggtattgcacaccgtggtgttagctacttgggagcctgaggtgggaggatcgcttgaacctgggaggttgaggctgcagtgagccatgactgtgccactgtcctgcagcctggctgacagagtgagtccctgtctcccccaaaaaagagaaaagttgggggaaatgagtttgaaatttctcggttattgcctttttctgtgccctggccccctcttccccccaggagaataatggtaataaagtatggtgctttgatgtgccagatgcctttcattcactttgtatgcattatcttatttaatcctcacaacccttttgggaagagcctaatagttccaactgaatgactgagtcacagagaggctaagaaacttgcccaaggtcacacagctggcaggtgccagcacctggattcagacctagtagtctggctccagagcccacacactgaacgacaatgctgtgttgacgttggccaatgccaagcatgccctttgtgatggagaattaccaggtggcactcacaagcctaggagagacagttgacctgtacagtgaagggctttagagtggaactcaaccgtgatggaggtggggcgtgctgtgtcgatctgcttgtcttgaagcatataaatgactttgcctctctgagcctcacctataaaatgggtacagaaataccatcctggctgggtgtggtggctcacgcctgtaatcccagcactttgggaggccgaggcaggtggatcacgaggtcaggagatcgagaccatcctggccaacatagtgaaaatgggtgtggtggtacgtgcctgtagtcccagctacttgggagactgaggcaggggaatcacttgaacccaggaggcggaggtcgcagtgagccaagatcgcgccactgcactccagcctggagacagagtgagattctgtgctgaaaaaaaaaaaaaaaaaaaagaaat

SEQ ID NO: 101245 - DNA, 2763 bp, Homo sapiens
tgaacatgtttttttttttcctccagcctgcttttcttgggaagtttagggactctgttcccctgtgacatgacccgggtcagggtccttcggttctgagcaggaaagggatggactgcaggtggtctgttggtgtgaagctgctcccactgcattggtgggaaggctggaggtccaggccactctcgggagtagagccagcccggagcctcctcagggacaatagcgcaaagtccatgtgcacgtctctggccagggaagggctaatatcctggacacctggacccaccaacgctgtccccactgggaaagagatgggtcctcaaaaggagataaggtgaccactctaccatcttatgaacctggcaacgtgtttttctctacttgcacttagaaaacaggtgctgagccgtcctcttcttgggaaacttagaaactctgacaataattggtgcagaattcctcagtcctattcctacatctagtccatgtgacctttcagtttctctaactgaatttcaatttttacgcccctctccccttgacacatactcacttattaactgagtaattcccaagccagtcattgccattatgccagccttggcatttagtagagcgttttagctctcaggagacaaagctttcgagctttcaagatgtcaggttgacatttgtgtccgagggtaatgatcctgctgaaagatgctcctacatcaatgggaagtgccatctcgatgccaggtgtgtttgcgtggctaatattttctgagtacttcatggcatgatatgcaaattacttcatttaattttcatactaattccatgatgtgggtgtgtcattcccattttacagttaaggaaactgaggctcagatgaattaaggaagtgtcaaagtagggatggaactagggtcaggttttatctttatttatttattaattatatagagggttattgccgtgttgcccaggctgctcttgaactcgtgggctcaagggatccacctacctcggctttccaaagtgctaggtttacaggcgtgagccaccactcccggccctttgatttattttattttattttatttatttatttttttgagacagagtctccctccatcacccaggctggagtgcctatctcggcttactgcagcctccgcctcctggattcaattgattctcgtgtctcagcctccggtgtagctggggttacaggcgcctgccaccacgcccggctaatttttgtatttttagtagagacagggtttcactgtgttggccaggctggtctcgaattcctgacctcaggtgatccacccgccttggcctcccaaagtgctgggattacaggcgtgagccaccgtgcctggctggccctttgatttttaaacctttttttttttttttgataagagtgtttaatgtccctagattttaaacctttgtacttaaccatgacctgtattccaagggttgcaagtcaaatgcctgaagggcccagcaggtagatcagtgattgtggctggcatctggggatgcagggggaaggggagctttggtgaatgggagagtgtgccaaagtggggagggtgcctccatctgattgctgaccagcaggaatatggctcatccgctgtggccagctgggattttcttttcccctgtaaaactgcctcatttagaaatgtggtctgtgtagactggcttctctaaagatcatgcgtgaacccaacaaaacgcatttccgggtcagaagaagccgagggctgtcattttgcattccctgtgcgagactggccaaggcacaattcattgcagaatttggcctcaccatgcgtgagtcagaacaagcgccttgaaggccagggatttgcagcctgagaaatgatgtactccgcgggttgaattcacgtctccatacaaaggctcccctgtttgggctgcttgcgtcttgatcctgccatgtgtgcgttttgtggtagtgcttgtggtgtgtggatgccagcctgccaaagctgaaaccatttttaaaaatgtctgtgtaatgtcaccggcacaagggaatgaacgacttggaaacacgcacagatgcagcggaagcccaggatattaaaatcttgaacagtatcattcttgctgagatttgctgggggtatggatgtgttttcagagacaggatgctagagaatgtacaattatagcaatttgctaaccagccccagaccttaattagcacaggatccttgttctcactgttgtatgtaaattaagactttcacaaagggattgtttatgaggacggctgtgagatagagaccttctgtcatttttcaaggaaactctttcagaaaatataaccacaaacacttttaaatcacagcgcgatgcagaagtgctgagaatttttctttcaaaaaatgagcatcagtatttttaaccgtattttggctcctctctatctctgacagcccaagaagtgccatccgtgtactgtgcagtggaaagaatttatttgtgagttagatgactaccagattgttcctctcctaacaaggtctaaaatatcccagaactctgaagatgtctgattatggttttgcaaatgagaaatcttctaccttctcttggccagcatcgtctctactgtgcatctgttcatggaatcctgtcggcagtgtctgtgcaatttagctttgtggttcactcatgcaaaccttgtgtttgccccatttttgaagcatgacccacgttatatgt

SEQ ID NO: 101246 - DNA, 1009 bp, Homo sapiens
tggctcacgcctgtaatcttagcactttgggagggcgaggcgggtggattgtctgagctcaggagttcgagaccagcctgggcaacacggtgaaaccccatctctactaaaatacaaaaaaattatctgggcgtggcagcatgtgcctataatcccagttacttgggaggctgaagcaggagaattgcttgaacccaggaggcggaggttgcagtgagccaagaccacgcctttgcactccggcctaggggacagagcgagactccgtcttaaaaaaaaaaaaaaaaaaagtgggtcaggttctgtctcattttgctaactccttctgatgattttccagtacccttccactcaggtctgaagtcaccgtgacctgcctacctgggccggccctgtttacctttgtttcctttgtgatgttctgttcaccttgtgccatttctcccccaacttcacttgagctccttggcctccttcctcttggttccttccttggggcccctgtgtgtcttttgccaggagcaggctgcccatttctcattgtgatctcagacttatctcagatggtggctcctcaaagaggcttttggtggccacggagtctgaaggagtcatttcattattttctgttttaaatatatatataaaagacaacgtctcactgcactgtcctggctagagtgcactggtatgatcatagctcactgtatccttgatctcctgggctcaaagctcactgtagcctcaatctcctgggctcaagctatcttcccacctcagcctcctgagtagctgggactacaggtgcacaccacctcacctggctaattaaaaaaattttttttttgtagggatgaggtcgcagtgggttgcccaggctggtctgaaacccttggcctcaagtgatcctccctctttgacctcccaaagtgctgggattataggcatgtgccaccatgcctggccaattttctattacatttttaaaatgaacttttaatttaacagt

SEQ ID NO: 101247 - DNA, 1045 bp, Homo sapiens
ctggataaggatgagggaatgtctttaaggtgtgtttgttgctagaacttccaaatagctgcccccatggggcaagttctcagccttcctaaacatgaacataatttgctctgtttcagcttggctgaagaggaaataaaaacagaacaggaggtggtagagggcatggatatctctactcgctccaaaggtgagtaaaaatcttgtattatctattctagagctaaggaggaaattggaatttctttttgttgttgtagtgcagtgaagtgtgtggctctctgagccgacgttgtaactcttcttggattttcagatataagattttttgatggatgaacctaattgatggagaactctcctccttttggttttctttccctggtgcctgtgtaggggtcctgacagtgaattttacctgtgtgtcatgactgagggtggctggctacctctccgcagggtgactttcaggagccacagtttaaataaagcatgttctggaagccaccagagcctctagctgctgctcgttttctgattttaacaacagacctctttggaatcccagaagtgggatgaagtcagcccgcttcactggaaagtggtggtcttgggttagagataaaaaggaaatgtagagcttgctgggatgccggggccagtgtttgcatttagttcaaaatttagcaaattaggacaaacacaatttatgcgtttattcacaagcctggagtagactcctgaatatcttctaattgagggattggtacttttcatttggtctttgtgaaagagattttatgaggcttcccaaaatgaagcagttattcacttttaccttcagggtgctttcacaaatgagctactggagtatttttcgtatctttggttgatgaaaaggctcatctccaaacttaatggttgtaccaaggtgttttcattccttcaacaagtcactgagtgctttcttggaacacacagccttgcactgggggttatggggagggaggaagaggctggacagggttactgcatactgccggaa

SEQ ID NO: 101248 - DNA, 2072 bp, Homo sapiens
agagaaggcttttccttaggaacctgtgacttcacaaactctccctgtcattgcagagttttttttaagcttctaaacgttgggttgttggtgtcctttggttcagcttttcctagttctggtatttaggaaggtggctttgaaactcgcagggctgcttaaacaagagctacagctattgaacaaactgctaccattttagcttcaacacaggaatgaggcagtgttgccagacgccattttaagaatcctgcataaatagcttagctaccgatgactctgcctgttttaggtgagtgcttatataaagctgctctgctaaccattcccccccaccccaatttcttaaaaaattaattgtagatttagggaagcatggtttttaattttgatgttcactattttgtaatctagaagaggaagatgttatgccttggggattaaatatttcttacagcctggaccattttggtattttgaatgaaaagtaaaaaccaggaaaagtcctttcgaatgatgcatgattcttgaattgctgtgcgatgatcctcatctgtagaaccagagtcttgtgcatgttggttatatattctagatggcttagatactcttctttaaaagtcaaatagtaggggcacttggggaaaagaaatatgtgggcattgtgtattcaggcatttttctgtcaaaactagatgctttcttttttctctctcttggaagtgttgaggagatgagattcctgggaattacggaccatccctgagtcctcagaattaacaatcagaaggcttaaagcatcctggaggtgcagtagttcatctgcaacttttaattgctcttttttcagtgcatgcaggttaagaagtaagcataggttttcttgctcaggcactgggggagaaatcttttattctttttgggatgggatggggtggtcttggttatctttgcaggtactgttatttctttgaattgcctcaaatgtatcagtttgtgaaatctgcaggcaaatgacttgggtaaatgtgagtgtaagaggtggtggtgtatacaatgtatctaactagttgatggtgtattttcctattggagtgagaaattgtttgcttttcagctaattttacccttttctgtagcgggcccccagtttcctcaacagacctttaaagggaaaaaagtaatgtcagtttgaaacaagagcttgttgtcccattgtttttgatttaaatcatcagggttgctggaagctagcagatatggaaggaaataagctgtctatgttctaagactttaatgtgttaatgacagaagttcagagtattttctccagatgcagctgccttttctttttaagaattatttgactgttttttttcccccaaatgactgaacagttcttaacctaaattgaccaacatcagtggggcaattcagacaggtacagatcttttcttgcgcctacttttgatgtaatattcatttttttttcctaataacatactagttcttaacactaaatcaaaaaaaaacacacacacacacacaaaaaaaccgaaatcagtggtgtaggaaaaaggaagtccctttagatgtggctattcaaaatgactaattttgcattctggtctttgcttttgtaaatgaagttttttttttttttttttttttttctccttttaatgcatagacactgcagtttcctttagtcaaatacaagttaattgtgtgtgtgagtgtgcgtgcatgtgtgtgcacgggttccttttgaaaggatggtttgctgatctgtgaaaaagatggttttcttaaattgttgtgcttgaaatgctgtgctaaagctggtggtgctattgctaaagttgggtgattatggtgcccacttgtaatacttggaaagataaaacagcttaacttttttttccctctctcttctgctccagcattgattatcttaaaactcagaagcaaatagccaccacataactagtttgcattttcctcgtctctcagcagcattcctgcctgaagtattcagctcctctaggctgttacaagccaaataatggttc

SEQ ID NO: 101249 - DNA, 2202 bp, Homo sapiens
cactccgatttgccggggcagccaatcggggatgagcttttattaggcggccagatcatcagccgaagtgccaaaccctttttctgtgagaactaggagcctgtcctccatgttttataagtattgacattacacagtgttaacaatgcatccacagaggtaagctcgactttttaaccatcttttttccccctccctctgagacatccgaattgtgggcgagcagtgtgatttctctgtggctggccgtgccacactcacccccagagcacttatgttaacttggaactgtttagagagaatttttttgctttcttgggtcacatggctcagtagccattagccatagcttgattttgcaaactggcaagggcctggcacacctttccttccaccagggcatggtgtttctggaagagtttgaagctagatcctggtatgccaaaaaagaagcttttttttttccttctttttttttttttctttccctcttccctctctcttcccctctctctctctctgagcagttccccccctcccacccctgcactattgtcttctcttttgccacatgccctgctgggggaagaaaatggaaggtaagcaaacaggctcctctccaaggagagctcatggcagacagcagagcaggcaagtttgcctctccaaagaggttctgggaaggctggataagttttgacaagagaggagcgtgtttgcaaaagaattgtgccctcagcagagcagtgctaaggagagtctagctcctggggcctaggtgggtggtggtgtctgtacacggtcttctcttattctacagagcttctgcacttgaaactacattgttcagcctgttttcctgacttaggttgctacagagtgttctgcaagccagcctacagccagcaaatgtttctgaaagtgttttctaggctttggaggaagttttttggagtagggatggggactggggggtggggggagagatcttggacaacatcctgcaaaaaaaaaaaaaaaaaaaaatctgcaaggattctgaatcccttagctttctactcttgcatgattttcaaggaactaatgttaccttttatccttgttttcattttcctgtcccttttatacattgtatcctcctctcttctcctgtgtcatggagtgtagaggaaataaaatcatgtctgtggctcatgacagcattccatattcagttgttgggttgtgttgttgttgttgtgtgtgtttttaataataccatgtaactgtttaaaaaaatttcctttttgatcaagtcccaaatctgccagcctgttctctcttcctaactgtggaaaaatgagacggttgcttgaacatttgttgggtaagtaaagcaatccatttcctctgtgaccatgtttgaagagttttgcgaacatttggggtctgtttgtaatagtgggtcttggctacaggagttgggggcttcattagcaggaacaaaataagggctttttaaagagtgtcttgattttaggtgactgtttgaatccactgtttttcctgataacctgcagctaggattgaagattatacttcctgtttaccctgagtcaggggagaaatgttcagttcattgtgacttgactctagacctttaatggggtttgtttggatattcaaactgtgagtaggtgatgtgcttgtgaaatgtcatgaaactgcttgttcttagaggtgcagagccctaaaaacattggtggtgtagaagctggtggtggtggtggtatgtgtgtgttgggggggtggtgtcagtgtgctcatgttttaggacttatgtatagtgcaaaatctcatctaccaccagactgggtttgattcaggactcactgaccaacacattttggccttttttcaggtctcctccacacatctgtatgcatgctggccccacataagatttctcactttttacatttcccttgaccacttaaggctgcagctagaagttaagtgggaaaagtagagtcttgtttagcagtaccttcagaatttccctagaagttcagtacataaattttcagcttggagaccaatccgacatgaccgtaaatgcaggaaatatattcaattgctgtgttatgtcaactttatggagtcagtaatcttttttctttcaaatgagtgtccagtagcccactttctgacaccgaattggaa

SEQ ID NO: 101250 - DNA, 1042 bp, Homo sapiens
aatcctctctgtaccctgggaatattaagagagacacgttttaatctatttttattagctcattgcttattaatatcaccaaagaacctgcttgtttaggcctgtgctggcttttctagccagaggcagaatgattggactgttttcttccctttccttaaagggcttaaagccagggtttcccaaccttggacattttggatcagatacttccttgttgtggcggggctggtcttgtgtacttataggatgttttgcatcatccttggcctctacccactggataccggtaatacaacctccctaactgtgacaacccacacgtctccaagcattgccaaatgccccctgaagggcaaatccccccatggttgaaccactggtttcagggaatataaaagcctaattttagagatggcaaagtgttcccccttgacatcttgcatcttgctggaggttgggagggagagggtcgcttcctctgggcctcaatctgtaatgaggggcatttgaatgagtctaatctaaaagtttccttcagcgccatcattcaatactgaaaacccacctcaaaagggtgggtcttcaggttgcagcattgagttgtgatgatgccactgcactcaagcctgggcgacagagcgagacactgtatcaaaaaacaaaaaagcaaaaaactggtctacctcctaaaagaaaacacagattatgcagttgctgttcgtaggtttcagcctcattgtttctgctgtgcttggttcggctttgcttttgcttctttctttagagccaggagaaggtacagagtttagggatgtgaagtgctaacggggtggacatctgatctctggcacttcccagctgtgtgaccttgggcagctcacttcacctctctgggcttagttccaggtttctaacaatgccacctacttcaggaatcagtctatgtaaagcactaatttagaagtaactgctgggatactcactgcagtggggctttaagaggagctgctgaatggatttctagattgagacctgcaac

SEQ ID NO: 101251 - DNA, 1075 bp, Homo sapiens
gcaagcttttggtagagatgatttattcaatgattccaggcactttttatttttgttcccattgtactgatgagaaaatcaaggcacagagaacttagtacttcaagcaaggccgcacagctggcaagtggggtggctgggatccacacccagagagtgtggcaccagcagccacacactcaatcactgcacagttgtgcttcttgatgtggggaagagagaggaaaaaggttacaggtgcaagagaaatggggctagtttttaagccagggctcagatggaaagatatctgatgtagggtgcagcagaagagaggccttgtcggctgtggggaatcctttcagaagcagcagggaagatacagacatgttgaggccccgcggaggaaatggctagctgctgggtggtttggggaagtgggcagatccattgattgtaggaagggtcagagtagaagatcaagtaccacggctccaaggaggagagaacaagttagagaatggaaagaacaggtggatgatcggagtggccggagcagagtgagccacaggagggtggagggagatggtcggaggtcagaagggcacagtgccagccgggaggctggtgggccgttatctggacttgggctgttactgagaaataggagtcattgatggattttgagcagaggaaggacaggagctgacttgtgttttgaaaggatcactggctggccgggaacggtggttcacgcttgtaatcccaacactttgggaggccaacgcaggcggatcgcttgagcttaggagttcctgaccagcctggccaacatggtgaaatttgaaaccccgtctctactaaaaatacaaaaaaaaaaaaaaaaattagccgggcgtggtggtttgcacctgtaatcccagctactcgggaggctgaggcagcagaatcacttgaatccaggaggcggatgttgcagtgagctgagatggcgccactgcactccagcctgggcgacagagtgagactgtgtctcagaaaaaataaaataaaataaataagtggctgggcatggtggctcacgcctgtaatccca

SEQ ID NO: 101252 - DNA, 1057 bp, Homo sapiens
gccagatgctgtgctaagtgagcactttttactacatgaattaatttaatcctgacaacactctaggaggtgctattatccccactttagaggcccagagaggttaagttacttacatgcggtggcacagtgagtgaaaggcagagccaagatttgaatccaggcaaactcactcagtctttgaagctggctggagctcagaccctgagcaaaagctggagaagggaatcctacaggccccctagggctcgttgaagaatttcagactgtggcctgagaacaatgggaaacctgtgaagggttttagaggtgggggttgggggatggggatgtgatctggcccaaattgaaatttcaaaagatccttccagcagctgagggtggaggatgggagcagagtcggggtgaggaggctgttcccttccagcccagatagcagataatggtggctctggagccaagcacctgtgcagaatggagctacgccgccgcagtcggcagtggaaggcgctcagaaggtgaagccacagggcttgggatgggagatggggaagcggtggtcaagggtgatgtccagatctgggacttgagggaccaggtggatggaaaacacagggaggtttggggggcctcagaacacgagatgaattgtgattgaattgccctctctggaatttctgtttgtgtttggtctattttttgctgctgttgttggtaaattggttcctgatcacctgtaagtgttggtttctccatagttttagcttcttgaaattttagaggccaagtaggctgaggtttcatttttcttatgaatgttttccttttttcagatgtgtaaattacttgatctctctgcacctcaggtttctcacctgtaaaatgggggttatccttgtacctgcctcatagggttgttggaggggttaaattaattaatacgtaaagtgtgtttggaacagtgcctggcacatggcacctcaataagtgcaagccactcttccaaggtaaagatgaggaggaggagatgtcgtcatgacaacgaggagggcgatgg

SEQ ID NO: 101253 - DNA, 2851 bp, Homo sapiens
tcacccagtgactttagcagctaaggaacagcctcgtggcttccgaccttgtgcctcagttcgctcatctgaaaaatgaggatgatcatggtccctaccggatgcttgttttgaggatccgtgcttggcataccagaaacgctccacaaatgttaggtattactggacgaaggcaaatatgaaaaaaattaagggcagggctaggactgcattccggttctccggatcccgagggagctcccagtcgatgctgggcgaaagcggccgcacgagcccacgtcgccacgccctccgccgcggaagccagggtgggggtcgctggaaccctaggccggccgcgcaaggccccctgggaccggtagtgctgggcgtggcctcgggactacatatcccagtggcccccgtgcggcgactttagctgctgctgtctcagccgctccacagcgacggcagcggctgcggcttagtcggtggcggccggcggcggctgcgggctgagcggcgagtttccgatttaaagctgagctgcgaggaaaatggcggcgggaggtgagtggagataaaggaggaggcggtggcgggcgagggggtggagtgcgaggcggagggaagaggggcgagttccccaggctgcgagagccagcggcttcagatctgccaaggcactgaggggcgcgccggccgggggacgcgctgaggtagtttcggggtgtcggggccgcgccgcttcccctcagcccggggggcggcccgcggcggtaggagctgagacgaagctgggtggcagtccgcttggggatccgagggggtccccgcgcggaggggtcacccgaggagtttgcggggggactgcaggggcccactttccccttctgtccctaaagttttttcttcctcttgcctcccccagcccttttgaaagctccccgcgtcgtcctcctgctgccccggctccttagcagcttctgggacgcacgggagggaaaagccgcggggaccccccccaccccagcctcccagccgggtgagatttggttgctgtgtttcctcctcacttgggcatttaaaaaatattttaacacgaattgtccgcggaattttcatgttgggctcgggtagcttcttagttttctcggtaaaaaggcgttttactacctctggtgtgaaggctgggaaatggcaagtgggaagttggttgataaaattaggagtttggctgtctttattactactttttttttttttttgctctccccatctctcattttatgaacatcgacccagttcgtcatggtttaaataaactgcttgtcttgtacctgccttaacaaaactagccatgggtcgttgggagacttagttgcttcctaggcagtttgagggcatctagggtggaaaagttaaccgagagagcgagcatctacctcactggcaggatctgggattcccaaatggaatgacacggaagctatgagattctctcgaagtcgaaacttttttccccctcccgaatgcgaagacttcctttttgcaatatttgagcagggcttcaaaaccaacctgtttttgttattaagcctgtacggtaaagaaacaggaaggagagtaccagctgtcttgctgcagtggttttaaatggagttgaatgagatgcgtgagagtggtagtagtattgagtaagattgctgcatctctttgatttaaatgcctggcctcggatccacctaactgatccctggctgcaaaaaagcttcagtatttgttgcagcaggttgttgagaaggtgattggaggaataaaaatcttaggtcttcagcgaatgctgcacaaacgaaaatgttaatggaaacctgtaagtttgtgaattgtttgttcttgaaaatattttaaatgtatgctcatttagaatatggttctaccgaatgatatccaattggaaaggtacaaacacattgaaaagtgaatctctctttcacgccaaaccctacagtttccccttctcagaggcaaagactgttactggtttttagaatatccttggtctttggaataattattttaagattttcatttgaaaccacttctgttggataccaaaagcagggaaataaaatgaacagaagaaacagaaaatgtgggaatactgtttttgctctcttaaaaaaaatgttgatagctattggaaaaagctcttcagaacttactgcttatgtcaccttatctattaataccgttaaataacaatctgtggggctttaggataaagaactctgccagggttcattgtttgtatgtacaatgaatcctctgcttgtaacatgtaaaatgatattgaacactatagctcctgtcactagaggttgcttcaggttctgcatttcaatgagcagaaatctaaattgcctgtgatcctaaattataggggcattttatgtatagatggaaatgacttaattgtccaatcagcatttgaaataagaggcatataccagcttttggcatatagaagatggggattgtggactaagcgggaggctgtaatatttctagagcagttataggaaatatttctgccataagatatttaattacaaaggctttgaaaatgtacaacttaagcatcaatagcgagatttatatttttatattttagaatggttgttttaacagcttgccaacactaacaatttgctaaggaaattcagtgatattagagctaggttattaaagattatattaaataatttaactgtattttgaaaatgattatgctgtgcatttccttctctgtataaaaattatttctaaaaagtgccacgcacctcccgagcaaataaaatagaattcagta

SEQ ID NO: 101254 - DNA, 1366 bp, Homo sapiens
aagtctttaaaagaaaattaaaaaataaattttagtttggacaatagggtaagatttaaaaactctgctattgtcctatcccaaattgatggttaaaataaatggctttgggtttttggttttttttttttttttttttttttttgcgggcaggggcgttttttttttttcttttctttctttttttttttttttgagaaggaaatttgctctgttgcccaggctggagtgcagcggcgcgatcttggctcactgcaacctctgcctcctgggttcaagcaattctcctgtgtcagcctcccaagtagctgggattacaggtgcgcaccaccacgcccggctatttttgtatttttagtagagacaaagtttaccatgttggccaggctggtctcgaactcccaacctcaggtaatccacctgccttggcctcccaaagtgctgggattacaggtgtgagccatcacgccagcctgcattttttaaaaactatataatttcacactttggccagaggaggtagagtacttttgaaaacttttaatttgttgcaagtttagaatgcatattagccgccagtgacttttggtctacaacagcaaatttgtcacaatttaatacagttgttaccctgtaaagctatctaggattagaaaaaaaacaagacttgttgatcatgattgaagagattacctgtagcagtttggttcatatccttggtataaatatttgttttttgcattactgagcggttaaagctctgagagcagaaaattagtattggaaatgtatgttaactttttcttatttttttctcatacttcaaaaaattgaaaaacaaggggactatattggtttggattctcaggaatagctttgagattgagtgctgcagtaaaatgtaggcattttctcctttttttttttttttttttgagacagagtctcactctgttgctcaggctggagtgcagtggcatgatctcggctcactgcaacctctgcctcccaggttcaagcgattctcgtgcttcagcccctgcccgagtagctgggactaccggcgctcgccaccatgcccggctaatttttgtatttttagtagagatggggtttcatcgtgttggccaggctggtctcgaactcctgacctcaagtgatcctcctgctttggccttccaaagtgctggggttacaggcgtgagccaccgctcccggcccattttctcccattttatgagtgcttcttggggttggggaggggttacaaaataaacacttcagaattaaggtggaggaggggctttgtggtaatgaggcatattccatgagtttggtcatgtttttactaggtaaattcattttg

SEQ ID NO: 101255 - DNA, 1054 bp, Homo sapiens
accacgcctggccaacaacttttaaaaaataaatgaatatacatcattttagtgtgaaatttaagtcagtaataattgacttagcccctttctcctcagctatcaatgtaggttgagatttttaggtctataaattgtattgtttaaaaaaaagggatagtaatgatgtagtttttaacttcgtgatactatccatataaatatgaaaattttcagaaacaagcttaatttatatacatataagaaaaagactgttcttatgcttggccagaaatatacttctttctgtcctgtacttttattaggttggtgtttgccaagcttcaggcatttacatcccaccttcatatctaaggctagcatttttagtttgtttagagaatttggattgggtgcagcaagacatttttgaagtcattcttttaaatagatgttccatgaaggagggaaaatctgaaagaaggaatttcaaagcaacccaagcagtgttttgaaaattctcaagactgaagaataatgactgactagtaggcaggaagcctgcagttgtattgtggtattgttcctccatctcatgcatttgagaactttagtacaaaagaagagaaagcatggggaggggaagaaagggttttaacaaaaaagggggcacttttggagtaaatattctttgcccttctgtttaaatgaaatctaaagccatattattttactttgaaagaaaatgtgtatcataatagaaatgtcctaaactgacatttttataaatgaaagttaattgctgttggtggaaagagcagcatgatcatatgttcagtttcaaaacagaactttgattaaaaagaaatctacatgtgaaaacctttttttcctttttggtacctgatcaatatattttgttagcttgttactttgaaaagaagacttacctagggcagagttcagaataatttgtaagcatgtgctataagctttggacaaatcaatctctcttggccagtttttaaaattttaaaacaaagggtgctctgtatggttttccaaggttccttat

SEQ ID NO: 101256 - DNA, 1041 bp, Homo sapiens
aatcgcttgaactcaggaggcagaggctgcatgcagtgagccgagattgtgccactgtactccagcctgggcgacggagcgagactatctcaaacaaacaaacaaacaaacaaacaaaaagaaattggggaattcaagatatataaatgaacctttaaactgcacttttgcagagaggaatttaagggttcaaagtgatgaaacagatgtattacagatatctttctgtgtttttacacttgcacatcactgacattttggaagtaaagccatattaatgcagaagtatatctcttctggactgttgggctagatttgagcaagaataatgttgtgacataacagtgttctccatcccttccctgtgatctgctcctcccttgtacagtctcatccttcctcttgacctttcctgtatctataacttttctcttgacctcttcatgcacttccccttctcagctttcctccagtctgcaactgtcttatcccttccctcagcctaaatttccgtctggcttgtaacctttttacctctgtcaactttccatccttcaggtccctcactttttctggtttctcactgttaaccaaggtcttttctttacctttggaagcttctttactgcgtgtgttctctgctcctgtcagattgatttttgtttagtccttgacccctcaaacgtgtacatcctcacaccctccaaaatcctttaactttcatttcttcttccatgctttaatttattctgcaaaaatttattgagtgctagccatgtgttgcctattccttagatgttaggaatataccagtgactagaaaggttacggaaaaaaaataaaactttgtagggggggacttgtgtgtgtgtgtgtgtgtgtgtgtgtgttgcagggtttacgttttagatatcatggtaagttttgctaagtaagtgatacttaaacaaggacaccaggaagtaagtaagccctgagaatattgggttggggtaaggttgggatggggagctttctgtttagagggaactaccagtggaa

SEQ ID NO: 101257 - DNA, 2088 bp, Homo sapiens
tgtagcgaacagattcactgacagtgaaaagtgtatttttatgtatatattacccaaatttgtaatatgtttatgttttgaacaattacatcctaataatgatcatagtaactcagaataagatgtttttcaatacttagaccttatgatcagatggaatttaattatttcagtttatatatcttttttcagatataggataataaaatacattcaagcataaaatggcatttcctcatgattaaattctggggaagaagaacggaaattttatatttcaggagaaaggaagagttgtagaatttctgacttggagatgatctaggttcttttcaatatgtaagagtgatataacaccttattaaaatgctaatgctcataatatcttggaagtgactacttcgtaactaaattgatgaaaaatttaaatgtcaacttgcaaatgttctggggcccatagtttttcaagaatcttctggtaggtacttgagcaaaaacattcaagtcctttggtacctgtttgttgtcaggctccgtgctggctgtgttggtgatgtaatgacacgttccctgaattgacacattcccatctttcaagcagtagactttctacaacaaccaacttaatttatgtctgaagcaaagacgtataactgtacacactaaagatctttacatttcgtgtttttataaacagaattacaaatgcatattttgtatttgaaattttaagacccctcacctccaggatgtgtgtgtgtttctttatgaaagtgcaggctggaagataaattttcttactaagatgaatgtttctttttgacagtgattaaaagatgattaaaatagtggtgattctgttgaaaaattttaaacatgtattttttaaaaatggaaaaacattatttgtgtatgccatagcaatttattttgcccacgtaggaaacagaaagggaaaagaagaatttttatatggttcaatattttactgttaagataacttaatacgtatgtatccttccatgaggaataaataggaaggctaaaatagaaaggttaatgtaaacattttttaaaagtaaattgttaggttttaaaaaaactttaattttactgttgttttttgggctttaaggaagctctgtatctctaggtttttaaatcctaatgtaccaggttggcccttttgctgaggatgaggcacttctgtggcagtgttgccatggtgactgcttgccaagtgctgtctcaaggtcactcatcactcatagccctgaatacttggattttgttaagggaaaatatcaacactcagttgataaaatgaagttaattatcatatcacattactgaagcatatctagcaaagttatacttataaacagcattttgtgttagtattgatgaactgtatgtttttgaatattgagttttaacctgccagattagaaggccaatggaaaatctataaattagccatagcccatattgtaatactttaattttattccatttctgactttaaaaaatgcagcagcgtaattttactgtggttatgtttgaagatatctaaacatatttccctcaatatttgctttttgatatgaggcaagagcaaagatttcttagcatttattttatattttggtaaacttagcttgaagttgccagttgctgaagcccttgtccatataagaacaggatgatcattatattttccccaaaccagattgcaggtagatagtagatctatctacctaggttctatttcatatattctttgtctcatactgctgttaattttccttgtccttactttgtaggttttaattttttttgttatatacgaacattatacaagaaaagctgttcattaaaggtttttgttgtttttatcaaaccagttttcaataaaggaatatatgaaaagaaattcccctttgcattagcctatatttcatctgggtcttgttctagagagaaaatcagagctatgtgtcttcattaggatgaaaggtgactttgaaatcagagatgagaagcattactgtaaaagggaaaaatgtgattgaaacaaacaaaaacatg

SEQ ID NO: 101258 - DNA, 1007 bp, Homo sapiens
attttggaacccttcagcagttatattaagtcacacacttctgtatatttgcttactttcacgttttcagaaataactggtatcttactttgctggtttggataagagctaatatcctacatgaaatcgttttcttaggcaatggtggtgcctacagggtattctaaacgtaaaggtaaatttaagtcaatgagtctgttaaaattcaactacctattgtgtcaaagagagaaatattgctaactacaaatttacagtgtgttcatttaggatttgactaatcattttaatagtagagcagttaatacagcgatttcacttttatcctgtggtgcttcaaaggcatctagtttttaaatgtagtccagttaaggtgtatgtagtagaggttttcattttagacttgctcaatgttaaatatagaatgttgaaaatattatttaatggattagtttattggtttctgcatttgaagaaatttacataaattagttagggagcagttgtacctactgccaaatggttcactcctgagtttattgtacagttactcccaggtactgaaatataagaaaagaaaaatttaaaccttagctaagagctctgcctgcatttctgtggatccacattatgaaaaggatagaggaacattacctgtgtatagtaatggtttgaggagagggtagggaaactatgcaaataaaaaaattggggtataggcaaatccttcagttagatgtctttattatctgagttacttttaaagcatttactggatacacaaccagtattatctttttaccatcctataaattgttcatagaattgcaacctcatggaggaaaatccatctcctttacctgcctaaatttattctttgtcttgatactagcattaataattggtttgttagatactacaggctaaagaaactcagatttcaagaagaaagaagataattactcgatcatttctcccctcaaacacctgtttaaaatatattgtct

SEQ ID NO: 101259 - DNA, 1066 bp, Homo sapiens
tgattatatggtacaataagacatctactcaaattcctaggaagaggtggtgtacttgatagcttttgtttgtttcatatatccagggaagggaaaaatgggaagacttaatttttttgagagagaatctcgctctgtcaccctggctggagtgcagtggcatagtctcgggtcactgcaacctctgcctcccaggttcaagtgattctcctgcttcaacctcctgagtagttgggattacaggcggatgccatgtcgcccggctaatttctgtatttttagtagagttggggttttgccatgttggccaggccagccttgaactcctgacctcaagtgatttgcccgccttgcctcccaaagtgctgggattacaggcgtgagccaccacgcccggctggaagacttaatttgtgggtgactaatcataatgcttaaatgaagaaaagacaataaaattcaatccctcctcttctttttgtcctcaggatcaaaatacttgctggatggtggactcagagaccaataaaaataaactgcttgaacatcctttgactggttagccaggtaattcagctttagtttgatttgatcctttgtaattttttgtcttcaaccttctgaagatattaccctcctctttaatttatgatttaattaaaactatttatgcttcatgtttttctctttaatgattattaaatgaatgtgcttagagtacttgagtgaatacgtatgtgtatgtacagttggcccttgaacaactgaggactggggacactgaccccttgttcagtaaaaaatgtgcagaactttcgactccccccaaacttaactactaataacctcctcttgcctagaagcctcactgttaatataaacagctgattaacacatattttgtatgttacatatattatatcctgtattcttacaataaagtaagctagagaaaataaaatgttattaagaaaattatggccaagtgcagtgactcatgtttataatcctagcactttgagaggctgaggtggttagatcacctgagtccaggagtttgagaaca

SEQ ID NO: 101260 - DNA, 1035 bp, Homo sapiens
actttttttttttttttttttttttttgagacagactccctctgtcacccaggctggagtgcagtggtgtgatctcggcttactgcagcttctgcctcctggattcaagcaattctcatgcctcagcctcccaagtagctgggattacaggcgtgcacggccacatccggctaagttttgtatttttggtagagatgggatttcaccatgttggccaggctgaaactcctggcctcaagtgacgtgcctgccttggcctaaagtgctgggattataggcgtgagccactacgcctggccccttttcttaacttttaatattacatcagaataggaaaaatgagaatagaaaaagctgtctagttgccgagaaaacaatcatgctttgcttagctaaatttcttttggtaatcccatcattctcttggttagctaggtttgaaatctgagttgtctttgaatcccaccgtactctgattcatttggtaagcaggctttatctggctttctattttcatgtgtcctgtatttgttccactttctgttcctaattttagcttccgaggccaagaccccataatttcatgagggtgtttttccttgtctctactgcttccttgtccactcacttaaaatttagctagattttcctaaatgtatacttttagccaagcttatgttgtgctctaagttttgtgctacctttccttggcttacagaaagaaaaagtacaaactcccttctctgacatttcaaatggtactttatctgagaatctatccaagttaccagccttaggtcttgcaatttccctgtaaaatccctcagttaattgtgatatatacccattcttctgaacatggcagagaactatctccacaggttttttttttttttttttgagacagagtttgttacccagcttggagtgcaatggcgcgatcttgtttcactgcaacctccacttccagggtcaagtgattctcctgcctcagcctcctgagtagctgggattacaggcacgcgccaccctgcc

SEQ ID NO: 101261 - DNA, 1050 bp, Homo sapiens
ccagcactctgggaggccagggtgggtggattacctgaggtcaggagttcaagaccagcctgaccaacatggtgaaacatcgtctcaactaaaaatgcaaaaataagccaggcgtggtggcgcatgcctgtaatcccagctactggggaggctgagtcaggagaattgcctgaatcctggaggtggaggttgcattgagccaaagtcgcaccgttgtactccagcctgggcaacaagagcgaaaactctgtctcgaggaaaaaaaaaaaaaagtaatcatgtaatagtgttgtataggggctgattctgctaacagctcttttgtgatatatatattatgtctcctttcccccctttctacgccttttcccttagtcttacctgcagtggtgaaaaacggagacgggagcaggaaagtaaatatattgaagaattggctgagctgatatctgccaatcttagtgatattgacaatttcaatgtcaaaccagataaatgtgcgattttaaaggaaacagtaagacagatacgtcaaataaaagagcaaggtaataaaaacactcatgtctttttgaacagtggtggttcccaacctttttggcaccagggactggttttgtggaagccagtttttccatggacctggtagaggggatggtttcaggatgattcaagcacattacgtttgtggtgcattttatttctattatggttacattgtaacatataatgaaataattatacaactcaccataatatagaaatcagtaggagccctgagcttgttttcctgcagctagatggatccatctgggggtaatgggagaaactgtgacagatcattaggcattagagaatcataaggagcacacaacctagattcctcgcatgtggagttcacattaagatttgcacacctgtgagaatctaatgctacttctgagctgacaggatgtagaactcaggtggtaatgtgagtgatggggaggggctgttgttaatacagatgaaactttgctcacttgcccactgctgacctcctgctgtgca

SEQ ID NO: 101262 - DNA, 3470 bp, Homo sapiens
ctcccagagtgctgggattacaggtgtgagccaccgcgctgggcctccagcttatgctctttagagacggttaacagacaattgcctgttatttggtagttccttttcaggaagctgtgggatagtacatttagtagtgaaatgatttaggtatcttctggcttcctgggcaactatgaagtttagttttgatgttataatattgtagcatcattctcttatgaggaaatgttttgtatgtatgtatgggcatgtgcatgtgtatctttatgtctcttctggggactattcgaaggtgatttaatctataactgatagtgtgttattcgttataccaccttctgtcttttcaggaaaaactatttccaatgatgatgatgttcaaaaagccgatgtatcttctacagggcagggagttattgataaagactccttaggaccgcttttacttcaggcaagtataaagattttaactgtccagtaggctgtattgccctttggtttattataaagttataaaaaatcgatgaaattttggttaggaaatgagaacaaaaagaaaacatttttttctttgagacagttcagtattctgaatatgatggtaaaatgctcttataattacaatatacataattcaggaagccttgcccccctagtaaaaatatagttgcaaactgaggaaccacacatatacaaacataaaaatataagcaagcaggaaaggaaaggtagcctgtaatttcacagagatatttgggtacaaatggcccttcatatccatgggttttgcaccacagatttggaggctgaggaagaaataaaaaataatgttaaaacaataaaaaacacctcagtgtgatgactatatagcacttacattgtattaggtattataactaatctagagatgatttaaagtatattggaatatatgcataggctataggcaaatacaccattttatattggagacttgagcatcctcagattttgctatctttgggaggtcttggaaccaaccttacacagatactggggtatgatgactgtacgtttcggctcagacatttttggtgaatttttgcgtgattgatcacatggcacgctatggttttatattcttgaggaattgttaagacttaaacatgtgctttgtatttgtttaggggctgaagcccttcataaagttaacttgtcaacttctttttgtttcaggtagtttgttccaactacttttagttgatcagttttgaaattcctctttgtaaattctcattaaggaatagtagagcagtttctgtagcttgacttggcatcaaatggaaaaatgggaagagctaaggatgcttttctcatttttaaaagctcctttaaagatataattctttaaaaattaggttagacattaattcagatttcatgctgaacatatttatgtacacactcccccacccccaattattcttctttttttttccccccagtaaggcctgtagtaatggtgctaatgttagtagtaatggtggcttatagttgtttgcagtaattaagtcagcagtagtttttacacattctacttactactgtggttgctgtttgctgatactaccataacaaaataccacagacttggtaggtgaaaccaaataaatttatttcttacagtgttggtggctggaagtccaggatcaaggtgtcagcaggattggcttctccttggcttgtcactgtgttctcccatggcctttttctctgcgtgcacattcctggtgtctttctctccccttataggataccagtcatattggattagggtccccaccgttatgacctcatttatctttaattacctccttgaaggtcttgtttccaaatacagttacactgatggttagagtttcaatttaagaattagagggaggaggatacaattcagtccataacagcctgtattaacatatcctattttaggcattggatggtttcctatttgtggtgaatcgagacggaaacattgtatttgtatcagaaaatgtcacacaatacctgcaatataagcaagaggacctggttaacacaagtgtttacaatatcttacatgaagaagacagaaaggattttcttaagaatttaccaaaatctacaggtaggcttttaatgtgtattttctaaataggttaaatttttttccttgaccatttcttagaaaattgaatgtatcttttaggaagtcaagcgatcaaatgagggtagaaaggcatgtgatttaatagcagaattttcacatatggagtcagtgaattaaaaatttggtatacattttaagaggcatatagttacaaaatatgcagtgagatttctgttaaagttgaaattattcacatgttttgtatattgccagcctgaaatgttagtatagatataactatggaaaacatgcataatgagaaaatgcagcttgaattcttgatgatggtcatagaatgagttaccagctttttaaaatgtcatttcaatttgttttccaaagttaatggagtttcctggacaaatgagacccaaagacaaaaaagccatacatttaattgccgtatgttgatgaaaacaccacatgatattctggaagacataaacgccagtcctgaaatgcgccagagatatgaaacaatgcagtgctttgccctgtctcagccacgagctatgatggaggaaggggaaggtaagagctattatatgtttgtgatgttcatgaaacaaatagtggccatacttggagttttgaaacttgtgttgtaacccttcttactgaattccatgtctttgcttgcctattgaacatatatatccaaaagttaagtataatccttaccagggtgaattttttattgtagatttgcaatcttgtatgatctgtgtggcacgccgcattactacaggagaaagaacatttccatcaaaccctgagagctttattaccagacatgatctttcaggtaaaaactctttttttgtctctctctctctctgtgtatacgtacatttttattttggaaatttttgtaaatgttactatttttaatctgtactatcatagaaatgtatacctactgtaatgagtgctttatgtgtatcttttttcatgttgcttatgcaaccttaaaagaatttcactaaaattcttggcatttgaattgggtatgtttggcattttaaatcccccagataaattaaaaaaaaaatttaggggcacctggttttctctccaaattgcattttgcgtcagaatttagtatttctttaacttcaagcccatttgtcataaagaaacatgttttaaaaaattataagtaatttaatgagaattattgggagtaattcctttttttttttttttttgttgagacggagtcttgctctgttgcccaggctggagtgcaatggtgcgatctcggctcactgcaacctcc

SEQ ID NO: 101263 - DNA, 1591 bp, Homo sapiens
cattcctggaggttagtagatggaactactaacagaaagttccaatcctttaattacttggtctttctgattatcagctccatcctgaggtgatctagagaccccaccctaagtctcctcatcagcataaattgaggtgtgttccaaaggggctctttatgaataacttgaaaatacttttattactcaggaaattctgaggattttggataggggctctgtgctagaaatctgacaaagaccaaatgtattattatactccttagcagaacatgtagggagaatcctgtggtgctatgtcttaaggagaaaagctgtggatatagtagaaatttggatcagagaaggtggagcaaagatttaatatcttttattttattctccagtgctaagccatgtgtaggcagccagtaaatacttgtgggctggatataagtctttttttcctttttttgtttaataggaaaggttgtcaatatagatacaaattcactgagatcctccatgaggcctggctttgaagatataatccgaaggtgtattcagagattttttagtctaaatgatgggcagtcatggtcccagaaacgtcactatcaagaaggtaaagaattttggggttgattgttcttatcattttattctttagagacagggccttgctatcttgcccaggctggactcgaactcctggatttaattgacccttctgcctcagcttctgagtagccaagactgcaggtgcacaccaccatacctggttttgtggttgattcttgatcttgtttgtcattatgtttggtatacacatgactgtagttgctctcttgttggtgaggggtaggaaaatgatgcctgagtgttcttattttaccctgttgatgattttggtgcagatccagtctttccttggatttttagaaatgtacttgaagtatatttcctccctgtcccctcctatatatatttgttttgctgactgtagttaccagtgatgggatattttccccaacagcttatcttaatggccatgcagaaaccccagtatatcgattctcgttggctgatggaactatagtgactgcacagacaaaaagcaaactcttccgaaatcctgtaacaaatgatcgacatggctttgtctcaacccacttccttcagaggtaatgatagattactgtgtattctaatacaaaatgcagcagtgttctcaaaatgctttattattaaagtaaaaagggaagggataaaatgagacaaaatttaggaaggttattgggtttgatgaaatgagtttagattcctggattatgatatgtttaaggttgtatttttatgtgaaagtgattatttattaaatactttacaggaaagctaggtgatgggaaggctaatgggtggataaaagagcacataaaatctgattacatgtcttaccactcatttctgataatgtgtgttgctttggggactgcatttaaaatttgagggtaaacttcaagaataaaggtagttactgtctgggttggtagtggcaaataagaaatgcatgaaggggaggatattcacccattaattatcttgagtaatt

SEQ ID NO: 101264 - DNA, 2025 bp, Homo sapiens
aaattttattttattttaaatctgattaaaagctttcatgcatgcttagaattttttagtaaaagtttgatgtttgttttgcagagaacagaatggatatagaccaaacccaaatcctgttggacaagggattagaccacctatggctggatgcaacagttcggtaggcggcatgagtatgtcgccaaaccaaggcttacagatgccgagcagcagggcctatggcttggcagaccctagcaccacagggcagatgagtggagctaggtatgggggttccagtaacatagcttcattgacccctgggccaggcatgcaatcaccatcttcctaccagaacaacaactatgggctcaacatgagtagccccccacatgggagtcctggtcttgccccaaaccagcagaatatcatgatttctcctcgtaatcgtgggagtccaaagatagcctcacatcagttttctcctgttgcaggtatttgtgttgacatttccttttattttttttctttttaagtaattattctttccatactactataattcttgtaaagttaatctattttataatagaaactttgaagaattaagttgtattttgttacagtgtctggtagtctaattcttttcctaaattttttttcaaattcaggtgtgcactctcccatggcatcttctggcaatactgggaaccacagcttttccagcagctctctcagtgccctgcaagccatcagtgaaggtgtggggacttcccttttatctactctgtcatcaccaggccccaaattggataactctcccaatatgaatattacccaaccaagtaaagtaagcaatcaggattccaagagtcctctgggcttttattgcgaccaaaatccagtggagagttcaatgtgtcagtcaaatagcagagatcacctcagtgacaaagaaagtaaggagagcagtgttgagggggcagagaatcaaaggggtcctttggaaagcaaaggtcataaaaaattactgcagttacttacctgttcttctgatgaccggggtcattcctccttgaccaactcccccctagattcaagttgtaaagaatcttctgttagtgtcaccagcccctctggagtctcctcctctacatctggaggagtatcctctacatccaatatgcatgggtcactgttacaagagaagcaccggattttgcacaagttgctgcagaatgggaattcaccagctgaggtagccaagattactgcagaagccactgggaaagacaccagcagtataacttcttgtggggacggaaatgttgtcaagcaggagcagctaagtcctaagaagaaggagaataatgcacttcttagatacctgctggacagggatgatcctagtgatgcactctctaaagaactacagccccaagtggaaggagtggataataaaatgagtcagtgcaccagctccaccattcctagctcaagtcaagagaaagaccctaaaattaagacagagacaagtgaagaggtaatttgttttctgtatatttcagctcatatttcatcatttttcggtgttagataatgtgatataaaaattcttccattttaggtttatttaaagaaagttaaatctttagctctcatttctttataattattttggatgtcagtaaaattatgatgtaatttagaaataacagatgtgtatgttttaagatgtgactataactctttagtagccaatatgaaattttttcatggaggtgtttattgctggaatgggcagattgggtcattaagagaatggtagaagtaatcaggaaaaaaaaaacttgtattaagcagcataatttttattttaaggtaaaatcaagtttcatgcacaagatgacattctgtataagcatttcccaaacttataggatatattaatatgcacttgagaaaatgaaaggcttaaagttaggatgtgggcttaacctactgttcaccaaatttattgaccgaagccctttttagagcatg

SEQ ID NO: 101265 - DNA, 1169 bp, Homo sapiens
tattgtgtgtgtcaattgaaaaggcagcatgcacaattattcagaatggtcattattcagtagcattatttcctaaactagaatggatagatcaattaagagtgggggggaaaaaaagaaggttagaaggggattttacattttatttcttttcgatcagaaggcaacttatctggttaagttgattgttaaaattataaacagtatacttaagtacaaatatgcaagaaccttcaggagcttggaacatttgtgaatttttcaatattaagtgaagcgcagagtatcagtgaccatatcaggctacagaaaagttctcagtacttcagccgacatggagattgttgtttctactttatttggaatatgagacccttttttggctggcaggggggcggggggtggcggtggtgggtgagggccacttccctcacttattttgtaaaggaagacagtgtttgtttttgtaagaaagacattcttgggtggggagtggtggtatttgtgttttgtacttgattatttatatattaaatcacgaagaaatgtttttgtattgtgttttcaacaggtttgaaaagttcacagtctgtgcagtctattcgtcctccatataaccgagcagtgtctctggatagccctgtttctgttggctcaagtcctccagtaaaaaatatcagtgctttccccatgttaccaaagcaacccatgttgggtgggaatccaagaatgatggatagtcaggaaaattatggctcaagtatgggtacgttatttctaattagtatgtatgattattttgggaaaagcatatttaaaatacttaaagccatctaaataattgggagtaaataataactttttgaataacgttagtatgtttcttccatgaatatccttcatttattctatgttttggttatgtaaactcttcaagagtcttttggtctatgacattttccagcctgttgaatatatgagaatagtggcctatgtctccacagttggccagcccttttcttaccatgacaaagtgctgttttgtcaaggttgatgttgtgtataatggctgtacttacatggtataagaaggatttcattataatatggaaaagacctaagtatggctacctgttttaggtgggccaaaccgaaatgtgactgtgact

SEQ ID NO: 101266 - DNA, 1030 bp, Homo sapiens
agcctaggactgaaccctgatgaacagttagcattcattcaaggaaaggccagagagatgggagaaaaatgagaagtgttgcgaagtacagtggggtgaagtatgcttcaagagagacatgtcaagcatgctggctgcatgcttggcattcagtgcctgtggatgagaaaataaaggtgaatgcacagtacacctggttcttgtcttagcacagcaggttgttctcttcttcagaatatcaacttttacttctttttctgtcacctgtgggatgttattttgaatgtatccttagcatgtagagaagtgatgcctggcacataacaagcatttacttaaatacttgttgaatgactggatgttttttgcactttctttagagcatttgacttctgttgctttcatagatgttcttcactgttcttttatgtgttgtgtttaagggacaggcattagagcccaaacaggatgctttccaaggccaagaagcagcagtaatgatggatcagaaggcaggattatatggacagacatacccagcacaggggcctccaatgcaaggaggctttcatcttcagggacaatcaccatcttttaactctatgatgaatcagatgaaccagcaaggcaattttcctctccaaggaatgcacccacgagccaacatcatgagaccccggacaaacacccccaagcaacttagaatgcagcttcagcagaggctgcagggccagcaggtaaccagtcatgtgttcttccctctggcttctccttctgttgttttcagactatgtttctcagtgttcttaccactggtgcaatctatccctgtcaactaaagaaattctttttgttttacttctgtgtaaggttttatttgtacaaatggctccttgttaaggagtagttttatgagaatattctattttacaggtaaaaagtaaaaaaatgtcaggaaggattgctcttggggaagaaaaatgttacttgatgactttgtagtcttaaaggtagataaggttttttttga

SEQ ID NO: 101267 - DNA, 5109 bp, Homo sapiens
ttgggaggctgaggcagaagactcacttgaacctgggagacgaaggttgctgtgaggcgagattgtgccactgcgctccagcctgggcgacagagtgagaccctgttaaaaaaaagaaggccctgggtgttttctgtcttatacctggtgtattgtgggggtactatatgtatgcaactggcaggttcttgctatatatatgtaattgcactctttcttgggtattagcagggttttcttaatgctcaaatggtcgcccaacgcagcagagagctgctaagtcatcacttccgacaacagagggtggctatgatgatgcagcagcagcagcagcagcaacagcagcagcagcagcagcagcagcagcaacagcaacagcaacagcaacagcagcaacagcagcaaacccaggccttcagcccacctcctaatgtgactgcttcccccagcatggatgggcttttggcaggacccacaatgccacaagctcctccgcaacagtttccatatcaaccaaattatggtaaatctgacaatgaaaatgtgccttccccaagttaacattactaaggacataagcttcattacatttattgcacatgaaagacaaaaacacgattcactccctctttacttcacaaggaaaaccaaattaatttaaatgattggaaaacaaaaatgctgcagcacacaggtaattgagacaggtgtatcctgtcatagttgaatatttttttcagtcccactcattaagagtccccaaactctggaagaaacactgcaaagttgtccccttgccccttcttgtatgttccagtatagtagaactctctaatctctgaatgcttggtcaagtcagtgagaggaatgcactttgtgggcttttaagttgattttcttggtgacttggatttattattttttttttgagatgggggtcttgctctgtcacccaggttggagtgcagtggtgcgatcttggctcactgcaacctctgcctcccgggttcaagtgattctcctgcctcagccctgagtagctgggactacaggtgcattccaccacccccggctgtttttttttttaaatttttaatagagacggggtttcactgtgttagccaggatggtctcgatctcctgacctcgtgatctgcctgcatcggcctcccaaagtgctgggattacaggcgtgagtcaccgtgcccggccctggatttattattacagtgatgcagatacctcttcatttcagcctttgagaggttccaggaacatggtgggaataaaggtgtctattggggagccctgtcatctgaggattataactcccctgccctttaaagaaggatggagtgatgtgagttgagtgatacggagtcccttttctacaggaaacccattaaagcaactgatctttcagtgatccagatggtgctcctttctgtagtaagcctgttactctagtcgtcatcttggtgagaatctagaatacctgggggggcagcatcttatagcactctgtatcttacacttatcacttccctccacccccacctcctttaaaaaaaaaacaaaattactacagaaatctgatattctaaggagaaggcatttgggcatttttatttcttctgttttatttttgtaaggaatgggacaacaaccagatccagcctttggtcgagtgtctagtcctcccaatgcaatgatgtcgtcaagaatgggtccctcccagaatcccatgatgcaacacccgcaggctgcatccatctatcagtcctcagaaatgaagggctggccatcaggaaatttggccaggaacaggtaaagaacagtgacttataaagttagtcacatcctagtcccagaagtccaagaacttaatgtatttttcagtcaagcctttttggatggagaggttgaaaggactgggttcatattagaaggtgtgatttggcttgtccattttgagagtccttcaagcacgcacatatctattagggtgtctagtacagaaagctgtgaaaaatggatcacaggctgtcagggagttttctctaacattcccagcttaagtatagcaatgtttgacacaattgtagtaatttctgtgggcatgccctttgtcgctaaagtgacttccagaggtaatattaccatttgtttacttacagctccttttcccagcagcagtttgcccaccaggggaatcctgcagtgtatagtatggtgcacatgaatggcagcagtggtcacatgggacagatgaacatgaaccccatgcccatgtctggcatgcctatgggtcctgatcaggtatgggatcgattccttacctttttcaaaaagtttttcttgttctctggatagaactaaagcctaggctataatcagaatgtcctaggtatattttaacttgaatgtataacttaaaatatagtaattgaaaaaacttggtttgaaggcattgggccattagatacttttggtaagccagagctgcattgtaagatgggatctcaggaacctgaatcactcagccagagctgcactgtaagccatgaatgtggacatgggtatttttttgttgtgcaaagcatgtgttttactcattttttttttttttttttttttcctggttgctgacagaaatactgctgacatctctgcaccaggacctcttaaggaaaccactgtacaaatgacactgcactaggattattgggaaggaatcattgttccaggcatccatcttggaagaaaggaccagctttgagctccatcaagggtattttaagtgatgtcatttgagcaggactggattttaagccgaagggcaatatctacgtgtttttcccccctccttctgctgtgtatcatggtgttcaaaacagaaatgttttttggcattccacctcctagggatataattctggagacatggagtgttactgatcataaaacttttgtgtcacttttttctgccttgctagccaaaatctcttaaatacacgtaggtgggccagagaacattggaagaatcaagagagattagaatatctggtttctctagttgcagtattggacaaagagcatagtcccagccttcaggtgtagtagttctgtgttgaccctttgtccagtggaattggtgattctgaattgtcctttactaatggtgttgagttgctctgtccctattatttgccctaggctttctcctaatgaaggttttcatttgccattcatgtcctgtaatacttcacctccaggaactgtcatggatgtccaaatggctttgcagaaaggaaatgagatgacagtatttaatcgcagcagtagcaaacttttcacatgctaatgtgcagctgagtgcactttatttaaaaagaatggataaatgcaatattcttgaggtcttgagggaatagtgaaacacattcctggtttttgcctacacttacgtgttagacaagaactatgatttttttttttaaagtactggtgtcaccctttgcctatatggtagagcaataatgctttttaaaaataaacttctgaaaacccaaggccaggtactgcattctgaatcagaatctcgcagtgtttctgtgaatagatttttttgtaaatatgacctttaagatattgtattatgtaaaatatgtatatacctttttttgtaggtcacaacaactcatttttacagagtttgtgaagctaaatatttaacattgttgatttcagtaagctgtgtggtgaggctaccagtggaagagacatcccttgacttttgtggcctgggggaggggtagtgctccacagcttttccttccccaccccccagccttagatgcctcgctcttttcaatctcttaatctaaatgctttttaaagagattatttgtttagatgtaggcattttaattttttaaaaattcctctaccagaactaagcactttgttaatttggggggaaagaatagatatggggaaataaacttaaaaaaaaatcaggaatttaaaaaaacgagcaatttgaagagaatcttttggattttaagcagtccgaaataatagcaattcatgggctgtgtgtgtgtgtgtatgtgtgtgtgtgtgtgtgtatgtttaattatgttaccttttcatcccctttaggagcgttttcagattttggttgctaagacctgaatcccatattgagatctcgagtagaatccttggtgtggtttctggtgtctgctcagctgtcccctcattctactaatgtgatgctttcattatgtccctgtggattagaatagtgtcagttatttcttaagtaactcagtacccagaacagccagttttactgtgattcagagccacagtctaactgagcaccttttaaacccctccctcttctgccccctaccacttttctgctgttgcctctctttgacacctgttttagtcagttgggaggaagggaaaaatcaagtttaattccctttatctgggttaattcatttggttcaaatagttgacggaattgggtttctgaatgtctgtgaatttcagaggtctctgctagccttggtatcattttctagcaataactgagagccagttaattttaagaatttcacacatttagccaatctttctagatgtctctgaaggtaagatcatttaatatctttgatatgcttacgagtaagtgaatcctgattatttccagacccaccaccagagtggatcttattttcaaagcagtatagacaattatgagtttgccctctttcccctaccaagttcaaaatatatctaagaaagattgtaaatccgaaaacttccattgtagtggcctgtgcttttcagatagtatactctcctgtttggagacagaggaagaaccaggtcagtctgtctctttttcagctcaattgtatctgacccttctttaagttatgtgtgtggggagaaatagaatggtgctcttatctttcttgactttaaaaaaattattaaaaacaaaaaaaaaataaatttttttgcaatcctttcctcagacctggctccaggctaactggaaggcagcactcccttttttatatagtagaa

SEQ ID NO: 101268 - DNA, 1763 bp, Homo sapiens
ccatgtgggcaaattatcgcccttggtgaactgccacttgcaacctctggtctactcatttcttcctttatatgcatataaacctgtgtggctttaataggacattagtaacaggtcacctaagcctttcttcggtgcttctagaattaaggtacagaatctttacatatcacaatctccttagccactattctgtccagatccttaaatgccatccttgccaggcattgggtgtataagtaaacaaaaaattgaggtgactaggtggtggcaatcccgttctaagtaacctagaaatattcattctcagcagccttgaagcaaagcttcctcagctataggaccgattaggaagtcatgataaagaccatgatagctaagtgctaagatgagtttgttttgttctttaggggacaactgtgggaaggctgggaaggttaagaaacaacagaggtggacctccaaaaacatagaggcatcacctgactgcacaggcaatgaaaaaccatgtgggtgatttccagcagacctgtggtattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaatccctcgcagttgtggacatttctgttcctgtccagataccatttctcctagtatttctttgttatgtcccagaactgatgttttttttttaaggtactgaaaagaaatgaagttgatgtatgtcccaagttttgatgaaactgtatttgtaaaaaaaattttgtagtttaagtattgtcatacagtgttcaaaaccccagccaatgaccagcagttggtatgaagaacctttgacattttgtaaaaggccatttcttgggagttttttggtgtgtctgtttttttaaagtattcaagatactaccagtcaacatctttttggaagaaaatgccttgggtttagaagattttcttaaaaggggagtagatggttgtagattgactaaaaagtctaccatacttcaagggactacaggtaagtctcatagtataccagctttggtacttcattttttaaaaaagtattaatcaattgcaaagaaattcgccttggccaacccttctttgtgtatcaggtagtctaacctgatacaagtagttgacagatttcaactatcaatcaccagtccaacccatttctcatttaacagatgacggagataatccctaaaagcacccacatttgtt

SEQ ID NO: 101269 - DNA, 1031 bp, Homo sapiens
catgtgttagctgataagctttgaggtgaatcttatcctcattttatggaggagtaaggtgaacaaggtgggctgaccccggagcccacgcacttgatcctgccacatcctcgggaaaacttccccagagcccaaaggggaactccctcctgcacttggtcagggctcttggctttctgtcctctggagcacagatgttcatgcctgcatctacctccctcaccataactaaggtcagcgctgaatgaagccatcagggtcctgaaactgatcatggtgacactggattttaggcaatctacaaggctatctaggagacttagggcaggttcccctcataattcagtctacccctcataattcagtctactctgagtagggaacactatcagcatcatgggattgtgacaaaaaagcataagatggttttctggtgtgttggggttgttttgcctaaactatctgctcctgttttgtttttcatttctccttcatttaggacttaaagatggaggaagctatgagcaatacaggtatttcgttttattattaaagcctaaacaaagttctcctatcttggcccatccttcagtctcatctctgtgagtctgcacctgttatcttgagaaactgcccttccctctggtctgcccgagaccaggatcacccaccaaagataggtgtcacctaggagaccttctttgtatagttctttggggactttttctttcttggtgatggttaacattcattctcctttgacacttgaaaacttaggcagtttcagcgtcgaaagtggccagaaatgaagagaccttcttccaaatcactgtgagttgaggaaccagcttacaaatagaaatctggttctgaccgcttcattttgccaatgctattctatttgcatgccatttcttacataccaccctttgtttgttctcatgatgagggtgggggggaagtactaatgcacatctttccctaagaaaacacttgaatccatttcatgttttagattaatgccttgtcca

SEQ ID NO: 101270 - DNA, 1050 bp, Homo sapiens
gtctttctccttagataggttcaccctcatactttaccaaaggggtaggttaagtccctcaccggtagctcccagactacacaagaacccaggccacttacccgtcctttcatcaaatggctgctttgcaatcaggaggagctgagggcccctgaatgaaggctgctgataaaaccaagacttggaaggctttctttccaagcttgggaagtttcctgaccagtggctgcagaactccaacgttaaatacacagacgtggtttttattctcctgagttttcactctcatgaagagtgaacctggtgggacttgaagccaaaaagtcacctaactcttccaaacgctggctcttgcagaagttggagtaaacaggtcaccagcccctagcaccttccacccgccacctgcctgaaatatgtcccctggttggtagaagggcagggcgagagtccctgtacttaccttgttgacagactaccttttttgcaaccagctgatgaatgcagtgaacacactggacagggatgtcctcaaccagctacacgtacagctcatggagctgaggagctgcaagggttacaagcagtgtaacccccggactcgaaacatggacctgggtgagtaggcaccccaacgtggggcccttggacagcagggtaaccaaaggaagggactcaggaggtggtgtctaccccaagaatgagcctgaaatcaccaggctttgggaggtgatacagttccagacgagtcatgggagcccctgtccatagcaggcagatgacctttaacaagctgtgattcctgagagaggaacacctgcaccaactgcccaggaaacacacggaattccgtctcatttcattgtcctcccttttgtccactcatgcattcaacaaacacttcctgagaacttacacctgaaaccatgttgactaaagatgaccccatcctcgctgacttgtgtggagccagtgttgtcctaagaagagcagtccacagcaggaggcctcttgcttgtatggaaagggtaaaactggatggtagaatcc

SEQ ID NO: 101271 - DNA, 3232 bp, Homo sapiens
gacccccggttcacagtgggagggcagtgaggccagacccagggaagaggctggagaggtgaagtgaggtccccacagattcctcaacgcggggataggtgtcagtcccagcatgagacagatagcttcctgcccaggccgtctgagggacgatggcttagccacgttgtcccccttttgacttacaagaagtctacgctacaggaggcctttcatcaaacccaggggagacactggaggcctcagtgggctcagcgggttcctgcgcaggccaggccggaaaaatgactcggttcccttgcaagggctggctggaggagaaggcgggcttccttcaggcagaacaagtacctcctccccacccagacatgccggtgcttgccctggggcccggggagtgcaggctgccgctgctgagcacagacacggcagcgtgggggcagtcaccaggccaagtctttgttgtccagccttgaaggtttcaaggcctcctcttctgcccctccctcagattgaaaccctgcagaacaaaattaagaacctgagggaagtccgaggtcacctgaagaaaaagcggccagaagaatgtgactgtcacaaaatcaggtgaggcagtagcaaagggacctccctaagaccccactctcctacaggacagttcagttcatcccctctcgtgattgacccctttcattttttatttttatctttatcttctcccctcatggcattaaaaaaatccgtaatttacctccctgttgtcagccagtgtggcacacggacctgctcctcagccaggctggcgcccagattccagtactgctagcaagagacccgtgctggctgcgcagagccggctccaggccggaaaagtgcctctgccgattgccctttcagaaatcccccatgtggtttgaggtccatgttcccggcttaggggtcccctggcccaaaggactgaactctagaacagctctaatagaacattctgtgctgacggaaatgggctatatctgcactacaccacacgtggctggtgcatacttaaaattttggctagtgtcactaaggagccaaattttttattttgcttaattcaaattgaagtagccacctgtggccagtggctaccatactggacagcacagctgtagaagccctgctgtctttccagaaagtgttgcaaaacacaggcttccctgtgttgaccccgaccaagtgtgagtaggcagggtggtgagggaaccaacctcaagatgctgaggctttgacatgtaaaattaaccatcaaaaaagaaaggaaaaaggatgctgaggctgatgcacctaaagccaggcccagcttctagtcgtggctaaattacaattaacccaacctgctaaagtctagcaaaagtccaggcagagtcctggctcatgcttggagaaagaagccactcaggcaggcacctgctgccctgaggatagggtcatgccctacccaccaccaccccagaaggagggacaggggtggggcagcagcaacacatgggagtcccagaaatcacagcttgcacctgccagcggagccctctgagccactcctgaagcctggggctgggggggtctgttacagctaccacacccagcacaaaggccgcctcaagcacagaggctccagtctgcatcctttcaggtaagagcagcttgaggtcctggggaagagatgcagaggcctgcatgaggaggtggccctcccttaagctaaaactcagaagaaaaggaaagaagtccaggcccttccctgggaagtccacggtagccctcgaagaggccttacttcccaatcaacactgagcgggcctccgacgcccccttgtggctaaatggggttaccgcaactccaccaagcagggcaggacacaggaaggaggggaaaggggtgtcaacaggagtcccagtagctgcctggttctgtccccagcttgtgcccccttgggagttaaagtagaatgacaagacccaggttctggtcccggctctgccttggagcagcactgggacttgggaccctgaattgctatgcccatggctctctgttggagaagcctcagcgaagcccttaggtggacaggaagagcagagacatggggtcactgatccctcagaggcccaaggtgtgtgtggccctctgcgcccataggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacacgtgagcaagcccagggcaggggtggacaggctgaggcccaggggttcaagaaacttctccacttagtgacccagacctctctcagaaagggggtccccaacaccaggggtccacggtgctcgggacagcctcttggcatttgacgaactggttttaggggctgtccctgacaggaatcactgttggcagatggggcctcctcccgcaggcactcaggacatgctctctcttccttggcagtggggcctttctgtgcctgcaccagcgccaacaataacacgtactggtgcatgaggaccatcaatgagactcacaatttcctcttctgtgaatttgcaactggcttcctagagtactttgatctcaacacagacccctaccaggtacaggcaacccgagctagagggatgggggtgtggggtacaccagtgctgccaggtaggccccccccaacctcagggaagtgatgacaaattgtccaagtcccactgagtccctgagccggtgggagtaagttgtgaagctgctgagattgggggttctgtgttcaatcagccttttttgcctccatcaccctgctttttgcctccatcaccctgcgtgtgtaatatatatggcttcttccctctaacttaacatgcagcatgcaaccaggttttgccggaacttgtgaagactcctaacactgtcaggctgtaggatcaagccaaatatcacccactgcagggcctacacggaccgcgcagctaatataacagtaacacactgcaccaagcactctgctaagtgcttccgtacagtaagccatctaaacacacatgcgactgaagtggcccaggaccacacaagaccaaaaggagcagtggcatgtctggtcatc

SEQ ID NO: 101272 - DNA, 1077 bp, Homo sapiens
cccctggcaatcaccaatcttctttctgccgctatagatttacctattctgggtagttcctataaatagaatgtaacaatacgagcccgctttgtgtctggctggtttcactccgcctgcttttgacattcatccacgctctagcgtgaatcagaacctcgctcctggttctggtcgcatattccgttgtacagatgatgtaccgccatttgtttacccgcaagcagctctcgcttgaaatcctcttgagtcagtggcttcttggctccaggacttccgtcttgccggtgtgatcacctcgaggccctcccctgcggtccaggatctgcgagcaggcgggtagattccacgacccctcgagtcgcaggcaaagctgagcctcatgcttggaagcccggccctatcttgatgaaggacccactgccctgggagcctggccagcctttcctgcctccctaactctgccactcctctaatgcccacagagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgagtgtccaggtggaagtcgagggtgaaggggacaggacagacctcggcaaagggcttcccacacctcttgggcccctgaggaccaagatgacaaggatggtggggacttcagtggcactggaggccttcccgactattcagccgccaaccccattaaagtgacacatcggtgagtgtccaggtggaagtcgagggtgaaggggacaggacagacctcggcaagggcttcccacacctcttgggcacctgggctgctccccctccaccacctccgagccacacgtgatcccttctctcaagcaggtgctacatcctagagaacgacacagtccagtgtgacctggacctgtacaagtccct

SEQ ID NO: 101273 - DNA, 1111 bp, Homo sapiens
agcaaagaactaaaggggtgagggacggtggcccctgatctccagggaaaggacattccaggcagagaggatggtaaagaagaaggccctgaggctgcactgtgcctgggctgtcaaggaacagcgaggagccagtgtctgccccagaggttcaggggaagggttcaggaagggccaggatttgggctggctgtaaagggggggtcgccttcactcaggaagtggggacaggaagggcaggagggggacagggtgaggctgtcagctcacggcatgagctgagacacagaaactaagggggggcgagcacagagtgggggttcagctgaatctgggccgcagaggggagctgctgaggttgaggtgccagactgcagcttccatacctgcagatgtcagcctcccacaaactgctgcccacctaccgctccccaccccccacgcgaggctgaggcaccaccacctgagtgactgagtccccgatctcctgcctcccccaggaatccccacatcgtcctcaacattgacctggcccccaccatcctggacattgcaggcctggacatacctgcggatatggacgggaaatccatcctcaagctgctggacacggagcggccggtgaatcggtgaggacggagcagggcaggtgttgagggggccgggacattgacctgcgggaactcagagcaaaaccctgtgggtctagaacgtggggtctccaagggtcgggagctggggttctcaggtcccgccatgccaaccacttacctgctgtgggagagaagcatggtcccctctccgagattctgtcttcccatctggaatgtggccaaggtgaccagttggggaccttctctgagctaaaattacccaaagcttgaaatgatagcagcagtgatggtaggagatggtgctaactgcacggcgcttgtgtgtgaggccctattctaagtactgtgcagggaaatctaggaatttgatcctcacagtaacccagcgaggtggacattatcatcatccccattttaccagtttggaatctgaatcccaaagcgattgagtgacgtgtcggaggtatcccagcaagtctggatgtagctctgggaat

SEQ ID NO: 101274 - DNA, 1064 bp, Homo sapiens
gcagcccaagtttcactcattcattcattcacctgacagcattattgagtgccagtgtacgtgggatacagcaggcagggaacaaaatgacaaaagtgtctgccctaatggaggcagcatgccaaggcagggacacagatgatccacagataagtaaaagagatggatgccaagaagggccatgaagaaccgtggaggggagggcgggccaggggtgacaagaggcaggaaggtgcagtgacaaaggggacagcccctgggaaagttgagcaaagacctgaagcaggggagggacggggcctgagatctcaagcgcctgtcaccccgggtcggagacgggccaggcacccagtccccactgtcccttgcctcctcgcccgtgttgcagatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgtaagtgtgtcatcccccagggacccagggaggcccctgggcccagctcagggcttcaaccatgcagcccaaacccaagcccaccctgggtggcacacagttttcgcagatgtaccccagggccagcggaaagcaattatgtcatgcatgttatatccctctgctggggaaggagaggccgggagctgttagcacctgtggaaacaggtgtggtggggccgtatgccaggaaatccagggagctgggctgtatacgtgtgtgcgcgcacatgcatgtcaccagcgggtgggaatggtgcttggatttctgttctgggctgggcagtctttgagcctggaggttgtcagggaggaaccccggaccacagcacaggcagctggttgtcagctgggatcagctgagccaactctgggcagcagcacaaagggaaatgctcttccctcccatccttcctggaggaccacgtgggccgcagccctcagccagccattctcctcgg

SEQ ID NO: 101275 - DNA, 1078 bp, Homo sapiens
ccagcccggccaacatggtgaaaccctgtctctactaaaaatacaaaaaattagccaggcatggtggcagacgcctgtaatcccagctgaggattactcgggaggctgaggcaggagaattgcttgaaacctgggaggcagaggttgcaatgagccaagatcgtaccattgcactccagcctgggtaacagagcaagactccatctcaaaaataaaaaataaaagacacactgtatcgcaaatgtgtttagtattttgataaccgtatttccaaacaattgattttctctgtaatcctatatcttgtattcaatgcacgtaataacattggagaagggatccattgctctgtgtgccagagggctccatggcagagcaggtgtgcatgctcaggcctcggacacacaatagtttaataaacatcgtcaggcactttctcacgtggcctcctgatccatctccctccgcagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggtaagctgcaacctttccagcctgggagtggctgtgtggcccagcagttagaggcccaactcaggagccagactacttgggttcagattgtgactcaggcacttaaaagtgtgaccttgagcattttacatacacctcctcctcagtttttcatctctcagccagggacagtggctcacgcctgtaatcccagcactttgggaggctaaggcaggtgaatcacttgagtccaggagttcaagaccagcctgggcaacatgacgagaccctgtctgtacgaaaaaaatacaaaacttagccgggtgtggtggcacatgcctgtggacccagctactagagaggctgaaatgggaggattgcttaagcccgggagtttgaggctgcagtgagccaggatcttcccactgctcttcggcctaggtgacggagcaagactctgtctttaaaaaagaaaag

SEQ ID NO: 101276 - DNA, 1216 bp, Homo sapiens
gggcggtgtggggagatgccatttgaataggagggttaggattgagccccagtaagttaacatttgaggctggacatggtgactcacacctgtaatcccagaactgagagaggccaaggtgggcagatcgcttgagcccaggcattgagaccagcctgggcaacataatgaaaccctgtctctacaaaaaaaaaaaaaaaaaaatacaaaagttatctgggcatggtggcttgtgcctgtggtcccagctacttggaaggctgaggtgggaggatagcttgagcctggggaggttgagggtacagtgagccacgaccgcaccactgcactccagcctgggtgacagagtgcgaccctgtattggaaaaaaattaaaagctttgagcaaatagctgggaaaggtgaggaagcagcccatgcaggtatctgaggaaggtgatttctttcaggtaacagcaagggcaaaggccctggggcaggtatgagctttggggttggggtgctggtaggatagagggagaccccaggacaggaggctggggggaaagtgggggcagatgcagtcacggagcaggacaggagacagttataggactttgtagggcatggcaaggactttggattttagttgaggtggatgtggagccactgaagggctttgcacagagtggggggcttgatcaaatttgtgatttaatgggatccttctggctgctgtggaagatgggctgaaggtggaggcaggaggaccagggacgaggttccagcaaggtccaggcagaggcagtggtggcttggaccaagatggtgacaggcggatgatgggaagtggtcagacctggatgtgtcctgagggtgaagctgctgggacatatgtgagggaggacagaggagctgaagtcccctccatggtgcgtagccttgacccactggcattgacggatgtatggatcacagggcgaaaatcaagaggccggtgtgaagtgctgatttgacaccaaatgaagtgatttgaaggaaattactaagtatgcagcggtccaaatgatacataaaaacggccaaacgtgtgtgagaggcacgcggacaactggaattgagatgatgccacgaagggcaaagaccccgttttgttttcgcagactccgtgcctgcgaaatggcgcgggtctgttttgggaaggacggactttccacaggcttctgcttcatctttc

SEQ ID NO: 101277 - DNA, 1157 bp, Homo sapiens
ccttagcaccattcttgattttttttttcctattcctttcacactccacattcagttcatcagcaaaccctgtcagctctgccttcaaaatatgcccagagtcccctctgctgccaccagcccatccgcgccactgtcttccccgcctgccctgttccaggtttctcctgggatcccccagcttctgcgtttatgaccccttggtctgttttcaatgcagcagccagaggggtctggtcagaacctagttcagatgctctttctcctctgggcagagccctccttggctcccacctactcagggtagaggccccgacagccacctcagggtcccagtgatccttcccttctctctgaaccctctcagcctcctggtctcccctcagtcactgtcctccagccacagcttctcaagcagtcagccacacctgacatgcacccactcacagtgctttgcacttctttccttttctcaaaacttctacacgtctgcactttcctcgtgtctgtgttccaatgctgcctcctcaaagaagccttccttgactaccccatgcctcctgttcatcccagttttttcccaccagtgcccccatcaccactgaacaccactgactgtgtattctgcccatttgtctcattgattgtctcgtttctaaaatgccagctctcaggctgggcgtggtggctcacgccagtaattctaacactttgggaggctgaggcgggtggatcacttgaggtcaggagtttgagactagcctagccaacatggtgaaaccccatctctactaaaaatacaaaaattagctggatgtggtggcgcaagcctgtaatctcagctactcgggaggctgaggcaggagaaccactggaaccagggaggtggaggttgcagtgagccgagatcacaccactacactctgtcgcttgggtgacagaatgagactctatctcaaaaataaataaataaaatgccagctccctggaagcagcggcctctgttctgtgccctcgcgggttgccaggcctagagagtgcccaccccatcgtaggtgctcaggagaccttcccaggatgactggtgactaagtctccacattctgtccccgccagcagcccacccccatctcttccacactcctttctcctctccc

SEQ ID NO: 101278 - DNA, 2334 bp, Homo sapiens
acaccaacaatgagaactgctcctcgccctcctggcaggcacagcacgagagccgcacctttgccgtgtacctcaatagcactggctaccggacaggtgagcagggacgggggcaggtgcaggaagggagtgacagccagggcgggcgtccctaggtgtggtctgcacaccactgcggtacccaagttgattctggatagcccctagagcaactctcttataatttcagagttgtgcatttatttctgtgtgtattaaagaaatacagatttatttgcctacagtagtgatgtaaagtgaccttgtcaaaggaatttgagtcccccaaaaaagtgagtcttttcaaactatgaatcatagtgtggagaggccataaggtgcccatgcatgagtttgcatcctctgttaatagttattaagcccatcagggactgtttcgttgacttcaaaccattagcttggaagaaggttccaaaacataggggtgggggatgggaattcatggaggggaacagataatggggctgtgtggtcgctttctacgtggcagtaaccaaggtggtgcagaaactgacatggtggttgactgtccacactcacccgtgtcatcctgggtggagggcgacccagttcctgtttgcttatccttcaggaggtctttggtgggctctgaaggctcacctgccaggctggttgtctgaggtagagatgcaattacagtatagtcacttacctgtagcgccattgcaaaaccctccagactcaattcatttaacttgctttaattaaaaataaataaatactccccgccttgggtaagaagccgcggcggttgtgaaatcaagatattgtggctcagatgttgcaaccccaggaagttgcatccaagtgacaaggggtttgtttgggtgggagtgccgcaagggaaggatggactcctcctccagccctgtccgcagtgctggacctgcagccctcgaggctgggcagcttcctctcagatacacagtgtgggctggcagggatgctttggtgtggggagcaagccagtaaggtgtgtcttcttacagcctcatcccatagccagaatcacctagaaagtatgttctgctgagaactaggaaggcctcgttcctataccttgttcctgtgtattgtgcgtgccattatgcagaatcaaccacctgttggttcccctgagcctctgcagaaagccacatgtgtcagaagttaccatggccaccaccctagatgattggcgggggcctggatgttgctagcagaagcaggacaggcaggcccgcagcacagcagtgggcccttattgaagatgcacctgcaacttggctctagaaagtacagccatgcactcaagagtgaccagccttgaaatgttttaaagtctgaatatttcactgaaaatcttattttaaaatatgccggcacagcttattttttctttaatgtatactgggggccaaagaaaatatgtctgaggagtgagtgtgtggctcacagactctcttttcacaacctctgggtgaaaggtctgtacagaaacctttcgttttggatgctggaagatcagtaaagaccctagacctgttctcatcaatccccctcatttcacagccagggccactgcagcccaaaaaagagacctgcccagagtcaaagtgaggtgtttgtggcataatcaaaatggaatgcaagatcatgggaattcagagggggcatggaaatagtattcatcagactgaaaggaaactcatatattctgtgccattttgagggctcagggtgggagctaaaggctagtgtttcaaaatcttacaggcgacatgagaaaatcaatcatttcaagaataaacattctctaaagtggatttcccaaacttgtccttgaatgtatgcaaatcaccaaaaagctgtctccctaaataagtgcttttattcaactatgattcattattataccctcatgaagactgggagcgtaatgtcaagtgtaaagagccagataccgagaacatttacgtttttgtaaaactgccactgagaattttattcattatatttagaatgccactctgtacaaagaatcccattccagccttactttcagaactcaggaccctgaaaacacctgtttagtctgatgaactggtgtactccttgttattacataataagagccacataccctgtatagtttccctctttgccctggcagctaggaagctcaggtttgagttttatattgagttgttgtttaaagtggaaatgtttttaaagatccaactgcgtgatatgttatactgatcagtgttgact

SEQ ID NO: 101279 - DNA, 1047 bp, Homo sapiens
ccaagttggctttactctcaggccagctctccaggcagcattcctggcatcactagacccacatgaacaccatacaggtgcaagccatccctgtggaaagagagcttctctcacctagaagagagtacccaaattgagtctttttggtctgacactgtctgggacttctggtcaaccagattcaggggaatggaacacagtggttggccagatggagtcaggtgcacattcctggagccaggactggagccaaccccacttgaaccatgaggactgggattgggatagagcagattccccaaaggaaaattcagaagctagtgccagaagaaggcaggtagctggtgtgcagtccagttagagagatgctcgtgacaccctcacatggcgctctctgaagcagctgctcaaactgtggaccagacttattcattcggcaggtgtttcctgagcacctactgtatgccaaaggagatccaacagcaaacaaactaaacagagcttacattctaatgcaagagttaacaagacacatcgaatctatagtacataaaagagcagaaagtgaggaggagaataaagccaggaggggaagccaggaggggcgatcaaccaggagaaaggtggagaaaagaatcgctgggattttctatagggtggtctcattgggaaggggaaatctgagcaaagaaggtaaggaaaccagtcaagggggatccctggggaagagcactccaggcagagggaacggtgtgtgctaaggccctgaggcagatgcggtctcagcaggctcagagccgcaaagaggccagagcagcgtgcacaagagcagcaggaagaatgaacggtaatagggaggtggtggttggatggaccgtgcaaggcatgagcctttgaatgggaggaagattttggctttctgagtgagatggacaccaatagaggacattgagcagaggaggacattgagcatctgatttgtgtcttcataggacccctctagaagaatagactgaataggtgtaatgagagcagggtgtccagtaa

SEQ ID NO: 101280 - DNA, 1023 bp, Homo sapiens
tagattagggcctacaagtcttgccctctataaacaagccagacctcttccaccagcagcactgggttttgaaggaggcaagggatgggaaggtggttgtgggaggggcatgataggctttttataaaccactagacagacccagatcaataatgcatgtcccaaaaaagcccaatacattatctcacagtctctgctacaactggcatgcagcgggtggtcctaaaaaatttatcatttgctattttctgcccatccgtgcagcagttctgacagccctctgggctggagacttcttgactgagataatcccaggattctttccagtcccaggacagagaacagacgtccatcctcattagggtccggttgggaggactggtgccagatacacaagacgaggggcttgttctgtttcctaattgcaaggttggggggttcggggctgtaccacgtatattcaattttcctttccctgcacgcatttgactccctaagctgtcatttggaattatcaaatgcccaggggaactgcttccagggccatactagttcgtaagtggcctaaattatcattacatgtttaaagtagttggggacatccctgtgtctcaatggccctctgagaccaacggacttttgctggacttccgctccaaaagaataagagggaagcacatggaggtaaaggtctcgtttgcagacgtcctttgttcagggaggcagtagaatctttgggctctgccagggtttactgatttaatttgatctaaacctctggggagcctctggggctccagcaggctctgagacagcaagaggattaagacatggttctggcctggagcaagagaatttttgcagcatcccagttctgatctatgacttgagaatttctttaactggacttatttttgaagcttaaatattattttaaaaggaacctccaaattctgactgtaaaggaaaaaaccaatacccattgccttcggcaaaggatcactgtaaaaccaaacacagtga

SEQ ID NO: 101281 - DNA, 1536 bp, Homo sapiens
agcgctcaattttctctattgtcatttcatttattctgcaacttaaaactaataggctgggcacagtggctcacacctataaccccagcactttgggaggccagggcaggtggatcacctgagttcaggagttcaagaccagcctggccaacatggtgaaaccccatctctaccaaaaatacaaaaaattagccgggcgtggtggcaggcgcctgtaatcccagcttctctagaggctgaggcaggagaatcgcttgaacaccaggaggcagaggtcgcagtgagcccagatggcgtcattgcactccagcctgagcaacaagagcaaaactctgtctgggaaaaaaaaaaaaaaaaaaaaaggaatacttttttgcccaactacaagatcccttaacaaggggctttcacacgcatccccagcagactgaaatcttacaacagccctgtctactcattttgttcatggggaaaccgaggttccaaacgggcttgctcacgggaaaactgagccagtgagtggaagatctgccactcacacatgccagttgtccagcccaaaacatccagctccaggctctcgtttaaacccctgattgaatcccccgctgctggggagctggaacttcatctccctcacctctgtaccccacggtgcgggcagatgcaagaggacggcaaatattcaccccttgagaccagcccgctgctgttcctctccctggggacgatttgtctgtggagttgggtggattattcagagacggctgttatctgactcgggtcttgggctgccaccgacacatcagaggctcactggatccagggaagaaattgtttctgcagaagtggccacagaaggcttttctgccagtctgttgaccaagcaaactgtaaagactttgctaacttcagcggagttcggttttcactctgccatagccacccctgttcaaagaaactcccattgttcatgccagccgccatacaaatcattatgcaagaatgagcagccggcagccttgacataaatattgacctgattcttcctcctcctctagatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggtaagcctcggggccccagggtggcacctcggcccctcggagcagggtccctgggttaggctgaggctcctgaggcaaggcggtggtgttgatgcgtcgtgctcacttttgagtacattgaaaccaagacacgggccacccacacgtgtttggggtcacaactgggtcctcaaggttaggggtctctacccttctccagt

SEQ ID NO: 101282 - DNA, 1743 bp, Homo sapiens
caagtcaagatgagatttgggtgaggacacagccaaaccatatcagatacacaacatagtttgaggattactctgatttggggtggttcagggactgattcgatggctagagtttgtctccttttcagctgtctggcagcctccagttacctccagcagaaagtctcagatggtgctaatgtgctttgactcctttcaacacctgctaatctcacttcaaaagagagtgcgagcgcgagggcacgcgaagcctgggaagctatttgcatcaagttccactgattcagctttctttgacttttatttgtacaattagctctacagggaagcgatgtccactttccatttatctttgggtaggaagttttcttttcccaaaacatgtgtttgtgtttttattttaaaatgaggccatttaaagaagcacgttaagcaaataatcactgaagggctctgcagattcagcagaaatcagggccgtggtccttgaacggaaagagttgggaaatccgagtttcgtgatgagaagcccacattgaacggtgagggagggcagaattcacatcccatccctgccatcttctgtctgggtggccttaggacagtaatgaaacctcagttttctctggggctaataatagtacttgcaggagggagccttggtggaggttgaaggagatttcagagtgcctgacgcaggacagctgcagcggtaggatcactctaataatggtttacattgtggaatatgtatcccagttagtactatggccaggctctagtcccagcacactgtatcaacacatttaatcctgcacacccatttcacagatgaggaaactgaggcacaaaggtgttaagttactagctcagggtctttcagcaagtaactccaaagtccacatccttaaccatcacaccacgtggcataaagcaggtgcccagcaggcagttgccgcagtggctctggctgtcatgaggtgtatgtttctgcagacgagagattgagaaggaaggtgttgttcaccctctggtcccatgaaactcacagttctcatgtcagacgactgcatcgagtgtgtccccagctcccctgaaattgtgactctcagagccacctgggaaggaggcattgagcggagcctgcttcctgctcccaggggaggtgctagaagggagacttgctgtcctggccagcctgacataggatacaggtccctgaatgaagtaaattagggtgcgcatcagggcagctgggagagttgattgaaagcactgttttcagaggcaggtgggcaaagggagcaaagaaatgatgctgcaccgaggaaccggtagcaacaggagcccttactttcccgagacttgatggggcaagaggagggagaggtgaactcagaactggggagacgctagagccaggaggggccccaggcaggagctgcatccacacacacagacacgaaggctactgcctggggagctactgcgtgcgggaggagaataaatgcacggacttcccaccacctcccatgctgcagcctcccagccggaagccagagagcagggacgtgccgaccgtgccatctgtagagctcagcctcccagggtgccaagcagagctgggggagaaatggagcaggagtgacccttcctggggtttttcaaccatagcgctgcccagagaacacagtggccagctcctcgttggtgtccatggagggtggctggggcaaggcatca

SEQ ID NO: 101283 - DNA, 3450 bp, Homo sapiens
ggtggcccaaacctagcagagaacacaagccagcatttattgggcacttgctgcatacagatctgttgaaagtctccgtgcatgttaaaccatccactctgtaggcaagtgcttgtaggtgtcctcactttccagatgaagtcactgagaagacaagaggttcagacacttgcccaacctctagtaagtgacggagctgagatccaaacccaggcaggctagctctagatcctaccctcctcctactcagcgtgttccctgtggcattttcccccaagtaagtatcaggctgtttgcttacctctgtccgctgtttgtcagctctctgagaatcgagagttttgtctgttctttttttttttttctactgatcatgaaacagtacaaagcaagtggcagatgctcaggtatttgagggtgtgaattatatggcctgtcaaacatctacccacttgacatacaaaacattttggtgctcagcttcctaagacttgaatacattgtttctaaatttcctttgtgctctaactttaatccatggccactctgttctcacagcttgccggtggtttgccattatttccagtcctcttttctgatcattctcacatgtagctggaatctttcaactccagcttttcctatgttgacttagagtatcacttccaggagggcagggagctttcttttcactgctttatccacagtgccaagaactgtgcctggcacacacgagccttcaggaatgtcttgttacatcaatagttaggcaggtaactgggttcctaagccctgcatttttgccctacaatctttatgccctaatttcctttccagatcctgagcctttgtcttgaaacctgatctttccctcctccctctgaatgacccttctattgtctcctgccctgttcttgagagccggcttggttctctgcctccatttggaattccaagaacaggcaaggagagccacaagatggcctgggctaggtaggggagacagggagaagctgtggcccataggttacaggagcttctgtcctttctttgacggccccaaagaggaggagagaaggctggagaaagcctgtagccaggaagaaagggagacacaggggagtgtaaagtttaacagatgtgcgtgtgtcatcccctgtctagacagcttctgggcttgtgaggtttgggaccacactttcccatccctccaggggcctctctctgtttcctctgcctgctctttgcccaaactgtttctcctgcctgaagcatcctgtcctccaccctcctcttcactggccatccaaatcctttggattcttcagaactttgctcctgttaggctgctcagtttatgctaagtactcctccaggaagccctccctgactgctcccaggccagcagtttcccctttcctcttgctgtttatacaacacacttaacctcagtcccttgtatcacttgttgctttccaagtcagcataagtgtcaaaagagtaggctctggggtcagaatgtctgtgtgcaaatagccatgctggcttgcttgttttgtctgtcacttggaggtggcacatccaagtgaacctcccaggggacagggaagagtggattactgttgtaatcgggcaggattctcctatcactgaacactgcctcacatatagcaggcccttaataaatatttgtaaagtaaatgaaggaagagagaaatgatcaggctccctggaccacctgaggaggccctcaggtctgttgctgggctctggccccagcccgtgggacatatctgcacacccacaatttcctttcttccctcctctcatgagtgtttcccgtctgaccaatgccgccttctgcctctggccccttcttcctctcccaccacctcaactgcctaattattaccaaacttctctctcctgtttttttttttttgttttgttttgtttttttttaaggcagtgtcgctctgtcacccaggctggagtacagtggctcgatctcggctcactgcaggctccacctctgagttcacgctattctcctgcctcagcctcccaagtagctgggactacaggcgcccgccaccacgcccagctaatttttttgtattttttttagtagagacggggtttcaccgtgttacccaggatggtctcgatctcctgacctcgtgatccgcccgccttggcctcccaaagtgctgggattacagacgtgagctgccgcgcccagccctctctcctcctcttgttggatttggaggtggagagaagatgggaagggaggaccaaagggacagtattcagcacccatgctgcacgacactgggcaggttctggaacctgtccgtgccttatcttccttgtctgtaaatggagcatcccaactcacaaggtggttgtaagggtggcgtgaggtcacacactaaaagtgcttagaattgtgcagggcccctgatgttagctatcattcattattgttcttctagggtgtttcctgtgttggtctgggtgctccctgttgcaaatgacagccctaattcggactctcttaagcagcaaagggcacttttttgagtctgtacctggctacaagatgcaacttggtccaccccattgtcaccagcatcctctctctcgggctccatccaatgggcggccaccatcagcaccatattcatgcctcctggcacccagcacagtctcctccagcctccaggactccctctcgcttattggccagacttgggtcacatgtctgccccaggaccaatcgctgaagctagagctggaattgctgattggctccacctggctcacatgcgctgccctgcagtcaaaccatatataagggggggtgggaaataagagcacttgtggcctcaaagcactaacaggggctgttaccaggagacaggagataattctttgttaagccagtaaatattttgaatgcctgctatgccgcaagcattgttttaattgttgaggatatagatctgaacaaaaatgacaaaaacctgtaccttcagggggctgatattctgctggaggacatccgcaaagaaataaaggagctagctgtgagaggtggtaagtgctactggggagggcagagatttcggttttaacctgccaaggtgaaatttgagcaaagacctgaggagggggaagaagggatggtgaagataacctgaatgaaggctccaggcagagggagcagcaagttcaagggccctggggtgggctgtgctagcatgtgcaaggaacagtacagagaccgtgtggctggaaccaggtgtgcaagggagagaggggaaggcaataaggtcggagaggtgatggagcaggttgggtgggttcttgtagcccctttggagggtttttgcgttttactctgcgtgggatggaagttattgaaggccgttcagtggaggaagg

SEQ ID NO: 101284 - DNA, 1050 bp, Homo sapiens
gccgtgccctgaggcctctgttcacacaggcacgaggtggccaggaagccacgggagtcagccctctgcctccagcccgccccccaatttgggttcatttggttgcaagtgagagagcaactaggaatgacctaattgaaaaaagggaatttcacttctgatcttgaagagtcaaaagtatggggaaactgacctacaaagaaaacagaaactagttaaagaggaatttattgggcctgaaacaaagaacccaacccaaatcttcctctttcaggctgggctggatcccaggtgtccagtgctgttaagtcccaagtatggtgcatttcacagcactgctgtgttcggtgtgttggcttcattcccgaccccactcaagacaaagtggcgtcgctgtcttccctggtcctcacattggaaccacatggagtgagttagccagttgtaaagactggatgcctcttcctgaccagtcaggccaaagggcctggattactctggcccgtcactgaggcaaggggtggggaggctctgattggcccaggtctaggatcccacgatctagcattgtagctccagaactggagcctaatttgaactttgtggaccaagggtggggagaaaaggatcccccaatattttttttttttttttgagacagagtcttgctctgtcgcctaggctggagtgcagtggcgtgatctcagctcaattctcctgccttggcctcccgagtaactgagattacaggcacatgtcaccacacctggctaatttttgttgtttttgagacacggtcttgctctgtcacccaggctggagtgcagtagcgcaatctcggctcactgcaagctctgcctcctgggttcacgccattctcctgcctcagccttccaagtagctaggactacaggcatgtgccaccacacccagctaattttttatttttagtagagatggggtttcaccgcattaaccaggatggtctcgatctgacctcatgatccacctgccgcagcctcccaaagtgctgggataacaggcgtgagc

SEQ ID NO: 101285 - DNA, 1025 bp, Homo sapiens
tggacgattctgtggtttgaccaggtggttcttcagcttcatgtgatatcagctggcaggtctaaaacaaccccattcaaatggctggcagctcttgctggtcaccagatgggagctcagttattctccatgtgggctctgccctatggctacttgggcttcctcgcagtatggcaggttcagggtagcctgacttctaagagtgcaaaaatgaaagctgccacggtctcttaaggcttaaccgcaaaaccggcacagcatcacttctgccaccttctcttggtcaaaacaggtcccaaagccagcccggtttcatgaggtggggcccacacaagggtttgaataccaggcagtgtggctttttggagtccaccaaagtacccattcatcacagactgcaagtagcagagcccaacacttactacctcaagctggaacaggatttactggggggctcaggaaaggacaggtcaggaactgaggaaattctggggaccttggcgcaggagttactagcagcctcctgaaggagagtttccatcccaatgcgacaaatgcacccctgctttttctttctgcccttgacactttatttgacagttggggacatggtaagaaagtctgattgaccttggtcacatgatcaccccttggcagagaggatgggggcatcttggcagaggggagggagtcctcaaaaggaagctggggtgctgtcaaaagaaggggaccagatggacaaaaattgttagaaatctctgcaccgcccctgcataggtgactccacccctggcagagcaatgaacattttaaaacgagtgaatggactttgaaagtccagtataagtagaatgcccaaacctgtgtggcagcttctccagctccagggccccatagctcaggtgctgctgggggtctggaagcttctctccactttacggggcaaagtcaactcctagaacccctgccatgcctcaatatccccctccagaagataggggcagtttgcttctggctcctgaaag

SEQ ID NO: 101286 - DNA, 4239 bp, Homo sapiens
gaaggcggggaaaatgctctaggcctggcgtgctggctcatgcctataatcccagcactttgagaggccgaggtgggaggatcccttgaggtcaggagtttgagaccagcctggccaacatggcaaaaccctctctctactaaaaatacaaaaattagccaggtgtgatggtgcttgcctgtaattccagctacacaggaggctgaggcaccagaatcgcttgaacccaggagtcggaggttgcagtgagctgagatcgcactactgcactccagcctgggcaacaaagtgagactcagtctcaaaaaaaaatttaaaagaaaaatgactgcatgatgtgatggggtgggaggcaactttaggcaggctgtcagggaggcctctgtgaggatgtgacctttgaactgtgacctagattttaggaaggagtccgccttggaaagatctgggggaagagcatgccaggtagaaggaacagctagtgcaaaggcccagaggcggtgggaggggcctgtccaagacacctgccccaaacacaaatagaagtcaagtggggtaggccaggcgtggtggctcacgcctgaaatctcagcactttgggaggctgaggcagttagatcactggaggtcaggagttcaagaccagcctgaccaacacggtgaaacctcatctctgctaaaaatacaaacattagccaggtgtggtggcacgtgcctgtagtcccagctatttgggaggctgagacaggagaatcacttgaacccgggaggcaggggttgctgtgagccgggatcacacttctgcattccagcctgggcaacagagtcagactctgtctcaaaaaaaaaaaaaaaaaaagtcaactagggtagagggtcaggagtaagtgggggagggcacgtcagagatgagaaatacaggccatgctaagaaattttagactttattttaaataaaatggataactgtctggacgcggtggcttatgcctgtaatcgcaacactttgggaggccaaggcgggtggatcacctgaggtcaggagttcaagactagcctggccaacatggtgaaaccccatctctactaaaaatacaaaaattagccaggcacggtggcgcacacctgtaatcccagttactcgggaggctgcagcaggagaatcgtttgaacccaggaggtggaggttgcagtgagctgagattgtgccattgcactctagcctgagtgacagagcaagactccatctcaaaaataaattaaaaaataaaatggagaaccattggagggttttaagtcagagaatgatatgatttgtgtttcaagaagatcctgctggctcctgtgagaggcgtgctgtgcagatggaagtggtatcaccgggactgttaggcaacagagagggcccgagagtggcttggaccgtggtggtatcaatggagatggagtgaaatggggattggagatgtattttggaggtagggcccacaggacttcctagtggattggattacagagtgagggaaagggctttgattctcaaccgagggtgattttgacacccagaaaacattttaacactatccggagacagtataggttgtcccaactggggaagggttgctactggcatctagagggtagaggccagggatgctgcttaacctgcaatgtacgggatgaccccacagtgaaaaatgattcagcccaaatattcatgatgtatcctgccaaggagtcaaaggtgactaggcagcctggtgcgtggtgattgctaaatagggaagataggagagaaggttttggggaggaggagtgatctggaattccgacgtggaaatgttgggtttgagatgaaccccacctggatgtctgaaagctcagtgggtggtgaacgtggatgtctgcagccggtcggggctggcaacctaagtttgggagttatcggcatattgatgttattttaagctgtgggactggacacaattatccagagagaatgtgttttgttttctagtgtggttttctccccccagcctccccctagtgcctgtcatgaatctatttgatgaatatttttagcatatcccacatgctcacctctctgacatttccaagaagttcctgaaggctcgggctgagcctccccttcttcatcgcctggtttctcagtgattaacagacagagctaaatattcattgctctgccacagatgcccttgggaaattgcttaaggtcatgtgggatctcgggccttgtaggcagcacgatgccttctgggtggaacagctgttggcatggccttcagagcttctcctccagcccaggccagggcttcttggaattctctgtaaccagaatgttttgaattccccacgttctcttaatgtgattccaaagcacacgttgcccagtggccctggcctctgccatggagcgtcatcttacagaaggcctggcccactgctctgcacacctgggcccagcttgaatcttagataaattctatcccaaactcagagttgttatggccaggtcttgtgtgtgtaagttggtggacagggccatccccagggaccacaaatagtaccaaagatgtgtttggccatgtggaagccagatgtgttaggggaagaatgtggccaatagcttttcttattggctcatggtcaggaccccagcgggtgacttgacccaccccagtagccagagaagaggagcttttttgtttttgagacagggtcttgcactgtcatccaggctggagtgcagtggcacagtctcagttcactaccacctcaacctcccaagctcaagtgattctcccacctcagcctcccaagtaggtgggactataggcacaggccaccatacccagctaattttttttttttttttttggtagagatgagatcttgctatgttgcccaagctggtctcaaactcctgggctcaagtgaccctccaaaagtgctgggattacaggcgtgagccaccctgcctggcctggaactttttgaaaagagattgaaaaaactgttagctcacagaagccttggagatgttcctgcttggtgaaaatcagaccatctgaaagccacatttctggtctgctctcgagacagatactatccatagacttctgattgcaggccacttatctggatatttcagagaccaggaaagcctactataattcttagtagcttagagtcctgatcattttaatgtgaattgaaatggtttcattatgaggaatcacatttctgactgacagtggcttatgcaatagaaacatttaattctcacataacaccaagtccaaagcaggggagtccaggcgctggtttttcagtacaacagtgtcatccaaggtcccaggatctttcaagcctcttcttctgtcctcatcatgtctttggccttgttgcctcatagtctcaatatggctgccacagctccagacgtcgcatcaccctacaaagtgggactataggacaggactccttgctgtctctcttttaatcagagagtaaaatccttgccagaacactcccaccctagcagactttgctttctgtttcattggtccggagttgggttttgcactcacctctaaatcaaacactgggaaaggacctggctccttcctatgcttcggatctcagctgaaatgtcacctccctagaatgctggaaggacaacctgttttatgttttataacacttatcactctctggaattagcctggtttgcttatttgtcctttgtcttctctctcctcactaaaaagcaagctctgtgcttgtagggacattgtctgtcttgttcatcgctgtatccccagcactgagaaccagggtggcactctttggatactcagtaaatttttttttgaatgaaggaagcaagaaaagaaagaggcttggagagctacaggcacatctggctagcatgtttgctcgaaggtgactgctcagggcaaggatgtcaaaacctgttagtcatttgcaaaaagctaagcaggtggctgggaggattggtttcatacacactcacttgctccccagtgccagagctggggttttgtgctagcattgcttgcagaggaaggatcgtcccctttatgccacggcagggacctcacggccttgcagaagggctggtggaaccctccacttctgatgactctggggccaagctagtcttccaggtcagtggtgtgacattctaatgag

SEQ ID NO: 101287 - DNA, 1456 bp, Homo sapiens
catttcactccatctccattgataccaccacggtccaagccactctcgggccctctctgttgcctaacagtcccggtgataccacttccatctgcacagcacgcctctcacaggagccagcaggatcttcttgaaacacaaatcatatcattctctgacttaaaaccctccaatggttctccattttattttttaatttatttttgagatggagtcttgctctgtcactcaggctagagtgcaatggcacaatctcagctcactgcaacctccacctcctgggttcaaacgattctcctgctgcagcctcccgagtaactgggattacaggtgtgcgccaccgtgcctggctaatttttgtatttttagtagagatggggtttcaccatgttggccaggctagtcttgaactcctgacctcaggtgatccacccgccttggcctcccaaagtgttgcgattacaggcataagccaccgcgtccagacagttatccattttatttaaaataaagtctaaaatttcttagcatggcctgtatttctcatctctgacgtgccctcccccacttactcctgaccctctaccctagttgactttttttttttttttttttgagacagagtctgactctgttgcccaggctggaatgcagaagtgtgatcccggctcacagcaacccctgcctcccgggttcaagtgattctcctgtctcagcctcccaaatagctgggactacaggcacgtgccaccacacctggctaatgtttgtatttttagcagagatgaggtttcaccgtgttggtcaggctggtcttgaactcctgacctccagtgatctaactgcctcagcctcccaaagtgctgagatttcaggcgtgagccaccacgcctggcctaccccacttgacttctatttgtgtttggggcaggtgtcttggacaggcccctcccaccgcctctgggcctttgcactagctgttccttctacctggcatgctcttcccccagatctttccaaggcggactccttcctaaaatctaggtcacagttcaaaggtcacatcctcacagaggcctccctgacagcctgcctaaagttgcctcccaccccatcacatcatgcagtcatttttcttttaaatttttttttgagactgagtctcactttgttgcccaggctggagtgcagtagtgcgatctcagctcactgcaacctccgactcctgggttcaagcgattctggtgcctcagcctcctgtgtagctggaattacaggcaagcaccatcacacctggctaatttttgtatttttagtagagagagggttttgccatgttggccaggctggtctcaaactcctgacctcaagggatcctcccacctcggcctctcaaagtgctgggattataggcatgagccagcacgccaggcctagagcattttccccgccttct

SEQ ID NO: 101288 - DNA, 2933 bp, Homo sapiens
taattacattcagcttacgtttcaatctgggtatttgctcatctgtgcgtgttgggacacccgccctctcgcccctccatctgtcccctgcctgtttcccaccgggtccacccccacttttggggcagagaaggggaggctgcgctggagcaggttctcagggggagacagggagcaggagagacgggctttctctggaggacacccccggatctgcgcgctctccaaatttcagcttgtagtgaatagtgaaggtgatttcttgacagcctctgcctcccattacagaaccaccagagggttctaattaaattagagccaatcgttaagtataggaacggggtagggaggacagaacgaagggggccccttccctgtaagagatgttctccccagcttcgtctctcccacatcatagagaagagaaaactcatccagacagcctgtcggatgtgtaatttagcgttctaataagcagcttgaaaggcgaaggtggtgggcttggcagatggcatgttggacctttgtacatgaaggcctcttccttccccagctaaatttatatacataaaggccgtgatgttggcatcactgctgcagctgagggtcaatgtgggtttggggtttgggctttgtgtgtacttcttgggttttttatttgaatttatggctttttctgaaaccctaataacatgttaaattttcaaacttgagagtagagtgatgagttgactgtaaaagtctggtcttggaggaggacagcatagcagtgtgtgtgcatgcacgtgcatgtcccccagttcagctgctgtccaaagaacccagttgatatgcagtttcacacctgatttggacctgatttgggagataacatttccttctcactttttctggcactggttagtttatctgcttggacctgcctcaagagggcagctgggttaaccaggcagaatatcacccaactctgtcaagctttggccattatctgaccttagactttagtcctgcagaaggagtccagaagccctgtcctacagaaaaatatcagcatttctgaccagcttgtagttaaaagaaaaggtttagtccagacttaagataattggtaacacttaagtagttttgtatgggcctgatctgaggcattgatctaagcccttataccttactcattaaatccacacaaataccctgttaagtaagtactgccattgttgccatattaaagatgaggaaacaggcacagagaggattgtgacttgcctacagctggtcacaggtagagctgggattcaagaggccctcaagctccggggtccacttggaaccactggactctcctccatgaccttggcctttgtcccagatgtagaagaaacacatatgcaggggaagaaaacaccttcagacagtcaaactttgcaaagtaaaaggcccttaactttccataaacccccactgttccgacagagagtccgggtttgtatttgaggttttttgccccaaggaaaacatgtgtctgcctggtgctttttcttctgcttatgagcagacacactgtcccctcccccagtcaaaatgcaaagggaaacatcaaatgcagctgatggaaaagccaggtgaaccatggtgaagatttcagcccactcagagcacagtggccagagagcaaaagctctcctagaggtgagaccttcctgtggttggtgatggagtctcgatggcctggccctgggggtggtgccagggtgctctgtgtcaggcctgggcggatgtggaagatgggggcctctctcaatgctgatctgcaggtgagggggccctccctgaaacctgctttctctgggcctccttggaatgggccttggtggagatctacagacagccctggcccagccggattgaaggcactgtctaattgggagggcattaagatcgttataattaattggcatcccgataaatggcatggttgcctaattggggtggttgctagggaacgaggcctcacttggagcctaaaggggaagaagcgctgggctggccacagttgggtgtcagggtacagatccagcagtgaatggaccggaagggagagcagtccatccgtatctgctggtgtttactgagcagctgctgtgtgcaagttgcaaatggagtatcagttaggggtacttgcctagaagaactgtaaagtaatcaggttcctttctcttgcaagcaacggaaaaagagaagaaaaaaactcaagccagcttaaggagaaaagaagtggacttactggttttcataaccaaaagtcttaaggtgactaactctagcttcagacacagctggacccacagctcagattttgtaatgagaatccattcctatccaccgctcctctgccttccatgaggctgatgtctctccagctctggggcgggcagtccctggcagctgtgggcaccgtggctaggagagccagactgcctggctccctgcccagcagtgggatctggggcatgctacttaacctttctgtgccttgatgttcacatccaacaaatgatgatgatcatagcacctgtctcctgcttgtggtaagcatgaaatgagatgatcaatgtcaagtgcttagcagggcgtctgacccaggtgagccttcagtaggcattgactgttaccataacttaggtgtcaggacagatgtcatggagcagaggggtctcatcccctctggtttaagcccaaaaggaaagaacaagcctctgatctggcaatgcacacctgagccccatggttccctctgattggactgttttttgtccaaaccagtcactggctaaggaaatgagttgccaacaattggcttaagccaggctcacaggcctctccctggagctggatggaggctgactgctgagaccccaaagcctggaataaaa

SEQ ID NO: 101289 - DNA, 1076 bp, Homo sapiens
ggcgcggagtcccctgcgcccagcggcccggccgggctgcggcagaggcggcggcggcgccccgctccgggtgaggttgccggggccgtgcgcgctggtgagtggggcgtggggggcaggtgggtggctgggggacgcggggctcgggcgggggctcgcggcggccggagccttccccggcgtgagcccggccgcgagcgccgcccaggtgagccggggctggtccggaccgcccggctccagccccagcgctgcttgcggaggtgggtccgggcgggcgggagggaggctccggcgccggccgtccgcagagggatgacctgtttgaccccgctggctggcgggcgggcgaggacttcccgccgcgcccctgacccgcggacacggcacaccgagcacaggcggccccgggtaggggagcgcgcctgggccggccatccgcaggggcatggccttgttgacccttagggtttagacccaagggaccggtagatgccagcccacgtggggcttgtccgggcaggactcggggaagcagtgggccggatcttcagagtggttggaaactcgcagacaccgaaaggacaaacaggatcgaaaaggcagacttcctcccaggccagggcagaacgagtttccatcgcctggcggagggatgctcccctccccggctcctcggggtttcaaaagtctagcggtgaattctaggagtgcacttttccaaacattccttatagtagttcgttcattcgttctacaagcatttctggagcaccccctcgtgccgggcaccgcgttctgttccagggaaacgcggctgaacaggatctggctcctgcgcgccagaagctgccggttcactgggagggcagcagggtagagagatgccgtctcggggtggaagatggaaagggaagcctgcaatcctagtttgcacactggcctcggtccgcaactcccccacctgcacgcagtaggcccagcacacagtaggaagagcaagccagacctgcctgtgacgaccctctcctcctcctcctcccccttgaaagctttgattcattccctgcccccct

SEQ ID NO: 101290 - DNA, 2056 bp, Homo sapiens
ctgtgttagagaaactgccgctccaacaccaagaataaatcagctccatttcccatcacctcggttgcttctttttcccatctcttcctctctgtaagttttgcctaagaaaaatgtatcatgttttctgaagacaaccgcttccccctcctcccttgtgaacagtcaggcaaagaatgaatttagatttttttgtagtgtcaaggcctctctcattaaattactcccaccatctcttgtctctcctggtgagtgagtttaatgatctcttgctccttactctcttgaaaactgcctcgtgtgcttctggcttgggcaatcttaatgctttgggcagctttcagtttcctgactgtagcttgcactccagacttcatccccagcccgtccccatcctcttctccgcccagcgcttcccatcttcccacattcctcttctcatcccctgttctctctgcacttatttgctcactgacattcccatattttctacttctactgaaatcctgattgtatccagtcatgcttttttgattttttaaaaacactgaaatgtctgtaattccaacactttgggaggccgaggtgggcggatcgcttgagcccaggagtttgagaccagcccaggcaacagggcaaggccgtatctctataaaaaatacaaaaattagccgggcatggtggcatgcgcctgtattcacagctactcaggagagcgaggcaagaggatcgcttgagcccaggaggttcaggctgcagtgggccatgatcacaccacggcattcagcctgggcaacagagagagcgcctgtcttaaagacaaacaaacaaacaaccctgaaattttggctcacacctgtaatcccagcactttgagaggccgaagtgggcagatcacttgaggccatgagttgaagaccagcctggccaacatagcgaaatcccgtcgctactaaaattacataaattagctgggtgtggtggcgggcacctgtaatcccagctactcggggagactgaggcacaataattgcttgaacctgggaggctaaggttgcagtgagctgagattttgctactgcactccagcctgggcaacagagtgagacttcgtctcaaaacaaacaaatacacacacacacacacacacacacacacacacacacacacaaacacaaacaaaaacccctgaaatgtgatgatgaccgttgtgtccttatcaacagccattgcttgcctgcttacgttagttgcagtgggagggtaggcagccagaagtattgggcattcccctggcctgtgcattttgaatgatgaatacaaaactgctcaattcaccaaaaacaatcatgtaagaaaggaacgtttcacttcttcttatgggcccctgattgcatgtgatgcaggtgacaattacatatgtccccttaacagtttggaaaattctagtgaagagaggagtttaagtcccttcacactgaactgaaacaattaattctctataaaaatctccgcatgatggatcatgttgcatttcaaacctctacagactgtctcatataaatatctgtttctcttttttgagacagagtctcgctttgtcacccaggctggagtgcaatggtgcaatcttggttcactgcaacttctgcctcccaggacctgcagaggtcctggtctcagagttcatgccctgcagttgctgtgtgtccagcagctggcagggcaagagggttggggggtgggcgtcacccccacagacacacagcacccggcagaaccctggcctaaaggcgcgcagctctggggtctcccaagcccacctgggagtaggcccatggggacagctgtgggggacagggactcccaatgtacaaaacaggccatgagctgggcaagctactccttctcataacctcagacctttcttctgacccagtcaggaccagctcctgggagcctgcagacaatcctgggcccagagaagcaggcagatgtggctgttggtagcactaatatgggttgtgaatatcatcctgtggttattactttactt

SEQ ID NO: 101291 - DNA, 1054 bp, Homo sapiens
attaagaggccgacacaggaccacgttttaaggagattctcattcctaagcctgttgcttttccctgcacagcacaagcaagacctgatttcccagcaggaaggttgtcttaattaaatcttatttgtcaagaaggcaagatgtatttgtgtttcctcaggctcccattattataaacttcgcaatgttttctctgagaaatgctccttttctgctcaaaagagctgattgttgctgtttttctctcttccattgtgagaaggaaatgctacaagttctttgtcaggtaatcaattatcctccttaaaggatccctgaagtgtcatttgaaaattatggctcctgaaaaataataaaatggccactttaacatattgttgcctgtcagagtgagtttctctcccctgcagagtcacagagcctgtaaattgcccgtggtaatgacctctggctccaaatgcagtcactggtctctgcacagatagacactgtctgtcacttctggggtttcactgttgacgctgtgtctcttttagcttctaggaagccctgtaatgatgctgtaattagcaatgcatccttccctctctcccaactccaattgctgtaatttatgtctctcaacaatacttacaccaagcacgccatctgtaccactgtgtggggaaggaagttctcaggttcaaggtctcagggagataaacacaattttaagttcacagacatcctcagcaatcaacatcaactaccacaccaagaaagcaagaccttggtattgttggcgagtagcaggtaattgatgatcttgtcagcatgatctactgtccctgatctgtatcaatatgaaataagaaaccatttaagaggtgtcaggaaaacatgtcaggcccccctcctcctcctcctaccatttgacattgactcattcacatataaaattgagtctttgtgatggtgaagtgttaaagaccccgtgtagtcaaattactatcatgaaaccagtgagtggaaacaagttattaaatgtccctggttcctcctcattcaaacaggt

SEQ ID NO: 101292 - DNA, 1043 bp, Homo sapiens
gtgtctcagggcttgggccaggccgactttgacatttaccgcttacctcttcatccctcctccctcctttcttgttttcttcttaggcctgtgttcccacactgcaaagagaaggcagtaaatgcccatctaatttatcagggcagtaaaaagtattgggattcatgaccagaggattgttccggaacaaaaattgtgcagctcacctcacctttccttgcactgtatctttttggaatctaagcacggcgagcagggcacatgaggacacggattccctgaaaagcccttgagtaattctggcttaggccattaaccttacacaggcataagaaatcaacatattttacacatgttcttgtaccccagctagtacatagatcaatgtaactgacctataacatgcatatgaaccaaaatactagaaatcttgtcctgggctatctataaggtgcatatgaacaaaaatactagaaactttgtcctgggctgatctattacatgcatatgaaccaaaatactgggaactttgtcctggtgttgtcctgaataggacttcttccagtcaccagaatgccaatatcattagcagacactttcccatttagcagcgaaatggcaggtctgtggggatgctactgaaccatgtttgctttcatggggtggaaacctgcttggctctgtctctggtaagttcaacctcaaaatatttactcttaaatgggttaactattttctcctaaccacactgaagctagcagcaaaggacgaacaggtaactttaacattcattttcccagggaagaaagtaattcatcaccccgtagcggccggctggcgggccaggctgaagactggtgtggagcgagccagcaaggctaaggttggcctaagagaccacagagggtgccagagccacagaaaaggcatagccttgccccctggcagaaaaagagggtgagaaaaaccctggcttctcccttcttccatgctccatggccccagcagtggcttggactggccaaacctggcccaaagacaag

SEQ ID NO: 101293 - DNA, 1125 bp, Homo sapiens
tcaatcttccctgcccacttatccagaaaataactattagtgaattatagagcaaacagacaaattgtcacctttatctgtgttctcagaaccgtgatattaactggccataaccctcttgtctttcattagtgagaatttagagtaaccaccatcactccctgaggtcacacataaaacagctcaaagatgactgcaattaaaccagtttataaatttcccacctcccaactaacccactcttcatgaaggtgctctattgggcattgggtatcagtataaattagacgctacaatcacatgtaattaagcagggggtaatggaatagataccgtgctgcagagattagtcctgttttgctgaagcgaattcatctccgtgtcagtgtgttcacccagggaggcagcatgagaagtaattatctttcttctgacttaatggtggttatgctgccattttttattaccataatttctcaagactcatacacagatccctttctcctaatgcgattgcagttctacatacaagacagcttatgcctaggtgaaaactcaagcagaattaaccataagactatatagttatagttgatgctggaatttgtatttttaaacccagagcaccacggtccccactcaggagtagagaatttagatcatgatcctttgagggtgactgcagcaacttttgctcttgaaaggcaattttcagccaaatttcggggccacctgtgctccaggtctgtgggcttattttccaaagcctccgaatgcatcccaggccacagccatttttcctacttttaatgtttctccttcacacactgatttgtttgacatgctgagagcttgacttttacaaccttcataaaatcccatctgctacaacccaaactcagccagaaagtgctcagacaaaaatggtacaggttgtattatagtctcttgatggagattaaaaaatacacactgagtgatttttttcctttttttttttttttgttgttgcctataagtcaaggaaataaaacagcaactccagctttgcaaggtagatggaaccagggggtgttctgcacaaaagggctgccaaggaatttgcaggctgaagaagcgaggtgt

SEQ ID NO: 101294 - DNA, 1067 bp, Homo sapiens
tctcaaactcctgggctcaagtgatctgcccacctcagtcccccaaagtgctaagattacaggtgtgagccaagcacctggccaagagtttcctaaaggggaaaggcaggatccatcctcccatatgtgcaattccatttagggctctttttgggacagcacacctggttttacaactcctttctagaaagttcacttatgagctgattaatggcagtaatgatttagtgtaagcagagcgcagtagccctagggctgaggttctaacctgggctctgttcccactggctggtaaatccttggctgacctccccaggcttccatttccgcatcttgagagtagtgatgatatcagcgacactgcagggacattgtgttggattgagtgagatgaaggagagtataaatgcacagcacagaccggttctgagcctcccatttcagagcaggaagccgggcctccccctcgaggatgcactgagagaggccactgtgagatctggcagagggtgtcttgatgtcaggtgatcagaacacatggcagccttggacatctctgatacgactcctgctcatggagtcattcatttgacagatgttattaagttaagtaccagatcatagcaaccacaggagttataaagaggacatgtcacctgcttcaggggaacttagagcctaggaggtgaaacagatgtaacaagtgaacatgacaaagtttgcagcaggagctgctggttgcttacctcttctttgctaataaaaatgggatctgtttgggcagcaacaggtccagttcaaggggagagaacaaccctgtcaatcatgacaatcccacaggtgggcacttgagcactgctggccaaggagctggaagggccagtcagctggaggcttctgggaatatttttgtccttgctaaaatgggagaaaagtattctgatttcttttcagagttattgaaagctggaaagagcatagctcccaaccctccaaaggaaaaaaccagacaagcaacaagtgcatgccttttccagagcccaacaaaatcctgaggttgcagagca

SEQ ID NO: 101295 - DNA, 1053 bp, Homo sapiens
agcaaatggaggcagcacattttcactccaatttccacttaaagctgcagctgctgtcgccgcctgggaacccctatctttttacatgttattgtggatcagttgcccgctgctgcaataaagaactctcagtgggttgcctggaatttctaactcagtgccacagaaaacctggtggataaggaaacaagaggctgcgcttcagtggtggtaagtgctagacttaagcaggcaaccctgggtcctagcctcttctggtcagtcctctcccagacatcagctccaggagggaatctgcttcctcagccatgagggcaatgaggaccctcaccatagctatctatatgggatcctccagcatcctttagcctcgatggcaaaacactcactggctgttttcagtaagttttagattcccaatattgttcttgcaatcgtggggtggaggacagaagggtggatggtcaggtattagatcgatcaaatcaaattgcagtactcagaccctgggggtacacaatgactttctaagggttcacaggcaacaggccattttgagagaatcacttttcagattctcaactgacatgggtactctgtgggctcttcatttccacatcctcttttggtaacactcttctcccactttataaaacaaagattgatcagtcaatgttctggcaggagacagatagcgtacttacattggctaattggaggaaagtttcataaaggtattatttaaaacttgtgatccggatgaagggaaatagcaaacaatagtgccaggccctggctagtaacagtggggccctggggagggtgaggggaaagagccttctggaatctgcagacaaaaggagactctaggcgggggctgtcagacaggagctgtgaccttctgcagtggaggcaggcagcctgggctcccccacagtagggataaagaacccctacctcactcatctctcagtctaccatctctgcctgttctcgctatcccatggcaaaacccaactgttacaggaaaggggtcccggtccagaccccaag

SEQ ID NO: 101296 - DNA, 1043 bp, Homo sapiens
aaaaatgatacacgctgcttccactcacatgtcttagacaacaccagtcacatgactgcaccaaacggcaaggtggcagggaagtgcaattctaccaaaaggcaggaaggaagcccttacatatttagcaaatagcactgatggccaccataccccatcacatgcagccatgccaagcttggctgagtcatgaatttgattcccatgcggtcaagctcgggggtggaacaagacctctcgcctggtgatgaaggctggcctcccactcagtatttgcaacccagaaaggtttggacatgtctctcatccatgttgtgttcaaatagataagaaattgattaaaaattcagattcttggtgaacgatgatctctgagcagaaatccaaatttccgtattagaaatggagaaatctaaaaaaaaaaaaaaaaaaaaaaaaaaaaaaaaaaaaaaaaaattcaatggtcttagccagaaaaacaaaactgtaaaatgtgaatgtaaccaagattaatgaaatggatgagaccgcattatatgctgaatggaagcttaaaaaaccatttatgagactgttttggtggggctgcagcctgtgaaatcgctgcattttatgtgagatgtaatgtagaccacagaactgttcacagagagttcccagtggtccctggagctggagtccaaccgcacatggaaagagtgtctgcacggttggaaggcctggatgctaaagtcaaacatagctggtgaatgctcttctgctcctgtggtctctgaatatatatgagacagggagagagagacagagagagagagagagagagagagtgtgtgtgtgtgtgtgtgtgtgtgtgtgtatatgcagttgtccctcagtatccatgggggattggttccaggacctcgcttggataccaaaatccatgagtgctcaaatctctgatacaaaatggtgtagattttgcatataacctacacacatcctcctgtatattttaaatcatctctagatgacttataatacctaatacaatgtaaatgcta

SEQ ID NO: 101297 - DNA, 1049 bp, Homo sapiens
tcccagctctccctgttctgtccctaccctgagctctgctgttccccagagacatgcctccatcagccagccagaagcccctgctgaaggtggactggtatggctcattcagccatcctgcctagaagttgctcagttataaaagggaaagaaggaaaaccaaaaaggaaggaatctccaatgctggagtttcatactcagggcaggctggtggggagatgggcagccttgctccatgctggtcactgtgagagaggcctggagtgttctgctgccccgaggtgcagagatggagatggggcagaggcactgggtccccagccatgcctctctctgtagtcatgagcttctcacctcctgctgcacagacctgtggttccactcagatcccagcacagaattgcacctgacattgggtctcctggttctcggcagctggatctggttctgtccctgtggggaggtggctgcacctgcaggtcctcccgggatcctgactgatgcacaatagacaaatcaccatgtgaggaaacgcttcagggaggagggcgtctccactccccaacaacccagcaagacaaatccaaagggatccaggagaacggagctagcaggagcctgctgctaaggagaacgagtcgagtgttctcatgtttctgaggttatctaacaagatgcacagactcacgtgggacagacatcatttcagggcaaagatgatacgctgagtgtgggttgggtatttgtggcttgaattttcaaaagcattttaggtgcatagaaaactattctgcaacaaaccatttcacaaaggatatcaaactttacaagcacagtggaagcttctagtgtaactctccaccatcatgtttgcctccctccctctgagaatcacacctgaactttaggtttactatgctcgtgtatttcactttcactgcattttcatgtatgaccacttttccagtttattttaacctctgtagagtactccacgccatgagctccagctggtggacatccgggctggctctgtgtttttcatgatc

SEQ ID NO: 101298 - DNA, 1042 bp, Homo sapiens
ggggacaagaggactgtgtattttagtgaccatggatgtctgaaaggaatggcagctcatctcattttgtaaatgtttggttcggtcactcccttaattcagggtgacctttaccccagactgaatttttctgatgttattgctcatagctggaagccggtgcccaaatctacttcagaaatcagaaggggctgaatcctagaaatttgtcctcacctctgttgtcatctgtcatagatctttcaccaactttctgcttcacttagagagtttctgaggttcttctcaaggagaaattgacaaatatgcaactgtgtccaggcactacaaggcccactaagagtctcagttagcacccgctttattgcaaatatcataaaaactcaactcaatattaaaaggaagatgttgactcatgtaactgaccatttctgagccacgtggatgcagtagattggactattgtacccaatccctttcctctcttccctgacatcctcattccaaggactttggtcttggccatgtgactttctttggccagtggggtattagtggacgtgacatgggagaaggctttagatatgcttgtgtgggatgcttaggatcttgcccttatggtataggcacaagaagggcaggctccaagcatcctatgaacccaggatggagatatgtggaggtggatctggtctgaactctgaagcagagatgcaccagttgacttgcagactcgtgagtgagaaaaagaagttttttgttttttttttaaatacgccaccaagattttggggctgtttgttacaaagctttgttgaactacacatccctcactaaaccaatcactgagaatggacaggataaagtaggtttctgacctaagcccataagactcatgctggaactgagggtagaatcaatgttctctggtgtgaactggggtttgatccaggaaaataaaaagggggatataaccttattaaaagtcatgtgaagggatgctggaacacaaaagcaacatttgcctataatgctgagctta

SEQ ID NO: 101299 - DNA, 1084 bp, Homo sapiens
agttttaaatatgattatttcagtaaaaaggcgagctgacttagggaaaatgtggttgatcgatgggttggtatgtggaagtggcagaaagcaccaaggtggaatgtgtctgctgaaagctgtggaaacacctggtttgagagcaggctcccagctcggctttatctgcaggggggaatgggagggacaattgtgcagcatagggttggagacctgccttagacggggatgtgggcagggtactgatgctccaggagcagtgacacccattgccctccctggcaggtgctgcctctctgctttggggatcgacccacagaatggcccagacctgccttcctaggggacttgtgtgggtgtttttctagggtcagcaccgagatgtaccagcagatcacttctcaccctcccacctgcgattgttaaactattgactggttggagtgctggtctcacctccaagggtcttaggacaggagaatgatggaggtgtgggaggatggtctggaatttctgttcgaggacagaagctccaagggcaggccagtgggttgtgcttaatcaaagatcctggtggcatgggctctgcctgattgacatttctctctgtatttgggagctggaaagcctggtggtgctactactattttgggctgaattttcccagtgtttccaaggcagaaagtctctgggttggcaccggggttattgagagtgatgctggttttcctcatggcctttttccctgcctcttctacctggtgcaggatcatcaaaatccccgaccagccggacacactgtgcttccagattcgtggagctgccccaccgtacgtctatgctgtggggagaggtgagtgggagccttgggagagaggggaaaggtgcagaagatggtggatctgtctgtgtggcaggagttcagagccttctgaactctaggcttctgccagacaatgtaccatcagcacttattttctttgcctgatgccaagacttgcaaacacaaatgcctgttggggtcaggcaggctacaagtgggtagccatcccagtggaagacagtgggtagtggtgaggactat

SEQ ID NO: 101300 - DNA, 1020 bp, Homo sapiens
cccactgtactttgcctgtctattcatttttatttctactcagcacattttatttttccctagcagttcctctctctacatctgtctccactgttagggaactgcatgaatataaaaagtgtctgatttatcttttggtttttagagacagggtctcgctctgttgcccaggctggagtacagtggtgtgatcataactcactgtagcctcaaactcctgggctcaagcgatcttcctgcctcctgagtagctgagactacaggtgtgtgccactgtgctaggcttctatagctaatttttatttttttttgtacagatgggggtcttgcaaatgctctcgccttggcttcccaaggtgctgggattacaggcgtgagccactgcacctggcctgatttgtctttatcacccccaagggttggctttgagttagacttggactcaagtcttggttccctcactttctagctgtgtgacattggggaagtttcttaacctctctgaacctcagtgaacgatcagttaaagggagataataaaatgtgcctctgaggactgtcggaggatacagtgagagaacacgtgacgtgtgcagcacagtgctggtgagactcgtgggaatcgtactggctgtgcatgatgagtgtatgaaggaggggcctctttctgccctactcagagaaaaatctcttagatgccacatttaaaaagcaaagaataaaatctgtgtgtattaatgtggagggtgtcctgggaggagcatggcctgtgccctctggcatcgtcagattagtaggggagacaaaacagattcactcattcattcacccactcagtgttaccgagtccctgctatgtgccagtcgggaataggacagatgaagtccctgccctcatagaggtaagcatccagtgggggaaatcagacaacagaagaggagacagatagaaagaagggaatttcagcaacttgatgaatgcgctaaggaaatacttagcgtgaagtcaggacaagagga

SEQ ID NO: 101301 - DNA, 1039 bp, Homo sapiens
ggaaaccaggacccagaagagcaaagtctcatgcatctcaactacctgcttagcatcttagaggcagcagtagtgtgtcgccattaagaacacagagggccgggcgcagtagctcacgcctgtaatcccagcactttgggagaccgaggagggtggatcatgaggtcagaagatcgaggccatcctggctaacacagtgaaacccccccatctctactaaaaatataaaaaaattagccaggtgtggtggcacacgcttgtaatcccagctactcgggaggctgaggcaggagaatcacttgaacccaggaggcggaggttgcagtgagctgaggtggcaccgctgcactccagcctgggggacagagcgagactctgtctcaaaaaaaaaaaaaagaaaagaaaaaaagaacacagaggctctgcttactatctgtgctaccttgagcaaattatgtcagctgtttgcgcctgtcttttcctacctgttatatggggataaaagtagtcctcatttcatggggttgtttttatagagtaaaacatgtaaaggtacacatgtaatgtggttagaataaggcctggtgcgtggtcaagtggaagaaatacaaatacatatatctttatttgggtgtctcacacatagcccacacttaaattgtgtctaaaggggctcttgttttttgtcttaacttctgccccttggatcttcctcattaccagtaaatggtaccaaaatttgtattaagtcaagattctccagatagacccaatagggtgtgtgtgtgtgtgtgtgtgtgtgtaaagagatttataataagcagttgactcgtgattatggaggctgacaagtcccaagatctgtcgtctgcaagctgaagacaagccaatagtgtcgttctgatcctaggattggcaggctcaggaagagctgatatctgcttgagtctggaggcaggagaagaaatttgcccaggagccgaagccagaatcttcttgattttgagctatcattatccccataccaactacatcagca

SEQ ID NO: 101302 - DNA, 1005 bp, Homo sapiens
cctgcaaaccttggcatgcatcacttaggaagacagacgttctcttgtgtaaccacagtgccttcaacaacaaaatcaggcaagtcaacatttatactaaatgatacaatgcacagtctatattcagatttcactatttctccccaagtgttccctatacccatctcctcgcccatccccacccccagtccaggatctagtcctggatcacgcattgtatttggcagtccagctctggtgattttgattgtcctcagtagagagtctccactgagatgtgctcatgcttgtcccagagccaagctctgtgaccagctctgtgacctcgggaagctgattcttggacctcagtttcttcagctataaaatggggaaatcgctgtccctacctcatagacttgttcccttgttccaacacattgtgttaagcacctactgtgtgcctggcccagatgctgggatacagcaggatgcagggcaggccgacatctgggccgttgggggtggagtagagtaggtgagtgctgggtgtggagccggctccctaggacgcccaccacgtatgactgtgtttgcagttactgcgctcattttagaaaatttgggaaataaagatgaataaaaagatctcacccttccaaatagctgtttcatctttgggtatatttcctctttgttccttgcatttggtctgagcctggtacacgacagcaggtactgcttgtgcatacttcctcgtgtcactgctaaatgctctccatcagcaagcctttcatggcttcgtaatgaaatgtgggggctggatcatggccactgtccagttcaaatcctgactgcctgcctgctgtgtggtcagtggcccagctgctccatctgtgtgtgcctcggtttcctcatctcctaaaatagtgccctcttcttagattgaggggggaattaggtgaattaggacctgcaaagctatcagaacaatgcgaggtacatagtaagcattccatatatatt

SEQ ID NO: 101303 - DNA, 1023 bp, Homo sapiens
acccactgtgtgccaggcactgtgctaggtgctggcatgtggctggaacaagacagacaaggtctctgccctcagggaatcttcagacaccgcaaaaagaaatcccttgagaaaaggaccagagttgtcataataaggacacccactgaggccttgctctgttccaggtactgtgccacatgcttcttgagcccttgcagcaactccctgaggtcaatatcatcattatacctattttgcagatggggaaactaaagccgggagaggctgagtaacttgctgaagtccacacagctggggagtggattcagacagaaggaaataaaatgaggtgatgtttgtgacagggatggtcgcatctactttagatgggatgggcaaggaaggcttttctagggagatgacatttgaccaagtcctgaaggaggagaaggagccctggtggaaagagtggagaaaagtgtgttccaggcagtgggagcagcagatgcaaaggccctgaggcaggactgtgccaggcttgtttgaggaacagtaagaggccagggtggctggaggggagagtaagggagatgagattggcatgttggtggggtccaggtcgcatgggcctcagatgcatggtgagcagtttgggttttatttctggtggtgtgaggagccaccagagtgctttcagttggatatggcatgggtcagttggtgacgtggaaaccaagactgtgcaatggtcttactaaggtctcagagaggaatgggtgtaccgtcccctcccacagcagatcccctgcctgctcccaggctgctctgtgacctacggctggttctgtcctctctttgggtttcagctttcctgtgggtactgggttaccaagtaaccagggcaggcttcctggaggaggccagtggacccaaccacacccaaagaggagtttgggcccccatctgtggccagaatgtggatgagctgtgaaggcagctgcctctgggctgggagggctgttgatgcgagatgaacctctg

SEQ ID NO: 101304 - DNA, 1680 bp, Homo sapiens
ttgatgtaaagcacttagaacagtgtctggcagtaaggtatataaatattggttattattgttgttgtaggaaaattaaataatacagataattagggttgtgggacttcagcatccagagagcaggggtgatcagagagggcttcctggaggaagtgaggtctgagttaagtcagcactgagaggaggatgggggctctgagtgagtttccttttgacaccctaaactccggccacaggaaccagtggttttgtttggttccaggccgagggctttgtggttccttgagaatcttcccatctttccccatctccttcaggaactgggttgcactccctccctcatctccagggagtcctctgagtttggtgttttgcgtgtgtttattaaataatcatgaaaaggcaaggacagccctttcacagagatgctggatcggtcttgggggaaacagtgcctggggttttgactcagaaccttggctcgaatcatttcgaggccctggctatgtggggtactccccgtgtgctctgggcagcgttagtcatgatgaaaacaatgacagtcattgctgtgcaggaactgactttgattcatcacttgccattctaagcactttgcatgtgtcaactcatttaattttctttatgaaggggatgctgtttttatccccattgagaggtgaggaaactgaggcaaagtgaatctaagtgagctgctctgggtcaggtggacagcattgccaggatttgatcctaggctgcctgaccccacaactcatgtccccagccacttgatagaccgcctttggctgatccaagaagggcttggcacatgatttattaaggtggcagaactgggatttgaacccaggtctgtgtgatgtttcacctccgcctgcgcttcctcctgttacttgccctctgtgactcccattcttttctccacagaatgggaagaactgtggacggatagaaatggcaggctgccgagttcttgctctgggctccgggtctgttcatggcacgagggttgagtgaggctctggagtcatgctgctggtgttcaaatccaggcttcttccacttggactgtaggtgaccttgggctgatcactgacttgctctgtgcctcagtttccacatctgtccaacgggcacagtgtagcacctgcgtcacagggatgtggtgaagcttgccccccactcccctagaggaggctgagtagaccttgggcccacctgccaaggggaggcacctcaggggcaggtgccagtaactcccatgatggggtgtgtcagctgggcagtggtcgaaagagaagagagggcctgggtgggtgggcagagaggccggtgggtgggagttggtcagcagctcctcgaaggtctccccgtggctgaggacagagagctatagagacacagagggtctgcccggaaccgaccaggatgggagtctctgaggaacagggattgtgggcagaaagctcccagaatgctttctgtggttctgctttttggagggaggagacaaaagtttttcttctcattggagctccgcttgccaaacaagaaactgtggttttttgttgtcactatttttttttctgttttaaaagattctgtactcctagtctcacactagggagaaatgccacgggtggttggggtgggggc

SEQ ID NO: 101305 - DNA, 1038 bp, Homo sapiens
atttttgtatttttatcagagaggggatttcaccatgttggccatgctggtcttggactcctggcctcaagtgatccgccgacctcggcctccaaagtgcagggattacaggcgtgagctactgggtcctgcctcctccgtttttaagattgggaaagtttagctccagaggggccgggtagcttgtctgggatcgcacagctgattaagtgggggtactgggctttgaaccgggactatcccagctggtgttctaaacccctattctatgctgcatttttcttttgctttttttctgtgagagggaggaaggggccacttccctactctcctaggaagtgagaaaagtggccagcgggtggagggggtgggacggggcagagccttggatggaagttaggagactctaaagtctttaatctccatgcctcctgctggggcctcatttactccccttctctgctctaggaagtcttttaatcctggttcaggaagggctggtgtgggggtggctctttcaaagaccctagagccaggctttgtagctcctagtctttgggagaaagagggagactctggggtcctctggggctcctcatggcttaggggtgcagctgaggctgtgtgagatcagagttccagctcagggaggagacagccttagactagagcccttctgcctgtgaaaggagatgtactgggggcagggggatgtgggagagggggttgtgcagaagcattgaaaaccatttggctaaaggacccttctaggaaggcctgtaagaataaggcaggattggctttctttcccatcccttcttctctcacagtttcgggggtggggggtgggggaagaatttgttctgttagaagctggcagtttttgaattaaacatgtagacaaccctggtgtctctgagcaatgtcaaattctagggaactcctgacttctccttctgagccactccatgctcctctgcttggaagagaaacaggaaatacaaaccaattttgatattaatgggaaagaaaatatac

SEQ ID NO: 101306 - DNA, 1082 bp, Homo sapiens
ttaggggctaatggaaagaaggaaatgagagtaaagagctggttacacataagtttcatttgagttattcagtttttcttttttttttttgagacaggatcttgctctgtggcccaggctggagtgcagtggtggggtgcgatctcaggtcactgcaacctctccatccctggctcaggtgatcctcccatttcagcctcccaagtagctaggactacaggggcgtaccacccacctggctaatttttctgtttttagtagagacggggtttttctgttgtctgggctggagttaatcagtttttctaattgatgatatctcttcatcagcagtaaactccctcttattaattctggagttgtgacctgttattaattctggattgtgattcatttctttgggtacagcaggcaatgggagaccaaggctaaggaagagagcaacttgcccatccacatccacacagctgggtggggaaacgtagctgcagcacatgatgtagcttcacatagatcataacatccattcttagatttgctcctctgtttaatatacgagatttaggatgtggatgggtcattggtgaccttagcttgagcttttttgatgctgtgatggaggtgaaagccagactggcatgggttgaggcgtgggaggtgaggaaacagatggtgagcatagtcagctctcccaaagtttggttgtgttgtaaagaggaagaaggagtggctcctgggagttgtttgtttatttaaaggtagaaaagattttaactttaaatattgttaagggatccagttaaggaagtatattcctaaatcttagttgtatatgaatgtgtgtaagacatacaaatgggcatttatcatatggacatctgtgtgtccatatgatacataaattgctttttcttccatatgatccttttattctaattttgatgtgttcagaaaaaccattctcatcatgaggattactgtgaaacttgaaaaatataaaaaacatctctaaattgatgtaacgtggcggggcatggtggctcacgcctgtaatctcagtactttgggaggtcgaggcgggc

SEQ ID NO: 101307 - DNA, 1035 bp, Homo sapiens
cgggctctgtcctgctctaagcccccattgctgctaggctggattattagcagtaacttcctgattggtttccctgcttctgtcctggccaccttcctctttatcctcacagcagccagagtgatctgtccgaagaaaagttgagtcaggccgccctctcccagcccctccatgggcttcctcccatcccttacaaagatgccgttatcatctgggcccctactgggcctagtggagaagacttttcaagagtgtctttctttctttatttcttttttattagatggactccaagtctttttaccatgttgctcaggctggtctgagctcctgagcttaaactgatctgcccacctcagcctcccaaagtgctgggattacaggcgtgagccactgggactggcctcaagatttttttttcttcaacaaaagagtagtttagaaagtgcagcaattcctaattcttgtgggaatacttaagggtaaatttagaaaaccaaagaaaatctgtgaacataggatttgcaactggagtttcttgggtttctgcagttactcttccaggtagcaactctttcctggtcacaggagagggctgctctcttcggtccctgtgccctgcactgctgctgctgccagtcctgtcaacgcttgctcattcccattccaaaaccaggttttacctttgctgtggtcatgccaggccagaaacagactttggagatttcagaaggcttgtaaactagccttcccagctggatgggttcacagagcagtaaaacaccagtgttttgaaccgtggttgtagctttcatggttagtgtcagtgctaggaaaaccacacatttaaactcttctgcatttatggtttacagagtaattccatatgcttgttcgagagtcgaggtatccaggagaacacagactctggagcctgattttctgggtttaagtcccatctccagtacttaataacttgtaacctctgtggatcttgattttcatctataaaatttataatggagtttggccttg

SEQ ID NO: 101308 - DNA, 1037 bp, Homo sapiens
agtatgatttcaaacggaaacacaccctgccttgtttcaacccactgtgaatcttgagtcttatggggtatggttatctctctttttagaatggaagttctggctgggtgcagtggctcacgcctgtaatcccagcactttgaggcaggaggatcacttgaggccaggtatttgagaacagcctgggcaacatattgagaccccatctctacaaagtaaagtaaaaataaaaagttagctgggccatgtggtgcacacctttagtcccagttactcagaaggcagaggcaggagaattgcttgggcccaggaggttgaggctgcagtgagccgtgatggtgacacctaactctagcctgagtgacaaagcaagaccctgtctctttaaaaaaaggaaaaacacacagaaaggaatggaagttctctgagatgtaatagattctctgagatgtaataggtacactaggatttctttgtttagtatacaaaatgagtcatcctttttatgacatgagaaagtggctcggtgctccctgggctactgaatggaaaaaatgtacttccccatggtggctgcccttgccaagcctgtttgactggcttttcccagtgtgggcaaggtaacctctgtcttagaaatggaaggccagcatcggggtaaagtttggtttgggcagaattgaaaccagctgcagatacatcagtgctatgccctgccattccttgagcttggcgcagcagtaggagtggcaaaggtgcttctgggattgatttgccataagcacagttagctcaggcttcctctccactgggagaagcctggagacttcccctgcggcttgcttctaccaggtgaaaaagattctgtcttccctttctccagcatttggtctgctacacgcttccccgcagccagggctcagtgtaaggggggttaaggtcagtcttgtctaagctactaagtagtccccaagtttttctggtcacatatcaattttatatatatatatatatatttttattttttatttttttag

SEQ ID NO: 101309 - DNA, 1124 bp, Homo sapiens
aggatacaggaactctcctttctcctggccttgtctcactgcacagatgaggggggaagtcatgcttaaaaccctttctgatttgaagagtaatgtgccccttaaggagtctggagaggggaggatactttctgtccttttcatactttagttaaagtgcgaaagtcgtaatccatgtccagcctgctttgtggcatcagtattgcagcctacttttcagcattcacatttgaggagttcctagaccaccccacttgcaatccagtgcacaaaacagacttgagtctgttagatgtaagaacaagcaatgtcaaaaccagagctcattttccaggtagacagccctgccctcctaggaagcctgcacctgcagcagcaatgtgaggggtgaggtaaagggcatctggacttgcccttcacaggccacacccctcacctggagatttgggggttggacttgagcagcagagtgtacgcaggcctctctcctgctccttcagttactccatccagtagtattgcatttctactctcagccactctctcaatccatttttctttctgcttgttgagtggtgacacttcactagctaaggaaggggaaaagccattgagaaacggtgtcggacctttgcagagcggccagtcttcctcccacagtggtggctgctctatagataacctcaggaacctgagtccccctggtgggggcagaagcatgtgaccagtagaagccaaaaaggggaaagaacagaacagcagttttaggagtcttcaccaagtcactggaggcagagaatgccttagagttcacatgtatatgtgccagatgagtgattcttttatctgatcaaccatcaatataacgtggatagcttggagaaaaacactgattcctgggctccacctggaagttctgcttcagtaggtctgggtcggagtccaggaacctgtgtttttagtgagctccctcaggtgattatgtttctcagccaggcttagaaatcatcctgctgctgacctttgaggttccttccagctctgtcctccatgctgacatcccggttgtgtgtgaggtggcacagaccaatttgtaacctctcagagagggcacgttccaagca

SEQ ID NO: 101310 - DNA, 1030 bp, Homo sapiens
ggatgtttgtcttgtttactttgtgtcctccagccgctactgcagagcctggtacataattggcacttgataaatatttattgaatgaaatatgctttgtagggctattattgaaaattgttctcattgtttcatgtccctttatagaaccacattataaatttttcttagagtttcattgctctgctgatcatcagatatgctttccttcattaaatgatgaaatctgtgtaattctttattttaattcccttttttcacatggctgccaagaagctcaggtttacattttttctctgtgactaaggttttctgtcataactggctcttctctaattcctttattaatggtactttaaaaaaatctgtacctttcatgtttagctgcttctaatctttttcaaaagtgaatgggggtgggtagggctgctgcattgcacagttctggaggcaccattgatctggagagaattgtatattgctgtggccctggcagtggggctgtggataacaaacactcgtaaggcttaagcatcactttggccaaggcttttccaggattatgtcagtcatgggctggtggcacaggaaaaggggaaaaagcaacagctgggaggttcacagataacttctttttggtgtcaggcagccctttagggtaagtacagtactaatttggctatgactttgtacttgtgttttaagaagcagcggaaaagcatggtctgacagaacctgagagagttctaggtgaactggagtgccaggaatgtgctattcccccaggagttgatgaaaactcacagaccaacgggatagccgatgacaggcagtccttgtcgtcagcagataatctggtatgttggtgatcatcctctgtggacttattgccatttttactttttcaaaagatgcagaattaagtctttcctcaaaagaagcaactaaaataagcaagccctgttcctttattagtcacacagtcctgggctgatattctttgtattagcaggttcagttcttagaacgt

SEQ ID NO: 101311 - DNA, 1062 bp, Homo sapiens
catcttcatggtgtgtgaaacagagtgagccaggtgtctcagcctcccacaagtgatgtaaagtcattgattcttgcagtacagttgcagaactcgctctccagaatcagttgacactttgctcctgctgtattctctactttgtgatggaaagagacaaataggagttggcagctcttgttctcaaagggcctgcgattccagaaggacccaactcatgccatctgccctcattctcctgacatttaggtgctattaattctttaaaattctactcattggtaaaggagcaaggccttctcaagaaacatactgtttgacattttttcttttagcactgttgtggtttttcattttctttgccagatcccatgagctgcgttccaaggtggtttccctgcagctgctcctctctgtgttgcaaaatgctggccccgtattcaggactcacgagatgttcatcaatgcaatcaagcaatatctctgtgtggccttgtccaaaaacggcgtctcttcagtgcctgatgtctttgagctctctcttgccatttttcttactcttctttcaaactttaaaatgcacttgaaaatgcagatagaggtacggattccaaagttttttcatttcattatttactattattattagtcattaattataatactcaatattgagaatgctgctaatattacactaagcattaggaaaatggttcatgaaaatgtttcatatcttaccatcctggaactcagaagtgggcaggggcagggagggtaaatggcatattcatcggctggcaccccagtaaatcagaactttttgaatgagtaagagaatatctttttataaaaagttactgcccccagcctgggcgccatggctcacgcctgtaatcccagcactttgggaagctgaggcgggcggatcatgaggtcaggagatcgagaccatcctggctaacatggtgaaaccccgtctctactaaaaatacaaaaaattagccaggcgtggtggcaggcgcctgtagtcccagctactcgggaggctgaggcaggagaatg

SEQ ID NO: 101312 - DNA, 1048 bp, Homo sapiens
ctgggcacggcagatcatgcctgtaaccccagcactttgggaggtcgagggtggtggatcacgaggtcaggtgttcaagaccagcctggccaacatagtgaaaccctgtctctactaaaaatacaaaaaattagccgggtgtggtggcaggcgcctgtaatcccaggtgctctggaggctgaggcaggagaacagcttgaacctgtgaggtggaggttgcactgagccgagatcgtgccactgcactccagccagggtgacagtgcgagactccatctcaaaaaaaaaaaagaattagctcatcaagtttcatgaggaaacaagtttttaagtaaagtatctgaatgatactaaggtttcatgcttataatccttatagtattgacttgttgctattacaggtttgggaaagggagccgtgcagccagacctagctcggctgtgtctgtgtcccacttgcttatttggcttcctttacttttgtttctccgcaggtcaggagaggctcacggatcaggaaataggggatgggaaaggccttgacatggcaagacggtgtagtgtgacgtccatggagtccacagtgtcctcggggacccagacaactgttcaggatgaccctgagcaatttgaggtcatcaagcaacaaaaagaaatcattgaacacggcatcgagctgtgagtggggctgccgttaactagcagggattctagcaaagccatattttctctgggaacctggaactgattcctaaaaaggaaatgcctgtttacaaaaggctggtgctggcacttgtagctaagcctgattgagccaggcaatcagtaaatgagcgtatgtgtgtgtgtctgtgcacacagagagagaaaactttaatacctttgtgtggttgatgcagccttttttccccccttttctaatgaaaataataaaaccaatttagaaaatacagaaaagtataaagtaagaatgtaaaaatcactcataaaattactgcctgagatggcccggcgcagtggctcacgcctgtaatcccagcactttagg

SEQ ID NO: 101313 - DNA, 1043 bp, Homo sapiens
tgtatgaccctgggcaagtgacttaccccctctgcctcatttttcccatctgtaaaatggtaataataatatttgtaatggactcacgagatggttgggaggatttaggagttaatcattgtgcatcttttgaaacagtgtatggcatgtagccagccctcagtgactgctagccacacctatcatgctcttactttacagatgtagctagtgaaaagcagcggcggctgctgtacaacttagagatggagcaaatggctaaaacagccaaagctctgatggaggctgtgagccatgccaaagccccgtttaccagtgccactcacctggaccatgtccggccaatgttcaaagtgagtatcctgagaacttagcaagcatgtggctaagcctgattctgaagctggccagcgagaagtactctttccacgctaaaactctggatgttattgaaatcttccttccatgatagctggtgtggacgccactattggcagcctacagcatcggactccagaactgtgatgacactgaagtggcctccttgtgtttggaaggcatccgatgtgcaatccgaatcgcctgcatctttggaatgcaggtaggtgtaagtcagcaacactccagagatactggtgggttgtgctcttttagatttggcaaaacttagaaattatcagaaattttcagttaatcaagactcttagcaagctacttacttatgcctactgacaagaaatccgtagctttgtgatgacagctcgttaggggcaaaaatggagatacggattaaaactgtctttaagaatgggtaggctgggcacagtggctcacgcctgtaatcccagcactttgggaggccaaggcaggcagatcacctgaagttgggagttcgagaccagcctaaccaacatggagaaaccccatctctactaaaaatataaaattagccgggtgtggtggtacatgcctataatcccagctactcgggaggctgaggcaggagaccggcttgaacccaggaggtggaggttgcggtgagc

SEQ ID NO: 101314 - DNA, 1055 bp, Homo sapiens
tgtgtgacagtcttagtattcaacagacatagtggaacatgggacaggtgagtttgactgaagtcaattagaaaggagagagctgcttctcaaacatgtggcagtgcatagatacctctgcaagatgttccaaaagcaagagggcattagcatggaataactgttgtgctaatgtgcagaaagccagtcaatgtgcatacaaaaagtatcagagaagcccagtgtgccagccctgcagatgtgagaatggccacactaaggttggagtcacagtgttctctcttgggtttctgttacagctggaacgagatgcctatgttcaggctcttgctcgcttctccctactcacagccagctccagcatcacagaaatgaagcagaaaaacatcgacaccattaagacgcttatcacagtggctcacaccgatggcaactaccttgggaattcctggcatgaggtacgtgtctctttgaattgccttttctcagttaggatgactcctggcttccttttattcattgttgatctcatttggtcagttctgtttttcttgaagtcaaatcactgtacctcatgtatctggaagtcaccctctctggggctgtgaaaggcgggggcgagttcaggcgcaccagctcacagtgagcacccttgcacccagcagccagtgtcccccatgaagtgtacttctgttgttgcaactttctttccatattagtgccatttttttttttttttttagtccttatgtacctcttgggagcttgggagctcctgtgatcaatgtgtaattttaagacaaagccaggagcctgattagaaatggttgatagtcacaatgagctgttagggagagtgccagtgaattcacatgtttttaaaacagtattctaagattctcacccaaggatatagttacttatgtgtacaacaatgtatttaaaaggatatttgttgcagttttagttgttctagggaaaagtttgggttaaaaagagctagatgtcccaacaatataagagattgctactttttttaaaaagtatggtacagc

SEQ ID NO: 101315 - DNA, 1032 bp, Homo sapiens
aggtctgtgtgccattccttggtaagtttcatgtagccagtgtttcctctgacagaagttgggaccagtttctgtttctacagctgagcttcaggtaggagggcccgtgtgcagatctgcattctcaagcaccagaggcacccctcaggaccaggagatccagcctcatctcccactgcatgcctgatgtagagcatattctcattccttcagttaaaccaattaacgattgccaacaactttaagtgccagggacttaagtgttcagcagtgaacaagacagagttaatgccctcttggcacctaaggcaggaaacaaacaaatagatatatggtataatgccaaaaagtggtaagcactaagaaaaaaaaagtatgagcaggacatggtaatgggaaggtacgatctcacaagaaagatctctttgagagggacacacatgtctgagctgggaattgaaggagtgagccatggggagacaacattccaggcataaggaacagtgagtgccaaggccctgaggtgggacaagagatgacaagttaaaggagcaacagtgaggccaatgaggctggtgtcttgtcgtctcacgaggagggtggaaaaaggaggtgggggtgactaaatgatgtgcctattaagtgacatggtgggaggaatccgccgccccagtcaaatgctttttctctctttattgagagcttactaaatttgcataaacatctatatggcataactccattgaaccaacttttttttaatgactaacttaagattacagtgccctttttctagctgtaaggtaggaactcatttcttcatgccttctttctcttagatcttgaaatgcatcagccagctggagctcgctcagctgataggaaccggtgtgaagacgcgctacctgtctggatctgggcgtgaaagagaagggagcctgaagggccacacattggcaggagaagagttcatgggccttggcctcggtaagacaccaggccccacagctaacagtcacggatttgcaagct

SEQ ID NO: 101316 - DNA, 1013 bp, Homo sapiens
aatgttctaggagctctggattaatatcaattgattcaaatttgttttcctaaatataggcctttaatactataaaaatgtaaaagattatagagaaaggtagatggttggtagaaacaagaaagcttatactaaggatatattttaaatgcccaatgccaaaacaaaactttaattttatcatcagtgggtttttgtttcttttttgaacttgcagagtcattcccatttatgtcccctgtccctgcgtgttgacataacaggatgctttgttctaaatacttgactgtttttgaagtactgctgattttgtgcattgtgtttcaggtaatttggtgagtggcggagtggataaaagacagatggccagcttccaagaatcggttggtgagaccagctcgcagagtgtggttgtagctgtggacaggtaatgattttattcttcagtgaccctgaactacacagtggtttggtggcctctctgtagttactggacatgaatgattcctaatttctttaactgatacaagtgttgttagctacaaattgcttaagtgtcacatttatttgcattttgaccttttagaaaaggtataactttaacattgtgacaaattatgtcaaaaataagagtttttcgcttatgttgatgttttaaattaccttgtttccttagtagaaattatttttttaaaaatcacaagaagagtttaggattaaaagcctacccatgctcacgcctgtaatcccagcactttgggaggtcaaggcaggcagatcactagatcaggaaatcgagaccattttggctaacacagtgaaaccccgttctactaaaaaatacaaaaaattagtcaggcgtggtggtgggcacctgtagtcccagctactctggaggctgaggcaggagaatggcgtgaacccaggaggcagagcttgcagtgagcggagatggtgccactgcactctagcctaggcgacagagtgagactccatctgcaaaaaaaaaacgc

SEQ ID NO: 101317 - DNA, 1020 bp, Homo sapiens
tacataaccagagttgctaaagaaatttcagtaccacttcaagagtggttacagagcagaggggtcaaaatcccagaaatagggcagagagtagggctatacatgcagactgtagaaagactgccaggtcctagctgtatgaccttgagcagcttactgaagctcttgatgcctcagttaattcatctataacctaggaccattgtttctacctgccacttggaatccttgtgagaattgttaatccatgaaaagaactttaacagtgcctggcccatagcaagcactcagtcaatagtagctgctggtattattttaagtaatgtgtatgacagtaacattccagaaagacctaagataatgatacatcctggatattttgtcaatactatttgacctttaagctcttcttagtataacacctcccacccccaggactcttgtgatctgccccccttcaacttgttctaaaacccgcagaggtccataggtttgtactgggaaactgctcatatgccctttgggacagataatgtctttgtgtagtctgttcccactgtacccttgctgaatggagatttttgggagagaaaaatgtgtggggccttaatctgcatatagttccctttcagttccttccttttgcatgcttagtttacacctgagatgtgatttttcatcctaggtgctacaagaatacacaagtgatgacatgaatgtagctcctggtgacagagtctgggtccgaggctggttccccatcttattcgaactctcctgcatcattaatagatgcaagttagatgtacgaacaaggtaaccatgttcccgtgcggtggccccttacatcactgaaatgaacctcagtcacttgctcacctgaccccactctcttctctgttgttctcttctccaccattctctcttctgtgcctgactttgtttcctccaggggactcacagtcatgtttgagatcatgaagagctatggccacacctttgaaaagcactggtggcagg

SEQ ID NO: 101318 - DNA, 2823 bp, Homo sapiens
agagtgggtgctcaatagttattgcagtggctgggctcagaggctcaggctcacatctataatcccagcactttgggaagccaaggcagacagattgctgagcccaggagttcaagaccagcctgggcaacgtggtgaaaccccatctctactaaaaatcaaaaaaattagccaggcatggtggcgcaagcatgtagtgttagctgcttcagaggcagaggtgggaggatcagcttgagcccgaggaggtcaaggctacagtgaaccttgatcacaccactgcactccagcctgggccgcagagcaagaccctgtctcaaaaaaaaaaaagtaattaaaaaaaacatgttaaaataattttaaaaatagcacaagaatgaatagttctcccctgaatgtgagatgttaatcaattgtttgatatgcctccccctctctaattcttctagtgtttgcagtgaagctcttgcctatttcatcactgtgaattctgagagccatcgggaggcctggacaagtctcttgttgttacttctaactaaaaccctcaaaataaatgatgaaaaggtatgaacaagtaaactctgaccaattttcactaggacataaagtttgggttggctttttactcaagagtttgcagtaactattttctcagttctcccaaggatggttacgtgactagcaccattctagatgcattggagagaagttaatccgttatggacaatgggtgccacaggatattagggctttttgcctggaagaacagtagttgagaacggctgaagtgtagacctcatgtgttgctgttaggaatggtatggtgagtttcagtgcaggaagagagggttaagattgtgaagcaccagttttgacctaggaacctgctttacaaaataaaagagctgttgacttttggcagcaagactatccaaatttaattaaagttaaatataactgaaagaagctttaatttgcaaggtttcttcaacttctttttttttttttgagacagagtcttggtctgtcacacaggctggaatgcagtgacgtaatctagctcactgcaatttctgcctcccaggctcaagcgatcctcccacctcagcctcctgagtagctgggaccacagacacgcgccactatgcccagctaagtttttgtatttttggtagagacagggtttcaccgtgttgcctaggctggtctcgatctcctgagctcaagcgatccacctgcctcggcctccccaagtgctgggattataggcgtgaatcactgcgctcggccccaactttctaatagcaagaaaagcaccaatattgtaataagttccagggtgagattaacacttctgaaaaactggtgcccaaaaaaaaaaaaaattgtctaattttatctgtttctctcccacctcaagttcaaagcacatgcttcaatgtactacccctacttgtgtgaaattatgcagtttgacctgatccctgagctccgagcagttctgcggaagttcttcctacggataggtgttgtgtataagatatggataccagaagagccatcacaggtaccagcagcactgtcaccagtgtggtagccctggctgcccaggccagtgctgcagctctgcagaatgttcagcatgccatttctgactggcacatctcgtgaagtttcatagaaacaaggagttggcatcttggatctcagaatggcctggaaacggatggcctctacgctgttccatcacagtctccaactaaggcttatggtatttcattaaactgttgcatacccagttagcacagtaggtggggagtctgcttcatttctatcattccatttttctgattaaactgtcaaatctgtcattgcatatgccatcgttttctagcaaaatcccatgattggctataaacgttttgtaagaagtcactctccttgaaaatactgaacatagctgtataggtttgtgattattagagaatatgttaataaaacttcttgtaacggctaactgccacctaaaatatgctgggttttctgttgtttgagtgtgttagagaaatttgaatgtttttgtcagttacgagtcagccgtaattagattagtttaaggacaggtcaggattagagaagagttgtttttgtgttttgttaatgtctgagtgatttttaaagtattttacaaaaagatattgaaaatttggttgaaggcagagtttagtaattaagttagaattaagagttttgcgaggttaaaaaaatgtgcctcgtggatctccctgttttagtaacatggagagaaaaagtctacacgaaaaagtgaacaatttaatgaagatgattagccttccttgaaataagtatttgtggatgggtgttaaattaaaatttccagaatacactgtccatctcacacactctgaaatctaatatatgaagtagtaatgaaaatgaagtagtaatttaaccagagttcatttatccttgaataaacctttttattttcacctcagaaaagtgagtgtactggcagttagtgtcactgctttgcacagtccccattaaaggaccctccagagagggacagtaactgtgcatgagaagccgctcccataagcctcctcagccagatgtcatgggtggaactggagctgtgtcggggccagcacagctgaactgtgacaatggcaggaggtggcatgtgcccagcacttccattaatctgagcctaggagttgaattctttggcaaggttggattctgaggtccttattatgttaatgatggtgcaatactctcacctgcagtagaact

SEQ ID NO: 101319 - DNA, 1100 bp, Homo sapiens
gagaccgatattcttaagttgttttcttgttttaacagccttgagaaatgtttggttttggccagcagaattcttgtctacttttttctttcccaaaaagtgttttttaatttctctaccaaagaaaaaatgagcaggtttaggtttttacatgacttatatacattagataaaaggagctgtataatttagcaggaagggactatgggagaatactttactgtgagtggaaaatgttagcacatttgactggtttgccctggaatccactgcacctttacactgcaccatgaaacctacactccctggtatcatagcgcgtcatcacctcaacaagtcagtcgtctccattgatatttgtacaaaaggtatacatggggaacacgtgttcattcattaagtccatcttgcgtgcagctatatccctgattggttatttttcctttccttctgaggttctcatgtcattttcttcatcggatgtgactaaaatttttctggtgtcttctgccctctctttaattttgcctcttgaggggtagcagatgtgtcagtgcattttattacttgctgaaacattcaggcttacatttcttattagtttagtattttaaaagatttaattttctgaatgaggcatttgaattgtaccagcaatggacttttaaaaaattggatgtaaaaccattcagggtgatttttcttgtcagtggacagtgacgaacagagatttgaaatcccttacctccaataataagccattcagcctaaattcatttttatgaataaatctcttctttctcatggtaaatgtggcttgtgccactcaaacactagtgaaagggtatgtacaaccgcaacatcaggccaggacaccatttatttaaccaagtaatggaggagagtgaaacattttccaaggccttatttctttttcagaatgctttaagtgttgattatatgtgctgggtctctagagaagtttttatttgttacaatactgctgctttgagcaattttgtttctcttcattgtctgttagggaaatcaccagctttggcatcttaacaacaaacagtggatgggtaatttttatttct

SEQ ID NO: 101320 - DNA, 1047 bp, Homo sapiens
acctaattatttgtatttttagtagagacagggtttcaccgtgttagccaggatggtctccatctcctgacctcgtgatccacccgcctcagcctcccaaagtgctgggattacaggcatgagccaccgtgcccggtggaaaaattattattattatttatttatttatttatttatttatttatttttgagacagagtctcactcttgcccaggctggagtgcagtggcgccatcttggctcactgcaagctccacctcccgggttcaccccattgttgtgcctcagcctcccgagtagctgggactacaggcgcccgccaccacacccggctaattttttgtatttttagtagagacgggtgtttcaccaggttagtcaggatggtctcgatttcctgaccttgtgatccactcgtctcggcctcccatagtgctgggattacaggtgtgagccaccgcacccggcaattattttttttttaataatgtgtgaggcaagagttctgttgctttatgtattcaggacagagtataaaaataatctggtatttctgggaagttaggaacatagcatttctcagggatcgagactgactgactagactgactcaactagaccttttgagactccttgagtgcgcagaaacatatgcatgtgaatattgtgataagttgaaagaaatgaacacagaaaggaacagactcaaactcacttcctggatattgattacaatttaggaaagagacttggcaatttatatgggcttttcctcaaatcatggatgtagtgtgttgccctgtacaaaatgctggctactaagtggaggaaacaaattgttctgtactcatataaaaccatagtatgtcccctcctgaaaaacatttttcagtttaacaatcttcatccttcaagaaagacatgataagcacaaagcaaggagagtttgaaaatatcagtgaaactcttgggactcagtcagaaagagggaaggtgttaaatgatacatgaaattaatttttcaaaaaatattggaatattgggtgt

SEQ ID NO: 101321 - DNA, 1392 bp, Homo sapiens
taataatatattaggatgaattgactcatttgctcttcatcactagcctataaaagaaatattactactaatagtactaataatactcctttctgaaataagacctgggtatatgaagtcttgaagccacttaatctgcctgggaagcagcttctcttgcagatgagatgatcatccaattaggccactgtataggtttgtgagaatcatgtgagttaattgatggtaaagttatttgaaaactgaagcattatataagtttaatgtaacatatataatccacttaatagataagaaaagtgaggccctgtagacccacaaataacctaatcttttctctttttttgatttttttttatatatatatatttgatatatataaggtggaaagatttttatcttagtcttttaacatgaaaattcttttacagctgagaaatttcttgaatctgttgaaggaaatcagaattatccactgttgcttttgacattactggagaagtcccaggataatgttatcaaagtatgtgcttcagtaacattcaaaaactatattaaaaggaactggagaattgtaagtattttgtgaatacataatttaataccctgtatgtttataaggtttatataagcagtgttcttcaaagataaggcacgtgcttgtagtcccaactactctggaggctgaggcggaaggatcacttgagtccaggagttcaaggctgcagtgagctatgattgcaccactgtactctagccttttagtgacagaatgagaccttgtctcaaaaaaaaggattcagatatggatcaaagataaaattaaacaggacccttttccaaagcttctgttatttcatttgaatttatataaatttgtccagcttcatacctcgggttgctagggagtgagacttggtcttaatctccattatgtttggaatttatgctttactcaccgcctactgaagagacattgtgggaagacagtctgaataaatgaagtgatttctgatgttggaaaaataaagctgagaagaaatcagatacataaaacatttgcagaatgcaaaataatttagatttcaactttttgataaggtattttgccctatgtcttgtgggatatgtatatatatactaattttgagattaaacctattttataacaggtttaatgattagtaaattataaattaagaaacaggcattttttttccttagcttaggacagtgattctcaactgggggcagtttggctcaccaggggacatttggcagtatatttggagacatcatagctggaggattgctactggaatctagtgggtagaggccagagatgctgctaagcatcctacaatgcacaagatagctttccacaacaaagaa

SEQ ID NO: 101322 - DNA, 1053 bp, Homo sapiens
tcctgaccttgagtgagccatcgcacctggcctaaaatggaaattttttttttttttttttttttttttgagacagagtcactcttgttgcccaggctggagtgcagcggcaccatctcggctccctgcaacctccacctcctgggttcaagcaattctcctgcttcagcctcccgagtaactgggattataggtgcctgccaccatgtccggctaatttttgtatgtttagtagagacatggtttcaccatgttggccaggctggtctcaaactcctgacctcaggtgatccacctgccttggcctctcaaagtgctgggattataggcgtgagccactgcgcccagtctaaaatggaaattcttaattggcatcaaggagtaagggaagttcactaatttgtatgtaaaatatttgcatttgggaggcaatgtacgtttttctgggaaaaggattcacgctgtcatcagattattgaaggaatctgtgacccattcatgtagagggaaactgaagaaagaccaaaccttcctctatttgttttcttagaaaattagtaaataaaaaaacagttatgttttacctaaaatcatgtggacatgaatgtggattttgtgttacttcctcagttactgctttgcttttaggttgaagatgaaccaaacaaaatttgtgaagccgatcgagtggccattaaagccaacatagtgcacttgatgcttagcagcccagagcaaattcagaagcaggtaatgtcgctccactttttagatgggctcctctgtaaagctctgatctaattaatcttttcctctcctagttaagtgatgcaattagcattattggcagagaagattttccacagaaatggcctgacttgctgacagaaatggtgaatcgctttcagagtggagatttccatgttattaatggagtcctccgtacagcacattcattatttaaaaggtattgatgcatagattcatgtttttaaaatactttctaaagttttatttgcttgtgtaaacagttgtgtttttgtgactgttgtc

SEQ ID NO: 101323 - DNA, 1051 bp, Homo sapiens
cttgataaactgcttgatccctttaaaaagaaaactggctgggcatgatggctcacacctataatcctagcactttaggagggcaaagtgggcggatcacctgaggtcaggagtttgagaccagcctggccaacatggtaaaaccccgtctctactaaaaatacaaaaaaaactagccaggcatggtggtatgtgcctgtcatcccagctactcaggaggctgagacaggagaatcacttgagcctgggaggtggaggctgcagtgagccgagatcaaaccactgcactccagcctgggcgacagagcgagactccgtctcaaaaaaaaaaaaaaaaaaaaaaaaagaattccctttgaatttcggaatttcggaaacccatctattcatagatgtccaatcagcatctctccttgaagacctaaagtgagtaaataaaaaaaacttgtaaatttatctgttttaccttaattttctagataccgtcatgaatttaagtcaaacgagttatggactgaaattaagcttgttctggatgcctttgctttgcctttgactaatctttttaaggtatggaatgcatcttggtgatatttttaaattaatattttaaattgcttgaatgtttgtatacatgttaagagaatgctttgaaagcttatttgatagataatgtttagagcatttcttttgaaaaatttcaaacctacacagaaatagagatgctatagtgaactcccatctattattacacaaatttaatggttagcaacgttttattttctctgttccctttcttaggaatgttataaaagcaaatcccaagcatcatatcatttcacccaagtattttaaagtatgtgtctctaaaggaagaaatacatatttttatttgactatgtttggagtttaattaattatatatttatacattattttacagtttacaggatactttcctgaatgtgttcttggtgtttgtgaaaatcctataagatttaaagaaatatatatatactttttttcttttttcttttttaaagacagggtc

SEQ ID NO: 101324 - DNA, 1029 bp, Homo sapiens
gaccaaggaaagaggcataatctaccctcaggggacttgtaccctcattaagaaggcagtactatgccacaagaaatcagtaactaaaagacaattagtttatctgccttggtggtcatcttacaataaacgtagttcagaaaagaaaggggatgtattagtatgcactgagcttgagctttgtaaggaaagtcttcatatagtcttagctgaaccttgaaggaagatttagattaggatgagaactagaggtggcatcatttatagcatacaaacagaggcagaagtcagaatgctttatgcagctgccagatgtagctggagcagagaattcttgtcagaataggtaatgctcaggctgtgaagcctgtgtataaaatgttttgtccacgtggtaagggaacttataaaagtggtgttcttaatattttaatcaaaagtttcaagtcagtgtttattctgtaggatctccctgaattttttgaagataatatggaaacttggatgaataattttcatactctcttaacattggataataagcttttacaaactgatgtaagtatttaaaatgttgcctgagtggtctttttctttcattaagagttatttggctacagtctggaaacctatttactcttgcattgttaaaagataaaatttcaatactgtaataatatttgattctatttgatgttacatgtttggtgtgtgtagtatacagaattactcttatcatgggcttggcttaagccatagtgtacatataaggctgtttcattacattattgaaagtaggtctttaaagtagtgacattatggatatttcatgaaataaaattatttttcattgaagatactaagaaaacttaaaactctataatggtagcccctttttaaaaatcatctggctaggcatggtggttcacacctgtaatcccagcactttgggcggccaaggtggggaggatcccttgagcccaggagttcaagaccagccttggcaatgtaaggagacccccatcacta

SEQ ID NO: 101325 - DNA, 1074 bp, Homo sapiens
gaagaattccagcgatacctgcctcgttttgttacagccatctggaatttactagttacaacgggtcaagaggttaaatatgatttggtaagatgatggtggagacaaataattaaaagacattctctccctatctcctccaagaaataagctgttgagttttgcttttaaaaatattcttgtttttgtgttttgttccagttggtaagtaatgcaattcaatttctggcttcagtttgtgagagacctcattataagaatctatttgaggaccagaacacgctgacaagtatctgtgaaaaggttattgtgcctaacatggaatttagaggtaattatggcaaaagtatattagtataaatctactaagtctgtgtttgttttttgtaacatattcagtctaattcatttattactggataaaacttgtatgtcatttatttcttattttctaaaccaagacagaaaatgtagtatctgtaatgagttttgttgtgccctgtgagggttttctcatggaaatattaaataagacttcaaaaattcctttacactaagaagataaactatctggaatttctatttagagaaagaatttgattttgtttcatttattatttcaatgaatttttagctggctttatttatttatatatttatttgagacaggggtctcgctctgtcacccaggctggagtgcagtgatgcaatcttggctcactgcaaccttagcctcccaggctcaagtgatcctcctacctcagtcttctgagtagctgggaccacaggcacacatcaccatgcctggctaatttcttgtatttttggtagagacagggtttcaccatgttgttcagggtagtctcaaactcttgagctcaagcagtccacccgctttagcctcccaaagtgctgggattgcatttctgagccacctcgcccagaaatagctgtttttaaacaatcgacttgagaatagaaatgataactttataaatacaaggttgaagcccacttagtttgtgcttaaggttaaactatagtgctaagagcctatatttataaaatgtatgt

SEQ ID NO: 101326 - DNA, 1062 bp, Homo sapiens
atagctattgggtggccctttgtttttcgttcttttttttccgttttacaatcgtagccaaattattccaggcaatttgttttcttataaattggatcagcttgttggtggttgttttttttccccataatatattttcttttcatttcatagatattgatactagacgcagggctgcttgtgatctggtacgaggattatgcaagttttttgagggacctgtgacaggaatcttctctggttatgttaattccatgctgcaggaatacgcaaaaaatccatctgtcaactggaaacacaaagatgcagccatctacctagtgacatctttggcatcaaaagcccaaacacagaaggtaaatatttttaatgtggttttgtttctaaaacagacatcagtgacacccacacaagtcaaaaagaaataacgtctctgataatagagcttactctgccagataacctattctgattaagatttatataatctctgaagatggctttatgttgatgtattgagcacttaagtttcttatagaccagaaaattgatagatggccacacttgttaccttagctgagacccgctgtatcaaatatgcttaacttaaacttagctgttctttaattgaggaaagtttctttattgtctattagtatagtcttattttacatttttatatttttgagatggagtctcactttgtcaccaggctggagtgcaatggcgtgatctcagctcactgcaacctccacctcccgagttcgagcgactctcctgcctcagcgtcccaagtaactgggattacaagtgtgcactaccacacctggctaatttttgtatttttagtagagacaaggtttcaccatattggtcaggatggtctcaaattcctgacctcgtgtgatcctcacacctcagcctcccagagtgctgggatacaggtgtgagtcaccgtgcctagacagtatagtcttattttatattttatacataagcaggttgtgttttgttgttgttgttttgttttgttttgttttgagacggagtttcgctcttgtt

SEQ ID NO: 101327 - DNA, 1042 bp, Homo sapiens
tagtagagatggggtttctccatgttggtcaggctgttcttgaactcctgacctcaggtgatccacctgccttggcctcccaaagtgctgggattacaagcatgagccaccatgcctagcctaagcagttcatgttttgaagtgtccctctctctctttttttttttttttttttttttttttgagacgttgtcttgctctgtcatccaggctggaatgcaatggcaacatctcagattactgcaacctctgcctcccgggttcaagcaattctcatgcctcagcctcccgagtagctagaattacaggtgcatgcaactacacctggctaattttttgtgtttttagtagagacggggttttgccatgttggccaggctagtcttgaactcctgacttcaagtgatctacccgcctcggcctcccaaagtgctgggattacagccgtgagctcctgtacacagccagtacagtctcattttatacataagcaatttgtattttgaagtgttcatctccattttaacatggttttctaaaattgcctgaatttctaatgtgatagatatatacaggtattttgttattttactatgttatgaatttgcttttcagcatggaattacacaagcaaatgaacttgtaaacctaactgagttctttgtgaatcacatcctccctgatttaaaatcagctaatggtgagttgtgaaattcttgctttttttacagcttgccacactatacctgaattcaaaaaacagcttcctatccttgttcccttttgttctttttttttttttttttttcttttgagatggtgtcttactctgttacccaggctggagtgcagtggcacagtctctgctcactgcaactcctgcctcctgggttcaagcgattctcctgcctcagcttcccaagcagctgggactacaggcacgtaccaccatgcccggctaatttttgtatttttagtagagacggggtttccccatgttggccaggctggtctcaaactcctgacctcaggtgatccacct

SEQ ID NO: 101328 - DNA, 1027 bp, Homo sapiens
atgagctcccatgtgaccatcatttagcttcaagaattattaacatttggtgatctattcctttcattaatttatttccctacccactagaataatgtaaagcaaattccagctagagagacatgtttctaattcagaatagcttcacttctgggaatgtaggtagacatgctcaccgatgcatggtccagctcatttttactcaattatgtaatatgtgttccttagtcatgaaacaggcatggggaaaaataaaatcatttataatcctaccaaaattaatgactaaatagtaaatcataatataattaactgtgctttaattacttgacattttatctttttttataactctgatgatgtcactaatttggaagtaatgatccttaccacttaagtaactgtggctttctgtttttttatatagtgaatgaatttcctgtccttaaagctgacggtatcaaatatattatgatttttagaaatcaagtaagtagctttttatttgttacacgccacttaatctctttaagagttttattatgtaccaccttctcatctactgtgcagtcattttatatccacatctaacaaaattaacaatgatttctttataacttagaattttagaccatgcttaattttcctcagatgtctttttgcaataatagtaatagaattgggatctagataatgtccacacattgcttacagttgattgtgtcttaagtctcttaatttacaatagagaggtccttctctgccactttttgtttgagatggagtctcattctgtcacccaagctggagtgcagtggcaccatcttggctcactgcaacctctacctcctgggttcacgtgattctcctgtctcagcctcccaaatagctaggattacaggcacctgccaccacacctagctaattttttgtattttcagtagatccggggtttccccatgttgaccaggctggtctcaaactcctgacctcaggtgatctgttcacctcggcctcccaaagtgct

SEQ ID NO: 101329 - DNA, 1038 bp, Homo sapiens
aggctgcttactaaaataggtgcattatgacaatacaatttaataaactggagccaaggaaagtaactgagataaagttaataaacagaaatgtgtgtcaaaggatcctatatagtagtccaagaaactccaaattttatttggagtctcttagcagccagggcaaagagggaaacttgggaagttaaaattttcacagggtctatgagataaaagttaaagcagagaatactgtacaatagtagtagtagtgttctcagcaacaatcatgtaacagttattttcatgtggctatttgcgtaaggtcacttatttctgagatatgacctaaccgaatgaaagtaattcactggggaccaagaaaataggtcttctggcctgaaccaggatgaaatgtagaggaatggatggtctgcatgtctttcaggccactattcaacagtattatttcttgaaatgagctttgggtaagagatggaaaacagttctaggttctttccttcatcaagaacttgaagtacagatactctcagtggccaattaagggtagaaaggacatcctttgaggtgagtcaagccagtacctatcttcaggcccagaatttatgcagaaaacagttctgaatcttggctccacctccaaaaacaaaataaatgacagagtcccctgagattctgagttctttctcagtggtaatagatataaaccagggacaactgtttcaacttcagatgttgttgggtttagctggctttttggttcagttgtgtttggttctcgatgtgccttcttaggagcctaacatgagcacatgtaaaaaaattattttcctaaactgtctatcaattgtcagtggtgggagatggctcagttttatgctgagaagggtgacatagtggttgccaagggtaatctgcagtgacaagctcaagagttggtagtgactgaaagctgttttttcatctatagctttacagctgcagaaatcgcaccgtttgttgagattctgctaacaaaccttttcaaagctctcacac

SEQ ID NO: 101330 - DNA, 1044 bp, Homo sapiens
tatattatgaaaggtaggctgtttccctggtgtgcagactacaggtatccaatctcagattgtaagggtgagcactctgagttatacttcaggttatacagtctatgaaccagataatgtttaccaagtagtaagttagtttagatatttcaaaatgaaaaacattatcttgtttactactaacaataatttttttttttttttttttttttttttgagatggagccttgctctgttgcccaggctgaagtgcagtggcttgatctcagctcactgccacctctccctcctgggttcaagcgattctcctgcctcagcctcccgagtaactgggattacaggtgcactccaccatgcccggttaatttttgtatttttagtagagacagggttttgccatattggccaggctggtctcaaactcctgacctcaaatatctgcccgcctcagcctcccaaagtgctgggattagaggccactgcacctggccaacagtaatcttaatttgatatggaacttctcattacagaaaatgtagcaaagcccttttttccttccctagattgagtttctttaaggcaaagaagagatcatgcaacgtttattaactgcatgctcacctaggtaggggtgaaatgtgggtgcctgtggtagactctgcacaaatcgtgtcttcttacgtactgccaaggacacaggcagctgtatccatccacaggctggtgtatccatccaccaggcactacattagttgagtgtcctggtgccagctctgaatttagagatagtctcagtgtttttcactgttgcatcccaaaagcctagcacattgggttgtaggaagcacttttcagagaaactccctgatcttttcagtctggatcagaaatcctagagtggatgtgtgtatctgggtgtatgtttccaacactatccttcccccaacaatgatgtataattgtgtaattattgttgtttaatgtcctttttttttttttttttttttttgagatggagtttcactcttgttgcccaggctggag

SEQ ID NO: 101331 - DNA, 1065 bp, Homo sapiens
caggtgagtctgagagagaactgtttggggtctctttctcttagaaatcagtagcagaggccatgcttggtggctcacacctgtaaccccagcactttgggaggccgaggctggcggatcacttgaggctagagtctgagaccaacctggctaacatggcaaaacccatctccattaaaaatagcaaaattagccaggtatgtggtgcacgtctgtagtcccagctactcgggaggctgaggcttgagaatcgcttgaacctgggaagtggaggttgcagtgagccaagatcatgccactgcactccagcctgggagacagagcgagactccctctctctctcaaaaaaaaaaaaaaaaaagaaaaagaaaaagaaaccagcatcagaaaatgtttagccctagcctaaaggaaacatgatcacaaactacaggaaactgaagagaaaactgcctatccacctccctcaaaaaaagagattaggagcctaaaaaaattctaaaaatacatgtaaagccacagagtccaaattgcaaaaatattgctcaaaagaccataaatgggttaaaaataggaagcatgggagaaaaataaatttgtcagctaaaaatgtataaaagctctctttccacaaataacatttctaaaataaatgtttactaagcagagccccaaatacatgccaagcataaaggacagaaagctatctgctcttgcctcctgaactctgcacatcatgtttcctcctctactggagtcaaagactcatccacccttcaacagattgctacctatccctcacacctaacgttcggttaggtcatatctcagcttagagatcacttcctagagaaaatccttccctgacctgggttaaaagggctagaggataaattggtgctcctccactaggctggcgcagaattatttcattcactcatacaaccgtacagagaaggtattacatactgtgtattcttacataccctaaaaacacagtaatgaagattacagactagttagccgctctcatagaaatggacattaaggctgggcgcagtggct

SEQ ID NO: 101332 - DNA, 1401 bp, Homo sapiens
tgaaataattctgcgccagcctagtggaggagcaccaatttatcctctagcccttttaacccaggtcagggaaggattttctctaggaagtgatctctaagctgagatatgacctaaccgaacgttaggtgtgagggataggtagcaatctgttgaagggtggatgagtctttgactccagtagaggaggaaacatgatgtgcagagttcaggaggcaagagcagatagctttctgtcctttatgcttggcatgtatttggggctctgcttagtaaacatttattttagaaatgttatttgtggaaagagagcttttatacatttttagctgacaaatttatttttctcccatgcttcctatttttaacccatttatggtcttttgagcaatatttttgcaatttggactctgtggctttacatgtatttttagaatttttttaggctcctaatctctttttttgagggaggtggataggcagttttctcttcagtttcctgtagtttgtgatcatgtttcctttaggctagggctaaacattttctgatgctggtttctttttctttttcttttttttttttttttttgagagagagagggagtctcgctctgtctcccaggctggagtgcagtggcatgatcttggctcactgcaacctccacttcccaggttcaagcgattctcaagcctcagcctcccgagtagctgggactacagacgtgcaccacatacctggctaattttgctatttttaatggagatgggttttgccatgttagccaggttggtctcagactctagcctcaagtgatccgccagcctcggcctcccaaagtgctggggttacaggtgtgagccaccaagcatggcctctgctactgatttctaagagaaagagaccccaaacagttctctctcagactcacctgctccattcatgtcagctcactgtttcttcctcttagtcaacctctttaattattttttaaaccttgagccttctagaaatactcagtatttcccagctaaattttgttgccaacccgtcctaattttaaaaggaagggaaatttagattatttttaaatgtagagagctatctcggggttgtctaagcatcttaaaatttagttgatgaattagtgcgcttttttccccccagtcgctctcttattctgaagtttaactaaactctatttgtttttgctgtttttgtattttacagctatcatgagaagtttttctctcctacaagaagccataatcccctacatccctactctcatcactcagcttacacagaagctattagctgttagtaaggtaatagagccaattttgaaagtggggttccttttttatttgctccaaactgtttgggcctcagaactctttggc

SEQ ID NO: 101333 - DNA, 1054 bp, Homo sapiens
caaaagtaacatgtttattgtagaaaaagaaagtgcagatgatccaaaattaccttaaatggagttaagtaggctttgcactaaatggatataaaagaggctgtctggacttctatgaaatgatgattaaaatcctttgtgttgtcttttcttccttactcttatttctcaaaaggaaagttcactctgatcaaaattttacagatacttagattcatgtttattaacactaaattttagaaaataaatccgtttaaggctgacagaattcctttttagatgctattcttgatcttatgagaattagatcaattcataggaagtgttggagggattttggagaacagagtgattattattcaactgagttagggctaagggtctttggactacttagggccttgagggatggagcggggagggaacccaagtctccgcctcccatatgtattaccatctcatgttctgattgagttagatttgtatgctagtagccttccaagaacttgtttaaagaaaaatggggttttgttgcttaaaaagaacataaaaaactactcatttgggggattatcagtaagtagacatagacattgaggcccacagaagttaaggctagtggcattactaggacttagtatttcttctctgcgagggcacgtgggcttaagacaagttacagctctgggatctgaggtttgtataagcaactctgtaactctgaagtatttttttcatggtggactttgggccatttaaaaaaaaattcaaatgaacaagcactagggtataattggtgtttttttcttaattttgatttttaaaaaataagatggcctctattttaaatgtgttttataaaggttaggtgtggattattagcataattaggttttttttttttaatttcagaacccaagcaaacctcactttaatcactacatgtttgaagcaatatgtttatccataagaataacttgcaaagctaaccctgctgctgttgtaaattttgaggaggctttgtttttggtgtttactgaaatcttacaaaatg

SEQ ID NO: 101334 - DNA, 2049 bp, Homo sapiens
aacctgggaagcagaggttgcagtgagccaagatcgccccattgcactctagcctgggcaacaagagtgaaactccgtctcaaagaaaaaaaaaattactttaatggctacgcgggaggaattgttccccatatgtttcagaaataattaaagagaaaaggatagattattacagtatgaactctgttttaagacatatatcatgtttaacttttcgaataattattcctgttaaccattttctgttggatctcatttcttaacagcctgggttactaggtgtctttcagaagctgattgcatccaaagcaaatgaccaccaaggtttttatcttctaaacagtataatagagcacatgcctccgtgagtatgactagaactttgtgcatttatttagaaattttgttaggtgctcagaaaagtcctaaatttatattgttgattttttttaattctttagtgaatcagttgaccaatataggaaacaaatcttcattctgctattccagagacttcagaattccaaaacaaccaagtttatcaagagtaagtaaaatcatctggatgttctacagaagtaatgaaagaaggtagctaaaacccttagactttatggttgcagatacattttttatccgttttaaactttatgcaaaaaatacttggccacgtgtggaggttcatgcctgtaatcgcagcactttgggtggccaagggaggccgatcgcttgagctcaggagttcaagaccagcctgggcaacatggcgaaaccctgtccctacgaaaagtacaacaaaattagccaggcatggtggcatgtgcctgtagtcgcagctgcttgggaggctgaagtaggagcatcacctaagtcccagaggttgaggctgcagtgagccaagattacacccactgcactccatcctaggtgacagagtgagaccctgtctcaaaaaaaaaaaagaaaatattgtaagggcctggtgcagtggctctcatctgtaatcccagcactttgggaggtgaaagtgggagtattccttgagtccaggagttaacgaccagcctgggcaacatggtaagaccctgtctctacaaaacagccaagcatggtggtgtgtgcctgtagccccagctactcaggaggctgaggtgggaggatcacttgaccctgggaagttaaggctgcgtgagctgtgatcacgctcctgcacccagcctaggtgatagagtgaaaccttctcacaagaaaaaagaaaatattttaagatgtttgtgttctccaaacattaagttagtgttagtcatattgtgttccagaggttggtttatggttggataccaaaacattttttcagtagagagaatattataaggaaatataaatcaaagagagacagcatgtaaaggtctatgacagaaagacaagttttctatttactagaaggcaggtattgatgccacagcctttggatgttaatgattaagcataggtttattttgcagacttatcagttaccagtttagtgcgtgagttctctatgctgatattctgcatcttctttcaacaggttttttagtctttattaatttgtattgcataaaatatggggcactagcactacaagaaatatttgatggtatacaaccaaagtaagtttgtttttattattttttaaaggaagaaaatgttttgactttttttttagtacaaatcagtatctctgtcttatagatgatgatgtggttcttggtatggagatagtgtctatggttttcaaaatattcttaggtattgggagtaaagaaaaagtaatcctggcccagcatggtggctcacgcccgtaatcccacactctgagaggctgaggagggcggatttagctcaggagtttgagaccagcctgggcaatatagtgagactccatctcaaaaaaagaaaaaacaccctggaatcattgttctaatcctctagattagaggaccatctactctacacactggcattctccacagccagtgttctatattatgttaaatggtcagtgtt

SEQ ID NO: 101335 - DNA, 1849 bp, Homo sapiens
gcactttgggaggctgaggcaggtggatcacctgaggtcaggagttcgagatcagcctggccaacacaatgaaaccccatctctactaaaaatacaaaaatttgccgggcgtggtggtgggcacctgtaatcccacctactcagggggctgaggcaggcaaattgcttgaacccaggaggtggaggttgtagtgagctgagatcacaccgttccactccagcctgggcaacaagagcgaaactccgtctcaaaaaaaaaaagaaaagaaaaagattatggcatttggctacagggtagaggtgtgatggggtttttttatgttttgactttcagtctcttcagatgatcaaaaacagcagtcttgttatttagtaatttatcatattcataagaagtaactaacatctaagcattttactatttcattatagtgataatctaatattaagttgatttattttgctttaatagaatgtttggaatggttttggaaaaaattattattcctgaaattcagaaggtatctggaaatgtagagaaaaagatctgtgcggttggcataaccaaattactaacagaatgtcccccaatgatggacactgagtataccaaactgtggtaagtacttcattttaatatttttgtaagttacagcttccttcccatatgactgcaaaattaacaaagcttattctcttgggggccaagagaatcttggtctgatctcagcttctccacaatcagatccaagacatgatttctggatccttctgggcttagaatgatcttgtttcctgcttctttttcagggggattcatggacccctttaagagtctgatctaggtgatctctaagacaattttatgacagaagcccaactaaactgacttatctttaaggggaagaactgaataagccaagaaaagaaccatcttaatttcaaaggtccccttttattcttgagactatgagtctgtaattttgtgtctctgagcaattgctggttttaagtcttccgagtattttcttgacctttttatctcttgctttcttccaatccaggactccattattacagtctttgattggtctttttgagttacccgaagatgataccattcctgatgaggaacattttattgacatagaagatacaccaggatatcagactgccttctcacagttggcatttgctgggaaaaaagagcatgatcctgtaggtcaaatggtgaataaccccaaaattcacctggcacagtcacttcacaagttgtctaccgcctgtccaggaagggtaagtgtgttgtcaaagaactctgtgataaatggagactttaatgggagggcaaaaggatagtagtagttctggtgtctgttttcattggtgggcgtaataaaactaaatctcattgagttacagcaagcttattttctttaattaaaaacactgagccctttttttcttgtattatgtactacaaatatattttaagtgaatggatttaggagtgagaacaaaggaggaaaaatcccttcaatagaaatgtaataaggctgtatagttgcattttgtcagcactttataataagagtttatttcccagatcgaagtaatccatctattattaaaatgtggtagcatttttttatttttatttttatttatttatttttttagacagggtctcactcttatccaggctggaatgcagtagtacgattatggctcactgcagcctcaacctcccaggttcaagtgatcctactgcctgtcagccttccaagtagctaggacccactatgcccagctaattttttatttttttgtggagacagggtctccctat

SEQ ID NO: 101336 - DNA, 1068 bp, Homo sapiens
tgactggctgctcttcccagagctgtggcagctctcccgtagaagatggggtttgtattggcgcaccaagatctccaacagccagtgtgtgtttcccatctcttgtaggttccatcaatggtgagcaccagcctgaatgcagaagcgctccagtatctccaagggtaccttcaggcagccagtgtgacactgctttaaactgcatttttctaatgggctaaacccagatggtttcctaggaaatcacaggcttctgagcacagctgcattaaaacaaaggaagttctccttttgaacttgtcacgaattccatcttgtaaaggatattaaatgttgctttaacctgaaccttgagcaaattagttggtttgtgtgatcatacagttatgtgggtggcttctagtttgcaacttcaagggacaagtattaatagttcagtgtatggcgttggtttgtgttgagcgtttgcacggtttggataatcttaaattttgacggacactgtggagactttctgttactaaatccttttgttttgaagctgttgctatttgtatttctcttgtcctttatattttttgtctgtttatttacgcttttattggaaatgtgaataagtaaagaattacttgtgttacttgccaagcagtgcacatttcatagtttcaaatctgtaatcagcaataaaaatcctaaaatatgtacctaagaacatcttaagggcaggttttcagtgctctctcatgcttttataaaaatgaagaatttctttaaatttcttccttttcctttcctggactctgtaaaatcctaatttctaaatcatgtaaactcagattatttagtctttttttttatatgggggaaggggacattaatatagatttggggcttatttactagaattttctgtagcagttcctaggtggcagtgtgagttttgggtaggtggctcctctgggagaaatgctctgcctcgcttaatgggatggcggtcgagagtacttgagactgtggatgttttgatctctttcatctctgctgttccctggagagtggaggttactt

SEQ ID NO: 101337 - DNA, 1064 bp, Homo sapiens
cactctggaaaatcactctgcaggtttatatggactacatggagatcatatcctgtagtgtagtgaaagctaagtcctcaagagccatatgtatagatacacaatgttttttaataatctttaaaacagagatcaaagttcatttaagtcctgtttgcattaacaaaaataaaaatgaaataaaaatggaaccaaatgatcatctaaagtttaaaattcctaaattgtccaatttatacaactgtgggagacttattcaaggtttttgaaagtccaggactgtttcagctgaaccagagggcacacaatttgcatcactgaaactgtcctgggttagtcaatgaaataaaaatgtctaaccacatacacatggatatgatctttgtcggttagattattgataaagtcagtctcagacaagtttccaaactgtgctatttaactagatacaattgagaaattctcaaatgaaaattttatatagtgtcatatcaatcaaaagaaaataatgaaactaagaatacagatcactgttggaagagaaagcagtggtgatggtgtgggtactgcaggaggtggtggggccgtggcacactagaaaagttgggtcacgctgagtaggaagcatttgattttctctggtgcttttagctctggggccggtcaaaggcctctctctggcatggctgtccagggtttgtcccaatgtgtctgagtgagccagcttgagaaggggtcgtgccgtttcttctttcacacaggggaaaaaaaagaccaaacacggaggtgcccagggtgtggatctgctggtgtcccgggagaaccagctggctgggcagcccttcttccccacaggcagctgctattgcgtagggaccgccaggtcaccgagtggccatcacaacaaaccccagcacagtccagcccggccacagccgcctccttgtgtttctgttgtcttccctgctgctgcccacatcctttacccaccgtgtctctcggcccactggaggtatcagaaattccaaattttcaaagcagtttcagtattttcagtatatatg

SEQ ID NO: 101338 - DNA, 1071 bp, Homo sapiens
cacaagcaagatcaccagctcttttttccaactcagccccactgtggccatactaacacctgccctgtcagcccagaaccttccaggaacctaggtgtctgctcagaagcccaagactgggagaagccatatcctttcctaccagacagaaagtgtcagcacgatgagtctgttctttgaaatccaaatttacaaccactgctagtggttagaagcttttagggttggcttgcatgttgaaatcttactaccaaaggataaagatatttctcttaccacatatgcttacaatacttctatacctcctacccttccatcactgctccccagcccatccctggacagaacttgatttaagaaaaaagtacaaagttcaaagttcattttctgagagaagccaaaagatgactgtcctgaggcacagccatcacagctcaggccagacagttacctggaatccctggactctggaaagatagtccagttgctcagagggtctcgtgagaggtccatggggtacgtggcctgaagagatgttattctttaaaatggtctcggctgtgggcgaggtgcccccatacaacaactctcgggctatcatggcagttaccgtggccttggcaggattcggagctgccctggtaaaatctttggtgtgatgtccttgactaactcctacagcctgggcgacctcgggcaccatgggaagaattccagcaggcagctgctgatgacttagataaggcatcctgaactcatcctctttattacctgggagggacatacacggtaaacacgaatccacatccacagcctggaaaaacgcaatgacaccatcaaaccccacgctggccctccccttggcacgcatggcagcgcagggaatcagggaatgataaagacactttgcatgcgggacctcactggctgggctcctgctgttattcaggacccatgcaaatcccagaatcacgttcagaggaagacgatattaagatcacacttactagtcccattttcatccccagagccaggttcaaaaaaggttacttttcttccatcccctggttt

SEQ ID NO: 101339 - DNA, 1199 bp, Homo sapiens
acagcttttaatattcagtggccagacacggtggctcatgtctgtaatcccagcacttcaggaggccaaggtgggcggatcacctgaagtcaggagttcgagaatagcctggccaagatggtgaaaccccatctgtgctaaagatacaaaaaaaaaaaaaaaaaaattagccgggtgtggtggtgggtgcctgtaatcccacctacttgggaggctgaggcaggagaatcgcttgaacccaggaggcagacgttgcagtgatccaaggtcatgccattggactccagcctgggcgacacgagcaaaactccatctcaaaaaaaaaaaagttgagtgtaggtggaatatacctgataaacataaggaaatgcacaacagataaaatcttggatagtcctataccttgcctatttagcagtttcagccatgggttccttttcagatagttctaatctcagaagcaggactttataaattctttgacaaaataagcaataatgtgaagaaaaacagctctttttgttttgggggactttgctagataagctttgagcttatctagttcctcttattatcactacagcacagtataaaatccatgttatcagcacgcagaagtaagatccttgctcctctttaatctcatccctgattggacgactcttaagtgaaccttgttccaaagatggaatctctgcctttgttgaggagactttattagtttgcgccttgtatttttttgccaacagccgttgagtatgagatacatggcagttttgtaatgtgtttcatcgcatccttatttatttctttatttttaattatagagatagagagtctttgttgcccatgctggagttcagtggctgtttacaggcatgatcacagctcactgtagccttgaactattgggctcaactgatcctcaactgtcaccttgctgagtactggggcaatagtcgtgtactgccatgcgcatggctgcattctcttaaagtggtttcccgccgggcgtggtggctcacgccttaatcccagcactttgggagccgaggtgggtggatcatgaggtcaggagttcgagaccagcctgaccaacatggtgaaaccccgtatctactaaaaatacaaaaattagctgggtgtggtggcgcatgcctgcaatcccagctactcaggaggctgaggcaggagaatcg

SEQ ID NO: 101340 - DNA, 1039 bp, Homo sapiens
ctacttgggagactgaggcaggaaaattgcttgagcccaggaggcagaggttgcagtgagctaagtttgcaacactgcactccagcctgggcgacaaagctctgtctcggaaaaaaaaaaaaaaaattaaaaatttatcactgacttgaaatcctggcagtcagcctgctttagagaacattaaccaaaaatcccttggtccacaccctttctaaatttaggcattcattcagagtcttaaactctaagagccactcaggacacagttgggttgctctttctgggatgggggtagattctggagcagatactttactcctagctcattttttgaccttgagacctgtggttggtgttgtgaagtcgtacatacacaagtgacttttttgttttaaaaagtgctctcaagatagtttacaaaaagcaggaaaaggaggagtgagtgaataaatgaagagaggggaagagaggaggaaaaaagtgtttctattttagcagctgacggaaaaaaaacccaatgaaataaggtcatagctgacttctgaatggttctggacttgtttcttgacactggcgacttgtcttctaagaccattatgtagatcttcaatggaacgcctctgttattttgttctgattctgaaagtaaaaaggaacaactgcactcttggggaattttgttgaataaggtaatacttatgcctctgctatccagagtcacatttcgcttgagtttcttttgagttttgcagtcctttttgctctcagtaagagagaatgtgttaggactcctcaagtagcttaattgctctggtcattcatctctttcttgaggaccagctttaaaaatcattttgatacttaaaaaaaattaaagtaactgtttctttataatagaacttctaattagttggtttgctggtttctgcattggttggctatttcctgagagacctgtcatttctgttctttgttgccactggttatttttaagtactttgactcattaaaaacattttcagcttttaaaggatggcca

SEQ ID NO: 101341 - DNA, 1471 bp, Homo sapiens
cgcctcctccacggccactccgcctcttccctcccttcgtcccttcttcctctcccttttttccttcttccttcccctcctcgccgccaccgcccaggaccgccggccgggggacgagctcggagcagcagccaggtgaggcggccgggccgggccgggcctggtggggccctcgcgggcgccgccgcggtggggaggtgggcggcgggtggggcctaggcctcggcgggcccgcgcacccctccgccttctcccgggcctctctctagcccgcggggccttcccggaggaggcgggtcctcttgcgttccctcgcctcggggcgccctgaggcctggccccgggcgcccccatcccctccagccctcaccggtgccacaaacaggtgctgcggccgcctttcctcgtcccgcatggcgcgcgcggggatgccgaagttattcccggggctggggcgcaggcgggggggggggggggtccctgcttcaggtccccgagggctggagcctctcagtgtcgccggcccaggtctgtagcttagtggttaagagcacggcccaggtgtccaaaacgggtgccgaacccggctctgccccgttaggcaagacacttaaaaagtctttgtgtcttggttggaaaaggggctgctaataccgtccctgcctcttaaggttcagtgaaatggggcgtgtaaagcgcttatcagagtgccagacccacagcgtgtcccagtaaaccgtctgcataatttattagcgtgatatgaaggtataatttaatgggcagagtggatagaagttgacctacctatccgtttgggtttcttagaggctgcagtgttccgcgtgcccatgtccagagccagggcattgttttcagttgttaacatctgaaaggggcgtacgcttaattgggacactgtagttgacagtctgtaaacgatggatgctgtttctttccatctccgcttaggcaactgcaggatattcaccatctcccgcaggatgagcaacctgtccatttctccccgccccgccatcatccagcttcttcttgtcattccatttctgggaaagttgctggcagaagcttcccttgagttgagcaaacctatctagagcacttgctgtgtgttgggctctgaaggggggtgtacggagatggaaaaatttgtctgtcttgtcttgctctacacctcgataagttttttttcacggaagctttgcttatattcacccctccctgttggctgactttccttttaagcccttgccccgcctccgtgttgcagtattgcttgtgtggaagttttcttctgttccgcgaagatacgtgcttcagtctgttctgccactgttcttcggctgtgtggaagtttttaaggtcacacttctcttctgcttgtagctttcattgttaagagcgtggtggagttaaatcaggttcccggttgattttggcgtttcaggaa

SEQ ID NO: 101342 - DNA, 1016 bp, Homo sapiens
ctgtgctcagccttaccagcactgcattttcaagatcgtctggagaggattaaaaaaatttttttttttgagacggagttttgctcttgttgcccaggctggagtgcaatggcgtgatctcggctcactgccacctccgcctcccaggttcaagcaattctcttgcctcagcctcccgagtagctgggattacaggcatgcaccaccacacccggctaattttgtatttttttagtagagacagggtttctccatgttgaggctggtctcgaactcctgacctcaggtgatctacccacctcggcctcccaaagtgctgggattacaggcgtgagccaccgcgcccggcctaaaatttttatatatataatatgtatatgtattttcagagaaggccaaaattttttctttttcaagttaattatgaagagtttgttctcttattcgatgtttcaatgaaaatttctttttcacctctttatttttatctgcagagggcagccactacattagatgagaagattgagaaagttcgaaagaaaaggaaaacagaggtgagaagaaaagtggctatttttcgttgttagggcccactctttactctcaccacgaccccagcatctctctggaagcccttatagagcggggcatggctggggcaggcgcactcttctgtgtgtttgctgtgaatctgtactgagaatccccacagccgttcattcaggccggagagcttcctatcgctctacttaggttctggatttctagaagtttctcatcaccctcactttaatttttttcccaggataaagaagccaagtctgggaagttggaaaaggagaaagaagcaaaggaaggctctgaaccaaaggagcaggaagaccttcaagagaatgatgaggaaggctcagaagatgaagcctcggagactgactactcatcagctgatgagaacatcctcaccaaagcaggtagacgttacggcggaggtgtcagtaatggggacaggagatcag

SEQ ID NO: 101343 - DNA, 1042 bp, Homo sapiens
gtattttttctttttttttttgagacagagttttgctgttgtcacccaggctagagtgcagtggtgcgttctcagctcactgcaacctctgccttcaagtgaatctccttcctcagcctcctgagtagctgggattacaggtgcccaccaccaagcctggctaatttttatatatttagtagagacaggatttcaccatattggccaggctggtctcgaactcctgacctcaggtgattcgcctgccttggcctcacaaagtgctgggattacaggctcccgccaccatgcccagctaagttttttgtatttttagtagaattggggcttcactatgttggccaggctggtcttgaactcctgacctcaggtgatccgcctgcctcggcgtcccaaagtgctgggattacatatgtgagcctgaccatgtgatttgaaagcagaaaaaatattctatgaaaaataagttcctttattttccccaaccagacgtagtttttctgtgctctggtgaaaacctaaccctggagggagctaaacttcttctcattgcttccttgctgtccctccctccaggtaaaactgccgcctttgccctgcctgttttggagcgtctgatttataaaccccgccaggctccagtcacccgcgtgctggtgctagtgcccacccgagagctgggcatccaggtgcactctgtcaccagacagctggcccagttctgcaacatcaccacctgcctggctgtgggtgagtttctggccaagggctgccagcccctgagagactgtggtggggtggaggatggatgtgccccgccatctgttggtgttggtgacaggtgccaggagaggcctttgtgttgattgaatccacttaaaaactggaagacttttttttttttttttttttttgagacggaggagtctcgctctgtcgcccaggctggagtgcagtggcgcaatcttggctcactgcaagctccgcctcccgggttcacgccattctcctgcctcagcctccccagtagctgggactaccg

SEQ ID NO: 101344 - DNA, 1007 bp, Homo sapiens
gctgcttctcttagtccttgaatgtttcaggcattctcttttttttttttttttgagaggaagtctcactctgttgcccaggtgggaatgcaatggcatgatcttggctcactgcaacctccacctcctgggttcaagtgattctcccactgctttccaagtagctggaattataggtgtgcaccaccatgcacagctaatttatgtatttttaatagagatggggtttcgccatgttgggtaggctggtctcgaattcctgacctgaggtgatccacctgccttggcctcccaaagtgctgggattgattacaggcatgagccacctcgcccagcccatgcattctcttctgaagtgcttttgtgtcatcatcattgttgatttttgcacttagcacaattttaatgacatgatctgtctttcccagtgcgtttctgggaaacccatgtgcttgggcctttgtcagtcttactctctcagtggttttctctgcatctggcctgaggcctggtgagtggctggtgctcagtcaacacccatgagcagctgacctggccgcctggtggggctctcttctctttgcaggcggcttggatgtgaagtctcaggaagcagctcttcgggcagcgcctgacatcctcatcgccaccccaggccggctcatcgatcacctccacaactgcccttccttccacctgagcagcatcgaggtgctcatcctggacgaggctgacaggtgctcctcacagcctggggcccagggcactgtggggttccaaggcccagaacctggatgtggacctgccacactgcgttattctttgtggctctgggccatggctgttggtgtgcgataccagatcagccacttgtgctggggcctctgcccagccttagcccatgttttcctcttttttctctttctctattatggtggttaagtgataaggctggtcaaatgttggtcctgccacttcctaagggagatttggaaatatttagattc

SEQ ID NO: 101345 - DNA, 1161 bp, Homo sapiens
agtggcgcaatcttggcttactgcaagctccgcctcccaggttcacgccattctcctgcctcagcctcccaagtagctgggactacaggcgcccgccaccatgcctggctaattttttgtatttttagtagagacggggtttcaccgtgttagcgaggatggtctcgatctcctgacctcgtgatctgcccacctcggcctcccaaagtgctgggattacaggcgtgagccaccgtgcccagcctctatccccattttaatgccctgttctgtcctctgctggctcaggctcttgtggagcattattaggggagggtgtctggatgaacagctgtttgtgactgtttctaggcgttttaaggatgaacagattgacatcctcgtggccactgatgtggcagcccgtggacttgacattgagggggtcaaaacggtgagcagacactatcttccttggacttttggtggaagtctttttgcctcttcgcaccccccttcccttgccaggcctgacgttcatttttgaccttctaggtaatcaacttcacaatgcctaataccatcaaacattatgtccaccgggtggggcgaacagcacgtgctggcagggctgggcgctcagtctctctggtgggagaagatgagcggaagatgctgaaggagattgtaaaagctgccaaggcccctgtgaaggccaggatacttccccaaggtgagcaggcacccctgtggcagtgcagaatggctcggtgggcggggcaaggacagagtgtaatggctgagagcaggtactttgcagttcagagccagatttgaattccagccctgctgcttccttgccgagtgaccatgtgcaggtttcacctcacctctctgagcttgcctcctgtgtgtagaagggaattatgacagaattgtaaacacagtgccccatttaggtggaaattgagaagagaaggttgcttggggcaaaattctcactaaactcctctttcccttactgttggtggtggggaagagagagatcagtactcattctttttgggtcctttcattgattttgttcctctgatctgtgggggtcttataaagcacatcctctttaaagtctttttttgttttgttttgttcttgaattcctaggctcaagcaatccaccca

SEQ ID NO: 101346 - DNA, 1034 bp, Homo sapiens
ctctgcctcccgggttcaagcagttcttctgcctcaacctcctgagtagctgggactacaggcatgcaccactatgcctggctaatttttgtagttttaataaagacagggtttcaccatgttggccaggctggtctcaaactcgtgacctcaggtgatccgcctgcctcagcctcccaaagtgttgggattacaggcgcaagccaccacgcccagtcttttttttttctctctttttaaagacatagggtctcaccgtattgcccaggctggtcttgaatttctgggctcaggcagtcttcctgccttggccttccaaattgctgggattacaggcatgagctaccatgccccaatctgcttttgattctttgaggagacccagccttcacattggttgtcatagaatcctcacaaatgatcattcttctttccttaggatagtgaatggatttgcttccagcactggaagcattccatgatgctggagtggctaggtcttggtgtcggttctttcacgcaaagtgtttctccagcaggacctgagaatacaggtaagaagtgcatgtcttcctagaatcaaatcttaacgtagaatatagtaaataccagaacagtgagacttaaaaataattcccagaataaataaagagctatgagtcaatcagagaaagacaaatagcttaatataaggaaaagagataaaatactttttttttttttttttgagatggagtttcactcttgttgcccaggctggagtgcagtggtgtgatctcggctcactgcaacctccaccttccaggttcaagcgattctcctctcctgccttagcctcccaagtagctggcattacaggcaagtgccaccacgcgcagctaatgagataaaagacttttaacaggcacatcacaaaataggaaattgttcaatagatatatgaaaagtgctcattaaaaactagaggaattaaaaccacaatgagataactattacttacacaccagtttggcaacaattaaagtttgatataa

SEQ ID NO: 101347 - DNA, 1107 bp, Homo sapiens
ctcctgagtagctgggattacaggcgcccgccatcacacctggctaatttttgtatttttagtagagacaagatttcaccatgttggccaggctggtctcgatctcttgacctcatggtccacccgcctcggcctcccaaagtgctgggattacaggcgtgagccaccgcgcccggcccaacattatttcacattttggatttccagatttgcaatgctcaaccagtaagtataaacgcaaatattccaaaatctgaaacacttctagtcccaagcattttggataagggatattcaacctgccaccacgcctggctaatttttgcatttttagtagagacagtgttttgccatgttggccaggctggtcttgaactacagacctcaagtgatccacctgccttggcctcctaaaatgctggtattacaggcatgagccaccacactcaaccgatactagttctttggtttcaagaccacaataatgtgccttgggaaattggtttgttgaccagtctatttatttattctccctccttactgttcctgtcttagctttgctttccctcaaggtgaggactgagtttgggggatgatgatatttcctcatcatttctttccctctgttcttggaagatcatgacacagatgaaggagtcagagcaagagcttcatgaaggagccaagaccctggagtgcaccatgcgtggtgtcctacgggaacagtacctgcagaagtacatctcaccccagcactgggaaagtctcatgaatggaccagtgcaggtaggggtcatcctgggggacacaaatatgtctctggcctcagtactttgaggtagcctccaggagaagcatcagtccaaaactttacctgtttgataatctgatgctgccacaatgtgtaaagttcccttttgtgatgagaggcagctgaatatgctggtcaggaacaaaactcgaaccagcctgttgggttttagtctgagcttggctctggacaagttacttaattttctgtggctgtttccccttttataaaatggggataataataagcattaagttgaaccatatgaaattgccaacatctgtaatattgatttg

SEQ ID NO: 101348 - DNA, 1516 bp, Homo sapiens
ggcccagaggaggagaaggaggaggcgggggcccagggtggagagcacgagggcctggcccaggcacggccggcgcctccgccctcgaggagggcgtcacctcagctccccccggcggcggagccggcgggctcaggcgggcgcggctgaggggagcggaccgcggggggcgggagatgactgcgcccaaggcctttgcgggcctcagccggccccagaggaaggggaacccgtcgagcggtttggtgcgtgtgaagcgcgacatggcgaggaagcggacaagcccgggtggcccggcgtgtagagggaagggggcggggctagacgcggcctggacaactactagagcgcctcgggctgtgctgctcgagactacatttcccagagcgacgcgcgcggagcgggcgggaaagagagcgtttcgggtccagtgcgcaggtgcgaaagccatctttggttatataagggaggttcaggaagccattcgttctttcgcgtctgcggtgcccggagtgtggtacttctcctagttgcagtcaggcttcatacgctattgtcctgcccgtaagttcccgttttgtgtgtggtgagtggaaactccatgttcttcgttggagacctctggtcctcccttcccttctttgtgccgtcgtctctgcggccagccctaatctccttctcgtggcttctccgtctctgaccccaaataggccttaagggcgtgggagaaatgagtttctggagctggaaaagccactgccttctgcacgggcctgagaagcccttggctggtgtaaatgatgacttcacttttttccccatcagatcgacaatgctgacgtcttatattttgccagttagttctgatacatcggcctcaaaaggcccggccttgttcgtttctgaccgtgggaagatggcggttaacgccctttatttgttggttcacaggttagagcagccagcgggtacagaatggattttggaagagggagtcaccactggacctccaaggaagccacgtgcagacatctacaaccttcgatctcctgacgagtaagtctttgtctcctatgggtctactgtagaaaacacgtgctttgagaagctttagttttctaggaaaacgtgggatttaacaaagcactttctatcgagcatttattaggtatttaaaaaagtgttctgacggccgggcgctgtggctgacgcctgtaaccccagcacttggggaggccaaggcagatgggtcacctgaggtcaagatttggagaccagcctggccaacatggtgaaaccctgactctattaaaaatacagaaattagctgggcgtggtggtacgcgcctgtaatcccagcaactcacaaggctgaggcaggagaattgcccgaacccgggcggcggaggttgtagtgagttgagattgcgccactgccctacagtcggggcaacagagccagactccgtctcaaaaaaaaaaaaaaaagaaaaacatgttctgaatgttttattct

SEQ ID NO: 101349 - DNA, 1432 bp, Homo sapiens
ggatgatttattgacatattttggaaagccaaatgtgtttttctgttgaactagccactcaaaccagtgcccgactacataactaatatttttgctagagtccaggagtgaggcgtttacaaagtctgggcttcatgggaacacatgtgaagcttattgttccagattgttcttttgtcaggtaacttgtggtaacttgtgttaaaatgcaatctcttggtacttgttcacttcccaactcagtaaatgccaactacttcctcaactcttccagccacactggcttctatcatgggcctgtactcagagtgtaagcactgaagacaggggtgtttggtttggctaccaagttattgccagctacaggatacaacacagaagtgctcaaacaccgaatgcaaatttgcaaatatgaagcataccaaccaaatcttactcctcatggctttcaaatcttactcctcactcaagaacttcctgctggcatatatgatgacttagcttttttccccgacagatcgactatgttgatctaacttttctaagccagtttctgtctgatatgccagcttgagcagctcctttgtcccagctcccctgggcatctagctgatgggagctcatttttctgttttttcatttcaggtttattgttggccaaaaccaggctttgattgaaccaggatgaatgcgggtgttggaagtagaatatatatatacatataaaattggtaagtggtgccaacacgtcttccctggctgagtagacacaggctctggagggggtagtagctgcttttcagtgtgggtttgtcaccctacttcttgtacgactcaaatgtggcctttgcagctgatgatacagcttctttccccatcagatcgaccctgttgatctctacactattggccagttttgtctgatgcattggccccagtaataactcctatctttgttttctgcttatctttatcagagactattgcttgttcatgggaactgggctttctctattttttccagcattcagatggcttcttttgacctgttaactttctataggttgggagccacgtgtaccagtgtgtgttgatcttggcttgattcagtctgccttgtaacaggtgaggtttctgctttctatctgccaaaccccaccgcaaaatttgtccaactgggcctaacctcaggacccatttccaagttgggtataaaactgggagaataagtcattaggactgacattggcctgttggtattactaggtctttgttggaaataagagcttggagttccaaagaaaacgagcacttgaacaaaagatttctcagcaaggcaaatttacttctgccgtagggtgctgctgctggcattcctggcaagagcacacctaacaaaagagagaaagggtttttattcctaacaagtagt

SEQ ID NO: 101350 - DNA, 1068 bp, Homo sapiens
gctttcatgtcactcagcccaggcaacccaaaccagtcctggctacacccagaaataagagttacctctgcattttctgttgccatttttctggctctagaagtatctgatgcgcgactatgtcatagaatgtccacgcatctcagagtagtctatttttctgttcagataaaatatatatatatatgtatttttagcaaatttataatagggcaattgagtctaatttcttcttttgtaatacagaacaatatcttaggagtttcattgttggtcattatcgtagctgatgttttctggtcttttgcagttcctaccattgtcccttgggctgtttgggttttcttccttttgattctgatttcttgagggtggggaaagactttggggtttgacttccttgtgtaggcatttcttgacactaggcctggactctgtcaatgctgtgactttcctcattcatttctgtgtgtttctcccattcgttgttcttaagaatccagggcatgaatgcaggaatgagacccagggaagcagagctacagatggccctcaaaatcaggatgggatgtgggctggtttcacttatatcccacacccctttagggatctgaagggactgagttttctcatccccagagatcttggaaccaaaaatctcatgcaagcaaactcatcactggcatttctgagatccagaacacatgtgagtccctcctggctgggctgctcccacatgtccagcaccctgtcggcctgtaacatcaatcagagctgaaggtcagaggtttttcaggttctcgtgaacctcacaagaacatgctgggcctccgatctcaccaacttgtttatcagttccttgtttcgatctgtttatttatttatttttttgttattattattttgagacaaagtcttgctctgttgcccaggctgcagtgcaatggcgcaatctcggctcactgcaacctcctccacccaggttcaagtgattctcatgtctcagcctcctgagtaactgggattacaagagcgcaccatcacgcccagctaatttttgtattttta

SEQ ID NO: 101351 - DNA, 1050 bp, Homo sapiens
acccacctcccctaagttcttaaggcagaactgtatttactccacagaagcattgactggaaaaggccccagtggtcaggaaaagtgcaaacttgagaaccacatctcccctgacgtccgtgtgttgccagggggaggagcccatggaagcacacgagatcagagcatctgaactgccctgccttggaggagagacttttgggtgaggtccaaagaggagagctgttcagcttacctgccacagagcttttctgcatgaactctggaacagaaaggccctgtaaagccctcagagagaagagagactccagagaaggctccctaagaccttgagagccatgacaggtccatcagcatgaagttggccaagccatagggcacagcacctccttgtaacaactctatagccctctttgggagatgacatgagtggaactcacagccaccactaccaccactttagacaggaccgaggccacatactccccattctctcgtggctttccatctcagcctcggagggcaacattgacagtcctcctggcttcagctagagaaggatgctggaacaagcggctggtgttgaaagagtgggttgaccaatttggtattgaatgttgcccagccacccctaggaacacctgtccatcacctcctggatggattccactgttagacagctacagggaatgattggtcatggggaagtctctgcgccataagccacgatcccagcgcaaaacccttactcaaatgtcttcattgacttcggtatttcatagtacctgagattttattttgagataccatcagggtgagttgcaccacttgtactcaattctaattgccccctggcaatctgggaagggttcagaaggtgggcacccagccaacagcatgaactcagagcattgttttagggttggaggaggaacacgctttctttacatcactagtgtagactcaaaagatatgcaagtgtcaaatatgcaaaagaaatagtttattcaaagagactgtgtgttactgaagaacagcataaaaatatga

SEQ ID NO: 101352 - DNA, 1039 bp, Homo sapiens
gaatgagacaattaccaagtcaagaaggaaatgatgagtgcttccaaaaccctgaaagagggtcatgagataatagatgaggataaagtggctagggtggccagggaggtccctctggggataacggatgagctgaacgctgaaagataagaaagacctgcagagatctaggagaggagcattcctggcaggaactgtaagtgcaaaggccctgaggctggacccagtctgggatattggaggagcagcagggccagtggctgcagcaggtttagctcagctggtggatgtgagtggagagaggtagccggggccagatcagacagggtcttgaaggctgtgtgaggcgctggctttcattccaggtgcactgggactccactgggggcttttgaggagggcagtggcaggatcaatgcatgctttaaaaagagtgttctgattggaaaacagactgcgggggtgagggaggacatagggacagcacagggacagcagtgaggaggccactgtaacagtcctggtaggatacatcaggggcctggcccagggtgatgatcggggaggcaggagaagtgctcagactactttgaaggtggaacccatgggatttgccgatgaacagaaaggagtcgaggagggctcttgggtcacagcctgaagatctgggaggatggaggcaccatttgccaaaaaaggcaaaacatagtacagagcaggtagtgggggatcaagagctctttggccttgttaagtttgagaagcccaagcgacatccaagtgtcaaaacaatcttcctcccacccagcaaggcccgagagcccagatagagggtggaggggagcctgcccggggtggagattaatgcacataacccagttctctctgcccgtggctatttgggtcacttggactgcaggtcctcacccctctgagcctgtcaatcacccccaccccaccctgtccctgtccttttcagtctctggaacctgctgccaggagaatgctcagggagggaaatgctcagggaggcacacct

SEQ ID NO: 101353 - DNA, 1092 bp, Homo sapiens
gaatgaagaggtccacatagggcctttggcactggaatgctcatgcctcagccagttgcttttacagatgcagaatgcacagcttaatatttttctttgttttcttttcttttcttttttttttttttttttttttgagacagggtctcactctgtctcccaggatggagtgcagtagcatgatcatggctcactgcagcttcaacctcccagcctcaagtgatcctcccacctcagccttccaagtagctgggactacaggtacatgcccccacacacagctaatttttgtattttttgtagagacgaggttttgtcctgttggccaggctggtctcaaactccttgggctcaagtgatccaccctcctcagcctctcagagtgctaggattacaggcatgagccaccacacccaaccttagtttttcgagataaattgaaaatttgcattctaaaacaaaatctctcaactttataactgttagcaacttgctcagttcttgaaacactatgtaaaccaaacaaaacaggtctgtgagttagattcaacttacaggccaccaattttcagcttgtctctctttgcttcgtacggatgggggaaactaagtcacagatatatgtcatattatacataatatatatatatatatatatttggccttatcactgaggctgaattaggtgctttctcctagggtggtcttggtagtgtgtctctgagaaggtgacatatgagcagaaacctaaagggagagcttcccttctgggggaagagctttccaggcagatggaggagcaagtgcaaaggctctgaggcagaaaagcaactgtatgtttgaggaacagcagtaagactagtgagctagagtagaataagagagggggagtgaaaggggatgaggacgggataaccaaatccacttctacatagggcctgtaggacccaggttctaattaaaatgaacaactgagaggacaaggtgatgaatggatttatgaatgaatgaatggattccaagctgctttcatgggatattcgtatttggtgttagtgtgtgggtgtggctgattcgccctaggttctgaag

SEQ ID NO: 101354 - DNA, 1041 bp, Homo sapiens
aaattttatttaatttagaaaatgaaaatgaagaaagaaaagaaaaccaagttcatccacttaccaggaacttgggccaggaaacccagggcttaataaagacaatcaggctaggggaaaatagaacaggcactagaatcagacatctgttcactcaagtatcatctaacatttaataggtcttgtttatatcagaatattcagcctgagagtgaaagagctggaaagaatcttaaatgagatcagacgcatgcaaagcatttagaacagggcctggtatacaggaagtgctcaatcaatgttagctgatattgtcattgttagcattgctactactcttcccttaatgagtacttactacttttaggcaaggtgtgaaacactttatttgcattatctttttacttctttcagcaaccctgagaggaagattccaccattatcctgtttttaattatgattatgattattattttggggtgtgacaaaagagagatgggtgagaagactggagtccaagctgatggaaaaatccctcaggctgctggtgctttgtctgggcagggccacagcaaagacccgttgtcctgagcgacatccactcagagatgtaatgattttccttgaggcttcgggtacccctataaccaccctcataaagcaattattcttacccaggaattcatgggggaagggggattaattagccttgctcagtgcccagatgtgccaaaaaacctaagtaggatactcagtgggattataaataaatgatgacaggtattatggagtccaagagaaagaaaaaagcttgacttcaagtgaacacgtctcttgccagcaccttttaaagggtatatcacttgtatttacatggacgaattgggttgacttgacctcactcagcctctgagaaaaatctgaacacttctcagcagaagatgtctgcagagaggattgagcagaaaacattttcagagggccttggcctagaagttgggtgctcgggtgttggtacttgcctccccactcactggctga

SEQ ID NO: 101355 - DNA, 1551 bp, Homo sapiens
agagagtgcttgttcttgcaaagttggtctatttaggacaattttctcagagatggcagtaaaatgtcttgagagcgatgcctgtttctaatctcacaaagacacctaagggttagcagcagtcctggccaagatagacagtgagggttccaggagtgtggggaaaggcggcaaagtgtgtgggctggaggatccagaggagtcgccgtattaatcagcacaggctcagctctgcacctgccgagtctcagtggcttttaccaacagaggtgtagttccactcacacggtatcagctgtgggattggagggcttccccactctgtgcacagactcgggccaggctctttccctctttcggctccaccgtctcaatgtgaagcctgcatggctgccaggcaggagggacagctggagagccacacactggctcgcgaatgctttgacacaggagtgacacaggccacttctgcacacagcccattcaccagaactcatccacgggcctgcctaaccttacagggggctggcaaatgtggtgagcagcaaatgcgtttcttctacttcctcactcctctcctcactttactcaaagttggagtcagacttaggaggcagccatggctcccctgccttgttcccgataaccccctgccctactcctctccttcacaccttccatgccatctctctgcagatttgtgttccttgtgctggtgcacttggacttggagctgatcaacgcagatgtggagatccctgagtttgacctcagcaggtacggcttcggtctgatgcagccggaacacgacgtgcccgtccgctaccgcatccgcccatgacacagggagcagatggatccacgtgctcgcctctgcccagcctgccccagcctgccccagcctcccagctttctgtgtgcacagttggcccgggtgcaggtgctagcattaccacttccctgcttttctcccagaaggctgggtccaggggagggaaaagctaagagggtgaacaaagaaaagacattgaaagctctatggattatccactgcaaagttttctttccaaaatcaggctttgtctgctcccaattcacctcgttactctcacctcgtgatatccacaaatgctattcagataaggcagaactaggagtcttcactgctctgcccccaactcccggaggtgtcaccttcctagttcttatgagctagcatggcccgggccttatccagtcaaagcggatgctggccacagaaaggccactcaggatgtcctttgtgtccattgatgtcattcagcagtcagtcccccaataatccttaaactagctaaaaccaaaggagtcccttagaagatctgcttccctggggccccatttgccagattgccccattgctcacactacttgagaaaatgcaggagagcttcccccaaggctgatgcattcccggtgcagaacaggggcaccctccaaacactgggctctgaggagtggagttctctgttctagagtgacaggcaccagatgggatgggctttctcagtg

SEQ ID NO: 101356 - DNA, 1015 bp, Homo sapiens
acctggcctgtctttcgctttagagggatcattctggctgcagcgctgacaagagactgtagggggtggggaagcagaggcagggagagcagagaggagcagcaggatccagacaagagagggtgctgctgggccagggtcaggggtggttagattctgaacatatatcaaagtaaagccaacaggatccgctgttggatgggaccttgggggaggccatcaaggatgaatccaggtttgggcctgagtgacaggagggatggcagagccatgggcagaagagggagatggcgggaggaggaagtttcagggagaagatcgggggttgggctttgggtatgttgaatttgagatggagatgggggagtggacacctggagaagagagtctggagttcaagtttgaggtccaggcttgggagttgtcagcatagaggagtttaaatcctcaggactggaggagatactgcaggcgagggtgggtgaagaagggggcatccctggggctctccagtggtgggaagggtgaggaggaggggccaggaaggtgggaggagagccgggagtgggaagctgggtcagatgctgcagagaggctgaaaaatggtagctgtgattgctgctgtcaggtcggagatgatgagtcaggaataataatctcaaaagatactgagcacttaccctgggccaagcatcctgttgagcactttgcaaccaccatctcataggatcctcacaacagcttcctgaatccagaacccctgaacctggaatcgagagtgatggaaggagcagtgggagtctcaggcatccagggaggactctgtgggccgagacctaaggtccaggcaaggggaagaggaggctgtaagggaaggtggggtggggtggtggggggcagacggaggagagtttccaaacacaggtcaggcttccctgccagctctgagcccactgatgctggtaatgccaggactgaaaccattgattgacatgatgtccctcagccccatcca

SEQ ID NO: 101357 - DNA, 1056 bp, Homo sapiens
attaggaaacatttcaactatacagaaaaagaaaaagaatacggtaagaagccccatgtacctataccttgatttgacagtcattaacattatttaaaaaatattagacataggctgggcacggtggctcacacctataattccagcactttgggaggctgaggcgggccgatcaagaggtcaggagatcgagaccatcctggctaacacgatgaaaccccgtctctactaaaaatacagaaaattagccaggcgtggtggcaggcacctgtagtcccagctactcaggaggctgaggcaggagaatggcgtgaacccaggaggcggagcttgcagtgagcggagcttgcgccattgcactccagcctgggcaacagagcgagactccatctcaaaaaaaaaaaattagatgtcatgatattccacccttgaatatttcagaatgcatataaaactgacaactacaattctattttcttgcctgagaatataaaaagataattcttaatgtcatgtagttcccagttcaaattcaaatttctgcaattacagcaagaattttcgagccccattcggtgaacatgagggtggtgagctgagagttaggagtatggcttgtgggccccttgaaactaattgatttgccttgtgagtatcagaagcattcttcctgcttcccaggcctcagtttatctgtacttcgaggtggctcatggaggtggtctctcaagccccagccatatcaccaggctactgcatctcttcctttgggcttgtgtgaccaccacagggagcactgagagagatctcttggttgggaggctccttttctgggggtccggaaggcatagtggcatcaagcgagggtcactgtggcccagtggctggtctgggcccttgcaggatgcagaatttgtaggcacaaataaatctgtctcattctaacatgcactgaccagaggtcacccaacagtggtccgtgactggattcagccctggatgggctgggtttgtgctgtgtgggacatggggagaaaattgggggattccatacac

SEQ ID NO: 101358 - DNA, 1485 bp, Homo sapiens
tggcttctgccctgtcttagctgcttcacacgtactctgaagccgatgaattatatgtctctcctggctttgctaaaaatggagtttgtggtttggttttgtatatttgtttttccattattcttgatgctctggtataatttctagaaggagagggtaaatgtggccttaggcagccatttttctacccccactatctaactggatcctctttagtaactccttgacataataagcaaagcagctatgactgctgtcccattttcaagatgagaagccagaagttctgaggttcttggggtgcttcagggtggcaggagcatcatcactcagggtctgtctgggtgacagatcaacatgggtctcttttctccttgccttccatgctaggctggctctcaggcaggacagcagggagttgaggagactgaggtctgacttcatcattttttccactacaaagtgccaaggcagctggttgggagccgtgaggccacctgtcccccgtcctgggaaaaccaaaggatgagaagcttgctggagtccctctcctgtagcacccaccacctctggcagatagcctgggaagaggggcaagaccactccagaacatcctctcacaggctaagacaaggtctaggtggaattagcctgggaacgctgaacgaaaggccgcctggcccagccatgtttgcatctgggtagctgccccacctctgggctcttagccaagcacattccctacataatcctggctctcctggggaaggatgctggaggatggctcccctgcagctgacatccttgcactttagagaccttcaaatctccaaaggcccaggcctgtgcaaattcttagagacagtcagcagcaaggcccagatggcagaaaacaggtcatttcttccaaccctctgcctctgattcagacctgctttctcttcatgtataaaaaagaccaagtgaagaggttttctgtctttcatttcttcagtaaaattcttgataaagaggcctgcacagtgttggcaaataaatacttggtaatatgtgctgaaagaattatgcttcatctcttttgttgttgttgctgttgctgctgctgctgtgttgttgttgttgctaagacagggtctcactccgtcgcccaggctggagtgcagtggcacaatctcggctcactgcaacctctacctcccgggttcaagcaatcctcccacctcagcctcctgagtagctggaattacaggcgcacgccagcattcctggctaatttttgtatttttagtagagacggggtttcaccacgttggccaggctggtcttgaactcctgacctcaagtgatccacccatctcagcctcccaaagtgctgggattacaggcgtgagccactgagcccagccttgcttcatctctctttcttttcttttttttttttttttgagacagagtttcactcttttgcccaggctgaagtgcagt

SEQ ID NO: 101359 - DNA, 1917 bp, Homo sapiens
agcctcccgagtagctgggactacaggtgcacaccaccacacctggctaattttttgtatttttagtagagacaggggtttcttccatgttgcccaggctggtctcgaactcctggactcaagcaatccgcccaccttgacttcccaaagtgctgggattatgggcgggtgtgagccattgcgcccagccttgaagtcatgttctaaattgtatttgaatttgtgcctctttgtttttccccaaaccaaagccctcaaattgtagtctctgtcggcttctgcagaattctggaaaatgccagttttcctcccccgcccttgttttccataaaacatatttatatattgtgatgaggagtactttctgaagagtacttcgtatttttttttaattgccttgtttgccttcaacttccttgattttcatagtttacatgggtgtgtgtaggggtgtgtgtgtgtatgtgtgtgggttagggcttttttcgttgcatgtgatggttctgtggacatatgatccccacaaactgtgggagtgattggccaggccttgttttgtttgtttgtttgtttgtgtttttgttcttttgaagaatagagtggtatttagaaaataaattgcattgcaaagctcttatcggctcatatgagagagcaggttcctgcccttgaaaatgccggtaagctatagcatatgttttttaagacttaagcatttcatgctttaaaataccttcacaagtgaacattacacacagaagttcatttggttttcctttgttttatggtgcatatagcaataaagacccccctccaccctgcaacccccatcccccaccgggcctttgtccctgccttggcttttctccccttctcattctcctctcccctttcctcactgaaggctgtgagttgctttcaatgtgacaacactatgatgtcatttggaaggatttgccaggacagactgattctgagtcctgggtgccgtatgtgtatgcggcagtgttgtcaggcgatcttgtttgaagctctatgttgccataattaccatcaagtacacactgttggcaaaaggctaacacctgactttagaaaatgctgatttgagaacaaaaggaaaggtcttttttcactgcttaaagtggggtcactttgatacctttgcggtcatgtctgtgtctgatgagtgtagaatctctggatgtgcactgtcagtcatgtgtccaccaggcctcgaatatcatatgggaaatgtcatagttaaaaacgtacagccaggcccgtgtgctgttaatagtgtgaaattgtcatgttaaaaaaaaaaacaggaaccaaatgtgaccttgtgcatatattggtagctgaaaatcttcaaggctactgatgggtggccccttaatcttgtctttgattgctgtgtgcagggaaaggtgtccccgtttgttcatgctgttttggggggtgggggggtatttgcaagaatactcattttgacataataggtcctcttgtcagagatcctctaccacagacattaatagctgagcaggagccacatggattgattgtatccactcaccattgacgatggcattgagcgtagctagcttatttccatcactacgtgtttttgagcttgctcttacgttttaagaggtgccaggggtacatttttgcactgaaatctaaagatgttttaaaaaacacttttcacaaaaatagtcctttgtcattacattatttactcatgtgtttgtacatttttgtatgttaatttatgaatgattttttcagtaaaaaatacatattcaagaaccaaaccttggtggtcatttctctttgtgtaggacagtttgggtccttgggggtctttcctttttcctttcctttcctacaggagttcaacttaaggca

SEQ ID NO: 101360 - DNA, 2748 bp, Homo sapiens
tttcttttcttttttgagacagattttctttctgttacccaagctggtgcaattttgctcactgcaacctttgcctcccgggttcaagtgattctcctgtctcagcctcctgagtagctgggattacagacctgcaccaccacgcctggctaatttttttttttttttttaagtagagatggggtttcaccattttggccaggctggtctcgaactcctgacctcaaatgatctgcccacctcggcctcccaaagtgctgggattacaggcacgagccacctagcccagcctattttttccgttcacataaaaactttaattcagttaaaattgagttttaactcagtttttaagaaatgacacaatgagtcagttaagcgggtgagagcttttgctgtgtgtgatttccagggtaagcttgtaacatgtcttgtaggctttggtcactcctgggctattaccgttgtatctaaaagcctgttctcttggtcttggacagagtacagaatgcaggctattctgtgagccggccagagggtgacacaggaaagtacaagtccattcctcatcaccatcgaggagaagtccagtttcttggaaggttggtggaatttatctctgtctcttagaagtatcccctatactttcatgtccggatatcttagagcatattacagccccttctcctactccccaccccgaggccctgttctgacagctgtttgacagctgttgcatgtattctaactctgaggcagaacagtgtggggatcagaccgttggtgaacattttcaatagtaagattcttcgaaggaaatcacttgtcctatgtcttcagccttgtggtctccacagtagcctttggggaatttgggaagaaacagcttggatgaaggtccctgaggtgacagagcagtggcgccctttccgcaggctcccgttccgaatggtgtcctgagcttctgtctgggtggctgcagttgctgtgttaccttttctttctttgtgtgtgtgtgtgtgtgtgtgtgtgtgtcttttctaaattgtggggaagactgtgctctagacaaccaattctaattgctgaaattctgttttcatgggagtaaaatggcactgaatacagagtatgaactttctcatctgttgtatttttaatgctttacctcccacttccccactctctgaccttgggcaagttacctcacattattaagccttggcttcctcatttgctagcaggggctggcgtgagcattaaatgaaataattaagtgaagcacctggcatgaaacacaggaggtgtttctgaccacagcactcagcctggcatagcagaattggccgtgcgcccaccttgtgctgcagaagtgctgccatgggttgcgtcctctgctgtgggacgccctgctccatcctctggctgcagaggcatggatcctcactcagagccacctcttctctgttccctccctaaacaggtatgctctgctgaggaagtcaaaagaacggcaagggctggatggcctcaacaacctgaactactttgcaaacatcacatacgacgccttgtataaaaacataactgtcaacctgacacccgagctggctcaggtgaacgagtactgagaggagagaatgtacgtttgctttacccaccgccaccaagaaagcagtccgatgagatttttttttggaggggggagggtctacacagcaagagaacagaaatactgtgtctcatgaaggatcacagagttcagggggaaaatgtgacagcacacgcacaaacgccttcactggatcagccgctggaactgagggagtgagcttggggacttccttcgtcagcactggctttctgttttcacaagacagacgtctgtcccgctgctctctccccatctcctaccccacatcctgtcttagccgcagtctccagaacccatgatgaactgtgatctgccgtggtcctgccgtggtcctgccgtggagcctgtccctacacatgaccttggagcctcttggccttcagagcagaggcaaacccaccacagggcagctgcgttttaggaagagcaaatgaaactccacaccattcttctagatctctggtgttctctttggtttcatttttttaaaaaattaccttctttgggtggggattgagggtggaggggagggtgtttgggaaagataaatagacataaatatataacaatcacttcttgaagaagtataattgtaaataagccatgtaaaatgcctttttaaaatttaattttctagctggctccaattcaaattgaggatttatgtattaggccacttacttggttggcaagtgcaggaactcagttaaaatgcagttgaagaatgtcatctcccgaattgctgtcactttggcgagggagtggatatagggcatgtcacaaaagaacaaaataacccgacctttattgctgggagctggcttctgtccctttcttcccccccccacgagtcttgcccttgacttctgctctggattcactcttccctgtcggccgcgcatgtgctcatcccactctccgctaagcgggaggctgctgttagagcaggctgcttcctgcctaaagcaggcccttcggggctcgctgcacacacatctctggctctccaggcttcgtgttctgtcttttcatcagcatggcggggcggggggcggggggcgggggtgtgtatgggaatccctccccctcttact

SEQ ID NO: 101361 - DNA, 1933 bp, Homo sapiens
ggagtcttgctctgtcgcccaaactggagtacaatggtgcgatcttggctcactgcagcctccgcctcccgggttcaagctattctcctacctcagcctcccaagtagctgggattacaggcatgcgccactacgcctagctaatgtttttgtattttcagtagggatggggtttcaccatgttggccaggctggtctcgaactcctgatccgcccaccttggttttccaaagtgctgggattacaggcgtgagccactgtgcccatgccagaggtccagtgacttctgagccacactgtgagttgatttgtggtgttggacctggttacactagcccagtgatcttttccagttggttctaataaactcgtctttaggcacaggaaagacagcaaagattttccttcaagattcttttaaagataaagttctgtttcttttaggttggtacccaaccctttaatcgagccatgcttttcaacgttggctttcaagaggcaatgaaagacttggattgggactgtttgatttttcatgatgtagatcacataccggaaagtgatcgcaactattatggatgtggacagatgccgaggcattttgcaaccaaattggataagtatatgtatctgtgagtatcatttcttcttaattaaagaggttaaatctgaaaggatggtgagcgatgtgaaaaggaaatctaattagctgcaacctagatgcccatcaactgatggatggataaacaaaatgtgtgtatccatacaattggagcactgtttggcaggagaaagcaatgaaatactgatacgtgccaaaacacggatgaacttcgaaaacattacgttaaagaagccagacacaaaggttgtgtatcatatgattccaggtgtctgaaatgtccagaataagcaaatctatagtgacagaaagtagataaatggttataaggggctaaggaggataggaggagcagggggtgattgctaatgggtgcaaggctttgcgggggacagtgatgaaacatgttaatatagattgtggtcatggttgcacaattcagtgaataaactaaaaccattgaatgatatactctaaatgggccaattgtgtatgggtatgtcaattatatctcactaaagctattaaaaatcagtttgcaaaaattaattttgctaatttgatacattcatatggttcaggtcaggagcacagagagcactgtttttagtcctcaaatgagaaccttctagggaaaacagttaccctgtaacacacagatgattgatgtcccacatctcctcctaggcttccttataccgagttctttggcggagtgagtggcttaacagtggaacaatttcggaaaatcaatggctttcctaatgctttctggggttggggtggagaagatgacgacctctggaacaggtacctctgccgttctttcggtgtcttctagaaatgctaccttagactgcagaccaatactatccgataggaatataatgcaagccatgtgtgtaatttaacatgttctagtagctacagtttaaaaggttaaggaaaaaaatgaaattgaccagctgtgatggctcacacctgtaatcccagcactttggaaggccgaggtgggaggatcacttgagcccgggagttcgaggccacagagagctgtgccactgcactctagcttgggtgacagagtgagacctgtcttaaaaaatacacacacacacacacacacaccacacacatccaagtttttagaaaatatctttaatcttaatttaaaaatatcttaatatcttaaaaaacaaactgtatatcccaacaaagcagctattttcatttttctcctttgacatgcgaaaatcaacaaattataatttagcaattttttcttctaataaataatacgttcattataaa

SEQ ID NO: 101362 - DNA, 1030 bp, Homo sapiens
cagaggcagaggttgcagtgagctgagatcacaccactgcactccagcccgggcaacagagcgagactgtctcaaaaaaaaaaaaaaaaaaaaaaaaaagctcagctactgttttacttaaagttttcatttctacctggcccctgacagaagcagaactctaaagtcttaattccttgatttgcctcttcaccttgaaaatagtgaggaactgaaatacggtgagatggaaagcagaggaagggacttccatccttgctaaaaacaaattcagctgaaaaagcattgcgctctccagagactaaaaccccaggcatagggaaacctatcattttctgacctcttaatcccttttccccgtctctgttcagagggcccaatagacataaacatgagtgaaattggaatggattacattcatgaactcttctccaaagacccaaccatcaagctcggaggtcactggaagccttctgattgcatgcctcggtggaaggtagggtgtgaagtcacagccaaaatgctgagaagcccacctggggtttgcctttggtccgaatcaccatgggattagctaaccatgacattttgtcattttcatcctaccattccatgcaaatgtagaaacattttagaggaatgggtttccacaaggactctttttgtagatacagaaatttgcattattctgatgaccgagcaagaccctttggtcttcccaccaggaatattaacaaagcaaggggatgagggcgttggtggtctctaatgacccatttgcagaagtcatctacagagtcagtgcttcattcctgttctccattggttactacaagattagtggattaaaaagcaaagttacctggcttgacattgagatttagtttttttctgcctgaccatagtcagaagacatcagtagttttcgttaagctgtgaccccagctgaagtccattctttcaacaagtatctattaaaatgcgtattctgtgccagcctcgttaagtgctgctgatgcagcagatctgg

SEQ ID NO: 101363 - DNA, 1035 bp, Homo sapiens
cagtggagtttgcaagtagaatatagggattacattttgacgtgtttgtgagcttctagttttgtatcatagagagacttcaggaaaatgcaagtggagatcactttccaaagaagacaagattggcaggttaatctgaacactcatttgttaagagcatgttttaattgaccttggactgtgctctttccctattgctttggacttttgggctgggatgggtggatagtgaggactgcaaatagtctttcgttactcctttttctttccaaatctcccaagggtaagtgattggagcctcagtctaccactttgaaaaggttgccaagaccagaccgtggcttcagaccatggcttcagtgcttctagcagtcagagagtcagtggtttcttttctctatgaagaaccatgaactaattctgagaaggtgaacttaaagagagcagaaacctttaaaaaaaaaaagttttaactaattcataaaggtctttcttctgatgatcagagtgctagaatacagattgggtatttggagaagagatggaatatatttttttttaagttgatgctttttctagaactgttggatattgacagaaattcctctaagctctactagctacccaaaagatgttggtgtcctgaaaggtatggaaaatagagttatggtcatgtagggttttaaaagaactaaaagaggctttaaaagtccaaaaagaaaaaaaaatccatagctatgtggtatgtttttttaaatgattgcttctgaatccacctctttttcccctttttgctttctgcagtgaacacctacctcttcatgatgcaagcccaaggcattctgatccgggacaacgtgagaacaatcggtgctcaggtttatgagcaggtgcttcggagtgcttatgccaagaggaacagcagtgtaaatgactcaggtatatttttagtaaagaggtggtctgattagaatgtctcctcccaagagaggtaaattcggttgcaataattattttcaatgggaaaagcgcatt

SEQ ID NO: 101364 - DNA, 1376 bp, Homo sapiens
tgcagaaataccccctagaacaaagaagtcagcaaaaacaaaacaaaacaaaaaacaccacttaagggtaagcacacaaacacatacaaatataaggacatacatcataggtattgtaatgttccaatcccataattttggaatgattacataggtggaatacagaagtatccctgcttttcagcatgactgcccttgatgactcatcaaaaaacagcagtgctagtcatcttagacacagaggatgtgtgccatttagacttgttcttttaaatagtgaaaattattgctttatggttttattctgtgccccccgccctcatgcccctatgggccagagaggcagttcaccaacttctctccagttgtgcctccccttccttcctgtgactttagggagtttgtacgcatctgctctagtcctagaaccatggggccttcatagcccctgcgcagtagccaagagcaatgggccttcttacggaaggaagagctcagttggcaagtatatcctgagctgagttgtgaaggcacacattcatacctctctttatttttaatggggttagcacagtcttcaatcaatagcttaacttcatctctgcttttatttctgctcctagcataaattatttagcacaaatgcagacataatctcagaaattacttagtattagtgtcctgctgtgagcatcattttcttgagtgtgttgtgttctaaccgcaaattagcaaaagacccttcaagaaagtctttctgtggattcatttagggggaatttagaaggttgtagtcagtgctacctgatcacttttattttcagtgaaattttgttttattcatagtatagttaatagctttcctgtaacacacacacacacactctctctctctacatatatatgtattatgtacatttttaaaagtcactttttacctggtaatatcttaatcccttaaggatttgtcagttggcccatcggtggactgagtcactttatgagtagggattccgaaaatgccaagctttgtctgggggggttgggttgggggaggatgcaataataaaaactctaaccttgaagatgcggggagggcctacagacatgttggaattcaacaattaggtatattttagtgtagcctcatagtgcagcgacccagctgtaaagatgaagtcactcattcctgtaatgatttgctagcttgttgaactaaagtctagagttgaaaattctgctccttttgaacagtgatctaattgtgaaacggacagttggctactgacagttttcaaatattagccagttgctgattttaaaaataactgtgagaaaggaagaccaaggtgagaagagactaaaaatcaaacagt

SEQ ID NO: 101365 - DNA, 2000 bp, Homo sapiens
gtcaggctccatctctttttggtttgcctctactctttggaagtaccctgcaggagttctggctaagaactggggcccttcccccatggtgtgtcctgaactttaatctttgtcccccacggtgtgtcctgaactttaatctttgtcttcttagtacatgggattggtgaagaaacctgctgtgctattcagaggctttctgcttggtttcagccttctgacctgtgcatctttgggattttgtaaaatgtcttcagggtaaaacactcagttcttttcacaggaatcctaggcccttgtctctatttttctttcttcaggcctgagacattaccatgagctctgctggtttctctgcctgtgaatagtggctctggtcatgttcccaggctgcttttctgtttcctcagcctccttcctggcacctagcattggcagattccctgaggggcaaagcagttgtggcatattggcttgctcctaaagggtttacccttccggattgtgtctcttcaagtcatagtagcttccacagttctccaaagtcttcagactttgaaaaaaaaaatttttttttttttaattttctctggctgttggagttgtttctctgagggatctctggtctgccacaggctctcagtcatagccagaagcagaggctactttatgcaaatcttgcacatgtgcattgttacttatgttgcagaaaaggtgatgctagtctgtgctccatttactaaggaagaaatattcagtttatagggaatcgaaaataaattatctgtttattttattttattttttattttttcccaggacagagtcttgctctgttacccaggctggagtgcagtggtgcaatcttggctcactgcaacctccgcctcccgagttcaagcaattctcctgcctcagcctcccgagtagctgggattacacgcgcctgccaccacacccggctaatttttgtatttttagtagagacagggtttcaccatgttggccaggctggtctcgaactactgaccttatgatccgcccacctcagcctctcaaagtgctgggattacaggcatgagccaccgcgcccagcatgtttattaatccaataaatgtgaaccagcaaatataaacttaacgtttatgcattactgctgtactttctaacagtgtcagtggttaatttaaaagtcagtagaagttaagtgatttgtctaaggcagagtttctcaaccttggcactgttgacatgctgctttgttgttgaggctgtcctgtgccttgtaggatgttttgcagcctctgtggcctttacccaagagatgccagtagcacctttctcccgcagtggtgacaacgaaaaatgcccccagatactgccaaatgtcccctgggaagcaaaagcacccctaattgagaactactggcctaaaggaagggaatagttttcctaatttgatataatgccagaaaagcagaattggattttgagttactcaagtcattgtctctgaccattggactatatgccagcttcattcttttttttttctttggtaaagatggggtctcgctgtgtcacccaggctggagtatagaggcataattatagctcattgcagcctcgaacttctgggctgaagggatccttccacctcagccttgtgggtctctggggctgtaggtgtgcaccaccacacttggcttttttttttttttttttttttttgggcagagacaaggtcttgctatgttgcctatgcaacatagcaagaacccttggcctcaagaggtcctcttgcctcggtctcccaaagtgctgaggttacaggcatgagccactccacctggcccagcttcattttttactgacaatttgatggtaaattctagggtcctaaaaatggttgtaagagtaaatgtattttttttttaaccattggcttgccatctgtgaattgggaacttaggtcacttggttgcttattctagggtta

SEQ ID NO: 101366 - DNA, 1039 bp, Homo sapiens
aaaggatatactcagcctcctaggcaatgccagcactacaactgagtcccattctagttgttattccaaggattttcaccagtttacatcaggaattttcataaagttggcattggatgatgatatggtgataccaagatattttctattgtttttgttttgttttgttttttgagacagggtctcgctctgtcacccaggctggaatgcagtgatgcgatcatagctcactgcagccttgacttcctgggctcaggtgatcctcctgcctcagcctcctgagtagttgggactacaggcacgcgccaccatgcctggctacttttttttttttcttttgtagagacaggctctcactttgttgcccaggctgggatgttttcttttggatgggagtgaaaggcttatgtataaatagaaacagcacactcaacatacctattgtttttataaggcacactacagtgaatacattaaaaaaaaaacagtaggtgagaatactctgaagatagtgagaaagcataattgtaggggacatagtttttaaatggttgaattactgtctgaggcctctttacagacatggggtaagtgggatgccaaggtgtgttgttgccaggagaatcaggttatatgtacctttgggtggcagcaaggataaatcaggacaaagggcattcattcattgtagcttcataatcacagtgtgataaaatcagtcatttggtgatcattacaggtcagtcactgcctagggttttgttttttccccggtatctttattttggattttaaaaataatacattcagtgtataaaatttgggaaatacagcgaagcataaggaaaataaagacaatctaaaacctcataacccaaagataacacactgttaacattttggtgctttttcttctggatctttttttaggggagtatgtgtaatttttcaaaaacgtaattgagcttacattatatgtacagatttatatactaactaaaaatgttaaaactgtagtctagaggcaaagtgactgtca

SEQ ID NO: 101367 - DNA, 1051 bp, Homo sapiens
taaaccttccaggctgtgctccctcaaaggcgccgctgcgcttgaggagcaggtgctgtggctgctgaagtcaggtgctctgggagcagacaacaactgcctgggtgtgtagcacctgtgtccttttggctcccctggccttgtcttctgagactctgttgttaatttctttagctgtttatgtcagctttgaccaaagcccactgcaaagcttagaagggtaaggaggcaacaatatccctttgaagacttattttggcacagattttgtgatttgtgaatagtaacattcctcagtagccacaaattaaacaacatcgatctaattttggtattaattagttgtataattaaaatagtaaaaccatctgcatagattgaagctatagtttcaggttgtattatatgtgtgaaaaaccgactcttcattgtgaattttgagtagacttcccagtagattatttatgtaagctgtgtcatcagaaacattccagaatgaatcacgtttaattaggatctaacaaatgttaccacctttgttctgttgaacaatatttttaaaccattaaatcaacttggttgataaaaggaaattgcagtaatttattcataaccctttcatcacaagtgttttcacttgtgtccttgtcattgtatacacagatatttgaaaattttgcacctcaggaattgctgggctgggagaaaaaggatggcagcaatttaaatctgtatttgtgctagaataatcttttacaatctctttgctataagatcttttcctggccagttctgttttccccactataacgaaacatcctgtcttaatataagattatttctggcaagggattcttgaaagctgtaaagaaaacatacctgctgtctttaccgataatgtggaaaacttcatgggaaattctagccccttcgatgtcaagtctatttaatctcattcctttactattaataaatttaaatagatgaatttcaaatctcattaaatgttacaacagtatgtctaattagtttttttctttctttgattgga

SEQ ID NO: 101368 - DNA, 1025 bp, Homo sapiens
atcttttctaaagagggatgaggaagtatttactttgtgaaattggaaaaccgtgtggttggtgtggaaaataagcatgttattaataaacagctagtcttgtgctccatactcttggatgtaaggtagaaataaccttgcctctattgctgagatttaaaaaaataaaaagctaggctactacccgtgccttcctcgtccacaacacaggcacagggtggcaggtagtgatgagaaacaggctgccaagatggtccctggatgactaggaggtgtgtgatgtgcgtccagttgtctggatggggcaactggaatccttcattgtgtggttcatgcttgtgtgtgtgtgtgaatgcgagagtgggaggaagttcaatgttttggctttggtgtgggattaattttctcttcgattgttaatttggcatacctgactttttcattctggtttaaagtattagaaatcttaagatttgtgtgaattagaagattgggatttatttgaatttcatttggcactagggaaaattcactttaggtaagagctactttttgggttggctttatgttcaaagcagttttttccttaagagtttcattttattatggaaattttcttttttctttttttatttttttgagatggagttttgctctgtcccccaggccggagtgtggtgccaccgtctcggctcactgcaacctccactttccaggttcaagcaattctcccacctcagcctcccgagtatctgggattacaggtgcgtgccaccatgcccggctaatttttgtagtttttactagagatggggtttcgccatgttggccaggctggtcttgaactcctgacttcaggtaatctgcctgcctctgcctctcgagtagctgggattataggcatgagccaccgcgcccggctggaaatttccaaacatataaaagtaaacttaatagtacagtataatggaccccatgaacaaaagtaatttttctaacctcaaaagcaggggcagtttatttaa

SEQ ID NO: 101369 - DNA, 1661 bp, Homo sapiens
ctgcaacctctgccccccaggttcaaaggattctcctgcttcagcctccagaatagctgggattataggcgcttgccaccactggctaatttttgtatttttagtagagatggggttttaccatgttggccaggttcgtctcgaactcccgacctcaagtgatccacccacctcagtctcccaaagtgctaggattacaggcgtgagccaccgtgcctggccgggagttgtgtttgtattgttaattttggaagtagtgttttatatcagcaatttaaaaggagaaggttgggacagaaagtgagagagtgaaagagagaaagtggtggatttgataaggagcaaggtaataatgttgcataaaaatgtgatgtcccttctcttcaaccctctaccctctggcctttatgattctcatttatttaatcacttgttttatttgcaatgttgaaatatccctattcccttcagggttctgcagaaaacttttgaacttatttatgacctgttaacttaaaaaaaaatccgagagctcagagtacttccgtactccagtctgatcaggtcttttaaaagataacagaagcgagctatttataaatatacatatgaggtgctgatttaaaatcttaataagtttatggtaccatcatatggcaaggttgtgtagaggttactgaccttagcaaattgtcgaaacagttatcggtttcaagagaggtgcctgtgcatggttaggggtaattgtttatgcattgatgactttttttttttttttttgagatggagtctcgctctgttgcccaggctagagtgcagtggcgcaatctcagctcactgcaacctccgcctcctgggttcaagcaattctcctgcctcagcctcctgagttgctgggattacgggcacctgccaccacacccggctaatttttgatggggtttcaccatgttggtcaggctggtcttgaactcctgacctcgtggtctgcccaccttggcctcccatagtgctgggattacagacatgagccattgcgcctggccgatgacattttattaattgaaattctgttctacatttaaactaatttttctctttccttgattactgaagaaaagagatggggaatgattttgacatttttggcctgcttagttccaagagaaatttgatttatggctggcttttggaaggcaggagccagtaattctaatcttacctgatttgatcgaatgaccttgagcaagtgacttgatttcaatgatctgatactttcaaaaaatcccaaagccctttgaaaaactagaactgcatcttagtcaatcttttagagaatttttaagaaatcatacctcaataaagctagtgagatgctttcatatatagaatgttgataattcatttacattctacataaacattggtcctaagattttaatttatttttatcttactattttttgagatgaagtctctcgctctgtcacccaggctggagtgcagtggtatgatcttggctcactgcaacctctgcctcctgggttcaagtgatcctcctgcctcagcttcccaagtagctgggattacaggcgcctgccaccatgcccagctatttttttttttttttttgtatttttagtagagacggggttttacca

SEQ ID NO: 101370 - DNA, 1396 bp, Homo sapiens
gaggtccacccccattcaatctcctgctaatcccctgagcgtcccatgcctcttccccatctcccccccccccacctcgcgtacccacaagggcacatccttgtcacctttgcccccagccccccagactttcagccacagcttctttctcaactgaagacctggggaaggggtgctgtctgtgttctttcttccacttctgccctctcctagccttgagggtagatggtgtggttcttcagtattggatagtgcctgctctgcggacaaaggagaagtttaaattgtccgtagagaaggggatatgattggggcctttgggaaatggtaccaggtgagaagggggagcatggaggaaagatgtaatgggtactccttcttttcaaagtcttatcctttaaaggaaaggcggtctctggagaaactgaccctcccacccctcccccgcctgccccaagcatagtcttttataagaccacagggcaccagttaggacaggaagagatcagaaggaaagacagcatgaaggttaagagcggaggacacagaggtcagacttggattccaatctctgccctgtatgaccttgggcaggttactaagcctttgcatttctcctctgtaaaatgggaatgtgagtcccaatctcatacagtgttaaggatggaagtagatacatgttctttaaaagcacttaccactgtacctggtgcttgaagagttttaaaaataagtaaataaaggcagctattacatgtaacttccaggaagaagggagttaggtggaacgcttaaggaatgtgtttgcctgacttggcatcactatgaggaaacctcagtttatggtgaaaaatgatcagaagatgctgctggggtaggggcagggagagtaaattctgctagaaaaattttggattatatggattttaggaaagggttgatggtttagctgtagggaaatgccttttaggattgtagcaataactagtgccattctctgttgacctgtcaacgcagaactagctgaatagagaaatttccagatagagcaggagatcgtctcctgattattttttaagcatattttacttgtggttaatgttgatgttttgaactatcaactagatctgggaagatagaacaggcagcatcagattgccttgtttacaaagtgtcatcacgaaaagtgttcctctaggaaggcataatatgtggcctgatggatttgatgagtagattgtaaaagggttgggattctggcagaacaagaagagataactaattagtggaattaactgagaaaagagttcattagcatgttggctattagactctaataaaaatgggtgtgaaaagatgggatttggacctagaggcagtcttagagccataatcc

SEQ ID NO: 101371 - DNA, 1085 bp, Homo sapiens
aaaaatcccccacaaaagatgctattctctaatttccccatcttctttttctttctttttttttaagacagagtcttcctctgtcacccaggctggagtgcagtagtgtgatctccactgcaaactctgcctcctgggttcaagcgattctcctgccttagcctcttgagtagctggaattacaggcatgtgccaccacacccggctaatttttgtatttttgtagagatggggtttcaccttgttggccaagctggtcttgaactcctgacctcaagtgattcacccgcctcagcctcccaatcatttctccatcttcttcctcttcttccacacctctgatataaaggacattattacaccttattaaaacttcacccagatgtccagacaatgctccatctatgtattcttctgtatttgcaagctgcatgttcatgtagccatctacagataccaggtagccctagtactccattccccgcttaagtttcaccatccttggctttcctgttactccactgaggaaagatctgggattgagacataaactcatcatcgtaaccacaggcaaatgctatgggcaaatgctgcaggccgctgaccaggctgaccaggctactgactacagcagctaccacaggtcctgagccactgagcatcaggagaaaactatgttcaagattttatagtaagaaatgtatttggtaacattccatgattttatgccatagaaggctcagccaacattccatgattccacatagaagggggtttagctaacattccttaagtctgtacagatgagggtgctctgtagacattccataacgataagcaaaaaggttctgcaaacattcaatgattttatacatggacagatgttctgcaaacggttcaaaattcatgctacaagaaaggattctagccaggcgcggtggctcacacccgtattcccagcactttgggaggctgaggcggtcagatcacctgaggtcaggagtttgcgaccagtctggccaacatggtgaaaccctgtcttcactaaaaatacaaaaaatagccggccatggtgatgggaacct

SEQ ID NO: 101372 - DNA, 1055 bp, Homo sapiens
ggctaaaatgtgggtggagacatgtaaggcacagtaaataaagtcttactaaggtcagccaaagctttttatcagtttattatattgcagtcacttttactagtttctacttgcctactgatggtatttaatttttcctgatcactgctgatgtttagaaattaactttcattgcctggtagatctttagtggagtagtaattctttcacaagatagttattgtttagattagctttggaaatgattgtttagactctgttcactagcctccccctcctcccatcaccccagcagtcctactaccttggttcagactctcctgtattttccctggacttcagtactaagtgccagatcctggcttgtgaggcttcacattgtcatctatctcatttatgccttatgacctccaggtgatgccgtattttaaggaatgggcaccactggatagtgttgacctcgagtacaggtttcaaaaccagttttactcaaaaagttcttgttctgtttttagcatgttttttagcaatatatcttggtagattctaacaaccttagctagtaagatagtcatagagctctaagaataggagccttgctcattaacattcctttctgctattaggcatattgaaaagaacctatgtgactaatacccataattctgggacattcggtaaaggctctaagaactactccaaggaatttacagttgtgtggtcagttttatagcttcttacataaatttgttatcaaaattatagttggtgtgtatttagatattatacacatgaaaattaaaatgataattcttataatttcatttggaatttcaagctcctcatgtttcttgaatgtctgggtaactgcagcttgctgaacaccagtgcttctattaggacttagagcagacattgttggtggcttaccaaagagtcatttcccccttcttccttgaaaatagaaccccaaatttgatcaggtatcttgccacagtgtgctcaaggaagatgggcccctccaagtcaagattggtctttgccatcatgttaat

SEQ ID NO: 101373 - DNA, 1066 bp, Homo sapiens
tatcctaatagtgtggactttggatgtgaaacacagttaattccttcagtgcctgtctgttgggcatcttccatctgacgggcattatgtcagggaccgtgttgtgcgaaagcaggtggggtcattgcccagaatgagcctgcagcctcatgggaaagtaagacatcagtacataaataagtgcaaaattgcagtcttgtcaaccgctacaagagagggtgactgtgcactgagagcacagactaggatctgggaagagttgaaatgtcctgagatcttgggatgatgaaagcttaacaagcaaagagggagcacaacctgctcgaagccaccagtgggactggaacccagagaacaaaggcgagcatggtgccagatgagcccagaggcctccccaggagtcgaatcattcagggtgggggctagctgcattttaagtggaaataggggtccaggtgaaggcagcacaatcagatttgtcttttgggaagatcattctggaaagacgggagagtggagggaaaggggccctggggggttgaggagacttgtgcgaagctatgcagtgtttcagatgaaagatggtgtgagtgacgggacactgcagtaagtgcgggggtgcaggaagactcccgggctcccagcttgccacacaggttgggcagtggtgccttttacagagaatcaagtctgcacggagggccaggtgtgcaggccgtgccttcactgacaggaatggcttttctaatcatttccctgatttctgctctttcaaacagggtaacttctttcaaaatattggttccatcaccctgtttgctgtttttgggacggcaatctccgcttttgtagtaggtggaggaatttattttctgggtcaggtaagaaaatcatctttgaaacactttgaaagtcttacattcttagagctagtgcagggaggtgggaaggtgaaatggggccactttgtggggcctgggtttcacccttaaggtaaattccttctggaaggaaatcctagcttcatatgaggcacagtagaggcgtgctaaattgtttcaaagtg

SEQ ID NO: 101374 - DNA, 2145 bp, Homo sapiens
tgcatgtcacattcttttcctttattgtcagttgcagaaagtttgcctgtctcagttctgaaaattaagttgagggtcaggtatctgagtgacgggcagatttctttaacacatcagctgctttcttctctcaatagccaaagcccattccattggattttcacctatattgcagctttgatggcaccagaataaatctgtctgtcatgcagctttcttcattgctcagcttctagtattaagtaagaataaacttaaggaaactacagttaattgggcttgaagaatgtagcattcttttccatactctcgttgcatgccgatggaatgcatgtttcaactaaggcttaggagcttttatttttcaagtggtttgggaactgaagattaatgtccttattagttttaataaagcactaatggacatttaaatcttggctgttctccagggttttttttttgtgtgtgtctgtgtgtttgtgtgttttattttacaggctgatgtaatctctaaactcaacatgacagacaggtaaatccttcatactgtaacacccatgcgactgcttttcagacaggggaaatgtttctccacattgcttcctgggtgtggtactgttctattctctctctgtgtatttatttttggtaaggatttctgccatagaatcttactctgagttaatttgtatctctgaaatgaatcaaaagtatcctaaagacttttgaagatccctagtggggcattgctgattggaatgatttagtttaagcttgggagggagtaactctgctcagctaactgccctgcctgtgtgcacgcgtacactgtaccattgtcttcttatttacaagacttttcagtcgccgtaacaaaaagtcttcttgacagattagagatggagagggggagtgacggagaaactttcctctgggattcccacgaagcctgtggtgggggaagcagggccaagacctctattgtggttattgtagaaagcccctccatctgaagccactcccgtgagcacttcccatgagccccatccaggatttcccagaattgcatagtgagaagcaacctcactaggttgaggcagttgtctctcagaaggtaccagatctagtgctgaaaaagtgcccatgctgagcatagtctgggttcccccctctgagagcagacagccttgctcagtgtgtctgcatttggtcttgtgacatggctggggagctgggcagcagggtcacatgttcgtccccagatccttgccatggggccagtcagagctttcaggatttagcagcagtttagcaacttgggactagaatctgggaacccttttcatgggaactgtgtctctgataacaaatccaattctatttctacctccactcaccacccaccccagcccaggacaattttggagcttttgttgtaagacagttttgatacataaacaagtagtcctattccatgagagctggaaataaagcagaactgatgtcctgtgtttggtaggtattttgcaaataaaaagaaatgcccagtaaaggaaggtatcacagtattcaaaccttccacttgttttgggggcaactggttagagatacagacaatgctggataacttcctgtgaagttgaattgaatcagtggttgggatgttcaggtggaggacaggaaaggaattgccctgtagacacactgacttagagccgggtagtgttttcctctccgtgtgcagaagtttcctttgctgttagaaagtgacgatccctcagatggggactgctctggggtcgcaaacccacacagccgcagggcctggcagagcacttaacagagggaagctggccagctgtgagtctagacatggggcagcggccagtgggagaacacaccctgtatgaagggacagccacttctcagcgccaactcatgattaccatgtggaaatctgggcccagaattggtggctattttaaatacttttttttcaaaaagatgctgggtttctagatttttatagggaattttccagtttttcaatgttgacaacttgctcaatttttcacaaataccatgcagaccaaacatgagaggggaccacagactttttgcaacctctgcactgtagaaaacata

SEQ ID NO: 101375 - DNA, 1386 bp, Homo sapiens
tgtgacatcctttccttttctttccctgcccctagttgttgttttcaccacatttgcccagtttttgccctgtttttgcccttcctttgcaggaggagcttaccaaatactgcctgatggcaagaggtgctcaacaggccttaaaaaacaaccaaacttataagtatttttgttattctaaatgtagtacatatattcttaccaaatttaggaaatacacaagcaaaaaagagagaagtatcacacacattgctactacctagagataattatggttgataatttggtgtaaatatatatacattttatttcaataggcttataccccaaatattgtactctattttccattgaacacaattgataaaacagtcttctggaaaataattttactggttacggtgtattcctttttctgggtttactatgatctacttaaccagtttcctactattggctttttcatgtttctcttggcagaaatttctatagctttattaggatattatccaacatcatgccacaagacctttaaaaaatccaatggcagtattttttcttatttaagatctactctgaaagctgcctagcattctggtttttacttttatctcgtatcctggctacacatattgaacatttgtgacaaggaattttgcctaacttggaggtgacatcatgagttatttttatgcattgggagctaaactcaattgctttgtctcttgatttttttaaagaaaaataatttttcagaggtaggatcttttctgagcttttccagttgtctctattataaaagccaaagataggagactttttctatttaagatgggaaatgatggagtcatcgttggtagccagaggttcttactggaaaagtgctttggaaacccaagatggggccaggcatggtggctcatgcctgtaatcccagcactttggaaggccaaggcaggtggatcacctgaggtcaggagtttgagaccagccttgccaacgtggtgaaaccctgtatctactaaaaatacaaaaattagcccggcatggtggtaggtccctgtaatcccatctacttgggaggctgaggcaggaggattgcttgaacctgggaggcggaggttgtagtgagccgagatcgcaccactgcactccagccagagcgacagagcaagactgtctcaaaaaaaaaaaaaagaaagaaaagaaaccaagatcgtctgtggtaacagttcccacagttggatctgtggagcatgcatgtatagtttccagtctcctcgtccaccagcagcagtgctactgctgaggccacggttggatctgtggagcatgcatatatagtttccagcctcttcctctaccagcagcactgccactgctgag

SEQ ID NO: 101376 - DNA, 1052 bp, Homo sapiens
tttattctttaaggtatgagaaacatgaccttaagaaacaaaatgtagaaaattaccaggccagaaagagtccaaattctactttcattacctggagttcagaaaccattgccccagccctggatctgctgttaaccctttgtgtgaccttacccagtgactcactctctttgggcctcaggctactctgtataaaaagcagtgaaaccagcctgggtacctgctgtggtagtgatgtgggctgaggctgggcactgtatgtgtgtgacctgcagatccatttttgggaactatgggtgatcatggccttcaaaagcacttttccaatatgagcccttgttggctgccacattcctcaaggtgggatgttaacctgtgatctgctagaaagaagggggattggggagattgtttgttcagatgagtctgcaaagctttcacgtgaagaaagttagatttcttttttgcaagacttctcagacctttattatgttattttgggctgtgaatttcctcgaaaggctttctgagtttatttgaccaagctaccttttcatcttattctgctttaaaatgataccaatcctggggcctggcatggtggttcatgtctgtaatcccagcactttgggaggccaaggcaggtggatcacttgagggtaagagttccataccagcctggctaacatggtgaaaccccgtctctactaaaaatacaaaaaaaaattagctgggcacggtggtgcgcatctgtagtcccagctacttgggaggctgacgcaggagaattgcttgaaccctggagacagaggttgcagtgagctgagatcgcaccactgcactccagcctgagcaacagagcgagactccatctcaaaaataataataataataaaatgatatcgattcatgacatggtgattgatgaagctgaatattactgttgactattctttgtttcatttactgagtcaacaaaaaggtattgactgtcttttgtgtgggaggctctgctttaagccccggacataaggcagcgaacaagatggaca

SEQ ID NO: 101377 - DNA, 1050 bp, Homo sapiens
aaagggtgggggggtagtgcagtgggccctcaatagccacaggttccacatctgccaaccctatccctggatgtcagtgatggtccacacctttttatctttggtgctgtgaaggggactttacatggcttattttcactcaccctcctaacagttctgtgagtggctactattagtcccactgtacagaagcggaaactgaggctctgatgggggatgtaatgtggctcaaggtcacccagctagtaatgaggctgccagagcgaagggacccatagtattttttctgaagcctctgggaggcttcaggaattcatttattttcctttttcttaaaccctctaatgctctaggccccagggccttgcaggcattgtgagatctgagttggggatcacacggcagtgctttctgttctgttctctccctctctaggcatcatggccatccttttctcaggcatcgtgatgtcccactacacgcaccataacctctccccagtcacccagatcctcatgcagcagaccctccgcaccgtggccttcttatgtggtgagttctgcttctgtgtggccgtgagcaggcccacccagagctgatcttgcttccttatcctgtttgagaagtcagttgagactttccctggcagcagggcagcagctcctcagagccagatccctcactcccttatcttttgtttgttcctctggctttgaaatttcataaagtaaaccaaacacctaataaatgaacatctggcgcctacaatttaaagaccaaaaatagtgagaaccaattatgaacatttgatacatgcatttttaatgtattaatgtgacatttccaaaaatgtattccttggaaataaaatattaatgatggtttggtgaaaatggctccatagtcaagcaaggcatggggctcacacctgtaatcccagctgcttgggagactgagaggatcacttgagcccaggagttcaaggctgcagtgggctatgatcttaaaaaaaaaaaaaaaaagaaagaaagaaaaacaaagcttttgtag

SEQ ID NO: 101378 - DNA, 1560 bp, Homo sapiens
cgtcacccatgctagggtccccaaagcactggggcaggggccagagcagcagcacccagtgctccctcctctactctgacctggggccccagcatcctggagcacacgctccacgcacacacaccccagccctgtcccaggggcctggccccctcagccatctcagggtgaggagctgccagtcatgtccagatggaatgactcccatcctctcctcatctcccctttgacgagcctcaaactgctcagctcatcaaagagccattgccaacttccgtatgtggttctgggtcccagggagccttggaacctggcaccctggggtggtttaattcatcattaagaagcattcctgcttctcaagggacacagtggcctgcatgggccagcatggaccctgggctgatcatgtgcattcctgcttctctggggacacagtgggcccacatgggccagcatggaccctgggctagagcaagcacatctccatctcttccacctcaggcagtgtggctccagatgtcaggagggactgacctcaggaccttccaggttcctctgtgccaggaatgagaggccaggcccgatcctaccacctcgccttgaccctgaagtcagagcaggccagccaagcaggaagcacactgtttactttttgcatgaaaagtaaatgtgtacttgatagagctaaaatatgatcttttttaatttctcaaccccataatttgagccattgccttgcttaattttggtttccaccatttccttttagtggagaagagaggaagtcagagggtagggacctttgcctgcccctgggcgagtgcgggcagggatctgagaccagattgttctcgcacccctgccagaactcactctcccctgaagtttagggtcccatctcccagatgtaagttgttttgcaaactcagtttgccaggatttctttctttcctaatcttaaattcacagataaagcaatgaaaagagtcagatcccatttccgtctgccccctcgtcaccaggtgtgatagccccagccaggtcacacctggcctcacactttgagctgagacttgaaaacgatgctgtggcggaagagcatgtggggcttggtggaggggccccaggatttgttgggggcaaagggggtggcgggaccgttcccaggaggtaccagcacctgcctcgatctcctctgagcctcttctgccccctgtcggccaggtgaggtcagcagcctgggagagtgcccccaagagatgagggcaccccgtgttccttggcaatcttggctcaccttggtaacaaaaggccatagaagtctgtttttctgggtcagttttttttgcctgagaataacaaattgctgctgtctacctttagcacacccaataattctatttggggcagtgaatgcatagaagatataaaaatacgcagcttaactatatcttcctgcgtgtgtatttattttcttctgggtctaggccatggtacaggagaactgtggcgtgtaggaggaatacttcaggatgagtgaaggctggagccagggag

SEQ ID NO: 101379 - DNA, 1003 bp, Homo sapiens
agatagatatatatatatatatatatatatatatatatatatatatatatatatattaaaaagagagccatagaagatttggaaaaccttaaaatcactcaactgagttggaagaacatcagcaaattcacagtggcctcaggattcagccagacttaaacttgctcaagagctgaataactttctcccagaaaagcccactgcatataaatcccttaacattgtgtacatcacaaacagttatggctaaaatatagttagttcacaaggaagcggctttattttcaaactcttgccccactcctgctcttgtacccccacaaggaaaatccaggggttggtaattcacatgagaagctgaaggggccttcaggcttggaagcgcttaggcttagctgagcatctgaggagccgtctctctgatgggcacatgccgactcctgcccacttttagtgcaaaaagattgcaaatgttgcagatgagtcctggaaactggtgaagagaagaggattgagatggaggggcagtaggaatcccaaatgattttccttctgaaacgagactcaagaagtgtgaagtgcaaggttcctgctcagcaagctataggtccgacaggtgaggtccctgaattgtcataggttagcagtctgcagacacacagacctcgacacccgcgctcaccccctaagtgcacactggaggtaggtgtatagatagttactgcagggaagacagtggctctccaccagctcaagaaaaggaggcttcatgtctgttcctccctgccccaaactctcctctcccctcgggccatagtgagtggaggatacaacacgaatgggcgcgaggccctcccttggaagactaaagaacccagggcatttaataaatagctacataattcatttttttaaccacgttgaaacacacagcaagttgaatatttatttaaaaataaatctcaaaaatatctattgacagtacagtaagaggggcatgtgc

SEQ ID NO: 101380 - DNA, 1802 bp, Homo sapiens
ggtgaaaccccatctctactaaaaacagaaaaattagctgggcgtgttggcgggcgcctgtaatcccagctattcaggaggctgaggcaggagaatcgcttgaacccaggaggcggaggttgcagtgagccaagatcgcaccaccgcactccaccctgggcaaaagagcgagactccgtctcaaacaaaagaaaggagctgctgggtcatttccttgcacaattcctgagtgcttagcaagccccagctcctgcgtcttctgcctcccgcagggtgaggctgtcgagatccttccctgccctgccctctccccgccgccccacttcagagctggacatcctttgctttgacatagtctctgtcttgtgtctctgacagaaaaccccacctttcttttctactccctcccttctagacctacacgggcccttttgtttattatgtcaagtcgacattactggaagaggacatccgagccatcctgagctgcatgggctacacacctgagctgggcactgcatacaagctcagagagctcgtggagaccctccaggtgaagatggtctcctttgagctctttctggccaaagtcgagtgtgagcagatgctagaaatccactcacaagtgaaggacaagggctactccgagctggacattgtgagcgagcgcaagagcagtgcagaggatgtgcgcggctgctcggacgccctgcggcggcgggcagagggccgggagcacctgacggcctccatgtcacgagtggcactccagaagtcggccagcgagcgggcggccaaggactactacaagccccgcgtgaccaagccctcgaggtcagtggatgcctatgacagctactgggagagccggaagccacccctgaaggcctcattgagtcttcggaaggagcctgtggcaacggatgtgggggacgacctcaaggatgagatcatccgcccatccccttcgctgctgaccatggccagctccccccacggcagcccggatgtgcttccacccgcctcccccagcaacggcccggccctgctgcgcggtacctacttctccactcaggatgacgtggatctgtacacagactctgaacccagggccacctaccgtcggcaggatgctctgcggccggatgtgtggctgctcagaaacgatgcccactccctctaccacaagcgctcgccccctgccaaagagtccgccctctccaagtgccaaagctgcgggctgtcctgcagctcctccctctgccagcgctgtgacagcctgctcacctgtcctccagcttccaagcccagcgccttccccagcaaggcctcgactcatgacagcctggcccacggggcatctctgcgggagaagtacccaggccagactcagggcctcgaccgcctcccgcaccttcactccaaatccaagccctccaccacgcccacttcccgctgtggcttctgcaaccgcccaggcgccaccaacacctgcacccagtgttcaaaagtctcatgtgacgcctgcctcagcgcttaccattatgacccctgctacaaaaagagtgagctgcacaagttcatgcccaacaaccagctgaactacaagtccacccagctctcccatctcgtgtacagatagaccggcctcgccccttccagctccaagggctacatcaaccgacctttcgggtttcacggtgaagaagtactaacgcattgatctcagaggcggaggcctgcacttgaccatgtaggtggcagagatcgtgggctggctgtgtccacgtgggagttcactt

SEQ ID NO: 101381 - DNA, 1061 bp, Homo sapiens
aaggaaaaaatggagattcaagaaaccccactgagatccttcagtggcagggcctaaggcttgaagcctcaaccttaacaccttcactgtgtctatcacaggagtttgcatttgtttctgtagttgtgtgttctttgtagtccactcctatccctcattttttctggcttggaaggacttagtatttgaactgggaggagagagcaagttgttttttactccattatccattgatgtctttttaaaagttgatccatatttgtcgtcttgtctccatgatgcgtgacagaggttctctgtatgtcttgttctagcttttgctctgcatgcctgcaggaatgtctgaagccgaagaagcctgtctgtggggtgtgtcgcagcgctctggcacctggcgtccgagccgtggagctcgagcggcagatcgagagcacagagacttcttgccatggctgccgtaagaatgtatgtggaagtgatgtggaagagtccatgtctttccatgataagttggggtaaaacgtacagctgccatgttgttgctgaagttagagcatgactaggtcactaacagcacgcgtgcatgccaattacctgtggtgatggctgggctggtttgttttcataaccttactggtttttgtttctttttttaagagttggttaagtatatattttaggtttgaaagccatagaaatcagttatcccagttttttcctataaaagatcaattatggccaggcgcggtggctcattcctgtaaccccagctctttgggagtccgaggcaagagcttgaggctaggagttaagagaccagcctggacaacatagtgagacctcatctttacaaaaaaataaaattagccgggtgtggtggtatgtacctgtaggcccagctactcaggaggcagaggccagaggatcacttgagcccaggagtttgggattacagtgatctatgatcatgccactgcactccagcctggctgacagcaagaccctgtctcttaaaaaaaagtcaatatgaaatcattggattgtaataacaatagctaaca

SEQ ID NO: 101382 - DNA, 1045 bp, Homo sapiens
aagagaatttagattttaaagattatttctcagaggctggtgatagatactttaaccagggttagtggcttttatatgttttacctaaaggatcacttttctctgctgcacataacagaatgtggtttttggcttgctgtaaggagactagtttaaatgctagtatagaaaacttttaaaaacatcctagatttggagcttgtctgtgagcagacagcctatcatgaataggagcaaacctctaggagagttattttagagtggaagtggatatcctgatttagtcgaataaaatagcagccttggtattaatgggaaatctgcaataatcagggtttcagccccatcagcgtagtcaggagtttggtgagattatttgccagggtggtgtaggtctagttttctttgtgcccttgtttgggactatattttgcctgttgcaaggtcctcactaacttatgggctctgattcttcctatttgagttcttcctgtccaagatccggtcccacgtggctacttgttccaaataccagaattacatcatggaaggtgtgaaggccaccattaaggatgcatctcttcagccaaggtaaatgactcagtctccccttaggtggaggtcatctcttgctattaatacaaagaggttgcatgcccaggggtttagttgtatgaattgttatgctggctaaagctgatacaagtattttgggaggagtatgcaagggaggactctggtgttcacttcagatgttagctgagctatattctttttttcttttttgagacagagtctcgctctgttgcccaggctggtgtgcagtggtgcaatctcagctcactgcaacctctgcctcccgggttcaagcgattctcctgcctcaacctcccaagtagctgggattacaggcacctgccaccatgcctggctaaattttgtattttttagtagagacagggtttgtcatgttggtcaggctggtcttgaactcctgatctcaggtgatccgcctgctttggcctcccaaagtgctgcgattaca

SEQ ID NO: 101383 - DNA, 1493 bp, Homo sapiens
gtggaagataatctagcttctccacctcttgtttcacactcattcctcccatccagtgtttgtctctcgggtccttcaagccagccaggaccttttctgggtcatgaatagcacaatgaagcaagtgtctcctttccttgtccccaaggtgtgcagactttggcagccgtgcacctgaccagagctgaagctcccgctgggctgtggggttgccagaagctggggttgccatcccggggtacatgtcaccagtcctcttggggttttgtaccatctgatgctggaagttttgattagtgatattttctactactacatatttagagttcactggttcagtcttaaatgcctgcatggtgcctttttaggataaggtataaccatacatttttggtggaagtgtttctgggttagggaagttaaagtctgtttatccgtaagtggggaggagggtcagctaagagaagtgggagggccagagctttttggttctgatttacaaattaatgaagtagtttcaaacaacgcggtcatgtttacctctccatttgggagcctgcctacattcttgttctagaagcacaaaaaatcctcagatgaattagaagaaagaggtttggggactcagcggatactagttcttttaccttctgcttggtaacttagattaaactgagcattgtttttctgtcacaaatgttttccttatgacactggtttcgacatgtaaaatgtgtttgaaaacctgctttgtagatgcagagagaagctataggaaacccagtaccacccctggtctgttctgacgagacatcgttcataaggcacagcacatcgcaagatgaacagttgttaataaaagctgttgctggaaacttgctttaggaacagctcaagaaccttggagttcatatttcacaaatattaataaatataagtccaagagctgtcagcctaatctgtaggagcagaacctctgattgaccaaaaggcatatgggtttaggttggttttttgatgtcatatgtctctgatggggctgcaagtgctacctcgcgcttgtacactgctgctgtggggctccgcgcctgccggtgaagagctgcagatgccgagaagccagcaaacacagggcccactggaaaaaaatagttttttcattagtatttctcgggaggacccaaaagttaaggtcagcttgttcactgtaatttctggaagaagttcactcagaccttcctgaattcagatcatctcagaagtctggagggaaatctggcgaaaccttcgtttgagggactgatgtgagtgtatgtccacctcactggtggcaccgagaaacttacttccttgtattaagtgcacttcttgtatttctaataagatgactttccagaaagtgagatttgttatgttctggcttttaaaaggtaaaatataaataaatttcataacttaatctaagtggtaagctatggttcttgttttcattc

SEQ ID NO: 101384 - DNA, 1052 bp, Homo sapiens
agggagagctctgtgtactttgctccttggatcctagcatccttaagaggcagataaaattatccccacttcataggagacaggttcagaaaatattcgctagatgccccacagctaacagcagagtatgaacttaaacacatccaggacctgaaacttgaccctgcggagcccctttactacaagccctcagcactgctgctgttacccgcacgtagcagaagccgcatgtctaaagccttgctatatggagcgctgccacttctcacctcccagagcctcccaactgtaacaagtgttctttttccagaggacaggcaccatgaggcccagctggtggcatcagctgagatttgacgccaaacaggactcagcaacaagcaagaacttcccttctagaaagggtaaccatcttctggagactccccaagcccatgctatggcaaatgtgttgaatgaaaacaagaaccatagcttaccacttagattaagttatgaaatttatttatattttaccttttaaaagccagaacataacaaatctcactttctggaaagtcatcttattagaaatacaagaagtgcacttaatacaaggaagtaagtttctcggtgccaccagtgaggtggacatacactcacatcagtccctcaaacgaaggtttcgccagatttccctccagacttctgagatgatctgaattcaggaaggtctgagtgaacttcttccagaaattacagtgaacaagctgaccttaacttttgggtcctcccgagaaatactaatgaaaaaactatttttttccagtgggccctgtgtttgctggcttctcggcatctgcagctcttcaccggcaggcgcggagccccacagcagcagtgtacaagcgcgaggtagcacttgcagccccatcagagacatatgacatcaaaaaaccaacctaaacccatatgccttttggtcaatcagaggttctgctcctacagattaggctgacagctcttggacttatatttattaatatttgtgaaatatgaactccaaggttctt

SEQ ID NO: 101385 - DNA, 1037 bp, Homo sapiens
aggctgagtgggtaacagggaggggagacttggccgagtcctgggtctgttttcatcctcaaatcttctcaggccgatttgagagagtgagacccctggggtcttggagccaggcctgggaaaagctacttcacgtcaggccaggggctgtagccctggcaacctccactccgcctggaaatcctccacctcggggcctctctttgcccagacctggcccaggaggagcacatgggagccgggaccttcccaacaatccttgccgttggctccacaaacctcagccagtcctgcaacctgggatgccttttccaccaggatgcctgctactgtcactgttgtcattagataattaatgaactataattagaaatcatatcaataaaatttcacagtctaaggctgttgaaataggtaccatcattatcctcattttagagctaaggacagttttgggcggtaggggaggtgcgggtgtcactgcctgaggtcacaccgtagcaggactgggattcaaacccccagacctccggttccagaggccaagcttttgtcaaagacatgcagtgaaacaggcttctcagaggttccagccagtcttcattgcaaaacaagagggaaaaccgaagccaggacaggctcggggacctggccctgcccctgcccctgcccccagtgcctagagaccccaaagcagcctctgctgagaggcccttcccaggatctcccacaggccagggctctgggccctgcaggaagtggccagggctgggacaggcctgctgctttgatcagctttacgagccagggctgtttacggagtctcaggcccccagccccctgccacccggggctgtgtcttgtcaccagcacttgggatattagcagtcccaggagagtctgctggccagacgggtcttggccccatttcctccagcctggcccgcaccttgcctcttagcctcagcctccggggacagggaggggcaggggtaggctgagagggtcccctcgggccagatacctcctgggctggg

SEQ ID NO: 101386 - DNA, 1037 bp, Homo sapiens; identical to SEQ ID NO: 101385

SEQ ID NO: 101387 - DNA, 1037 bp, Homo sapiens; identical to SEQ ID NO: 101385

SEQ ID NO: 101388 - DNA, 2127 bp, Homo sapiens
gggttactcagacctgccagctctcggagtccttggtggttgaacttggagaaagaccgcatgaagatacttgtaagcacacatgatccctctgaattgttttactttcctgtaactgcttttgcttttaaaaattgaagaagttttaaacagggctttcatttggtcatccttgcaatccattggggtctagtttggaatctgacaactggaacaaaaagaaccttgaatccggtgcatgccttggttttggtgctgctgctgcttcccaagatcctcagcagggattaagaaggaacccggtgtgcacagcagatccccgaaattggtgggcttgacctcctggcaaattgctgcgtctttccacttgctgttcaggaccactaaatgctgaaatgtggatgcataccgaaataaaagcaattcattgtgtactaaaggttttttttttttttttaatttagtatttgtgtaaaaccaccttttgaagcagcaactatcaagtctgaaaagcaattgatgtttccattaatctttttctggggggaaaaccttagttctaaggatttaacatcctgtaagtgaagtttaacataacagtattccataagcagcctttttattgtcagaccattgcctgattttaatataataaaaaaaaagtgtgcgttaatatttaacaggctgtacttttcttcctcttggcatattagggacagaatttaatgttttagatgctttgggattcaaattgacatcctaaagcaggggtcggcaaactttctaaaagggcctaaattagtaaatatatagactttgcaggccaagaggcaaaatctaaggacattgtgtaagtacttatattctgagagaaaacagatttcccaaatttttaattggtgaaattcaaagtggaattcagtttatttataatgctactggcccactaacgtgaggactggagttcttttaggagataacatgttgtttaactgggactcattagtgttccctgtcatcaagcctcttgcaaatgttcatctgtaaaaataattcttcatgctaaaagccatacagaatcagtcagtgggctagatttggcccatggatcatagtttgccaacccctgtcctaaagatggtaggtttttgttttgttttgttttgagacagagttttgctcttgttgcccaggctggagtgcaatggcgcgatctcagctcactgcaacctccacttcccagattcaagcaattctgctttagcctcccgaatagctgggattacaggcacccgccaccacacccagctaattttttgtagttttggtagagatgggggtttcactatggtgcccaggctggtcttgaactcctgacctcaggtgatccacccaccttggcttcccaaagtgctggaattacaggcgtgagccaccgtgcccagcccaagatggtagtttaaaaaagcgttcttcctttgatttaagtagcctcacaggtcttgagctattaagcctccactagaagccatttattggctggacttagtagtctattcagagaaaaaaaaaaatcatcggattgtcacatgtatttctgatgtttaaaaaaaatttttttttgatctgatgattaactatttgtctaccatctactgcatatgcagtgggaacgtgtctagtttttacccagagtttgaacttctgctgtagtcccaactacatacaggtacgatcttggtgccctgtggcaggagcaggctattccctctggctgttggggccagctcaggtgtgagaagagctggctgtaaggaaagggccaggttcttcccaacaggccaccctccagaaagccctgcccagatttctttggatggtctttggagtcctctgcagggactggtgcccttcagttctgaaagtacatacattgggccagggaaagctgtgggttcttcatcctcagtcagccctcccaagggaggagaggagaggttccaaaattatttcaggccagatatggtggcccactcctgtaatcctaacactgggaggccaaggcaggaggatcacttgagcccaggagtttgagaccagcctgagcaacatagtgagacccctgtc

SEQ ID NO: 101389 - DNA, 1057 bp, Homo sapiens
atgctgccttaacctgagaggtgctggctctgtggcaggcccttgtcactggagcaggtgtcctggccaccctttgccttggctgtccgtactgccctgcatgcacatctgtccccctgacctgggcgcagtgaagaggacaggtcctgagcccggcagccgccagcccagcagcggccattattgaagagccaagtagggctgggttgagtctcacccaagtgtcagtaccaccgtttccttatcccagatagtaatggttcagggcacaaaagggaaaggcaggctgactggagggagggactctagcaggtaggtattccgcatgtaaggtattaggattagcagcaggttcagcttaaaaagtacatcttactccagtttgcaccttagcttaaccccggcatatagctattttgtttgagagtctgagagtaatttgcttttgtttgccttgttgtaggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaccacaggcccttccccttccccccaattcgatttaatcagtcttcattttccacagtagtaaattttctagatacgtcttgtagacctcaaagtaccggaaaggaagctcccattcaaaggaaatttatcttaagatactgtaaatgatactaattttttgtccatttgaaatatataagttgtgctataacaaatcatcctgtcaagtgtaaccactgtccacgtagttgaacttctgggatcaagaaagtctatttaaattgattcccatcataactggtggggcacatctaactcaactgtgaaaagacacatcacacaatcaccttgctgctgattacacggcctggggtctctgccttctccccttaccctcccgcctcccaccctccctgcaacaacagccctctagcctggggggcttgttagagta

SEQ ID NO: 101390 - DNA, 1054 bp, Homo sapiens
ataaaagaaattgaatgtgggggatctgactgaagtgacccaccacaagctgctgccttttgagtttaaaacagtggggtcttcttgcagaatagcggagaccatgaatccttttactcgattttggtttcagctggaacagtgctgagtcaattcatttaccatgacgctgccccaggcactcccagaagagagattctgagtcaggccagactgctgggtaaaacttctcaccagaataacactcctaccgggtcgtaataaacgaaggggcccagtgtgctggtggtagccagcaataaggtgctgttgcagctcagccctgcttgcagtcactcggttggctacctacaatctgggttaacagctgcccggttctaacttctccagaccctgacagttaaaaagtgagtgcttcataaatggctatggtgatcagataaaatgtcagctgctgtctagtggaatacaagagcacttggcatggtttagataacataggacaggctttgaggtgccctaaaatggacttcccaaaattcttttgtctgtttattcaacagatatttactgagggcctattatgtcccatcgtggatagcaaacaaaatggacatagtctgtatccttcgggagcttccattcaagtcagggagagaaggctgttaaggagtaaataagacaatttcagatagcagtaagtgctatggaggaaattgtgtgatgtgatagtgtctggagaggtggtcaggaaagtgacatttcagctgagtcaaataatggaaagagctaaccctacagtgtcacaggcaggagagagagtgggctgttagtgcaaaggccctgtggtgggactctgcttggcatgttgaaataacaggataaaaggccttcatgtgcaagcaaggcttgttaaggagatgagttggagagacatggctttggatttgagatggtatgaggggaagccatcaaacaagtgtctggtatgaagtaggcattcagtaaatatttgttgaatgaatgaataagagtcttaaaaagaggagtatga

SEQ ID NO: 101391 - DNA, 1081 bp, Homo sapiens
gccgaagctgcccccagggggagccggctgccagctgccaccaccccaaagctgggacaaagaggcttctgtgtgcctgtctgccacccctgcccccattaaagcagcctcagacagcagcctggagtcactgccaccggcagaggccgcaagatcacggagccagggggagggctcctggtctcctaagatgattcctgacttctgtccaaagcagacatccctccctgctgggcagcgtgcaggcgccaggccttgaccattggacagatggcaagactgaggctcagcagagagctcacaggagctgcgttggggggatgcttgctgtgtcgtgggacccaccgggccctttacccagcagcccattttattaacttctcatagttaagggaggtaaatgtccccattctccatacctgggtgcgaagtctccctaaccctaaccctaaggttgcatcatcctgaatgactctagcgagtctctggctactcaccagcagccctgccttgcccctgccaccgtgtgaccttggggagttcttaccctcctctggaaggtcaggatggggtggggcctgttactgtggacatgaagtgagattgtccactttttgaaaaacagactttattttttagaacaagttttcaacttacagaaggatggggcagatagtacagagagtccccatatgcctggggcacgcagtttcctccattattcacatcctaaatcttacattagcggggcacatttgttacagtgtgtgccagtgttgatacattatcatgagctggagtccatggcttattcagattgccttagttcttccctaatgtccttcttctgttcctggatcccatccagggtatcacatggcctttagttgtcatgtccctttaggctcctcttgtccagttttttttgtttgtttgttttttgagacggagtctcactcttgccaggctggagtgcagtggcgcaatctcggcccactgcaacctccgcctcccaggttcaagcgattcttctgcctcagcctcccgagtagctgggactacaagcgcgcgccagcacgcc

SEQ ID NO: 101392 - DNA, 1081 bp, Homo sapiens; identical to SEQ ID NO: 101391

SEQ ID NO: 101393 - DNA, 1081 bp, Homo sapiens; identical to SEQ ID NO: 101391

SEQ ID NO: 101394 - DNA, 1081 bp, Homo sapiens; identical to SEQ ID NO: 101391

SEQ ID NO: 101395 - DNA, 1081 bp, Homo sapiens; identical to SEQ ID NO: 101391

SEQ ID NO: 101396 - DNA, 1069 bp, Homo sapiens
atcatggtgatccccaggctggggcggctgctggggcagtgggggtgctgcgtggctcaagagaaacagccctcgcctgagaattggggaaccaggagatctaggcccctgtgacctctgctatgtgacctctgttgaggtccttctccttcctgggcttcacggtcttcttctgcacaaaaggagccaagggcatgtaaccctggtgtgttccgttccccttctgagccttggtcttttcaaggggcaggggagggcagctgtcctggttctgggtcagggtaggtcaggagcagcttgctgttgtgtgacctggagaaggccttctctctccctgagcctcagtttccctatcatgacaaatggggaacccagtacttccttcccaaggtatgtcggtgagcggcacccagagacaaagccatggagttgtccgttaggattgtggttgggaatttgctcattctgcaagcatttactgagtgtcagggccctggtgagtgagccagacatggttctgggcctcccgacttcacatttaggtagggaaagacaaacgtagacaaggccacaggcatgagcaatgggcctcgtgtggggggagtgtggggtcagaggaggcatcatggatggcttcctggagatggaggtttccagggtgagatctgcaggaacagtgtcaggtgcacagggagtgaagagaacagcatgcacagagtcctaaaaagaagagagggtggacacaggaggagcccttctcacctgctctggccctgaccccttcacagggacctgcctggccccgctgcttaagtgggggcctgggctcctgacccagaatgtcgtcaaggtgatagggtgatggggaatagagggagggaccaggggcagcaggaacaggatagagcggggcgagagcgggatcttaggagccagacctctggccatggaattctggtctctgctgactagttgggtggctttgggctacttccttgaccactctgatggtcagttttctcatctgcaaaaggacatcacttcagcaggcgcctgatatgtagtaact

SEQ ID NO: 101397 - DNA, 1069 bp, Homo sapiens; identical to SEQ ID NO: 101396

SEQ ID NO: 101398 - DNA, 1069 bp, Homo sapiens; identical to SEQ ID NO: 101396

SEQ ID NO: 101399 - DNA, 1069 bp, Homo sapiens; identical to SEQ ID NO: 101396

SEQ ID NO: 101400 - DNA, 1069 bp, Homo sapiens; identical to SEQ ID NO: 101396

SEQ ID NO: 101401 - DNA, 1063 bp, Homo sapiens
ctatttggtttgattaaagtgcttggcccctcatgagcacccagtccacttttgttggaacatttcctgaggcttagaaaatgggagaggctgcctgaggtcatacggcggggcaccgggcagcagtagggctaggcctggaacccgggactgggccgggtgggggtgcgctaggttctgtgttcttactcttcactatggaagtcagccagccaggggtgagtgtgtgggaggtgggggcgagtattccggatcatcagaacagcatgtgtgcagggcaggtggcagagaatgggcctctgtgtgtagggagctgtgagtagttggaccagagcagcatggggctgagggaatggtgacaggtgcagcagggaggcggccacagcctgatttcgcaggccccaagtgtctggcccagaggttgagccctggtcctgcaggacccaggagccgttctgtcctgttctgggctgagtttcccagcagcagcccacctcatgccagatgtcagggtttgtgaagggcctggccagcttggcaggccagagggtgaggcgggtgtccagcttcccaggaggtcccagctgaaatctggccatgtgtgtgctacttctcaggtgccccaggcttcatgggtgcagcctcacggtccttgatccacctgtaccccacccaggccaactgtgggtgccccctgccctggggattacagaggctcttggcacagggggaagggaaaggtggagggtgtcaggagtactgggtgagagtcctggcctgtactcccaaagctgaacccaggggttcagtcccccagatgggctttctgttttttgctccttttgtctctgtttctcatctttgtttctttcggtttttttgtttgtttgtttttgagacaaggttttgctctgttacctaggctggagtgtgatggagcgattgcagctcactgcaacccaaaacttctgagctcaaatgatcctcccgcctcagcctccaaagtgccgagattgcaggtgtgagccaccacgcccagctaatttttatttttatttttgta

SEQ ID NO: 101402 - DNA, 1033 bp, Homo sapiens
aagccccaactctagctcttgcccctccctcacatccatgtattggccccttccttaggacttgggactggaacccccatattccccagaccagatcataagttggagttcacctctccctctctgtccctttccctcaggccacggtttctccctagcttcttcctgctttgctcactgtatatgctccagcaagcaccccccctacacccacttttgtgactcctacgtgagccctaggaattttactgtttggcctcaggagggccctatatccccaggagttaaggaagtgcctttgagaactcctggttcaggtgactgggaggcacctctacctgggtgtcaccatggaatgaagctttgtttgtcaaatatcctgacatccttcctttttctgtggggcagccaccaagcaccacatgcagcccttgcctggagtgggcctggggtcactagcaccttagctttctgccctcactggcctgggttccatgccgtctcttccttaaaaggcggcatggccacggaccatttgcatttcctcactgggtcctagaccactccattctctgtatgtgatttttcacacctgacttgggcacctggtccatgccgctatggtttcttcaggcctatacccaagacacccagcctatggacttaaaacctcctgctctcctgggggtaggccagggttaacatcctgactctgttattcagctgtatgacctggtccaagccactttccgtctctgtttccccttggtttccttgcaagttaaagtttatctgccccttcgtgttaggaagtggaaatgagatcgtccactggcattcagtaggcactccctgttgttgtgtgggtttttttgttgttttttgttttgttttgttttatttgttttgagatggagtctcactctgttgcccaggctggagtgcagtggcgtgatctcggctcactgcaagctcctcctcccgggttcacgccattctcctgcctcagcctcctgagtagctgggactacag

SEQ ID NO: 101403 - DNA, 1023 bp, Homo sapiens
gcagctcctcaggtctcagcccaaaagctgcctcctccgggaaaccctccctgaccttcccatgggaagtctaggccctcagtcactcctctcacacccctgcttcatttccgtcaccattctcattataatcagaattatcttgcctgccagtcttgctgtctgtccccacggccttcactactgtgtccctggtgcctagaacagagcctggtacatagaaggtgctcgatgaatggtgagtgaataaatggaggaggctgagaagaaggagaggttcctcgttagctgggctgtgtgaccttaggcaaaatggctcccctctctgaaccaaagcactcgcccacgttccctttctggattctgaagagatgcagggagatatgggggaactgaagctaattggaggatttgctgtgtgttcttaggccaaacttccaccttctctgaaccacattccaagctctttgcatgtattaactcatttaatcctactgataatttgtaggaggcaggtcttttttcttcttcttttttcatatttttcaatgttttgtagagatggatatgtctcactctgttgctcaggcttttctcgaacgcctggcctcaagtggccctcttgcctcagcctcccaaagtgctgagattacaggtgtgagccgctgcgccaggccacagtcttatcattatctccactttatagatgaggaaactgaggcccagaagagctaagtgtgtctgctccaggtcacatgaaaggatgagaaggaataaaatctttccagtctgactttccctcttgggtttgtcataacaggcctggcaatgtgagtcccatcttctggatagaagaactgaggcacagagaagggtagacctggggtcacacagtgcgttaaggtgttactcggaccttgcaggccagcccccaaagaccagactcagccccagcaggggtctaggccctctggcctctggggtggaacatgcttgccacccttccccaccctccaccccctg

SEQ ID NO: 101404 - DNA, 1023 bp, Homo sapiens; identical to SEQ ID NO: 101403

SEQ ID NO: 101405 - DNA, 1023 bp, Homo sapiens; identical to SEQ ID NO: 101403

SEQ ID NO: 101406 - DNA, 1151 bp, Homo sapiens
gagcccgctgtgggcggggatgaagtaggaagagatatgagctgtgacggaggctttctgggtgctgcccccagcactctgccacaagaacccaggacatacccattccttctctgggcttcagtttccccatctgtaaaaggagagatgctcattgctctcagaagcagacttggccctgccgaggggcctggcagggggtggggcaggcatggggttcaccagtatcacccgtccacccccgtcttgggggccagggccctgtctggatataaaggccggtgccctggggtgcagccggcttaataacaggttccaggatccaggaggggtttgaacccaggagaataggttcaaatacaattgagcagcccacgttcctgtctgtagctctgaaagccaatcgttcccacacccagagggcccggtcccggctctcatcaaacccattcaccccagtggagcccccatctgtgtacctaccatgtgccaaccttcccactgcgctcagaagatgcacactcctgactttggccatgagctctggacctgccccggcccccagtcccctcctcactcgccccttcacacaggccaagctgagccctgcatcgaggcctttgcacttgccattcctcctgcccagaactctcttcctgcagatcttgccatggcggctcgtcctccaggcctccagccaagctcaccttccagtgaggcctctgaccccatcctattgatccctgtcagccccctgccttgtttttctccatcaaagtcttcactgggatgtcctgatcctctgcctggcgtctgtctgtccctggatttggagctcttagacggcagagtctagggctgccctgggactggctctgacatcaccaggtccaggctggacccagcctggtacccacctcacagtgtaggttaaagaacaaatgaaacgggcatgggagattttgcacccacctgggggaccatcaatgcttcatctacacagaccctctcatctccacacacaggccagggggatgcatagacctggacacagattcactgcatcccgccccctccaaaacaccctgacacacacgtgtgcacacacacgcgccccccgtgcccacctcccctggcctccacaccagtgc

SEQ ID NO: 101407 - DNA, 1151 bp, Homo sapiens; identical to SEQ ID NO: 101406

SEQ ID NO: 101408 - DNA, 1151 bp, Homo sapiens; identical to SEQ ID NO: 101406

SEQ ID NO: 101409 - DNA, 1045 bp, Homo sapiens
ccgtgagaatatggggctaaagaaccttctagccaggaggcctgcggtacccactccattggggccatgatattattctttcaggcagggactcaggaaggttaacgttttaaccctctctaaaatagcatctttcctcaatgagcagcttagtctttggtcgtggcagagatgaccttgtcttaggagtcatctccttgtgtgttaaaaagttaggaaaggagggtttctcatatatctataaaacaagtagttaaaaacacaaagagctcttcctttcacaagcagctgaataagatacatactcccaattaaatgtcattgcgggggttgttaagattaactaaaaccacacttgcacagtatcttaaataagcgatatacagaatagagagattttgttacttgtgtaaagggagacagcagatgattctgttttcagcttataggctcaaaaggcaaattgtgagatccatcagctgtagtattaaaatctattttgagctccgcttagaaaggaaaaaaggtttaagcagttctttggtatgcttgactaacaaaagcctttttttttggcagccttgattttcatgtggatttacatcaagcttatttgacaggattctttttatttggactgtagtgtgtatattagtttctgctagactaatatttctaaccactgtaatctatatactaataagtatgattgatcagtatataaaatttgtatgccatatctggtctctgaattagctgaatgaattccataagggactttgagactgtgtagacaaattttctgcatcagtttaatgcagtagagtctaaaatgtctttaaatgaaaattgttggtctgaagtgttggagttgattatgatacaccccatcacagtggaagcattgtggagagaagtcttttccactgaaattgactgagttgacaacaagaaatacgtattgtaacttagttcttagttgaattttatttcttacaattttaagccagagtgggttgacctgtcacccaagcatggttaaaat

SEQ ID NO: 101410 - DNA, 1038 bp, Homo sapiens
aaagtttataggagctttgtgagtatagttaacaactcaaaagaatggggtgttttttcccgaggggcatgaaatgtttttgataaatagagttcatttgacttggtaatgtggaaaatgagtagccctgacacgtacgctatgcttttgcagtttttctctcaagtagcaattgggtggcttttcctgtaaaagatagaggaactgattcttgagaatttacgaaagcttcaaccctaactaggtatgcaaagaatagttgccctttatgttgtaattttaggaagaaacctacatctggtctaagtttcatttgaataatatgatagtttacacatctgccatatttgagaagaaagtacctaagtctccagcattttagaaataatgctttactttgtgtagaaatggtctttagagtttaatagctgctgccctctcctttttcaaagcagcttgacataatcatgagtatcttgctgacagcttgtaaattttgattgtatgaaaactgaaaataagaccatttcacatggaagattccctcctgccctgaaacagccaaagaaaactgtagccatcaaatctattgatctctgggctttggtacaagtcacactactacaaataaaataataccaagtacttataaatgattttcagtccttttaaagtttatttttttaatattttttttgagatggggtcttgctgtgtcgtccaggctggagtgcagtggcacaatcttggctcactgcaacctccacctcctgggctcaagtgatcctcccacctcaggctcccaagtagctgagactacaggcatgtgccatcacgcccagctaatttttgtatttttttggagtagagatgggattttgctgtgttgcccaggctggtcttgaactcctgggcttaagccatctgtctgcctcaggctcccaaagtgttgggattacaggtgtgagccactgtgcccggcccagccctttttttaagagaaaaacgtatgacatcgttcgatttactgagtgctta

SEQ ID NO: 101411 - DNA, 1085 bp, Homo sapiens
ccacagtgggtcacactgtccttgtcggtgtacactacctagcacttgagtttgcaacccctaccccaagctgagttttctcgtcaagcttgatgttaatgttatgtgatgcttggccttgtaggtatttggtatattatcgttagataaaattgaagcaaagggctaaagggttggtggcctgagggagtgcccttgacagtaaagtctaggataaaatcattggccaggtactccttcccttcccgcccttcctcttttctctttatcctcagcctccttctgctattttgaggaagttagaagccaccaccattttttcccacctcaggcaactgagtgtggctgtatttctgtcccatgttcagttatttccaggaactatttttgatgaccaacttgaagttacattgggtgggcctaatgggggctgataaaagaatgaggtgaccaaatatgcttgcactgagacggctacgaagtaaggtttttaatgacttgctttgtgacttggtcaggagtgataccatttgtcatgtgtccaacttcatgactaaatggttgctctaccttatcctcatagctataataaaataaaataaatacatacattgcagggaggaatgtatcttgttaaaggtctctcccttttagcaacaaaagtacatattatgttgtagaacatgctttttctttgatccttcttgaacacctattactctatagaggtatgttgtgtatggcaaattagaacaagcaatagataaggatgattctttaccattataacccagtcaaggtctttgtcctaagttttgtacctttctccagagggaaaggtatttgtatttatttatttatttttgaggcagagttttgctcttgttgcccaggctggggtgcaatggcacgatctcagctcactgtaacatccgcctcccgagttcaagtgattctcctgcctcagcctcccgagtagctgggattacaggtgcctgccacgatgcccggctaatttttttttttttttttgtatttttagtagagatggggtttcatcatgttggccaggctggtcttgaact

SEQ ID NO: 101412 - DNA, 1134 bp, Homo sapiens
tagctttatagaaattgcagttggaactcccaggcctggcattcaaggctctctgagatctgggctacccacccatgtcctccagccgtctgtcgcacctcctactgcccactcactgttcctggcatgagatgtgatctccagcccccatgcctttgctgtgcagggtgttccagagtgaattgtccctcctgtctgtctctctgccctcttcctcgtctttccatcttcctgccccacatcactgcctcctacccaaggcctgtgctcattcctcctcggttttcccccatggcctggtacatacctctgaattatcaccttgcatttcccatattgcccggctctctttgatgtctgtttctttgctgggtcttcctcagtgtctgacggtcagttaaatgtctttattcttttttgtaggatatccgacatgaagccagtgacttcccatgtagagtggccaagcttcctaagaacaaaaaccgaaataggtacagagacgtcagtccctgtaagtatccacgtggccggtaccagtcttgctcttcctttgctgcaggcctttttagtcaagactcctttcgcctcagggtttagtataataataaatcaatgtagcagaggtttatgacgcgattgtttcctatagtaaaggcattagagacttatagtaatagctcatttttccaccattatagaagggctcaggtttcagtttctggaaaattcagtgaagttcaaagcacttttcttaagctttgactgtttttgtgatgaatcattttcctaccagctgaagcagagtatagcaggcataataaaaccttttctggatgactcagcagcagcgtcattagggcatgagcactgtgttccgctgtaatgaagccccgcacaggcattcggggtgggcactgtcgtcccctgcgctgaatatgcaaggcagctctgtctggagtccccaccgcctccacccccgccaacctcatcatttttctccctctttcctgctgttagttcttcctaggattgtcagtgtgcctgctggcctgtggcagccctgtccgccttctgagtgattggctgtcagtctgccggtagctgaaaagtaaataacttaacatgttagaa

SEQ ID NO: 101413 - DNA, 1119 bp, Homo sapiens
agaacagatttcccagataggacatgatccatgttttaatatggcttactgctgttgcttcatagtgtgaagcttcagacacttctgaaaaccctttcagaaaatcccagtcgccccatactgatgactaatctcaactaaaacagggcttcagccagtgtgaatgccactaatgccaccaactcacctttgcttttctgtagggtgtgcacctgtatgtacacattcagcttttccgggattaacctctgagttctggtttgtctttcagttgaccatagtcggattaaactacatcaagaagataatgactatatcaacgctagtttgataaaaatggaagaagcccaaaggagttacattcttacccaggtaagcagattgtctgaattttctatttaatgtcaatttaagagtttgagagtgctgttatccacacctcaaataaaatctgccacatcctttagaaggtcaggatttcagcataccaaaaagcagcaaggaagggggaaaaatcatccttcaaaggttcagtttggttataaggaacgctaatcttttctgggaagcataagatgacattgctggaaatgagagcttatagaaaacaacattaaaatgccagagttgcctgtgtggtctgttggcagagacagcagagccatggctggaggagggtctgtacctgtgttgcttccagaagtatttgtcgtagagcacttgtgatggcaaatctaagaacgttagcagtagaccaggaatctctgtccagagccattcagagtagctcagcatggttctcattctttggccagaagaaaggcatcattggatcatgtgaacaagcatgaaaaatgacttaaaatttctgttggcttttggcatctttatggaaacaaaatcctgaaagtggtttaataattgagcctcttgtaaaacactcagtggcatgtgaccaaaagggtatctgggaaagaggataaaaagagtttctttttaattaatcttctcaagtcttaacttgttacctgtaagttggtctaaaaagactgggtttcttattttgtttttcatcataatttttgtttctcattccatgtcagctttcagtcttatatg

SEQ ID NO: 101414 - DNA, 1048 bp, Homo sapiens
gctgatgtttcattggatgttgctgtattctagggactgtgctaagtactttatagaaatgaacatacttcattttcacagttttatgaatagggactattattagtcaagtaagcgatggggaaactggggcagggagcgatgaagtgacttgcgcaaggtcacaagatgatgtgattggaaccaagagaagtgttgtggttggccacgcccccacactgcctctcatctgcaccaaggagttttgtcccatagcccaagggccttggggacgaatctcagtggaggcccttagcgggcctgcctgagccagaaagcagaatcggcatttttctgtccttggttggcccagccctgaactgagatgcggaaatcgcctttcgctgcctggtagaaaatggagctgcagttactgaccaccaggcagagagaggtgggtccctgtcccagcctcagccaccactctgcctaagctgtggggactgagggcgctgtcgttagctgactgcagaaggtgagcacacgctgtagcatgttatgtttcagatgtcacatgttgtgttattgtgtctttgcagggccctttgcctaacacatgcggtcacttttgggagatggtgtgggagcagaaaagcaggggtgtcgtcatgctcaacagagtgatggagaaaggttcggtaagtctcggcttcatttgctgtgtatgtgatcatgcataccactccatatagttaccattttcgtccagatttttaaattatttttcttgcctttgtatttcctttacgtagtatttttatttaaaaaaattaaaacagcagcatataaatgcatgttggttgtcaaccagttaatgaagtgaataaaagggaggaggcggaagaactgcacggacctcttcgcccccgccttctcctgtgtggtgcgtgtggcgctccgcccacctgtgctgcctgtgcggctctcatcacagtgtggagttgtgtgtggagttatggagacctgcttttatcttgaaaagcaagttcttagtgcatcttcatggtgt

SEQ ID NO: 101415 - DNA, 1070 bp, Homo sapiens
tcatcattgatccaggaaggtgacatggatgaaactggctaagacttcagacaggcttgtgtccagactcttgagaaagctctgttggcttctggtctggcactgtgaagtttgctgtgatgctggcaccacaacctggtgtttcctaatttgtttctcccacattttgctttggttttgtcttttgggcagcttccagctccagtagagcaggaccaataggcatttgtggttctatattcaccctcctcacgtgcttcctggctcctcattgcccccagatgatgccacaggtccctgggcctgctgccagtcgtctgtgatctgggcctctgctggccccttctccagctgctcttttcagcctcttatttgcagtcactgcctaggaaatcctagtcatccttcaaaacctgcctcttgcacagagctttctctgatctctcttttctgtaaccttggctgacctgaaacatttccctcttctgaattcctgctgcatgtccgtagcatttccccctcagccctcccccatagtccaccttgtcactgctgggcacagcagtgtcttctgacagacagctggccctgaagtggttcccttcacccacaccatcctttgccccagaggaggtattgagtgggtcagtgcacgtgaactgccagtgtcatttgccaaagagctgttgacacacgctgacatttcttttgctgaaaatcataagggctttgagcttccctctgtccaggcacatggtcaggctgacccggtagctctgcccctgctgacctgccatttttgtccacaacagttatccatgagcagaaacatttgtgtaactgaggcagaaacttagttcaagtaaaatgtcactaaattcgagtcagtttttgtcttagaccctaaatgaaaccaaattttcataaattttcttgttttaaagaaaaatttaatgagctacatttaaactgagaacatcagatagtgtctgagattatcaaaatagaacatcaaaagtatttttctgaatgaactgaaccaaaccagaatgaaagggcaagccctgggg

SEQ ID NO: 101416 - DNA, 1135 bp, Homo sapiens
tgtctctcccagttttatttttaattgcctgtgagttttctgtgcagggtaaggcacctacattctatgccagcagcctgatcaggtcctgggtaatgtttgaaatggctacacagaggagtttcaaagccttttgttcaatctggcttcacctcgtagacggtgagaaagcgtcagagccctgcaggatcccgttgccacgtttgaccggggagccgatgggtttggaagtctgagccctgtctgcacaacctgccccggtcagcagcttcgtgcccccacccccatctccccatgaggcaggcatctgtgctgaccatggcttccatgttcagaaacccccaggcctttgagttatcatgaagcttgtgggatgtgctccaagcctcctgccatagaaaaactgccatattgctcacaataattcactattatttgtttccccagttaaaatgcgcacaatactggccacaaaaagaagaaaaagagatgatctttgaagacacaaatttgaaattaacattgatctctgaagatatcaagtcatattatacagtgcgacagctagaattggaaaaccttacagtgagtatagcacacacttcagcacttcaggcggctactggttcacatgcctcttcctttatcccttgggtgatattacctaatgtcagtgttcctggcttttgtataccccgagcaagatgtggtttgggcactgtggtgagcggagcttacttgtgtacctaccaagtgcccagggagggtggaggccacagtgctctctctgacctttaacaacagttaacaccagttcttagggaaaggagagtttcttacccaaaagactggttcctgcttgtgcagctgcagagggactggagcggcagcctgcaagtcccagtgaagcatgctgccttctttgtggtcctcagtcttcgagtctgaagagagggaagaaggggtataggggctcactccagtttcatagctagtgaaagttttctgggccaggtcttgggtttttttgttgtgggaagagtttataacaccagctacttgcttggtaaaagttggtcttggaacatggcaaggcattgtggcaagcagcactgccgctgaacgcgctgctcct

SEQ ID NO: 101417 - DNA, 1017 bp, Homo sapiens
agcacaggttaccaggacgtaggcaaggggttcgggctgcctggctcttgaggatggtagcagtgcagctgatgtgagtgctttctgccctctggtggtgaccgcgccggagtcaccagccctgccatagccctgatggggcagagggttctgagtacggtggatggaggtgctttctggaagattctcaggagtaacatgggcagtgtgttggaatgtgctagaggatttatgcagtagccttttaaaagaatgctttttagcatttgcaagcctgacattaagagtgacttctgggaaactatttgcttgttgagggaaactgaatttcaacagagcagaagagctgtgcgctttttgcttggcagagtgaatacagccagctcagaggttttgatgttaggatctgtttgctccaacagactttgtttttaaaaggcttttctcagccatagctgtctgttctagcacaaggctggaatgagttccttgtgaaagaggtgagcaggtgtgagggagggtgtcagtgggcggtaacccacaccttcaaggattaaaggaaaacttgcatttggcatgcttgcttcttattcaattttaaaatacattttaacggccgggcacggtggctaacacctgtaatcccagcactttgaggggctgaggtgggtggttcacgaggccaggggttcaagaccagcctggccaagatggtgaaaccccatctctactaaaaatacaaaaaaaaaaaaaattagccgggcgtggtggcgggcacctgtaatcccagctactcgggaggctgaggcagagaattgcttgaacccaggaggcggaggttgcattgagccgagatcatgccactgcattccagcctgggcggcagagcaagactctgtctcaaaataataataataattttttaaaaatacattttaagtccttttcttccccacctgcctccacccaccaaatagaagaggtatttcttcttctttaatgtcattaaggttatat

SEQ ID NO: 101418 - DNA, 1049 bp, Homo sapiens
tcattctttgagaaatagttgaagtgtatatttacgaatatcagactactcactgaagcattttaagccctttagcagaggtggaattaagtcacatgatctgttttctggttaatagcttataatactgtactgctttttgcgcggagctggggtggtggtgctcacagacagagagacgaatgaattgttttctgtagcctttaggacgtgagagcccttttaggtaaaaactcagctttgcaggaggcagtatgtgccaggcacggtgcctaagccttgcccttggcttggtctgccacgggtttgctttctgacccctctctcggactcaatttctccatctgtaaatgcaggacctgatgagatcatctccacaaccccttccagctcataacattctatggtactccagggataatggagattgatcattatttcaacattaccagggatgaactggaatgaaaataataatctttccatcagggtcaacagacaggctgcagtcatcagccaaactattccacttcccaggaggtgttgatgaagatagttgatagttaacatttatgagacctaccaggtgccagaaactggctaagctgctatttacttatttgattttaagttgcatgaaataacttcatatttggaggcatcagatctttgttttttaaactgatagacatttatttgagtcgttgctctgctccttgctgtctgggtgaccttgaccctgttcacttaaccactcagagcctcagatttctcctctgttcctctataaacagaagtagacagcaatgcctacctcaccagattgttgcagggctcagatgaggaaccatacatgaaactgctctgcaaaccatcaagtctggtacagatattactgggtttcatttagcaaataatgttgcctaccaaagcctttgaaaggagttccttgaaataaaatggaaatgtgtaataaataaatgcttctttttgttttcacaccgggtaacctctcagtagacatccctcagagaggccaagagcaatca

SEQ ID NO: 101419 - DNA, 1022 bp, Homo sapiens
atataagtggtgcaggggttcaacattttaagtaaaaatatttttacacactacctctctctttttttttttaaagttttaacatcagaacttttgggggaaaaactacttcagggcttgactttttgtacaaattttaactgtaaaatacagatttatcttgtacgcattcatggaaatggaaatcaaagctgctattgctttttattttaattatcctgttaagggtatctatcaatggtattttcaagtagatctctgtttcttaaattattggtgaaataattgattactagatatattgtaaaaccaatagatcctggttatacgataaaatatcagctcattggtaggctgaatcaattatttcaagtgcaccttattaacaaaagtatcagtggatccaacataaaattttatagtactaaatgtcaagcctaactgtgaattttgttctgtatcttaagtaaatttatgataatgttctcgagctatcaacaaaatatatgtacttttgtgagctatgaattttctaattaaattttacatgctataacatgatttttacatgaatgatactttgtttataactatcaaatgtcagtattttactacaattttattataaagtgtacattatcactaaatgaacttcgattttaaaaatcaaattagctttagttgtatattattttttacaaataaagatagacttgtataaaggctactttcttgtttgaaattatatgaaaagttgcccacaaataccaggtgcccattatataaaataggtagggagaaaacccttgagttttaacaagatccttgcttccttaacttttaattgttaaaagatggaccccaaattgtatgtgcactttttgcaactgtgtatgaccatatggctatgggctggatggtaacttttaaaatgtggttaattctgatagtgtgaaaggttatgcaagctattcacccaaagttatctttaagattatttgaaactagtttgtaatgtgaca

SEQ ID NO: 101420 - DNA, 1080 bp, Homo sapiens
tcacttacacccagttaaagatcgttgctgagcacagtgctatttattaataatttttattataatattataataaatagcacagtgctatttattaaatgactaacaaatggcagctactaatgccatcatcattgttaccaaagcaccagaggggcatgacactgatgaagttatccacagtaaggctggatttgtaaagcctttcagctcagtgccctctggggtttgggtagcttgtccagtccctctgaaactccagtggccttcggcccaccttctgccaaggagcagagtcttacttcgctcacataaatggagaacatttcctgttggccttggcccagcagttgcatttggcgtgggtgcatgttcttgggtcaaatgcctttggctctccttcctaggggcctgaatcattctggacagatgactttcctctgtggtgacctcagaacctgctgcccagacttctgggttctggagaccaggtctggagaggtgggaggatagttgggggaagggtctggggcctccaggctagcacacctggttgggtgtttgtcctgggagaggctctagagcatggaggctttttcactgaaatctgtttgctcttctcagagcgtagcccaaggcgtgcaaatgtaaacacctgtaatgtaatgagaagtgagttggagatgagaaatgtgtcactttccttttgagtcctccataagaagaaagtgctcctctgggtagctatggattccatgttggggagactgtagggagtgatggggactggggttaacaaaagtggcagctgccactcagctccagctgattgttgccatgtggaacatgggctcagtgtggccaggtcttggctcagtgtgtccaggtctcctgatttttcacaagaagtcagagatctgggtttctaagggaaatatcctgactttgatatcttggcatctggtttggttttactttttttgttttttttaggcatgattgggctgacactgcctttgcccgatgaatgacatctgtagacctctggtgttaggaagggtggtctcaggcccatctgga

SEQ ID NO: 101421 - DNA, 1191 bp, Homo sapiens
taatccccatttttcagataataaaatggaggctgatagaagttaagtaacttgccaaaaggcacacaagtaactgttgagaggtagaatttggattctaatccagagagtctgatcatagctcactgcagccttgaactcctgggctcaagtgatcctcctgccccagcatcctgagtagctggaactacaggcacatgccaccatgcctggctaatttttcaattttttgtagagatggggttttaccatgttgcccaggctggtcttaaattcctggcctcaagtgaccctccctggcttcagcctcccaaagtattgagattacagtcatgaggtaccatgcccagccagaattctttttttatttattttaattttatttatttttaagtttttaaactttttatttgcatatttaaaaaattgtgcattccaataattaaaatcatttgaacaacaagaaaaaaatggcactctgattaaactgcattacagcctgcaggacaccttgggccagcttggttttactttagatttcactgttgtcccaccccacttcttccttcaccaacatgcaagttctttccttccctgccagccagatagacagatgggagaggcagtcgcggccttcgttgtcagtagttctttgatgtgaaaggggcagcacagtcatttaaacttgatccaacctctttgcatcttacagagttaaacagctaaaagaagtaaaataagaaggcaatgcttgtggaatgtacagtgcatattgacggcacacgcctcattacgattcgcctgcttgcttctcctgttcaatcgtttctttggaaggcagtggatttttctcttgcgtctctgtcttcttcagtttcgacttatcgaatttctcgatctcagccatatcggatttgtcagacatggttacggaggagaagcggagcgaggcacgcgagaacgagcgaagtctggtctgcgtagtggccaccactgagttgtccaattttatttatttttttgagacggagtttcactcttgtcgcgcaggctggactgcaatggcgcgatctcagctcactgcaacctccgcctcccgggttcaagtaattttcctgtctcagcctcccgagtagctgggattacgggcatgtgccaccatgtccggctactttttgtatttttagcaga

SEQ ID NO: 101422 - DNA, 2901 bp, Homo sapiens
tgcacatcacttacgagagaggcaccaagttattcagacggttcatccagttgagaaaaagctcacctacaaatgtatccattgccttggtgtgtataccagcaacatgaccgcctcaactatcactctgcatctagttcactgcaggggcgttggaaagacccaaaatggccaggataagacaaatgcaccctctcggcttaatcagtctccaagtctggcacctgtgaagcgcacttacgagcaaatggaatttcccttactgaaaaaacgaaagttagatgatgatagtgattcacccagcttctttgaagagaagcctgaagagcctgttgttttagctttagaccccaagggtcatgaagatgattcctatgaagccaggaaaagctttctaacaaagtatttcaacaaacagccctatcccaccaggagagaaattgagaagctagcagccagtttatggttatggaagagtgacatcgcttcccattttagtaacaaaaggaagaagtgtgtccgtgattgtgaaaagtacaagcctggcgtgttgctggggtttaacatgaaagaattaaataaagtcaagcatgagatggattttgatgctgagtggctatttgaaaatcatgatgagaaggattccagagtcaatgctagtaagactgctgacaaaaagctcaaccttgggaaggaagatgacagttcctcagacagttttgaaaatttggaagaagaatccaatgaaagtggtagcccttttgaccctgtttttgaagttgaacctaaaatctctaacgataacccagaggaacatgtactgaaggtaattcctgaggatgcttcagaatctgaggagaagctagaccaaaaagaggatggttcaaaatacgaaactattcatttgactgaggaaccaaccaaactaatgcacaatgcatctgatagtgaggttgaccaagacgatgttgttgagtggaaagacggtgcttctccatctgagagtgggcctggatcccaacaagtgtcagactttgaggacaatacctgcgaaatgaaaccaggaacctggtctgacgagtcttcccaaagcgaagatgcaaggagcagtaagccagctgccaaaaaaaaggctaccatgcaaggtgacagagagcagttgaaatggaagaatagttcctatggaaaagttgaagggttttggtctaaggaccagtcacagtggaagaatgcatctgagaatgatgagcgcttatctaacccccagattgagtggcagaatagcacaattgacagtgaggatggggaacagtttgacaacatgactgatggagtagctgagcccatgcatggcagcttagccggagttaaactgagcagccaacaggcctaagtgccaggttccctggcgttggtgacatgctgcagcctggaactctgatatccagtgtgactgcaaagctgtcttctcactggtactgccttgtgagtactggttggactgtggggcatgtggccgctgcagttccagtggttatttctaagtctatgacaggacaggctgttcttgcttcagaaccttctctgacagacacggtaactaaatgtgaaaaaccaataagctggtgactcatgaatacacacgaggaaaagcagaggtttattttatctgccttttcaacatttctttccctctgtgaaatgattggtcagatgtctttgagaagtgttaaactaattcacatggtagtgtagggccaacatacaagctaccagtctaatgtgtatagtagactttgggaaaagcgattttttttcatgtattcattctgaatagttgaaatgtatatttgtacagtcttttagacctattcaagtgatgctcatgatcctgttactgtgtgcccatcatagatttctttttttagtgttgcccttgctgtgtaataaacgctctatctagtttacctagcaaaagctcaaaactgcgctagtatggactttttggacagacttagtttttgcacataaccttgtacaatcttgcaacagaggccagccacgtaagatatatatctggactctcttgtattataggatttttcttgttctgaatatccttgacattacagctgtcaaaaacaaaaactggtatttcagatctgttttctgaaatcttttaagctaaaatcacatgcaagaattgactttgcagctactaattttgacaccttttagatctgtataaaagtgtgttgtgttgaagcagcaaaccaatgagtgctgcattttggatatttagttttatctttagttcaacaccatcatggtggattcatttataccatctaatatatgacacactgttgtagtatgtataattttgtgatctttattttccctttgtattcattttaagcatctaaataaattgctgtattgtgcttaatgtaaatatttgctttattacacatgacagtcctgtgtgtccattatatcttttgccatttaatgccataactctttcatcagagatggcagccacagtcacagaggaaacttgtggaaaacccaagatctgtcatctgcaaatagaatgctttctcttgaggcacctggtacaaaatctgtttttcttttttttttttttttttttttttttttttaactgaaaaacaaacacccttgagtttttcagttcaccttttgttaaggagcagagcctgcatatatatgtaaatgtctcaatgataaaaaaaaaaatgtaaacatggattggcattaatttgcaagcagaatcttaatagcctgatgggttttttgtttgttttttcttctagatgaagttaaacgttcgttttcaccttacgatgggaacaactgtagtgcaggcggctctgc

SEQ ID NO: 101423 - DNA, 1205 bp, Homo sapiens
accttgaactgtgaactttttaggaacaagtgggattttaccctaagacttttaatcttcctagtctggagggaagtggaccattaaatttttacatgagagtataaatttaacatcatactgcttaactttctttgaatagctttctttctgcctttttgggtttgaaatttgagttttcttcctgatctgatctcctgccccctcccctcgaaaaaaatcttttttttgcacagaaccagaaatcatatttgcagtgctgtaagcaaacattgctattttagacaccattccagtactgtaactgacgagttagagtacagtactctaatgaaaagtgctttgatattagtgtgtggctgaattttttacttaattagaacttccagcaatttccttggaaacctgactgaccatcaggaaagtggttggttgatataaaatgtagactgcaacttccatatgcctttttatatttaagagccttatcactcctagtttaagtccttgttgacgttggttttcctgtgcctctccccatcttagttaagaggtgagatttacatgtaagattgggttagcgtttataccactatgtttttgtaaacttatttcactgttttctaggattttaaacaatttgaacctaatgacttttatttgaaaaacactacatgggaggatgtaggactgtgggacccatcacttacgaaaaaccaggtaagtggcacaggagacttcctcagatggcagcatgcttggtatactcccttttcagctctaggccttttatagcggtgcagtgattgcgggcaagtgccaaacatcgaaagtgtcaaaattgcatttcatattttcctgaccagtgggaagactaagaaaaactttttgtccttttttgtcattggactaaaacttgaggtgtaagaagaaacaaaattttgttacttaaaagttacgaagcctgctgtatcccaccatttcccctaaaagtgctctggctctatttttctgcatctgtgttgccattcttgttttttctgcacagaaaaagacaagacccttccttacatttaagcttttcttatttccctatgttgatggcacccaacttctatgggaggcctggggaagtgactctgtaggatgtcagtgacagagagataaaacttcttacaaattggcattaaaaacaatattagcac

SEQ ID NO: 101424 - DNA, 2195 bp, Homo sapiens
aaacttctgttttaaggaacttgggaaagttgatatgaatttctaatttaatgtattaggtcattaaaataatttttgagttcccttagacacatacaggcttttcatttttttcaaaagtaccctccttaaagtctgtaacagttaacatttttgagtacctttgcccaggtacgttgcaggcaggggtggagtgggggcatgcattggtcgagtcacatatcattactgtatttagtttggggagtatacagaaacttaaggtttttttgtttttgtttttgtttttgtttttgttttaaagaataccgtagcagtaggcaggacagttccaattcaacaaaaacctctttaccctggcactcaaaactgtaatgatgatgaactggtaagcatttttctgttttcagatgttcaacatcaaaatgagaaaagcactaacacttgatttaaaaataattgattgctagtatttctctaattttcatcttgaagttcattactgaactgttgttaagtcttatcagaattatgccagattagactcatagtcaaaatgtcctgttaaaaactgggaaaatcagagagtacttattttgcctgcctgctttaagtattcaaaatatagtagatatgtgctcggctcagtggctcacgcctataatcccagcactttggggtgccaaggcaggaggatggcttgagtccaggagtttgtgagcagccttggcaacatagtgagacctagtctctacaaaaaaattttaaaaattagttgggcatagtggcgcactcctggagtcccttcctcttgagaagctgaggtgagaggatcacttgagcccagaaggttgaggctatggtgaatcgtgagtgcactgcagtcaatgaaccatgagtgcactgcactccagcctgcgcgacagagtaagactctgtcttaagaaaaggaaggaaggatggatggatggatatatcaagccatatgcacatgaaagcaggtgtgtgtctgtgtgtgtacacactagatgaggatatctatgcaccttttttgtcagatgggtaggttttatgatcctatcatcagtggaattagtaaatattacaagttgtacgtgttttgactttgacttaaatttttttttccaatagaaactatgttccaacttcctgtcaacaatcttggcagtttaagaaaagcccggaaaactgtgaaaaaaatacttagtgacattgggttggaatactgtaaagaacatatagaagtaagtagcatgtcatttttaaattttaacatgactcagcttctgatccattactttgtgtcagtggccaagatggctaaatcttagatgtgattctgaatttcagccacagcagtagcttcacgaaaacattctcaatagcattaacttgtgcctttctccctaaaatgggctttttcatttttgcatcctgaagcagaaggctaccattgaggacttaagcatgtcaggcgttgaactaggtgccgtaaagttgtctatacatttaatccttagaacaaccatggaggcgggaggcagtgtagcagttcttatctccacttcacagatgaagaacaaataaataggcccagccttgcagctgagaaagtggcagtgtctgtgggactcaaagcctgttctcattctgatacgcctgaatgttctggttgaccttcttctaattgttgaggcgtgcttgtgtgggtgcttgttgtctctttccttaggatttgagcatttgttgccccttttgacccatcatagactattactttcccccttgtataacagtttgggctttatgaactgtttttcaagctgttttattctatgagctttataacagctctgtgggatagccatgcagtggtctccttttcaacatctcactgttccaggtcttatggtttgttggtcagagcccctgattgaaaagaaatgtttgaagctgtttcccccactaacctttaagttctaggtggctagggaacatagctaccttgtttatccatttagccccagcacctagcacagtgttttgcacgtaataggtgatcagtaagtgtttgaatggaattggaagtaaaaaagcaaattcattcatacaacaggttttcttaatttgagttccactaataatacttgaagagtatggcatggaaacagaag

SEQ ID NO: 101425 - DNA, 1625 bp, Homo sapiens
ttgttctagtcattgacatagatgatagagatacagcagggaaaaaaaccaaagttccagggtctccctttgtaacgcaggctggagtatagtggcaccatcatagctcactgcaactcaagccattctcccacctcagcctcccaagtagctgggactataggcatgcaccatcacacctggctttttacatatatatatatatatatatatatacacttaaatatatgtattttttcaggctggtcttgaactcttgggctcaagcaatcctcccacctcagccttccaaagtgctgggagctgtgagctacacctgtgagatggcacccttgtcctgctgcatattttaagagttctgtttagtccatcaattgaggtcaggaaaatgaacgtgctgaaagataatatgtaatgataataatttgtagacataaatgccagccgtgtctgttaactatttcaggtgatattgtactaaatctctgaaatcacctgtgatgaacttttaaaataaataaaacttttaagtcacagtgtgattataatttttgtataattggtaggtaatgtgatgaaccaggctgtttatttaccattagattgttggtttgctataaatgaactacaccagcatgagagaaaacaaaacttccttaaagtgctaaaattaaatttttcatcattctgttacctttcaaaagctttccatttcatttttcccaggacctctcctcttgttcttctacttttgtagcggaaactgaaggtaatttgaaattttaacacatgggaattctctgaagatcttttctctactgccacatgctcaagtttgcaaaacaaggtagttgaacgtctcactgaagtaacccagctgtactaaatctattagttaaggcagagtgaatcagggccttcattgccaaaagtaatataatatcctgttcctggcctcttggagtggagcagatttgccaataacgtgaacactctaccatttttttttctttaagtacttaaaggttttggggccacctaggttccattaatgtattaccactcatattaaatgattatagtgtcaaaaatggtctggaaatttgtatagaccttcaaaatgctgtgttacatccacggtttgttctagaggttctctccttttctgggtaatattaacaaatgcttaagattcacattttggtaaagagatccatcagtgataaatgcccctgattttgaacccagaccaccctgctgttgaaattataagcagactttgtctccttccctaatcaatactgctgccttaaatttcccagtagccactttaaaaaaaaagaatgtgtttatttttaattgttgtaaagtatacataaactttaccattttagccttttttaatcttgcagaactgaaactctatacctgttaaacaataactcctcttttcttcctttacccagcccctggcaaccaccattttacttttctgttgctatgaatttgtttattctaagtacctcatgagtggaatcatacaatatttggccttttgtgattgattttattcatttagtataatgttttcaaggttcatgttggaacatgtgtcggtactttat

SEQ ID NO: 101426 - DNA, 1089 bp, Homo sapiens
accagtcttgtagtctgaaaatcttcctaaaagaccagtgactccacatattttttaaaacttaagatacgcaaaatctagatgacacctttatgtttctacataactgtaagtcacctgggtttatttaagatagttgcagatgttcagttgcctaaatattttaagtgtcactgagcttgttaagaatatgcaaacctgagtatgaatggctcacacagatgtaaaatattgtataaaaacactactgtgcatgatgcattgtaatgtgtacaggaacagatgttgttatggcaaccacatctgattctcagtcataatagtttgagctttttggagaggttatgccctggtgtgaactcagaattttgaaagtgattattttagtatctcatctggtttaaggtgataatggtaactgacttaagcattaacttgcatcatctcatttaatccttctgccattaaaacaatgagatagtgtccttctgcttatgccataagaaaacagacctctagaggttaaataacatgtgtaggatcacaaagcttgtaagtggcagagcaaggatttaaatacagatctgtctaactgtagggtggaccactgcatctttattttctagcaaagaaaagctttactgtgctatgtcaccctacctcttgttaaggaggtttgaagttataaggtacaaattttttacatatggctgataggtaagtttttgtccaggaaaatagtattattagcacaaattttgacttaggctataagcttcacctgtgaaccttttcttttcccctcgttttactcttaccccagtatcctattatctcatacctaaggcagtgatggtttctcagacctcttagattgagaagatgtggcatgggtgtaaggtccctcaggtaattctgagggttgggtaggtctggtatctactcttttacttaattgacttcctccaggctttttttttttttttaatggagtccaggctggagtgcagtggcgcgatctcaacctctgcctcctgggcgcaagaaattctcctgcctcagcctcccgagtagctgggattacaggcg

SEQ ID NO: 101427 - DNA, 7727 bp, Homo sapiens
agccagaaccgagcttctcccatcctggaactaatcccgtccgccccccacccccaaaaggagcccccccacgcacacccccatgccttgaaccagccttctgccaggtctgcccacccttacctgggggaggggggacggggttggggggggcggggagcatgcatggcatggagtgagtctttgcctcccctgtgcaatccttcttccccaacctgccagctttcctcttatcctgaccacagttcaccaccatcccttttccccaatctcagctgcctggtcagcacctctttcgaacattctgagccccaactttgcagtaaggtggtagaaaatggaaatccagagagctgcaaaaagatttttttttaatgtaatgaatggggagtagttttgtgaacacactcgtattcacctcttctttcctctgggaggcctgcctgccttcccctcccccccaaccttgatccctgtctgctggaaaaggcgcgattgcttctcttcctcttctgcccaagaccaagactctaggtctgatatcctttttagccacacacacacaccccccacacacgaagtcttcttaatcttcttgaatttaccagttactctggacacttcttgccataaccccatttcacagacaaaggcttaggagggaaaaagaaccaaactgtttctgtgtttgtcatgttaatgatgtccatccccacacacccagttcccatccctgatgcttcttgtgcctgtatcttgaaccttcagaatgaaaaaaaaaaaaatctcttggatagcttgatacagtttctttagaaatctgcattgttgcttctggtttatggccatggagaaaataccagcccccacccaaaatgcaccgcagccaagtcggctaaaggcgatgagtgttggagtcagtagggggcgcattctctgcactgggtaaggctgcagaggggggaagggcccccgagctagaacaggatgtgcttcacagcgccttctacagaccatgggaaaatgggcccagcaagacacactcgcactcttagttggtgagctgacagcaacatggcgaaggattaagtgagtcaagagcagtgattttacttcttttaaagagcccaccctgcattttagaagttttctccttttactttttcaaaactgttggcccccagtccatatttgttcttgacgaatcaccttggcacatccttggttcggattcccttcctctggagttcttccacctcaagttttgaatgtgtcaccatatctttcctaagtctggtggtaaaggagaaggtttgaaacaaagtaacaggtttgggggcatagctggttaactcccttcttcataggccaaatctttccaattctttgagagttaaaaatcattcttgagagatgttggattaagtgtgtagatgggtgtcatgatttgcaaagccttgttggtaaacatcaagcccatgttgggttcttcattgtcgaactcaagtgttgattgtaaaaatttcgtttccctccaaatttggacttgtaattgccattcattatctcagcagccaaccacctttacaaaaatgttgataccagtcttctgtgagcacccaccttcttagggtgtgttgatttccatagattttactcctcttgttatttccataggtgtgagatgcacaatgcgaaacctaggccccagcttttacaccatgatgcgcagggttgtactttttgtactgaactgataggtggcctagtggttatgccctgtactaccattttgaggatctggactccgtttcctgccttgctctttggaccacattgtcaattcacaccggtgggtatattcattttggagggtgggaactgcagcaacagggaagccagagacttccttctccttggtcaccaccaaaaccaacacttccaaaatttcagcctagccacattcctcaaggaaccggttagagctggttgcagtagtgggttctgaacacttattaacataagaaattacttacagcttttttaagagaaatttttacagatgctaatattgtaatcatttgcattctacacccctttgtataaagtataagtattcagttactattactttgataacccaatctctagagttgctaagcttctaaaagccttaaatgtctgatgaaaacatggttttccatgaacttgttcttgctaccaaagattgacagtggttgatgtttgtgggtacctttaagactttgtatgttacataaatacaccaagataagtttatggagaactgaatgggtgtattctttgatacctagttaaccagttggtgcttaacaggagaatttttcattggagaattgctaccaggtaacattttggtgagtgaaaaggaggccctttggtacaggtatttgactagagacattgcttctacaatttcttagtcattgtgaaaaatcacatatttaaatgggattatttaaatttttaaatactgtatagtatttgtaggcaggtatagtttttatctttatttggtgttttatatgcagttatttaagttctgaaaatgaccatataatttgaagacaacttatttgacggaatgtttgaaatgaagtttgttgaggggcttttgtttgatttagcgaatgggatacagtgttgaatgatgtcctaagtggtaacagccattttcccttaaaggaaaacttgctgtgagctcttagaaagcatgtattctactgtttcaaaggtttcttggttttaacactcaaaaaataaggtgaggccaggtgaggtggcttacgcctgtaatcccaaaactttgggaggctgaggcaggagaatcacttgaggccaggagttcaagaccagcttgggcaacataatgagaccctgtctctaccaaaaaaaaaaaaaaagtgaaacaattgggcttgaagactggaatttatagtaggtaaactatatacttcattaaagtatagtaaaaggttcaattaactagagtgtggggaatgggtattctgtttaactgaactttaagtagaaattccttttttatcttggcctttgttgaaaaatttcctgagactagcttattaggagctatatattgaaactaacctctttgattttggtttttatagttcctgtatagaaaatataggagattgggctgaaaatctcttaatgacccttggcccttccaaccttggaagtcattgattttatacatgcccactgtgaatttgctttgctttgcttaagtttatctttttctccttataccagagtgcaggaagagttttaatactatttatattaaaataagaacttcacaaccttgaacagatggttttggtaccacttgcaagtaaccaaccagtaggcttttatcaggcaaaaatggcttattatttatatttgattattaaaagtataggtatataaggcatactatgtgaagttgttgctttccttgtaactacttacacgttttgaaagtattaaaaagttagtattttgaaaactaaaatactcaagtttattgattaaataagatgatgctggctacaaattttattttgaaaattgcaacttaataaggaagataaagctgttttgtaaaggagaaagtagagattgatacttcatagggtaaaaaaaagaaaaacttcagcatttatgtttcttcttttgagaatcatatataagtaacaaaactgcataaattgcaatagacctaggtcacttgatttcacaattgggtgtgtgtatgtatgtacacatacatataaaatatatgtaggttttctagagctggaaatgattgtcatattattaaatacagatgaaaagttcaagtatcacgtgtagtttggggaaagtacatttagttttgagatgtagtttggggacaatacatctaagtgtagtaaaaaaataccagaattaaactttatgtatgtattttttccaagtaacctatttaaatcttagtgaaataaagatttttaaagtaatatgaaagaaaaaaataggaagtttttattttacaacattagaagcattattgtggtttacaccaaagtacccatgactgttgtgtaaataagctacttgttcaacctggagttccaaaggagtttttaaaagagcatcataaagtcagttatgtcttacataaggtaaaataactttcagtgggagtttaaccttcattctcttgactgagaggcatgtacattaagagaaacattgctcccctatgtgtaaataatttaattatagttggattcacagagcttgacttgttattagcatcgtataaacttaaagtttttcctcccctagtttttgtgtgttgtttgtttgtttgtttgagacagtcttgctctgtctcccaggctggggtgcggtggcccaatgtcggctcactgcaacctctgcttcccgggttcgagtgattttcctgcctcagcctctgagtggttgggattacaggtgcctgccacaacgcttggttaatttttgtatttttagtagagatgggatttcgccatgttggccaagctggtcttgaactgctgacctcaggtgatccgcctgccttggcctccccaggtgctgggattataggcgtgagccaccgctcccagcccctctcctagttttgtaagagcttgtgatagtaactggagtaaatgccgtattttgctgatgtacctcactgccagttaacaccttctatgttgttagtttggaaactcggtgtttgaaactagtataaaccaaagccccatgctaattaactgaattgatactttgaatgtaaaagctgtttcttgtttttactttggcactttccaccttgattgttgagatactttatttgataaaccgtccatgctttgcccattgtgggtggccattgtgatttcatggttttttgttgtttgtctgatcctgtttattagaaagtgaggagaggatgattatgttccttcatcctctcagtgtcttagtactccctacacctgcgttatgttatgacctacctttgcgatctgccagttttggggtcagcttaagtgagaattcatattctgcttcactggaatgagaaggctctcctcacatattatcatgcttctcaagttggtatatatgagccaacttgattatgtagtgtgtgtgtgtgtgtgtgtgtgtgtgtataggaagtcacagataaaaattgagccaactgtggaaagtgacagttttgattgcagggcacacgtttttttattctaatcaatgaaaaatgcaaaattcatattactgtttttagtcctgggtcctgtcatctctgtgtattaattcagtcctctgccttaaggagttccttgagatttcactcacaagctttggtattattgatccctaccttggttccaagacagcagctagagaaagcctggaacctctcaagaatttcagcagtgttctggaaataaagatttagaaaataagaggaaagcatagacaacgttggatggagtttacaaagggaagcctgctctgaatatatgccacagttttagatttaagttaaagatttaatttaaaagcatacacgtaatctaaaagagtcatgcattatttgaccagctgttagaattaaaaatgaatctgcatatcctaataccctcttcagtaagggtatagatttgtaattgagtcacttagctgtgggttgtgtttatatgtcacttctcatgtgactgtgatgactttaataaggatgtgctgcttaagtgtaaaggcccccttgctggcctttatggtattatagtattggtggcttgtctgttttattttccaagcactttataaactattcccaattttctcaggactatccttgtttcacaagtagggaaatcaaggcactaccacatacaatgatgaaatgagccacagagtatgtctgggctggttcccaggcctgtgcttgcaacacaggcctttatggtgctcttgtaagctgtttggctaatgggggctcacatgaatgcttcccatttcacagtgaggttttatgcttccatgtgagcttaaacccaaggattccaatggcgtctacatgtaaagaagctagccacacccccagcagggagagtatgggtgtaaattgtgcaggtggcagttaattggagtagcatatttctgctgggaagttaactgtataagaatctaaaaagaaacgttgtttatgttcccttttcttttcccagttttttagtttaagacagtcagtctgtcctgagcagttacttttttcttagataattgctggcttttaccctttctttttctgaatccttcatgctccatttaagagcttgtggaaacctgtgcttcagttgacaatctgtaaagctctgctcttctggtggaagctcatgacctgagaaccttttgagtggtctcttttgagaaactcctgtctagtggaaatatggtggaatttattaaaattttcaattcgaattataaatttaggttgacagaatccttgctcttgtgaaagaagtgagctgagactgggagtatccaaatgcaagaagtgctcagaatcctgcttcaagatcagttacacttaaaaacagcaacaagaggatgggtgcggtggcttacatctgtaatcccagcactttgggaagccaaggctggcgggtcacctgaggtcaggagttcaagaccagcctggccaacatggtgaaaccccatctctactaaaaatacaaaagttatcctggtgtggtggcactcacatgtagtctcagctacttgggaggctgaggcaggagaatcacttgaacctgggaggcggaggttgcagtgagccaagatggcaccactgcactctagcctgggtgacagagtgagactcagtctcaaaaaaaaataaaaataaaaaacagcaaccaaaaaaaatgcaaataaaacttctctgaggaaagtgtgaaaacttgagccatcaagtggcaaaacctggtacaagaacgcttttgaaaagctaccttcggtgaagccttgatcctgggaaatggcttcgaaaaacttgagaacatagtttaaatattctgttactcaagaatagtgaaagaaatatatttcctattgtgggaaattatttctgagtagtttcggtagagcataaaaatgtattattaggggatcaaaataacgttttatgtcatttagatacaaagacttggcatgcttctgaaataatttataaatggacatatctgcgtgtcctcttgtggtgttgtgatacatactggttttcatccaccacggttcctggctcataacacccataaccccattaccgtgttttgttataatatagggtacgttaggtctcagaaaataatctctgatcttctcctgctctccttacacgtgtcccaaggcaagattctgatctttacccagctttctgattgtaggtcttgagatcctctctagagagagggtgttggccctataccccggggaagggaagtaaggtttcctatatgaagcttttataaaaacccaggagggccaggcgcggtggctcacgcctgtaatcccagcattttgggaggctgggggcgagcaaatcacaagtttaggagtttgagaccagcctggccatcgtggtgaaa

SEQ ID NO: 101428 - DNA, 1009 bp, Homo sapiens
cgccccaggccgccccgcacacccctcccgccagatgtagtccaggcccagctgggcccgcgcagggatccccagcacggccacctgactgagtgctgggcgtgctgcggcccgctgcttctgcctccgccgccggcgctgcggccagaggaaggcgcccgccgagcacacgggccccgggagcgcactgcggccattatccgcggcgcctcctagtgggtcaatggcaaatccgcctggttctcgcgagagctcccccctcagtggggattatataatttccctcaagcgggggtgggggtgctgagagcaccctccctcaggaaaagttaggtgcaagcaggggtgggagtaagaggaaccccccctggggaaaagggggttaggggtgctgtccccactgcccccccctatttagctggacaatgagtcctcttatgctaatgaggcacttacgtcacttccgctctttctcggccgccattttggctagggcaggttcggggactcggtccgaggcgcttgtattgtctgctgaggggagacgcgggatcagccccctcccccgcccgttgccgccgccgcctccgccggcccggtctcccctccgccgcccgccgggatccatgagctgaactcccgcccccccccccccggccgccgccatcttgtgccccctccccctcccgcaggcagcgctaagggggattttggcgtcttctcagacacagctccctctctcggtccccgctgctgaggagcgagaggagcgcggccgccgccgcccgcgccggtgaagccgcctctcccacaccctccgtctcctccctccgcccctcctttgtctgcaccgctcgacgacgccgccgccgcccgccgctctgctgcgcccgccgcgccccccggcagcacccgcggccgcggcgcgagccggagtccgccgagccggagcgcgacgaggccccgggcgcgccctccccgctgccgccaccgccgtgccgccgccatc

SEQ ID NO: 101429 - DNA, 1517 bp, Homo sapiens
tagcataggttatggtcatgtagtatcttttaaaatttgagtaagggcatgctttgagcaagtaagtttaagttgactttcttctggaaataaaagtaagaggtgtctctaaattatttattgaacagtattcctaattactacattttcctggcttaacttggctgctgaagaaattgaggcccagcacaatggcccatgtctataatcccagcactttgggaggccaaggcaagaggatggcttgagcacaggcatttgagaccagcctagggaacatagggagatcctgtctctacaaaaatataaaaaaagctgggtgtggtggcactcacctgtggtcccagctacttgggaggctgaggtgggaggttcacttgagtctgggaggtcaaggctgcagtgagctgtgatcatgcctggacaacagagtgagaccctgtcttttttaaaagaaaaaaaaatgaaaatctgatttttcatttgcatttctctctgacagattctaccagaaatgaatcccagactataaaacctgtggtgtcatttcgaacattaaaaccaccccctcccacgcttctatagttgaacccatagtacacattccaataagggccactcttgttctgtttcccttatgtccagaactgtccagctggccagtgagggaactgctttccttagggaagaaacttctctcattcataacaagaagaaaattcatcagtgcttgatgtgaaattagttttaagctaagataatagaaatgtaatattctcagtttttttggagtggttagaatttattttttcttaacctaaactcaaagttgagttctcagtgtcaagtatgtggagcagaaattaagtaacaaccttagagaacctaatatagatagtactgccttctcagatactcactagagtagataatgtttgccttttaaatctttttagttattcacacaatcattatcacaacactgtcactcttggaatttaccatagagtatttgagcagtgaagactcatagcatttggaagtcatttagaaaagaatctggaatatttagatgcatttttgtagtaaatctggtgcttaaacactgtaaaattaaatatttacatctgaatccagcatcccattttgctttgtaaatgaggccaaagatgaaatccagatgttttcccttgtatttgtattatcactatatggaatctaagtatatctaagaaaaactaaacttaaacttactttgcttatttcatattagtttttatctgtcttctgcagtgtgtaattagattctttagttttctgaatcaaatgctttgccccaacccctttttccacgacttttttcagctgttttcccttgaaatactgacttggcttttaaagatacattttatcacaattgcagaaatgtgttgtataaaagtttgttaaacagggctaactgaagtcttagatgttgaacagctatgtgtaaccacaatttatactacttgcagcga

SEQ ID NO: 101430 - DNA, 1151 bp, Homo sapiens
taatcctatttctgttgtgttggtaatgtggtataccggctaagctgcctaattgtttttaaagactaacgttacttttttttttttaaactaggttccaatatcatttgtggatcgtgtttatggtgaatccaagttgggaggaaatgaaatagtatctttcttgaaaggattattgactctttttgctactacataaaagaaagatactcatttatagttacgttcatttcaggttaaacatgaaagaagcctggttactgatttgtataaaatgtactcttaaagtataaaatataaggtaaggtaaatttcatgcatctttttatgaagaccacctattttatatttcaaattaaataattttaaagttgctggcctaatgagcaatgttctcaattttcgttttcattttgctgtattgagacctataaataaatgtatatttttttttgcataaagtattgctgccttcattagagtatgtgaatgtagaattttttacatggggaataatttgaaatagtctttttaaaaactggaatcatagatctttatacctaattgatctcagaagtaagataatgttaactgatgaaatgtttatggctgtgtctgtatgaattgaaaaagaaatacacacctctgccctttccttaaaaatgtatctcaaatttcttaaactagaaaatacatttagagcaggcatttacagttcggttcttttcagctgttgaattgatgaaacatttcatctatcaaagcaggtctatttaaaatgcatattgtgaattgggaaacaatttgacagcagttgattacatagccgtttttttctcttttgagcaataacctctatcagtaaggaaaaatattaatgacactgaggcagaaacttagctgctacagtaatttttaaacatcttactgaattatataacaatttttttctcaaaagacttgttttcatattatttaaagaccctcagcaaagctcacatccctactaatttgaaaaatctctgccttaagctcttctctccatttagaaaagtgttctgccagttaaaatttgggctaagctatccaataaagccagggcaaatattatgtttacccactttctctaaagtaggtatttcagaagagat

SEQ ID NO: 101431 - DNA, 1795 bp, Homo sapiens
acattggtcaataaatatttattattgaataaatattgctaccatcagattctcctctctccatatttattccaaattgattcctttgaatccttaaggaaactatgtggataaaggattgcacacactaagctgtcaggtttttctaagggctgtgctgtcctatacccacttcatagtcaaaagataaggtcgccttagaagtctgagggaaaaaaaatgtggattcagggtgaaaccctgaggcacagtaggtccagatggccttaactttgaagagaacaaagttacaccaaactgcctcttcttgctttctcccctctccccacaaaaaaaggtagaaattgctgcctccctatgaactgagacactgatctttaaaaaaaaaaaaaaaaaagtgtgactctgaaaatacggagctccctgctatttagttactgaagaaagtgcttgggtctacccactggactgcccaactccgctgtctttgtaaatctggtgtttggcctgcagtccatctaaagttaggctgcacattcacccactgttaagtgtctaactgtgacctcaactggtgataggtgaatcccaccaggattgtttctatcctgtgatgcctcgttcctgttttaacctagcttcccaagctcatcctagagcaacttagtttatcctggggaatttataaaggaaatcatgagaaatcaaaactcatcataaacatttattggaaaatgactgtgaattatgaggttctttcttgtcatctaacatatatagttgcttcatgatcatctgtccaccctgttgttcaatatttggaacagtttctttcaactttaaattttagggaaatcttaaataatggatggttctgcatcaaatgattcattttaccgtatttcactaatttctgatagtatggtgggaaaataattctataaaaagataactgagaattcattttcacaattattctaagttatttagcaaatatttaatggcctttcttgcttaggacaaatgtatcataatcatcaagtgtgcgagcttttctgtttaccaatggccagtgaaagttttaggctttatacataccagtgaactctttgaaaggtcaggatacataggcatgtgtatttatccagaagttgatatatatttttaatttcttacagattataccgaaaagaagttctagagaaattaatagaaaaatgtgtttctaaaggctacgtcttccagatggagatgattgttcgggcaagacagttgaattatactattggcgaggtatgcaactgatgctaaatagtgtgtcatgttcctggtaaaggagcagtaaggtttagaatttttataataaaaagtttaactttcataactgctaaattgtggaggtcttctagttgtttagaatattcatgcacaaagggtaaaaattcatattagtacatttgaacagtaagatttaaaacattaacagtcagcattctcttttaaataattaaaagttcctggtactttctcaatcctagccctttcttctaactaatcagcattatggactgagtctctttgcttcttttccttttgtcaccgccaatggccaccatactttaaaatgaatgatgagttccatatgtccatttcctgttagtaagagaagaccaggaattacagagcaaggaggtggtgatctgtaatatttagggctcgttagtgagctcttagggtagggaagactctcctcatttaatagtaaaactcttattcagagcaagaaaatagctat

SEQ ID NO: 101432 - DNA, 1126 bp, Homo sapiens
aatttgagagacaaggtcttccattgtcacccaggctggagtacagtggcacaatcacagatcactgcagcctgaacctccctggctcaagccatcctcccattgcagcctcccaaatagctgagactaaaggcatgtgccactgtgcccgactaattttttttttttttttgagatggagtctcactcttgttgcccaggctagagtgcagtggcgtgatctcagctcactgcaacctgcctcctgggttcaagtgattctctgcctcagcctcctgagtagctgggattacaggcacccgccaccgcgccaggctaatttttatatttttagtagagatggggttccaccatcttggccaggctggtcttgaactcctggcctcgtgatccacccgcctcggcctcccaaagtgctaggattgcaggcgtgagccactgcacccagcctgtgtcgacttctcttaaaagttttgtttgtgtagctcatgaaaatgactgttgaaagctcagtggctttttctaattgacagctaatttattctacaggaagcaaaaggagggtaattttgatattgtctctggaactcgctacaaaggaaatggaggtgtatatggctgggatttgaaaagaaaaataatcaggtaggtacatgtgttacaacttctttattagtataactactggaaatgtattcatagcaagtatttggattagctatcatgctgcccgggatttgtgggatcaggttataacttccagtaaatactcccagatagtttcttacagtttttcctgtgattagagcctggatgttttttattaaggaaaaatcagcataaacctttggacctttggtagaaatggtctcattcagcaaaagttactgtactggaccttcagttttaatttatgtgacctgttctatacttttggtctaaatatgtagggtttctccccataattatagtgtaattttaattaagattgatttcagacagacctgggttaaagtcttaactcactgcaacctctgcctcccgggctcaagcaattctcctgtctcagcctcccgagtagctgggactgtggacctgcaccaccatgcctggctaatttttgttt

SEQ ID NO: 101433 - DNA, 1104 bp, Homo sapiens
aaagttgggactaggtaagtcgtgtaatctctaacccctcacacctgctgcttgcttggtgacatgatccagtgtgtattttcccagtttggaatagggccaaaatacagtaacttcctatgatggtttttaatgatcttaatgacatttaaatggtataacttgggtcgcctgtataagtcaagacccactcaggaaaacagaaccactgtaagtctttcagtgtagggaatttaatactgagtctctggttacacccctgaaggagttcctgagaaaccaaatggagcagtgaggctactaagattagtaacagctggaggtcactgccacccctagggatggagcaacggcaggaagagatgttagagcccaagaacctgggctgcccagagggagctagaatgatggggcaggggctgcctggcaggagctagaactgtgggaaattcccagtcagaggtaggagggagagtaacagagggaggaccacttagacttttcccttttcccctccctgcagtcttccacctgtacctcccaaagctgtttggcagccagttgacaagagaatctggaatatgtagttcacccaatatagcacagagtagggaagggccagagaatgggtctgagggcaaatatcttggaccagcatgctgcaaaccttggaacatcctttaagttacaagtttaaaaagttactcttcatttaaggctgggcacagtggctcacaaatgtaatcttagcactttgggaggccgaggtgggcagagcacgaggtcaagagatcgagaccatcctggccaacatggtaaaaccccatccctactaaaaatacaaaaattagctgggcgtcgtgacgcgcatctataatcccagctactcgggaggctgaggcaggagagtcgcttgaactcaggaggcagaggttgcaatgagccgagatcacaccactgcactccagcctagtgataaaaacagttattctttatttttaaaaaaggaagcttttccagcttttaaacatacagcattattgaaaagctcatatgagctcagtaattctgagaggaaactctgcctttatttgtgctaaaact

SEQ ID NO: 101434 - DNA, 1097 bp, Homo sapiens
aaccagccgttctggctgcggttcctgctcagccaaaagagccgacgccagcttctgcttcagcgaattcaattcctcctcacgttgggcaacttcagcttgtaaggcgagtacctcctcccgggaagccatggcgacctcttccggaagttgtcgtgaaaggcatttccgcttccgtcttctgtctcctagcgactgggataaactaaaaaactttatggagcttgggaaaaggtgatgaatagatatttacttcctgaagaaaccttcagattaaacttcaaagatgtataaatccagaatatttctaattgaaccacgcaatggccctagaagaactagcgatcaatcacacaggtcatcccccgcttccgaatttggtacggtccgacccgtccttttccgcgccacattacgtaattccgcttccggcatctggctcagttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagaggtagcgcaccaggtctccctccccgaagaatgagatgagctggcttccccggcccgggtgtcggcagctggctgcgcgaagcggccctgtccagccttctttgcctcacacaggaaggcccggggagagggccaccctgcgagggaagcagaggcggatgcttgttgggttttcttcgtgtcctgggttctcattcctgcccttgggttttgtgagactctcatttatctttattatgtagtactcccgtcccccgcctttccgtagaaaggttggccactcttttacttggaagcgaggctgaaagcgtgatcccactcctccctctaggcggtcaggatctgcggcaagagccgggagtccaagcgagagctctcactctccgctccggtgccgagtgcttacataagcatgaggtttggtgtgtgtgggttagggagctattgctgggcacgataacctttctggaaaggagaaagcagaag

SEQ ID NO: 101435 - DNA, 1048 bp, Homo sapiens
gtgtgctatgctggatgtaccatgccagctacctcactcatttcaggatgatgccgccactcaggtgatggttttcagcagcataacttgtggggctggaaactgcaatggattttccctgattccagccacaacccaagataatccttttttttttttttttttttttttgagagagggtctctcactctgtcacccaggctgcagtgcagtggtgcccccatagctcactgcagccttaacctcccaggctcaagcaatctgcctgcctcagtcttctcagtagctgggactataggcacatgccaccatgcctggctcaactttttattttttatagagacacagggtcttgctatgttgcccagtctggtctcgaactcctgggctcaagtgatcctctcgcctcagcctcccaaaaagctgggattataagcgtgagccactgtgcccagccagaatatcataatgttaaaaaatctacataactttctaatatcagcgctagctgtagtctgtttctctctagaaatgtagaacttgaaaaagaatttggttactttagtctatgaattgggtggcagttactcaactcatttcatacactagattattctctgtgctccttcccttcccacccttgataaacccattttggatcaagggcaaagctttgttttcccaggggaaaacccacaaagaacaaatgaaagccccctgccctgaagtagctgtggttgccagtcattcctagacttgagatttgggtgtgttttggtgtgtgctgccttcaagtaacattctggactctctttttgctctgaaccagttcaactttgttttagcaccaattttcctttagtttccaccctttcagaaaaaaaaaaaaaaaagaggggttttcttcctggggaatgatgaaaccatttatttggctcttctctgctgcatttttgacacctctttaattttttatggatccagggatctggtcaagttgtgcctgtgaatagacgcagggctggggcctgttttgcccatccagagt

SEQ ID NO: 101436 - DNA, 1048 bp, Homo sapiens
gagaatttcgcaccaggcaccaccagacctggcccgcccccggtcagtcaaggtcagaggctgagcccgggttcctaccccacagtcattcagcagcagaatgccacgagccaaagagccgccaaaaacggacccccggtcagtgaccaaaaggaagtattacctgcgggggtgaccattaaacaggagcagaacttggaccagacctacttggatgatggtaagacgcttgagttttgtcactgcctgtaaggatggtgccctgaagcatctctgcccaggaagttcactgcatggcctacggattccgtaatctctttgggcctcagtgtccccattttaatttaaggaggttgaataatatgaccctgaaagccacccctagctctgtgcaagaattacctcccagcagtagttgcagaggggaagcagtaacaatttcagatgcccccctccagaatcgcccccatagaaaaagcaaatgagggcaacccggcatcccctgggtcatgaactgggtccatttaactgcttccacactctttccaattgccagatttagactgaggccaagaaaataggaaggaaagctaacctcctttcattcctgtacagaaaaaaaatcccattttatagccctcttttgtatatttgagggagggagagggaggaaaaggaagaagaaagctcattgaaaagtggctttatcagaacagcttgcaggcaggctgcgggcacttctctaccctgtgctcgtggaacagagatgcgcattgatgggaaggaagcagtgggcttccgctgtggtgagcccagctgatgggtggtttgggccaaggaaaagatgcagaggaggctttgtgtgagtctgtaggtgcccgtttgtgggcaaggggtctgcccagagggtagtcttgtggagaagctgtgatgaggtgttggtccaggatctcagggaggaaggacaaaccgcattgctaagactcacctgggagccgcaaggtgcattgggaggtcggagagggtgggatgagcagagcagccttgc

SEQ ID NO: 101437 - DNA, 1042 bp, Homo sapiens
tgagcgctcataagactcaggggtaagaatagtgcctggagaggcaggaatgagggtaggagccaggttgtgcagggccttgagggccacagtgaagcttccacggtatcttgagggcacagcaaagcagggaagggcttgaaatctgcatctgcatgaatctttgtggtgagtgaccctacaagggtcccacccacatgagatctttctccagcctcccaggaaccttctagcctcacaatgatctggtaagtttctctcgtgtaacaaccttgacctgtctttgaagccatctcctttgttattagattatgtcagttgttgcttaaaggctgtgatttaataactactgtgggtctttgcacagccgccttgcttctctgggcctcagttgccttgtctgccagtgcagggctggctagtttctaagggtactctcaagaacctgtgtgctggaattctatggctgtcagtgggtagagttttgtctgccatgcacacccaccagaggtgggaaaaggtctccttcttcgtgttgcgtcccttgacccggagaggacagtccatgagaactctcctcttggtgatgccctttttgttggaccgccattttgtattttctgtttcatctgccacttattggtgtgagcctggaagacagctgggaatggaagctttatggatcctacttaatacttcctgaccacatttccagctactattttctccctttcttccccattatgaacttctgaaaatgatcttttttttttttttttcaaagcaagctcatataagtggaaaaagaaatgatgctgttggtagcagaattcaagaattcaattcaggcaaggagaggctatgggggagggtgacaaaccaaacatcaacatgttgccatttccgctgttcatttcttactcagtcttcaggcttcaagctcactttgcaggtgtggatgaggacccactttttgatgaagaccctaggttggcctgtacagtcacgctcctggtggtgacctctacctgaaaaggggaca

SEQ ID NO: 101438 - DNA, 1024 bp, Homo sapiens
agttcacgctgggaagtccaggctgttcctgacttcagtgggaaccctggcccttggccacagggcctcaggcggagtcgggggtcccagcaaaacattgcaaaacaggaaaaaatctaaggacacaaaaataaaagtgatgtggcagcgggaaaggggttgccatggctttgagcgactcgctgcgcctgggtgggatccaatgttttggaaggttccttcacatgacacagagttttggaatttttcggctggtaaatccttcttaattcaggcccccaggcttggccaactagctccctggctctgtgtgtcctgcgggggcgtaggttggaaactggcctgcatcagattactcagctttgaaacttaaattgtttgaagagaattttttgttttgttttgctggacgattttcttggaacggtctgatggcagaggctcccatcacctgtccagaggacaaattgattttttagaaaggacgcgtgggtggtggaattccctctttcccactgagtcatcatatcctgacatgagtcattttattacttggaggtccccaaaggttgtattttgagctttgtttaataaatataaatgcatatgcttaaaataatttttttttttctaaattaagtatttttccgtgaatttgtgccctggaacaatcggaaccatcttagagcagacacctgctcttcccacctgtttctctccctgggtttggttgtacccggcgtgatgttctctgaaacaatagacctggtatgggagtctctagatggggcttccctctgggaaatgtcagactccagacagggctggggcatgactaaggctctccggacctttgccctctgtgactcatgtccctggtgtcagtggccccccgggctggagcccatcacttacccacagctttgctgggacacgaagctgctctccaaagatgcgatccagattgcaactccgaagctgccgtggagatagagaaaatggtctcgttttcagggatctaaat

SEQ ID NO: 101439 - DNA, 1090 bp, Homo sapiens
cagtttgaattctctagtgtgtttccggcatcaagaggatacatttctgacccttccatgcctaactgaagaatcccaggtgaatgtagttcctggattaacgacaagagacaatcgggggtgttagggacacggtgggcttctctgcgggggatgtctggctctgagggctctctgcagagagggggctcgccttgcatttgctggtcctgctcttttgacctcaagagctcacctcccagcccgggacgccttctgcagggggaatccctgttgctcaacttcttttttccaaaactcatccccgttcccatctccatggacatttggccagcaagggctctgcggggcggggcggaacagttgaagttttccaaggaaggggaatcccagctgtttctcacattaaggaaaggtgacagcctcctgggctaatcttagccccgagtttggtcatcggcaccaccagctccaatgttctttttatagctgtcgactaaaatggaattggcagtttccactccagcaagatgacaaattggagagcagtggaaaaacagtaggagaggggcagcgtggtgtttcttaagttagaaaagcttggtgttttggaaaatggcatcttatttatagcagcaataataataatgattattatattatttgtattactatttttgattatttttgtgactttcaagagcctgtgtgatctggctctgacctcagcttttttgactctctccctgccacttggccatagcaacacctggcttccctctgtcctcaaacaccccaagcccatttctgtctcaggaccttggctttctccgtttgctcttagaatgttcctccaccatttcttttcttttctttttttttgagacggagttttgctctgtcgcccaggctggagtggcgtggcgcgagtgcgcgatctcggctcactgcaagctccgcctcccaggttcacgccattctcctgccccagcctcctgagtagctgggactataggcacctgccacgacgcctggctaattttttgtagtttgtttagtagagacggggtttcaccatgttagccaggat

SEQ ID NO: 101440 - DNA, 1051 bp, Homo sapiens
gaaagtggattttttcacatgctcttttccctctctgcctctctttgtgacatatatatatatttttatggaggtataattaagataaagtagattgcatagattgtaggtgttcagtgatttttgacaatcgcatatacccacgtaaccaccactcaagacagagcactttcttcactcttgaacgttccccatgtcccttcagccaaggccgcctcctcaagcccacacacggaggcagcgctgttctgatttctatcacggttgattaatcttccctgttctagaactttatagaatggaattaatacagtgtgtacccttctgggtctggctgtttttgctcagcatgttatttttgagatctgtcactgctatggtgttattcagtaatgcattcctaattattgctgagcactactattcaattgcatgaatataacaattgtttatttaccattgatagaaatttggtctgttcccggggcttaggtttatggataaggctactatgcacattcctactcaagtccttctgtgagcaaatgctttcatttctcttgggtaaatgacctaggaagggacttggttgtgtatgtttttatttatgtattttcaacatcatagtccactctgaacaaggatgtatgagagttccagttactctacatcctcaccaatatttggtattgtcagtcttttaaattttaacccttctaatgagagtaaaatgggatctcattgtggttttaatgtgcatttccctaatgactaatgattcaggtgcttgttggctatctatgtgtcttctatttttttattttttttgagatggagtctcactcttttcccctaggctggagtgcaatggcatgatctcggctcactgcaacctctgcctcccagcttcaagtgattctcctgcctcagcctctggagtagctgggattacaggcgcccaccaccatgcccggctaatttttgtatttttagtagagacggggtttcaccatgttggccaggctggtctcgaactcctgacctcaggtga

SEQ ID NO: 101441 - DNA, 1015 bp, Homo sapiens
ccccacgggactgacattctagtggggaggcagcaaagagcaaataactatcacatgtggggtcaggtggagggaagcgtcaggtggatgatgcaacttaaggcagggtgtgtggagggacagtgggaagggcgtggggtgtcacattggggtgcggctgtctgggaaggcttctctgatgagaggtcacctgaggacaggttccaatgaagagtggggtgagccctgcaggtcatggagggagagcatttcaagctgagggcatgataagtgttgggatgcagggacgggcacctgcctggtgggtgtctggctctcttgagggtgacaaggccagtgtggctgtcatggggggcagcagggagggaagaagggtgggtgggagatggagaagcagggccagatcatatgggatcttctgagtcatggtaaggactcgggctttttgatgcaaggaagatgtttgctgttggggcgattttagcagaggtggcaaaagctctaacttaccattttaaggatctttctagctggactgctatgtgaagaagactgtgtgtaggtggagggagaggggtgggtaaggagactgggccccctctttgaccagggcactagagtggaagtgatggagagtcacaggtggcaaatttgagtgggatttagggaatggaattgacagggctttgagatggatctaatatgggatggaggcagagagagttaccaagagttagggttgttattgaagtgattaacacacagtcatggcttgttggaatgggtgagagtcaagtcacggacgaagtgtgcctggtctgcttgtgtgtgtgtctgtgtgtgtgtgtgtggtgggggggagagggtggaaggtggggttaggatggcaggtacgtgctgcaactttagcaccccaaaatagatactgaattgggatccatgtgtgtttgtaaaaattttctccccatgtgctgcatggccatggggaattgcagtcctcttccccggtaccctc

SEQ ID NO: 101442 - DNA, 1041 bp, Homo sapiens
aactctatttcattgtaatttttgttttctttttatcattgtatcaaactatatggaaatcatatggttagatgtgagtgattatttgataatgttagtccatttgaatccattttcgatatttcaaaattaaagaatatgaaacttcaaaaaaaaggactgcagggtaagagggatttcaggaggcaatgtggttggaaagaaggggaggagatttgcttgcacagggaggatatgattataagttggatgaaatgtttaagttggactctggcacagatgaagtttatggaggtgctaccccctgggctccccttggtactgctgtgatagagaagacatagaattggctttattgcaagtgcttaaccaagcccagctgatagtgtcagctcctagcagccctgagctaactgggaaaaaatactctgatgaatgatttctgccatatgtgaaaactcaggacatggtgacataaatccatagtgatgcttttcaaaattcccaggggaaaagaagggacagcagttagaaatatgctagaactaacataagcttcattaattgagaagttgctcacactgtctttatcaaggtggaagagaaagcaaagaggaagatctctaccctgtgaacagttctacctgtcatgtgtaagaaatatgtgctgcctcagcattttgttcacatacaatcatgccccccatgatcacattttggttagtgatggaccccatatgtgggggtggtcccgtaagattataatactgttttgtttatgtttttttttttttttgagacagtctctctgttacccaggctaaagtgcagtggcgcaatttcagctgactgcaacctccacctcccaagttcaagtgattctcatgcctcagcctcctgagtagctagaattacaggcatgcaccaccaagcccagctaatttttgtatttttagtagagacagggtttcgccatgttggccaggctggtctcgaactcctggcctccagtgatctgcccacctcagcctcccatagtgt

SEQ ID NO: 101443 - DNA, 1032 bp, Homo sapiens
gccacagcacttcaacctgggcagctgagtaagacctcaaaaacaaaacaaaaatcaccacactcccctttggctggagttcagagagagggaggggagagagtgaatgcaggcgagggtagatgcacaggcagggcccagccaggctgcctggcgggggtcatttatttttacctaagagctgtggggagccattttggaagtaggggtaccatatggaccctaagagatcagcttggctaaactggacagtatttcctctaggatagcccagaaagggaacaaggaggctgaggctcactggggtggccacctggggtcccccaaagcaggaagagggcttgtttctggctggcaggccccggacatggttcttatatttacttattctctcagccactcggcaaatgtttatgggggcttgcaagtgccaggccctgtggtaggtgcttggcagacaatgctgggccacagtgacacgggcccaacactgacggagctctgggtcgagtgtggggttgtaaaattctctaaagggccaaggagtaaatatttcaggctttgggggccattcggttcccagactaccaactctgctgttgtagtataggagcaagctgtagcttgctttgttcaccctgtgtcaataaataggctggctgtgttgtcataaaactatttacaaacacaacccatgggccgcatttggcccatgggctgtggtttgcctgcacctggtttggcagaatgagattccctaaacagatacctggtgcgacgggagctgttagcaggcgtcagtggagaaaagatggcagggaaaagggaaggaggggatctttttgatgggtcgatctcaggaggtgcgggctgagcagatgcaggaaggaaccaggggaagtgggaggatctcgcggggagggtttccaggcagagggaacccaaggcgtctgaggcaggagctgcttaagtacggcgaagaggttggaggggttgttgctgactcagcttggggagaagtggggagtggtg

SEQ ID NO: 101444 - DNA, 1029 bp, Homo sapiens
ctccaaggcaggagggccccaggaaatggcttgaaaccagcaagagacagttcttcccatccagatttgaagatggagatgagtccttatgtgtgccacatgcctgggccctgctgcccccatctaaaaggtgaccttgaggcctgcgggttgcagattccatacatttctccacccctatccaaaagcaatacgtgtcagcgcgtgggttcgtgtgtttttgcaagcggtcatgccagagccagtctgcaagcctcattgcttgtggatcacctcagtcctgtgtcctgggcgcctggccttgcggcagcctgcctggaaggcaccactgagtccttctttcagccccgtctggggaaggcagacagctgtcttagctggggcaaggtcagcaaagacatcgccttcaggatgactttttccagtggttccatggacgagacaggatggcaaatgtcctccctttcctttttggcatttctggacctgatttatccagatggaatttctcgactttcaggcctgtgtctgtatgtgtcacctccgaacgaagggtgtgacaacctgactctggtcattaatacacatgattcattgattgagaatctacttactgttaggtggtgtatgtgtgtgactgggtggggcgtgggcagcagtggtctgggggcttgtcagaaagtttgctgagtgtcagatttgttatttggaggcaacccattgcttttcaaaggggttctttctctaggttgtgcacacctgccggatgaagaatctgtccaccttcctgctctgttttgggattctttgtggcccctgatgggcaggaagttatgagagttgtcggggcgagtggcaggaggcgaggtttgcctctctgtctgctcccctttcctccggctacagatctgcggtgccagctgtggcatcctaagtgctgccttggcgacagactgtcatgtcccaaacccaggccctgggactcacgccacctcggcatcggggtgagctcatcaagccgtgggtcgg

SEQ ID NO: 101445 - DNA, 1003 bp, Homo sapiens
ctggctaaggtagaaatgagaaatgacagggagctctgctatttttctgtttctttctccatcccggtggatggtcctgcctgcctcctgggcatttggatctaaagccctgcacttgaatctttaatgctttttccctctgtggaagaaatataccaaaggcagactgtaagccacatgcagagtggggagattgcttttcctgggttggtatttgggaccctcccgaccttgtaatctgaggttttggaaaaagagcatttcttcagctgggtctgaagggaagaaagtggccagcaaagctcaggatttatgaaggtccttatcaaaacagacctgcttgggcatgcctgcaaaagtgagaatgttaaatgagggggaaaaaaaaccccaagtctgaaatgcctgctaaagttattttaaaggttatggaaaggggctgtttacctgtataatcctaagaaggtgcgctgcaggtctaaaatccacaatgggtgacatcacctctgttgccatggagtagggaggaatgtcttaataaccagggggttggcaggggccactgatgaagtgtgcccacccccaggaacatggcactgaaatgaaagctcctggggaaaagtataaataaagaagctgtcagtcaagaaggcattaattttaaatctctgaccccggccaagggttacacaggccccactgtcttcaagggggaagtttccacttggattttaggttggctgaaagaaaaatggaaatcagcctttcaggctgtgcgaggggatgtggggatcagtaagagaccaaactcgcagaggtggctggtcggagagagggactgtttgctaagttgggcagaggatggaaagaagggatgttcccctgctcatgtcatcttctgcaggcctttgacagagtgggtgggtttagccctggcgagtcctgttgcaggaggattatctgaagtctatttctggggaactcttctgaccaaatctttcct

SEQ ID NO: 101446 - DNA, 1041 bp, Homo sapiens
ctgtgttaggcagataatgaagttttcgcttccatcggtgtcctctctggccacgttaggtgaggggtttgctttagctttgggtatcctcttcccttggatacccagagatggtcattagtaataattttgtgtcttggctggagatggaaacaattagccaacagaagagaccagtcttctagagttgcaatctggaggacatcttttgctttgaaaagatacaattaagaatctgcaaacgatccgcactaatatccgtggtctttctgttcattaagattaaagtcatgtttttcagggaacgaatactcacacccctcccagattggtaatcagcttttattttccttgtcgggtggggtggggggatttccggggaaatagtttccaagccaaatctgaagggaggtactttttatggtttttcttggcaagtgctgcttggtggccaccagatgggtatctaaatgaccacaatgaaagccctggaatctgttttctcaaaaaaaaaaaaacaaaaaaaaaacttcagtttttggaacagtttcagatttacagaaaagttgcaaagatagcacagagagttcccatatacccaataccctgtttccccgtgttattaatgttttacattagtatggtgcatttattgtaaccaacaaaccaatattgacacattattaactgaggtttatgccttattcagattgggaatgttttatgtgaccttcactgttttgaggagtgttggttgtattgtagactgtcccttcattagactagggctctaggttttcgggaggaagcccacaaagataaagctcccttctcatcacatcgtatcaagagtatgtactatccagccaggcgtggtggctcacgcctgtaatcccaacactttgggaggctgaggcgggcggatcacctgaggtcaggaggtcaagaccagcctggccaacatggtgaaaccccaactctactaaaaatacacaaattagccaggcatggtggaaggcactgtaattccagaaactcagg

SEQ ID NO: 101447 - DNA, 1050 bp, Homo sapiens
ctttgcactggtggttccttctccctggaatgctcttcctcctgggattggcttggctggccctcaccttttgtgggtgttcactcaaatgttctgttcctcagcctctaaaattgtaccatcaccccctacacacacacacacacacacacacacacacacgtcttatttcctctaccccattatatttttctctttagcacttctctaacacacatagagtttacctaatttatttgtttattgactcgctgaccgggatgaaagctcttcagggcagacatttttgtccatttttgctcatgggtttctggtgcttacagccagccccggagcataatagacaagcagtaaatatttgttagaggcatggttgggacttgggtgccggaggctggcacagcacatagctcctatcgcgtcagccaggtcttacctatggcggttttctctcccaggtactccacaatttacaccatgtttcctgtgttttctctggtcctggacaaagatgtcaaatcggaagttgccatgctgtatcctgagctctacaaggatcttctcaaggttctgttagcttttcagtccctccttcctcctttcctcctttgcttttcccttccttccctccctccctgctttttttctttgaatttatttcacacagaccctccaattctgatttgaacacacttgaactggtagcttttttacttttggggggaaggtgtgggagtttacattttttcttaaagcagtaatatattcactggtataaagaacgtgaaaaagtacagtaatagataaactgaaaacaagccaactcacgacttgcaaaaagcccctgacagttccgctttgcagttgcaacttaacgtttgctcccagagatgttcttgtgtacagttccaaaaagtgtgtgtggtggcgtgtgcctaggcaggtgtataattttatttgtcttcagggttttttacccaagggaaggtttattcccatgtaatgttaattttaatgttaattctttttttttttttttttgagactaat

SEQ ID NO: 101448 - DNA, 1027 bp, Homo sapiens
cagagctgtggccacagctgggcttgagtcccatagggctgtttacctgctcagcctccccttctgtaaagtgtgggtgatagtagggcttgatcctgtgggctgctctggagatcagctgtgctcatgtacaaagcattcctgggtcctggaacttaataaatattcacaacaggctgagtagaccctggagctgtgatacatcaccctacccgggaatgattcctagatttgctgcttaggaactgtgtgggcttgggcaagccacgtaccctctctatgcctcactttctgctttgcataatgaggatgatgagaatcgtacctacttcatagggttgttgttgatgttgtgagaatgaaatgagcaaatccatgtaaagtaccttacagcagtgccggcgcgggtgttatgtaagtatcaggtgttatttttattctgtaaatgtaagggattttgtcatgacttttggtgacatcctcctctctccttggcacaggctgtcttttcctccgtgttttactttgcctccgtccctctctatcaaggattcctcatcattgggtaaggaaatcctgccaaggaattaattgtttacaaaaccttcttcaaatgctgcaacagagagaagaaacgtggtggaaaaattcttgggttcccaagccacattggattcccagccccagcgaatgcaggcccagcaccatggtttagaacctccttcaattaacaaggttttgagctgttaagcccttaaccagatggaggaagtggagttggagatgtgtgtggtgtgttgcactttgccatttgtacctggtcttgaaaaaatactccagagttatcagttgattgaggagagcaaggtggaaggtttgcagacttggtgatttcactggggtcttaataaaaaggggtgggggatctgaaaaatgccctcctggcctgaactgagcccagtagaagtcccatccttggagctccagggagggccagagtccactgcctcggggatgtgcaagtaac

SEQ ID NO: 101449 - DNA, 1021 bp, Homo sapiens
gttagtagctctgggtttttgcctcttgtttaattagctcttaagggaactgaatgttttaaaatatctatttttaaatgattctttgctacttatggggtgggctgaactcccaaagtattagatccacttgacgtccaaattataactatatgtgattcggaatggtttttatttaaataaattccccttttaaaatcaaatttagacttggaccaccaactgcatatagcttgaaaccaaagaatttctttcttgaagttcttcaaagatttcctacaatgtcttgctttttcagtgaaagaaaatgtgtttgccctgacctcttgtgcttctgatggtgcctaattttattggattttaggaaggaaaacaggcttcgttggctgcagacttctccatcactcaatttaagcatcttggccggttgcttatggtgcatggccggaacagctacaagcggtcagccgccctcagccagttcgtgattcacaggagcctctgtatcagcaccatgcaggtgagtggacagctggcccctctgcacatgtgcctgtggctataccatgtaggtgggtgggcagctgctccctctgcacatgtacatgtggctatgtaattatcatggaaaaagcctgggaattagattatgctttggagctgtcacccctacctcgccagtttaaatcccccacctggctgcattccagctgatagaccttgagccagtccctgaacttcttggtgctcaagattcctcccctgttaagcggtgctggtcattcctgccatgtggtgaggatgtgtgcgttagcagtggtgacatccagtgcctggcatggggcaagtggagtgtacatgagttattttaattgtgggtacgttgttataatttgtttgctggagtgaaagacgcagagttaaatgctgaatgactattcaggccctggtttttcaccttttgcagaggtaagggccatcagagaacaaccactaaagaagaatgtactttgcttgtgtg

SEQ ID NO: 101450 - DNA, 1111 bp, Homo sapiens
aatgagtaacactggttattctctcaacattttttctgtgtgtatattactggttatgagtgtgtatatatttgctatctatacaaatatcttacacatgtatatatatgtaattttcatgtatttttttaaattgaaaacacactgtacattttgttgtgcagcttacttaaatctgctacatcatggatttgttcctacatgagagcatacagagccatcacttcttactctgactctacctttttattttgaaaaatgtcaaaagttgaaatacaacaatggaaaagttgaaatagaacagtgagcattcatctacccttcactttggccaattgttactatttgctacattatctttctttctttgaatcagtagaaagtaaattgtatgtaatgttacccctaaatatttcagctggatctctttagaacaaggacattctcccacacaaagaaagtaacatcataaccacgccccaccccccgccccgcccccccaggcacccccaccccatgtaacatcgatacaatgctactatataatattcatgctcaaccccgtgttaacattgatatataatggtactggataatattcatgctcaaattcccccatctgtcctctgagtgtcttcacagcttaagtaataaaagctccaggaaggattgcaaatcacatttattagcatgtcctcatgtttctgatcttctttattgtagaacacgtttctctctttttgtttggtttggttagcgggtgttttgtttttcatgtcagtgacatttttgaagcattcaggacagttgtagtgtctcacggcacacagttcttgaacccatcagattgattcggttccaattctggtttggcatgagcactgtacaaggggaattggtgttcttcctgttgtgtcgtatccagaggctctcatgtccctctgtccctttattgctggctgtcactgccttttaaaatgagagaattcggccaggtgcagctgctcatgcctggaatcccagcactttgggaggctgaggtgggcggatggcttgagctcaggagtttgagaccaaactcggcaacatggagaaaccccatctctaccaa

SEQ ID NO: 101451 - DNA, 1043 bp, Homo sapiens
aagaacctgactcatttacggtcagcgttttataagctgagttaaaccccagaagggtctgtcttgctcatccaactacatagaaagtccacagcgtcaaaaatgagtgtttcctgtaggacagggaagtgccccctcacctgtacagcctttcccttcttttaggatatttatcactttaagaaaaatcctcagaaggggaattatgcggtccaaggaccgagcttcatagtacctcctgtagtgtgtggccaaatggccctttctagaagcatctgccagtttttgctgctaccagcagtggttgcttggagtcccagagcccttcagccagggcgcttgctgtgttgtgttggggacagcatgagtcggcaggaggtaaacggaacataccaagttcagctccatgttgttggaaactcagctgttgcagatgacaggccggcctcaaaaactaataaacaggacctctgtcacgccatgatttcaggtttggatgctgacaggggacaagctggagacagctacgtgcacagcgaagaatgcacatctggtgaccagaaaccaagacatccacgtttttcggctggtaaagtgtcctctgcgttagggccatgtggggatgatgttcgatttgtcctataacctcctaaccttgagtgggccccttaagaagggaggggcagcatgtgaattacctagggtggggagcatcaaccacggttgctttggatgggatgattaatgacccaggcgccggctggagagtttcttccagtagtggtttgggagtacctccttctagccctgtgctaatgccatgctcttaaccttttgggggtcgtggtccctttgagaagctgatgaaagtcaggcactccccccgaaagatgcagatccactcatacacatgaaattatgcatgggattcctgggatttcacggaacccctgaaagtcaagtccttggataagaaagaaattccaggccacagatactggtccatctgccctcctgagaggggaagcatttaggaccattga

SEQ ID NO: 101452 - DNA, 1079 bp, Homo sapiens
gggcgcggtggctcacgcctgtaatcccagcactttgggaggctgaggcgagtggatcatttgaggtcaggagttcgagaccagcttgaccaacatggtgaaaccccatctctactaaaaatacaaaaatgagctgggtgtggtagcgtgcacctgtagtcccagttacttgggaggctgaggcaggagaattgcttgaacctgggaggcggaggttgtaatgagccgaaattgcaccactgcactccagcctgggcgacaaagtgagactcctcaaaaaaaaaaaaaaagaaatttaggatgggctatagaggaaatgggagagagttttatgtatttcctccaaaatcagtaaaaaggaaaacagttgagctgagctgcaaatgcagagaaatctgaggtggaaggagcaatgttggaagggcttgtcagtcttagtctcagagatgagcaatactaattaagtcttcacttatcacttacttttaattgatgaagtgttttgctgccattctcttaacttggtctcataacattacatgaggacatttaatgggatgaggcactgagtctcaggttaagcaacttgttcaaggttacatgccttggagaggtcatctcctgggaggaggagagtggaaggcatattggcatcttgaagaagaaagatatttcagacagttcatgggagatgccttgtggagttaaagatacattttcacttgtctgaattcctctctgtgtgctcggttattttggggggaggggtgcggtaggggagggagagcacagcagtgatctgatggcattgcctgccctgcctcttagtgggtgtatgatttggagtcagtatgagcagctgggcattgactgcttccttaattggcctcagtttcccctgcatctcactgagtagacatctaattgccctctgattctaatgtaaacccaagccatttccttctagttctcaacgccaggaacagccagcaagagtcatcttaattatgtgagatttcacttctgtgttccctataggctgtaactcttgcctctcggttaacaggtctgctattatc

SEQ ID NO: 101453 - DNA, 1003 bp, Homo sapiens
actaacttctgatcaaggactaaatgaagcaagcggacaattagccttgaaagaagtgcaaacagaggcataattaacacaattgctgatgcttctttcctgctggggacatctgggcaggctgaccataagtcataagccaaagatctatgctcttttgcgtatcttcagctttctcctacatatgtggtataaaaaatcgacctgatatctttccttttccacttctttctagatagttgagtgatgctctctgcttactctttctcatttacagaatcacctgtaacctcaaggatctcttgagtaacaagagacaacaaatttttcagtgtagcacaaaacccatgttgtaccattatctaggattgcaattaatgtgacttaaatttcaagacctaagaatgcacctttttcttttttggagttgtatgtcattgtggttaatcagaaggtataataatgtagggaaggtgcattcattaatggggaattgtttagctaataattaaattgaaactttatattcctaaacccaagtactacttatgtttcaaagtataagctctgtccagacatggagaacactaagatatgcattatgatttttttttaaagaagagaatggtatggatagacttttcaatgttactgcagcaaaactgctgcaaagatccttcactaaggacctcaaagacaattcagtgagcaaagaattcccttcccaaatttcccttgtctgagattcagagcatcagcaggtacaagtgaatcttacttataacagattttgctgaatactttttcatactgcctggtacagatataaagttttttttttgtttgtttgttttttgttttgagatggagtttcgctcttgttgcccaggctagagtgcgatggcgcgatctcggctcaccacaacctctgccttctgggttcaagcgattctcctgcctcagcctcccgagtagctgggattacaggcatgtgccaccatgc

SEQ ID NO: 101454 - DNA, 2190 bp, Homo sapiens
ttgttgctatgctgctttgcaaaaagttgaaaaaataaaaaaaaaatgcataccaaaacaaatacagactctttttttttgagatggagtctcgctctatcacccaggctggagtgcagtggcatgatctcggctcactgcaacctccccattctgggttcaagtgattctcctgccttagcctccagagtagctgggattacaggcaggtgccaccacgcccggctaattttgtattttgagtagagactgggtttcaccatgttggtcaggctggtctcgaactgctgacctcgtgatccacccgccttggcctcccaaagtgctgggattacaggcatgagctaccacgcctggcactttttttttttttttctaattttggaaagaagcgggtcttgcaaagtagctttgttacttgtaacagacgtatacatagaacctttgtacaacctagagtgactttttccaaagactgttacctatttcaaggtagaatcgttggaacttactgaacaacagtggaaaagacaactacacagcctcattgaggggagatgggtactgtatacttactggtaactggacacgggtaaaaggacaaggtctgtcatctctttagggacctgttttatatgccccaaccctgtccccatcttattgtttttttttgaatgtacttaaaaaaggaacaacaaaaaactagggttgtagaattataaaactgcttcaaccttagaaccttaagtaggaggccctcaaatggacttacgttagtccttagggagtcaatgtgtgtgttgctgcttatttaaatacagttcagttggagccccgagagtgccaatgttttccccacacctcttggatgccttcctcttcccaaatcccagaagaggtgggcacctgagcggggaatctcaggtgacttagtttgccagtgcctactctattgaagaactgggttttcatgctcgagaagaaactcgtggaagggcgtgtttcccatcacaggttcacatactgattgcttttgttgaatttccttggtgcgacttatgccaagtaattatgacgattttttgttttgttttgtttccttgctgaatatttcatgaaggctacgaagttagaacaggcacgtcctgggtgtgaaagctttaatttatctacctcatttattttttattttttgtagccatagtgtctattttcctattttaagaccgctgaagtattcccaggccctgtctaaagcctaagagttgatgtattggtgggaagaggtgaacgttcaagatgattttgtgatgccttttttttttgtagtttcctttgtaaatgtgatattgagcaaacgaaacattgctcttggtttaacaagaaagaaagaaaaaaactctaatttctgggagaaaagtctttcccctctatgtggaaggtcctgacggaaatatgcatccaagacgattagccaaagtgttgtctcttcatcgttgcacctgactttaggattccgccccccttttttttttttttttttttttttgccaagttgtgcctttccttctggaattgtaagtgaacacgataatagtacctgtttacactgtgaagtggatattgttacagaaaacacaccagtggctttctcactgttgagctaataatgccttgtgaatgtatgatctacggagaaacccctgtagttgtacctgctgatgctgtctgtctgttggaaaataaaatttgaatgtttttttttctcacccaggtgtatataaatttttctggtactttctgctctatacctgagaatctttacttgacaatcactttcagctgccttgtgacactcttgttcctagcgtcaaaaagatgcacacctggctatgtccatacttgcctcactttttttttttttttgacagtttccctcttgtttcctaggctggagagcaatggcatggtctcggctcactataaccttcgcctcccaggttcaagcaattctcctgcctcggcctccggagtagctgggattacaggcatgcgccaccacactcggctaattttgtatttttaacagagatggggtttcactatgttggtcaggctggtctcaaactcccgacctcaggtgacccgcccacctcggtctcccaaagttctgggattacaggagtgagc

SEQ ID NO: 101455 - DNA, 1753 bp, Homo sapiens
agagaaaacggttccgtggagagcgatggcttgaccaacgactcatcctcgctgatgggagaccaggagtatcagagccgaagcccagatatcctggaaaccacatccttccaggcactctccccggccaatagtcaagccgaaagcatcaagtcaaagtctcccgatgctgggagcaaagcagagagctccgagaacagccgcactgagatggaaggtgatagagctttggatttaacttatgtccattttgggctcaaggtcatcaaaaaggagcctgggttgaactttacaaacggagagtatgacttgaagcagccccttctatagggcaattagcttttctttacttctgggtagagggcaatagtaactgcctctatcctagtaacgaacatgcttttaatttatgatggttaatgcaaaatgggtatggacagcataccttttttgttggtttttatttttgtctttgagccccttgggacataggggtgggtagtcgttctattttgttatagtttttttctttttgtttctccacactatgattctgtatatgggtgtcttaagagtatgtttgaggaagtggccactgctttttgaccactgaaataagccgtggttccctgactctgaggccccactgcctgatgtaatgttcacaaattagccactcttgaagcagggaaagatgaacccattttaaatgcacatatctattgagaggtttgttgatgtcattaatggtaaaataagggaaaagctgtatcaaagaatcaaagaaagatggtgtctgggcatatgctttaaaggtagtttcttatgcagaaatttgaacttaaattacatatgtgtttatatgttgcccatgcctttaaaaaaaaaaaacccaaagtgataccttttcccaagcatttgaagctttattctttgtgcagataaacaattcaaaggggaaggtgttaattacttacaaagccagctccagactctcaaactagcaggcagttatttttaaagatctcttttgctttgaagagaaagaatgaaggttggatgataaaggtctggcttttttcccctctgtgtactaggtcggagcagtctcccttccacgtttatccgagccccgccgacctatgtcaaggttgaagttcctggcacatttgtgggaccctcgacattgtccccagggatgacccctttgttagcagcccagccacgccgacaggccaagcaacatggctgcacacggtgtgggaagaacttctcgtctgctagcgctcttcagatccacgagcggactcacactggagagaagccttttgtgtgcaacatttgtgggcgagcttttaccaccaaaggcaacttaaaggtgggtttgtgtgggctttcagcaggatgggggctaggcaccaggtgtcttcttattggcacaagccgtgatgagttcttccatccttccattcctcctttgggaggccgaggtgggaggattgcttgagtccaggagtttgtttatttatttatttatttttgagacggagtctcactctgtcgcccagactggagtgcagtggcgccatctcaagctcaagctcactgcaagctcctcctcccgggttcatgccattctcctgcctcagcctcctgagtagctgggactacaggcgtccgccaccatggccggctaatttttttgtatttttagtagaggtggggtttcaccgcgttagccaggatggtctcg

SEQ ID NO: 101456 - DNA, 1629 bp, Homo sapiens
ctaatttttgtgtttttagtagtgacagggtctcaccatgttggccagactggtcttgaattcccaacctcaggtgatctgcccacctcagcctcccaaagtgctaggattatagatgtgagcgacggtgcccggctccccccacatcttttacttgggcagagtccttagctttttctgtcttgttacaggtgctccagtgaaccacccagggaatgacgaggtggcgagtgaggatgaagccacagtaaagcggcttcgtcgggaggagacgcacgtctgtgagaaatgctgtgcggagttcttcagcatctctgagttcctggaacataagaaaaattgcactaaaaatccacctgtcctcatcatgaatgacagcgaggggcctgtgccttcagaagacttctccggagctgtactgagccaccagcccaccagtcccggcagtaaggactgtcacagggagaatggcggcagctcagaggacatgaaggagaagccggatgcggagtctgtggtgtacctaaagacagagacagccctgccacccaccccccaggacataagctatttagccaaaggcaaagtggccaacactaatgtgaccttgcaggcactacggggcaccaaggtggcggtgaatcagcggagcgcggatgcactccctgcccccgtgcctggtgccaacagcatcccgtgggtcctcgagcagatcttgtgtctgcagcagcagcagctacagcagatccagctcaccgagcagatccgcatccaggtgaacatgtgggcctcccacgccctccactcaagcggggcaggggccgacactctgaagaccttgggcagccacatgtctcagcaggtttctgcagctgtggctttgctcagccagaaagctggaagccaaggtctgtctctggatgccttgaaacaagccaagctacctcacgccaacatcccttctgccaccagctccctgtccccagggctggcacccttcactctgaagccggatgggacccgggtgctcccgaacgtcatgtcccgcctcccgagcgctttgcttcctcaggccccgggctcggtgctcttccagagccctttctccactgtggcgctagacacatccaagaaagggaaggggaagccaccgaacatctccgcggtggatgtcaaacccaaagacgaggcggccctctacaagcacaagtgtaagtactgtagcaaggtttttgggactgatagctccttgcagatccacctccgctcccacactggagagagacccttcgtgtgctctgtctgtggtcatcgcttcaccaccaagggcaacctcaaggtgcactttcaccgacatccccaggtgaaggcaaacccccagctgtttgccgagttccaggacaaagtggcggccggcaatggcatcccctatgcactctctgtacctgaccccatagatgaaccgagtctttctttagacagcaaacctgtccttgtaaccacctctgtagggctacctcagaatctttcttcggggactaatcccaaggacctcacgggtggctccttgcccggtgacctgcagcctgggccttctccagaaagtgagggtggacccacactccctgg

SEQ ID NO: 101457 - DNA, 1128 bp, Homo sapiens
tgagtcataatgcttttatcaagatatacaggttttactttttaagcatttcagtgtctccagaatttgattggccactagtagatgaactttcttcctatacaatagtaagagtattttctatccatttggcagtgattgaatctaagacccctgctgggtttactgcattcttccaacttattggataactagatgctgcaagataacattcctaaaattcggggtgggggtggggtggagaaatggaagaactagttgctgtgtaatccctctgaactttgctttttttttttcctttttggttaacttaagcatgcccagcaattgttcataacagaatcttcttactccttggcaaatacagttgcggtatttaccagtggtggcctggatgtagaagcactttttactgcacaagcaaacagagctgctgctgttttaagagtcaagtgggatgttgctggtggaggctacagaagaggcaagcttgtgtatacagcaaaggcaagctggtattcaggctgtaaatcactctgggaactgctggatccttctaggggagggagcttaaccttttttgtgccatagatcccttctcaacatagtgtataaaatacatagatgaccaaggaaataaattgcattgaaatacagtcatcaaaaatgaaaacatttttaacttagtaatatcagctactttattaatacaataaataacaagatctagtagcctgtcagataacaagaatttccaagtcataacaacttgtaacactatatgaaaatatctgtggtctccactgatgacaaagtcacaagttctattaataccactgtggtatgttgcttatattcatcattgaaagaaaggttgaattttagttcagcttagtgaaaattagtatttttttcttatctaatttcatagaccccctgtttaaaaatgcctgtgttaaatagaacatgcattttcaatcaagtgatattttcaccaatgggatgaaaacgttttattgatagtacagtggtttgtggccttccaaaggagataaatgtatataatatgtttgtgatattagaactttataagtggggagctattagggaaaaataacttaaaagcct

SEQ ID NO: 101458 - DNA, 1007 bp, Homo sapiens
cgaggtcccaggcgcctggagggactctctttgtgccttggttgggggcggggtggggtgggggttgaggggagcgtgaaggcttcgtggcctggcccacctggaacaaaagggttaaccctcagcccgcctgcttcctccggagaggaggggcgagctcctggttctgacccctcccctggtcctacgctgacctccccttcccccttcattttgggtgggcgcacacacgtggggcttttggtggtgtttggcacctttcgggagggaagcttgttacgagagggcttctgaaattaacgatggttggagtttggaatcagagtcaacctgagctgagctaaaacctcgggcctggccgtgcgctgccactgcgatttgggagggaggggagttggctattgatcaccagggttgtcgcggacagcccacccggcttgcgcgcgggcgccccctggaggcccagcttgaagcctagccctttgctgggaggcggggtcccttcgcaggtactggctcacacctggtgggtgggacgggttgtgggggtgaatggagagtgctgggctgggccaaggatgggtaccctaggggattcgtgccggtcgcctgcttgatcgtcgtctgtgcccgctgttctttgccaagtgtggaattcttggtaataactcctggcggctagaatgtgtttgcagagcctccaattgcctccttgggagagaaggttgttttcccaagcagtgcgtttttaatggctgcgtttgggttgtttgcatttgagctgcctaaaattatatgtgttaggtatataatgtagacatacatatctaacttagatgtatgtatatgtctcacataattttttagaatgcagattgagctggtcttattttgcaaagccattcgagaatgcagtttttgagggaggaaaatgacgtctggcgatcaattagcagatcaaaaaatctgcaggtggtcgcagggctaacactacatacaggaaaaat

SEQ ID NO: 101459 - DNA, 1082 bp, Homo sapiens
gccgaaggggggtaaatttcccaactccaggaatttgtggcggagagggcaaataactgcggctctcccggcgccccgatgctcgcaccatgtcgaggcgcaagcaggcgaaaccccagcacatcaactcggaggaggaccagggcgagcagcagccgcagcagcagaccccggagtttgcagatgcggccccagcggcgcccgcggcgggggagctgggtgagtggggctggggcgcccgcccggggaggggagcttcccggacgtacgcgggatcctcgagggcgcaggcttcggggagcgggcggcgtccagcgcaaattcaggagccgagatttgggggctcagtgcccgggaggagaggtctcctcctctccccaccaccccgccttttgcacatttcacacttttttcctcttctcccctcttgtgtaagtttcacccccagctttctcccctaattgtaaaattgacccccactcgctcctctgttctcgctcccgaaaggttcccttctccttgtcctctgcccctcacttaattggttccactcccctcactggtgttaccccccccccttgtaacttaggtccccctccctcgcgtcgctctcaaaagaaagaaccccgggggatccccaccctctccaccagccccttggggcttttcttggaggctggaggaggggcgcacccctggaagaccccccggaggaggacgatctgttgcacgcgcccctcccgggccaagtggggggagggggcgcgacctctccccaccctcaggagctggggtgcgggccacccgcgctgcgcaggggattggagggcccagagaggtgggggaggagggctcaatgtttccctttaaaatttttttcttttctggatttcgccttttctgcccgggctgcgccgcctgccgatcttcgccctaacctttcggggcctgacctccagccatctttgatttccgacttcctaaaaataaccgcggcaagcccgagggtgcgagcccccagtggccggggtggcgggcgcgcggcagccccactggggtgcaccggcctcccgttttgcgtg

SEQ ID NO: 101460 - DNA, 1056 bp, Homo sapiens
aaatctagaattgcaaatgtaaaactcccgccttccgacaaagattatgctgatgaaactgaaagctcaaacacaagcagaaatgatcagatacgggaatatccatgaaggaaaatgccaggggcaagtcacacgagccatcccccatcccctattattattctgggaataataataccttcctcaaagagatgtcctgaggattaaaaataagaccgtttttcatgtcaggcactgagcaacccctccatgcttagggagggcttaacccaggttcgtctagttcccttcccccaagcaaattcctcctccaacgtttccaatctgtccgagaaatccctgtggttactgtgtacattatctggatatttagctagtaggcttacccaggtggcatattgtaactttactccgacaatttggaaaaacaaacagagcagttctgaccttttccactggttttgcttctgcatcccctcaaagcctgcccattcgataggatcctatttaaagatgatagtctttaaactgggaagttccaaactgcacatggggtgcgggtttggccaagaggttccttttttgttttaccaccttaaaatgctaactttgctaatggccgagattgattatataaatgttcttgcttttgtttgcacttatctgatcttgtcctatcaaggggcttaatctcactcttactggaaattacaatttagtccattttaggatggccccaatctttcacagctgtttaaaggctgtgttgtgaaaacaacccaaaatggtactaggtttgttctggttacacaactgtggggaggtgggaagtgaagcgtgtttgaaagtcactcatttaaatgtcctcatgaaatatatatatttatttatatttatatatttatataaatttcatgaaatatataaatttatatataatataaatctataatatgtatatactatataaatatatataatatataaatataatatataatatataaatataatatataaatataatatataatatataatatataatataaaata

SEQ ID NO: 101461 - DNA, 1024 bp, Homo sapiens
aatcccaagggaaagactgtctcaagctttaagtttataaactagatggtaacaccaacaattcagttctctggttggttggttggttggttgggtggttggttggttggttggttggtttttttgagacagggtctcattctgttgcccaggttcaagtgcagtggtgcgatcttggctcactgcaaccttcttctctagggctcaagcgatcctcccaccacagcctcctgagtagctgagactacaaggcacacaccaccacacccagctagtttttctatttttagtagagatggggtttcaccatgttacccaggctggtcttgaactcctgagctcaacctgaccacccacctcagtctaccaaagtgctgggattacaagtgtgagccacgacgcccaacccagttctctattttaaactatcacttctcccttatcaggtggtgtggcatacggaacaacctttgtaaagatctggtcaaactttgaaagtaaagtaatgagaggaaagcgtactttgtatatttctgttaagtctctgtaaaccaagaagacaagatggcatttgtttgtttgtttttttaaataattagattctgaactcctgacatccatgtctagctacttttaaacagacagaatggtctcaggaagaattttatcccagaagacagtaggttcaggctgggcgcagtggctcatgcctgtaatcccagcactttgggaggccaaggcaggtggatggatcacttgaggtcaggagttcaagaccagcctggtcaacatggctggtcttttctttttagctcccgcatgtgtgtgagaacgtgcaatatttgtatctgccttgtctgtgcctggtttatttcatttagcataatatcctccagttccattcatgttgttgcaaatgacagaatttcatgcttttttattgctaaataatatttctttatttctttttctttcttttctttttttttctttttttttttttttgagacaaagtctccctctg

SEQ ID NO: 101462 - DNA, 1048 bp, Homo sapiens
agatcgtgacgcagagggccttccgctgtgagacctgcggcgcctccttcgtcagggatgactctctgagatgccacaagaagcagcacagtgatcagagtgagaacaagaactcagacttggtcaccttcccaccggaaagcggtgcctcgggacagctcagcaccctggtctccgtggggcagctcgaggctcccctagagcccagccaagacctctagctcagccgaagagggtggtcagctgtcggaacttctgaccagtgctgttgcccagccctccagaggtgaggccactgagagacaggctttgggcaccacttctggggctggccgctccaacttcacaggccttcagaggcgatggctgggcgacagtgacgaaagcaaagcaaagcagggctgtggagacactcctcgcatttgtctcttccctccaaggattatctgagcaagtcgacttgttcattcaaaggcggggtctgccaagccctgctctatccaatggggatagcttctacgtaacggattccaattttaaaactgatccatctctgatggaattattaaacttagacgatatagaaaactaaaactaatctctagagtggaaagggttaaagtgaggaaggtgtacgtgaagggtctggggttgctggaaaacttctatttcataacctgggtgatcgttctaagagtgtttgccttatatgtttgtgtggtttcttttacctgttgtcttacaataaaaaaggcagactcatggtagcatgatgtaaggaacactcaattttgcagccctccacagacagttacggtagaaggttctccatccccagcccgcgccccattcagtaacttaattataaacgcacattggatttctcaatgagttcctactgtagtaaaacgaaatgcagtttgatctggaggtggcgccaaagatcaagctaactagcccagcctgtgcttgtctgttgtggaattcaaaattctgtttaattctatttggagagaaaagtccaggggcccagtgggccctgagcttg

SEQ ID NO: 101463 - DNA, 1021 bp, Homo sapiens
tgtgataattgtgagatttgtcatttttctgttgccggaacaacaacttttggtaaaatatgactgacagctgggttttatatcttgactatatagaatccagctgggagtagatacccactataactgccaagaagccaatgatgtatctcaagtcagacctataaactagatgtttcagtaaatgtatacactgattgcatggctaaatttggaatgtagcaggatccattaagtataattaaaaatcacaaacttttaatcttaggaacttcctttatgggaccctactgaaatgataggaccaactcatcgtggcatggaaaaatggggtttgagatattcataaagatgctcataagttgaaaattttcaatgaattcctggaaaatggtgagcagacaggaacatagtgatgtttaaaactgagtatagaaagctgtgtcccagcagacaaatgggaggcagctgtacagttggaagccaaagtttccagccaatatccaagggccctgagggctctgggcttggaacaagcatgtagacagccagggccacaaagcttgggggactagccaaggcctggcaaaactgcccaaccaacccagtagcaggtgaaacctctggcatccatgtctaatcattaaaccagtctactttcccaaatatagtccaccaaggatcatgagtcatctataggaaatgaatggaataaaatgagccaagtcaataactaatcctggaagtaagagtacttgggtaattttcacattctaattggtgtctacccactggcagaaatgttgcatccaaatagagacctatgaagagataatgagaacaaagaagtatgaaataaaactaggattgctagctataaaattaatgtcccagagattacgggaaaaaaattgggtgagtgaactgagaataagagccagtcctgaagtctggtttctgaccaggtctaggaagaaaagaaaatggaagtgagaagaaaatagagtgaaaatagaaaatc

SEQ ID NO: 101464 - DNA, 1280 bp, Homo sapiens
catccacgagcgtatccactgcaccgaccgccctttcaagtgcaactactgcagcttcgacaccaaacagcccagcaacctgagcaagcacatgaagaagttccatggggacatggttaagactgaggctctagagaggaaggacaccggcaggcagagcagccggcaggtggccaagctggatgccaagaagagtttccactgcgatatatgcgatgcctccttcatgcgggaggactcgctccgcagccacaagagacagcacagtgagtacagtgagagtaagaactcggacgtgaccgttctccagtttcagatcgaccccagcaagcagcccgccacgcccctcactgtgggacacctccaggtgcccctccagcccagccaagtgccccagttcagcgagggaagagtcaaaatcatcgttgggcatcaggtgccccaggcgaacaccatcgtccaggctgccgccgctgcagtgaacatcgtcccgcctgccttggtggcccagaacccagaggaactcccagggaacagccggctgcagatcctgcgccaggtcagtctgatcgccccccctcagtcctcgcggtgtccgagcgaggcgggcgcaatgacccagccggctgtcctgctgaccacccacgagcagacggacggagccactctgcaccagactctcatccccacggcctcaggtggcccccaggaaggctctggcaatcaaactttcattaccagttcgggtattacttgcactgactttgaaggcctaaacgccttgattcaggaggggacagcagaagtgacagtggtgagcgatggaggccagaacatcgcagtggccaccacagcgccaccggtcttctcctcctcttcccagcaagaactacccaagcagacctactccatcattcaaggggcagcccatccagctttgctctgtcccgccgactccattccagattagtgcttaaaaaaacaaaaggagtgggggaaaggaattgagaaaaagaaatcttaagtagaattctctaaaaggtttgctcttaatgttttctttgttttgttttgtttttgagacggagtctcgctctgtttcccaggctggagtgcagtggcgctatcttggctcactgcaacgtccgcctcccaggttcaagcgattctcatgcctcagccctccgagtagctgggaccacaggtgtacgacatcatgactggctaatttttgtatatttagtagagacggggtttcatcatgttgaactcctgacctc

SEQ ID NO: 101465 - DNA, 1023 bp, Homo sapiens
tgtaatctttccctggtgagccatgaactctgctgaaacttaggtattctaaattttacggtgcatctctgttgtgaaaaggaaaaaggagagagtgaatacaagggaaaattaacaaaactgttactattttacgtacctatactttaaaattttaattgccttctatttttaatttataaaaaatttataagaaattcatattcatcattttaaaaattcaagtaataccaataaggaacatggaagaaacttcccctctcccaagatgttagctctttgccaatcatccacccagtgttttagggtttttggaatattcttcggtggttgtatatgacttttttcgtaaggcagtgggaaataagccttttccttttttaatcttgtttcctgctgccatctgtgtgtgtatgtgtttgaaggagacaaaccccataagtgtgaagtctgtggcaagtgctttagccggaaagacaagctgaaaactcacatgcggtgccacacgggcgtgaagccctacaagtgtaagacgtgtgactacgccgctgccgacagcagcagcctcaacaagcacctgaggatccactcggacgagcggcccttcaaatgccagatctgcccctacgccagccgcaactccagccagctcactgtccacctgcgatcccacacgggtgagtcctgcctgttatttgctctctacgctcctcactttctatggcataaatcataagcaccttaaagcattcagccacaatgtaagaaatcgagttggaacctttgctcatcccgttgtttgcagttttgtttttttttgttgttgttgttttgtctcgctctgttgccctggctggagtgcagtggcgctatctcagctcactgcaacctccacctcccaggctcaagcaattcttgtgcctcagcctcccaagaagcatgttgcaccacgtccagctaattttttgtatttttagtagagatggggttttgccatattggtcaggctggtcttgaactatt

SEQ ID NO: 101466 - DNA, 1051 bp, Homo sapiens
gacagggtttcaccatgttggccaggctggtctcgaactcctgacctcaagtgatctgcctgcctcggcctcccaaagtgctggaattacaggtgacagccactgtgcccagccaaaatgctgatctttaataaacttttagatgtattcttaaatcccaaatatttatttatgacgacagtgatcagctttggctattttagcacttggctagttacgatttggtgaaaatacatatttgatatataaagtaaaaaaaagaaaatcctgattcacagccacctccttccatgaccaaaagtcagctctcctaatagacctctatgtctcattctgaaatatttgcatgcctagaccaggtctaaaaacacacacatttaatttttccatgtcttactaagttaatatgatacacgctatcagtgcaacttgcttcttttcatttactattgcacatcatttcacatcagtatgtcatatcgacttactctttttcatggccaagtaaggaatgggttcagtaatttatgcacatccatacagtgaaatatttcagccttaacaaccgcgttgtgggtatgtaatgatatgaaacaggtgatcgaaattaccgtacatgcaagaaagtagtcaatagggaggcagtgcagtatttggcaaaaaaaaaaaaaaaaaaaaagaaagcaatcacaagacggtcctgggttctaattccagctgttgcaaggattaactaaagtaattcaaaggcacagtgccattcaaaaaggaagtatttaaattgatgttagccaggaatttttatgtaccaaaaacatacacacacagagattggaaaaatatacatcaaaaagttagcagtagttcacagatgtcaagttgacatagcattagtgaggttcagattaagctgctgtaagaatgaaactgaaacaccagctcaaacaagatagggatttgtatctgtcccgtgtaactgtccggaggtgagcaggcaggctaggacaggtgggcagctctgtcctagggaccagccaggcacttaagttcc

SEQ ID NO: 101467 - DNA, 1030 bp, Homo sapiens
tccagcctggaaggtcaaggctgcagtgagctgtgatcatgccactgcactccagcctgggtgacaaaatgaaaccctatctcagaaaaaaaaaaaagaaaaaagtatagatttgggtggcttcagagctctgactcagcatctgatttccatgtttacccttatggttacagaatggctgccacagatccaggcatcacatcatcactccagcatatacaaagacaggaagtagggcagccagggcagcaagatgagcttttctcaactgcttcttttaccatctgccctgcccaccctgcccccccatgctattttaaatcagggaggaaagtcttttgcagaagtctcccagcggatgctctctagtgtctcattagctagaactgggtcacatgatcactgtgaagccgcaagggaggctgggaaagcaaactagtacatgcattctctctacaaaggaaagtaggcagacaccatagctagcgggcatttatattaagaaaattaataatcaccatatcttttagtttcagctccagaatttgtttttgaacatggctatcaaacttacctgcccacggaaagtaatgaaaaccagacagccactgtcatctctctccctgccaagtcacgcaccaaaaagcccacaacaccacctgctcagaaaaggcttaactgttgctatccaggtaaaggcagcattatgtcctacttgtgtagagggtgtgatatttaaccaggctccagggctcctcctcatgagttcctgacaactgctcatggatgtgttccaaactacctggcataaaaatcagagccccctggcatttacatcagcacatacaacctatctcccactgtctgtggtcattctgcctctgggttctaagacttttctagccataggcctttgaagtggaactcgtgaaaatttcaggttgctataaatttttttcctatgctatagcttaggaagatatccagtaagaattttctttccttactttggttttaatttattcagaaa

SEQ ID NO: 101468 - DNA, 1019 bp, Homo sapiens
ttgtatgtatacgtcaagagagagttaggtatggccaggtgcagtggctcacacctgtaatcccagccctttgtgagggcaaggctggaggatcacttgaggccaggagttcaagaccagcctcgtcaacatagcaagaccccacctctacattaaattttaaaaattagccaggcgtgatagcacacacttgtagtcctagctgctcaggaggctaaggcaggaggctcgcctgagcccaggagtttgaggctgcagtgagctatgatcgtaccactgcactccagcctgggtgacaaatgagaccctgtttcttaaataaaataaaaaagagggatttaaacaaataaatatcaaagattccaacaatggaatatgacttagctttggaaaggaggaaagttggatctgtgtgtagtcacagaaagattctcaaggtaagtataaaaaaaatacatatgcctacatattatatggtcttatattccagggaagtttctagaacagggatggggcggtaatgtaaatgagagaagttatctttgggggaggtgttagagagtggtggggactgtggtgaagtagagaaatcacacatgcctcatccaaaagtgcagctgttctttggatccagccagttagatatttcagtttttcagagaagctgaaaatgtgaaattttccaaatataaaactttgttgccaaacaatacatctctgagcctgactgagtccataagtttcttctagcttattctcagagaatgtttacccaatagtctggagctgaagagtgaggagcatcagacgtcagggccaggcgcagtggctcacacctgtagtcccagcactttgggagaccgaggcggatcacttgaggtcaggatttcaagaccagcctggccaacatggtgaaactcatctctagtaaaaatacaaaaattggccaggcatggtgtcactcgcctatagtccgtgctactttggaggccaaggcacgagaatctcttaaacccagg

SEQ ID NO: 101469 - DNA, 1084 bp, Homo sapiens
ctcgaactcctgacctcaggtgatccgcccgcctcagcctcccaaagtgccaggattacaggcatgagccaccgcgcctggccaattttctgaagatttctaagatatttacattatgtccaattttccccaagtttaactaaggcaagaaatctctgtgtggaaatatgataccttgctgctagggcacaattaggatgcagttcgcaggaagaggaaggtggagtggatactgggccactacccagccatgtctgccaccatgccttttcttcctaccatgaatctggtctgcattacaattcaaagctgtttggaattaatccgttactttccctttgtcccatggagttccaggtggcacaacggtgctggtggagctgactcccgacatccatatctgcggcatctgcaagcagcagtttaacaacctggatgcctttgtagctcacaagcaaagtggctgccagctgacaggcacatccgcagcagcccccagcacggtccagtttgtatcggaggaaacagtgcctgccacccagactcagaccaccaccagaaccatcacctcggagacccagacaatcacaggtacagctggagcatgggggagtcggccagaattggcctggctgtgtctcaaacacgtccatggaacttgttaaaaatatagattcccagagcccaccccctagggttgctgattcattatttttaacaagctccaccaggaagccagctgcccagccaggtttgggagctgctaggttaaaacattaactgttagcagttataaatgttgtcacgttacaaaaaaaacagacaaaaaagagatttctgaaacaaaaatctatatactataggaaaaaaaaaaggctggcagaaaatacgttgcaataaaaaaaaaagtggttgttttgggtggtggaagtatgggtacaatccttgagtttgcattacttgtgtaaagggccaaaaagcatgttgttgttaaaaaaaaaaaatctataaactggcattggtatctcctcccccttgtgctgctgatcaggaaaacatccctgttctctgttgtgtacactca

SEQ ID NO: 101470 - DNA, 1007 bp, Homo sapiens
ttcttcattatctaatgtgctgattcaggctaatttcatgtcttccaccaggagaatgagggagccacactgtttttattcataatgccatgctctttggaacctgtttgcattgagacaatgtaggccttcttgcctttgcaatccccagtgccatttacatcatcagttctgatggctgcctcattcattggactggccatgaaccctggcttctgatgactctctcaaaggtcatgactgtgtgtccatgatggtgaccacaaatggaagtctcactcagcatctgcagggagatgtgaatggtagtttgttttctggtcttgttaaatttactgtttggaactttagagtgtaaacgtagaaagcctatcttctgagtatatcttcttttggaatctttaggtggtagctgcaagaactcttagtatgttgacctcacctctgccttccacataccactaccagtgaggaattaggaatgcatgagaagagtgtccaagaagagtgtcctcattcatgcaaggcttaagagagaatgcaggtcaacatcaccatgtcaatcagaggtaggtgagctcaccaattggaaaggcccattggtgtggggatgaatggtcttgaaaaagcccttcaggagataggtgtgggcacccaagaggattgcctaatgtgtggtatgaagctagtagaggttgtcgggtgactgcattaggagacacaatgtatagaatgtcagttgccacccccactatcctaagatgctgtagaccagaggtagcatggtgaggggcacatgggtgggtgagagcctggcatgggcccacagtgtttagtttaatagtagtccagaaatctgatgttgtcttgtgccgcgcttgagtgagaatcatcaaaattggtgtgttagccccattctacttgtcaatcttgtgcaatcacatgaaagaaatgctgtgccagctggcagggagctatctgctggtctcctggaattgggatctccc

SEQ ID NO: 101471 - DNA, 1061 bp, Homo sapiens
tgagccgagatcgtgccactgcactccagcctgggtgacagagtgagacttcatttcaaaaaatataaaataaaataaaaagtaaaaatcttttcccgaacttcactcaggtggtataaacagagaccaactatgatgaatggttatgtaaagatcgccagtcctgggtgcttttttgagattatgctgcagcaggctttctcagaatctctccattctgcctagagagggattttaatttggttgttattgtcatctgcatcaggccacaagatgacatcagcagatttttgccgaagcccaaaaaagataaatatttaagaagtatttaagagggggtagatgtgttcccatcttacaatcatttggggtcatgcttgcattcaaggatttctaaacaaagggtggtattttaataagaaaagtgattgtggttccagttttgatgtgatttgagatgaaaacgatattttaaagactgaccaaaattgcatttaatagctgaaaagaataaacacttaaaaaaataatgaccttaacaaagaaagttgtgatttaaagcaatacattctaagcatagtctgttttatccataccaaatgtgagatgcaatattttctggaaataggtcaaattctgagtattttgtataaacaatatattccactagagggcgctatttagttgtgtatttaacgttctttttctttttataaaaataaaaaaggctataagatgatgaattctgatatgattcttgttgagcatgttatgaaatttcctcccagacattgttttattttcagcttatatgtgtgaaacttcactttaagaagtatacatgaccctgaatctttcaatatgtatacagtcccagcggtattatggtacaatagaagcaaaagacataagtttaaattattgtaatcccagaggtcttttgactgttgtttctctttatatgttacctcatgaagaaaatttattgtaaatattaatattgtctgtttagatcttatgtgaaaagacaaagagagggagtgtggctctgggtgggtgat

SEQ ID NO: 101472 - DNA, 1127 bp, Homo sapiens
ggtggcctcattaaccagccctggcctgtcaacttccagacttcctgttgcataagacaaatacattctctactttttaagcccctggcttagagttttctgttatttgcaatgaaaagcattctttttaaaatatggaggtgaaattcacagattataaaattaaccatcttaaaaagaacaactgagtgacctttagtatgttcataacattgtgcagccactacctctatctagttgcaaaaccttttaaccccaacatcaaaagagttcttaactgacacaagtgttaggccaatattgtcttatggaaccttccaacagttctaataaagcaggtattggtggtggacattttttctgcccagtgtgcatcctcccttgtccaggtaacagacatcatttccctctggggaactctctcttccttgcaatccatccctgtggtttgagaagccctgatgtcatccatggctccaccgtgcatggacaatcagagcaccactgaatggggagagtttagggatggggacatgatacaatttgggcctaagtttggatggctggggagaggagttctatttctcattagaaagcagggaagccaagagcagctggccacggtagggagctggtcagcctgagggtgaagctgatgtggtgagggctgtgctaagagatctcaggtagtggtgagagttcggagctcccaaatcgggctgtgctagcagccagctctttcttcaatactttcaaatatttgagtcaattaatctcctttttcttttcaaaatcagtttgaattggattttccgtcaattacaatcaaattagtattgcgattcattagcagtactactgttaaatagtagtagtagtagttgaggtagtagtagttgtagtatttccctgttttacagacttgagatttgatctccaggggtatgtaatttgcccaggatcacccagctttgaactcaggccggcatcattccagggctcgtctgtatgactactgagaaatcacattcccacttctgttccatgctggctgtttccaaagacagggagtcaaactctaccatcttgttagtgaatgtgaatctgtacttctcctggatcccgtg

SEQ ID NO: 101473 - DNA, 1088 bp, Homo sapiens
gcaaatcaaaaccccattgaggccgggcatggtcgcttacaactataatctcagcactttgggagtcagaggtgggatgattgctggagcccaggagtttgagaccagctgagcaacatagcaagacctctacaaaaaataaaaacacttagctgggtgtggtggcatgcacttgtagtcccagctacttgggagactgaggtgagaggatcacttgagccagggagatggaggctgcagtgagccatgattgtgccactgtactccagcctgggcaacagagcttctgttttgagactgtctcaaaaacaaaaataaataaatacataaaataaatagtataaacaatgacatattacttcagactttttaggatgacagttacaacaaaacaaaacataatgagtgttggcaaggttttggagaaactggaaccctttgtgctgtttgtggggatgtaaaatggtgcagccattatgaaaaacagcatagaggttcttcaaaaaattaaaaatagaaccaccatatgatccagcaatcccacttttgggtatttatacaaaaaatttgaaatcagaatcttgaagaaatatttgcacgcctatattcattcagcattattcacaatagccaagatgtggcaacaacctaaatgtcattgacagatgaatgaataaagaaaatgtggtctctacctacgatggaatataaatgagccttaaagaagatggaaatgctttcatatatgacatgaataaaacctgggtgaaataagtcagtgatatggactaattatggatctgtgtccccatccaaatctcatgttgcattgtaatccccagcgttggaggtggggtctggtgggaggtgattggatcatgggtgtggatttctcatgaatggttttgcactatccccttgctgtgatagtgagtgagttcttgtaagatctggttaagagtgtgtagcactggccgggcacggtggcttacgcctgtaatcccagcacttggggaggccgaggcagacagatcatctgaggttgggagttcgagaccagcctgaccaacatggagaaaccccgtcgg

SEQ ID NO: 101474 - DNA, 1012 bp, Homo sapiens
ttggaaattttactatgagatttttcaaaaggctttatgtaaaaaaaattgaaaggcttgcaaaatataataaaaccacaaaatacaaagctataatgtggctttcatttgcaatttttttaatctagaatacagttcctcctatcttgccccattttccacttctgtcagctcccacaagaaaggaaagaaatggagtgaggatgacaggtagcagttaaccaggaaaagatgctctcctaaagccagtgttattgcacatttgggggttgaccttagcactcgtgaattctgaccttgtgaaatactcaacaggaaaagactcaaagaaagtcatcaagaacagctcaatcaagatgtccgagcagtatgatacagcagtgaagagagacggggaacggatggacacattaaaaatgaataggaaggatattaaaggacttccggttaaaaatggtggcttgaattcacccgttcatcttctctccttctccaaaccccactgaaatgacagtaaaggaactaaagaggtataaattcacaaggacaaagagagtgggagaataatgacaggagagaaatgtcagccaaattttgaaagacagaaagtggatgtatgagtgttaagcgattgaggtttcaatgttttcccatctgctgaggactgggtggtgggaagagaacaggaagccagtttaagccccaggaccctagagagctacaagaaccggaggctccagttatttctgaagtcagggatgaagaacaggagtgaaatcagagattctaaggagcttctcccccaccttcctcctacagagaggagacaatagacctgagttgaaaggctggactggaggacactagaaaatgaaaagtgcaactgacaaagacactcaaaccctcctttctctggtttctgggagtcctggttacctggttcatactcacctccctcttaactgggaaatccactgtttcctaaaaaaaaaaaaaaaacaaaaacctggcc

SEQ ID NO: 101475 - DNA, 1383 bp, Homo sapiens
caggactcccagaaaccagagaaaggagggtttgagtgtctttgtcagttgcacttttcattttctagtgtcctccagtccagcctttcaactcaggtctattgtctcctctctgtaggaggaaggtgggggagaagctccttagaatctctgatttcactcctgttcttcatccctgacttcagaaataactggagcctccggttcttgtagctctctagggtcctggggcttaaactggcttcctgttctcttcccaccacccagtcctcagcagatgggaaaacattgaaacctcaatcgcttaacactcatacatccactttctgtctttcaaaatttggctgacatttctctcctgtcattattctcccactctctttgtccttgtgaatttatacctctttagttcctttactgtcatttcagtggggtttggagaaggagagaagatgaacgggtgaattcaagccaccatttttaaccggaagtcctttaatatccttcctattcatttttaatgtgtccatccgttccccgtctctcttcactgctgtatcatactgctcggacatcttgattgagctgttcttgatgactttctttgagtcttttcctgttgagtatttcacaaggtcagaattcacgagtgctaaggtcaacccccaaatgtgcaataacactggctttaggagagcatcttttcctggttaactgctacctgtcatcctcactccatttctttcctttcttgtgggagctgacagaagtggaaaatggggcaagataggaggaactgtattctagattaaaaaaattgcaaatgaaagccacattatagctttgtattttgtggttttattatattttgcaagcctttcaattttttttacataaagccttttgaaaaatctcatagtaaaatttccaactgtgcagaggatcagcataatcctccccagtctctctctcctttaatcttgtgctttttctcctatgaatttggtgtgcatctttccatatcttttaaattatgcttgcactagtgtacaatcatttatttattcaacaaatggcttttgagtccctataatgtgctaggcattgatgtagggactggcaatatgttggtgaacaagacaggctaaatcccttccctcatggggatttacattctagtggatatataaaactttaaacattcaacacatgcacactgcctacccaccagcatcactggccatatcatacacagtgatctgtaagatactttttttcccacttaccacctagtgtatcttttcatgttagtactatggatctttatttttaatggttgtgccatttcaccatatgaatgcatcatttatctactcttctagt

SEQ ID NO: 101476 - DNA, 1010 bp, Homo sapiens
cttccttctttctttctttttttttttttgagacagagtctcactctgttgcccaggctggagagcagtggcatgatctcggctcactgcaaccttcacctcctgggttcaagcacttctctgtgtcagccttctgagcaggtgggattacaggcgcccaccaccacgcctggctaatttttgtatttttagtagagacagggtttcaccatcttggccagggtagtcttgaactcctgacctcgtgatctacccacctcggcttcctaaagtgctgggattacaggcgtgagccgctgcgcctggcccagtaagccttttcaaagaattctgtgcaggttacagcataatttaattacaaatgaatatgcattcttagatataaaaatgagagatgtctgagtatgataactaagatagacagtgttagaacatcatgatttgaaggatcgtcactcactgttacttccagaagttatgtccaatcagctaccttcgttttggataagatagttcctgtagaattactcacattggatctttcttcctttaatctatttctctgtaagcacatgcaaattatgcttgacttaaccaagcagctctacttcaatttgttgccatgatgtgatgagtaaccagaatggatttttaggctcatcaaatgtctatgctatgtggttcaaaagcagagtgacctttacagcttgcattgtgcattgcaaatctaaaatttgaggctaagataggaaattctcacatcattttcctttcattagaggagaaaacagaattcagctggacacatgcactaaaattagatttttaaataaacagcacaggtcttaataattcatgcaaagatgcagaaaaaaatgaggaaaataattgagcaatggcaggcaaatatcatgtcgttttgtactgcctcaaactaaccctcagtactgtatatctctgatgtacacgtttattaatgaaacaaaaggcatctactatggataaataat

SEQ ID NO: 101477 - DNA, 1429 bp, Homo sapiens
gccaggggttaagaggtgggggcaggagagaaaggtgcaatccaaactgcaaaactggattaaacagaggtttaaaaaaaacaaaaacaaaataattagtggtataacataaatagatgtcattagctgtagtaatgtctatgacaaataaataagagttgaaaacaataaaactcccggtaatgtactctgttgtaatatcgatggcagcatgtggggaacatctgacagctgttaaacagatgtggcaattagcaaaccttatggtcatgctggtaaaattatcatgcaacacgctctccagcagaattagatgacttccttctttgtgtggctttatccacgtggagagttagactaatcctccgtttaagcaatattgttagctgatacagtctaagccacatatgggtgtgtgtgtgtgcgcgcatatatagacatatattttttgatgtcttctgaaagatttagagaaattcagaatttaaacaagaacaatatcaattcagctgtgtagcagatacttcaattataatcgctaatggacaaattgagagataaaaagacttttctatcacgttgaaattcaatgaacagttttcaattaggctttggatgtaaaaggaaaaaaagaaagtgacttttccttgatgttaacattgctgagagagatgagaggaactttgctttttcattatactgaagagatgcatataaggctgcatatttgaattataaatcaggtcgctatctgccaaccgaaagcaatatcaattagaacttaggtggattaagctttaaaatgccttatatttaatgacaaaagtatgactgttaatctccgcagccatcaaagggataatttaaggcagcaagaaatcagagaatgatgtcacaaaaataggcccttgcagctttttggatagtattatcgtaattaatgtacttcaaatgactttttttgtgggttatgagctttcacaaaagcatttattgcgggcataaaatataaaactctaaagagtgggtttgactaaggttgactggaggggccttagcctttctgctacagtaattcctgtaaaataatagtttcatttacaggcataatttataatgttgaatttatgccagttcatctggtataaatcatggtaatagcatgatctattgtatgtcacttgagcgaatgcaaattaaatattgttaaattaaagaaaaactgttaaaataacattgggttgtaaccagaactgctggaatgaaggaaatgtgggattaaggatgaaatttcactgctgtaggtcttgagctgatactggaggttgttgccaaaagcaaatatacatctaaataagtaaataaataaataaactgtactgtgttgttggggacaaagtcatacattaccccagagtgttctttcatt

SEQ ID NO: 101478 - DNA, 1789 bp, Homo sapiens
ctgcagaattgagtagctgagacagagatcaaatggcctgcaaagccaaaaatatttcctatctggccttttgcagaaacagtttgctcagccctgctccactgcttttctcttccagctttgtaactgattagtggtccctttactaacctctgtgagtctcagattttgcagatgtaaaatggggataaatcactgctcctgtatagttcttgtgaagattgaatatacgaggtaatatttgcaaagttcctagcacagagttcacctcttgcaaatataatagccatttctactaaaataaattttatgaaaatattgttatctcagttgttcccgagcctataaaatcccttattcagtaaccagcagatttttctggggcgttggcatgggagagtgtttgcattctataggtaatgggtgggcctaattgcctgttagttgcagatttctttaaagttgggcaagacatggaaaagcagagaaaacaaatgaataaaaacaaagcagcatgaaaaatgtcaggggtagtatgtgagaaactggaatcaatattcaaaatgcatgcatgtctcaatttttctttgttactgtgtcactgttttgaaaagtctaaattatgcttgcaaaaacttaacgtatgcatacatatgtatgaatgtatacgacgtagcagggttgagacagacaagcacaatagtaggttttgctcagaataagaggcagaagtatgcggtaaaagtcgtttctgtacacagttgagtggtgggtcattccagcagacccttctcagggacgtgcaaacagaccagtaagaaacttcaaggctgtttctccatttttctcaaatccatctcctttcctccatttctgcagttaagtctgcctttatctctctcaggtttacggctccccaacctggctttctttcctccagtgcttctcagtgggagccagttttgctccccaggatatattgttttgtaccataatcaagagtatgcaaagggcatccatccatgggtacaggttaggaatgctgatgaaaccctacaatgtactggatcatcctcccgctcagggaggaattatcctgcccaaaatatcaatagtgttgtggttgagagtccatgccagtcttttcctctgatgggttctcaattcagcagccagtatgatttctattttctaaaatgtaaatattttattttctaaagtacacttctttgcataagaccctgtattgcattctttttgcctgcagggtaaaatctgaacctgaatccttataacatgttaaaaaaacctgtgttgcctgtttcttgcctgttttccccctcatctctctcctctttcgactcatactttataaatgcatcgaggtgttgctcacctgtaggactcggcataaactattttcagactctgagtccataacccttttcacccttttctggtcaacttttatgtacgagtgacatgaaatatcagctcacaggttaccttccccttgatggcagctaccatttaacatgataatcttgtgttgtaattgcttgctcaattatttgtattcctgtttacaggcttacctctcagagggcagggattgtatctttctttttcactaccacatgtgcagtaaaaggcacacagtaggttctcagttaatatttgttgatgactggagtgcttatgctagtttgtttatatggagcaacttatttagaatgttgttaagacatttataaatgtaaatatttttattattattatttttttgaga

SEQ ID NO: 101479 - DNA, 1094 bp, Homo sapiens
ctctctgctcctggaaagggagtcacagataatgctggagctggaaaccacaaggattttgtaaaagcacagaggaaactttattatatgtgtgctccccagtgtctcaactcgactttattcaaggcagataaaatgtagtttttggacacttctgatatgttcaaaataggtgcagacagttaatgatgggaaagttcatgactcagtaaagattactccctagctggtagcttaggacagaaaactataaaatcaaattatgataatcataggagtcaggagaaaaaagtaggcccatggagctctatttactgaagttttgaattcattatataccacctactgtggaagtataggaaacagattttttgatcatctcagtagatttacaaagtagaactattttgtgattaccaaagtgaatttttaaaaaacttaaaattgtaagagagagaaccggggctagaagaaacatgcaataatagagaataaaaataatcgacatgccccacaatacacttgcacacatccagactttaccttttgaggaacagttggttggacattaaaccagtgaaaacagatgtggctgtctcagtttttaccactaaaaataatttttttccaaacaacatttccatcacatagcagtgtctacctgtcctgacataagagttaaaccattgatctagggcttaaataggactttgacctgcagtggtctattttatcacatgtaacttagttgttgagtcagcaaggccaaatacgcttctactagatatcaaatctagacagctagggtgtgcaagatttttatttttttaccttcactcagatctgtgttttagggagaaagtcggccttttctacctgatattaagaatatctatctggacagtgcccttgagtgacaaatctcattgataattttctatgcttgccatgttaaattacatagctgctagtgttttatatgataccttcttttttgtatgcttgttagcatttataggattcttatgatgtgcttagttttttttgtttgtatttaaaaactttaatacagttctgtaacatttagctattgc

SEQ ID NO: 101480 - DNA, 1039 bp, Homo sapiens
atctatttaaacacgatctatcaaggaaagcatttcgacgtctttgtttcttattctttcttgtttacggagaccacattcccccccaccctcaatttcaaattgccctctcttctcgtctgcaaatgctcatggtatagatatttcctttattattccctctaaactttctttgttcccgtccctgtcttttattatttctcctgtgtcatcagaaactgactgctggatcctgccaattagcctttgtctgtcagcaccagcctcagcctcccgaagagcgagtgtgcacggcgaggcggacaggccctatttcgtatgcagcacagtgtccccacacggagatatgccattactgacaaaagagcagtagatgggctcagattagctgctgacaaacttcctgtgtgtgtgtgtgcgtgtgtgtgtgtgtgtgtgcgcgcacccggtaggaggagatagtggggggtgggcaggacagggcaggaaagagaaccataccctggaacaccaaacagcaaatctaacttgcaaagtaacttatcaattctattccaaaataccaatcattctgaaatggtttccattataaatgtggtccatctgtactggtgggcacaaatgggcaggtcgcagccacaggaataatccacagatttctgcctcttggtcgcatctgctcggccctccactgtgaactgcttctctccttccccaggttaatatttctgggcagcttccagggtgaggcaagggaggcgctcaccttgggtacgaattgggcgccaaaaaactcagtagtcaaaacaattataatatctatgatttaattaaaaaataaaaatgaatgccaaaaatccatgatgaagaaaatattaaaatttcagataaagaaaggatcagtgttggtgatgtttccgtatgcatcgggctctaatatggctcggcacagtgctgtgactgatcctgtctttatatacagcatcatatatgtatgtgtatatatatatatatatcatatatatatgcattgagcgag

SEQ ID NO: 101481 - DNA, 1063 bp, Homo sapiens
catgaatggggagcgtctccagcagtgtggccgtatccatattgctcattttgtccgagaaattattttgtccaagggtatcagactgaggtccgttcaaagacattatatacatacacagagacacagaagagaaatctgagatgcgagtgggaattgctgatatatttgtttccaaagcaaactccatgaatgaaatgattcaataatttggaggcatttgaaagtcattaaaatggccatttggaattttcagttgttgcctccctcaattttttacgtttcccctgtagaaaaagacatcctctgggcaccctcaaatattctgggatgctaaagtcatgctaaaattatttacaattttagaaattaaaattcaggaggcacagcaagataatccgattattaatatatcagtattatttagctatgcataacaacaggaaaacgcacaatgcaaaagttttagagataatgagcttagagaaattacatggggggaagaaatacctggatcatatttgaaagcatttgtcttgaattctgctcatctaaatgagagctctctttctacctgtgtcatttaaaaaacaatttcaatatcctcctacctgctaccccagcctgaagcagggactaatgaaactctctctggacacacagatgtaagacactatattacacaacactttttaaaaaattgtttcagaaaaccaaatgtgggcatgcaaaccaaaagaaaaacctcaaggatcttcgtaagatagctagctcagggttcaagatcaagagaactttgttgcggcaggataagaagacaacagcattgcgttttagctaaacatctcttcttggcaaatgagaagcggtgaagcagggaagatttttttaaggagctttttagctcttttgcatctctctccaaagactaatttaattgaaaagctgtagtgtccatttatgattaaggaaaggcctcatgtttccacaacactgctagacactaaggtgggtttgaagaaaaaaaaaaaaaggccagcattctgcagtttctgttagtata

SEQ ID NO: 101482 - DNA, 1048 bp, Homo sapiens
tgaagtttgcctatgttcagatctgtgctcattgctttatgtgcggtatctcattgaattttcacaacagctctgtggcatacagggcattgtaaacctccttttctgaaatgaggctcagggtaattagtaacttacccatcatctcacctagtaacttacagagctgttttgatccctagtttgcttgactccacagcccatgacatgctacaagtcgtactgaaataagtcctctctgtctttctccctgaggatctctcaaagtgcagtggatgtaattctggtgtttcacaacatgattttacatagcatacgggccaacattttttttctttaacagttgatatgtatcgtaatgtgtatgtgaaaaagatataactcgtggcaaaatcatgatctaatagatgttattgcttaagttgaggcttaactgaatttttaagtttaaaaatagtcaagtttttaaattaagtaaatataatagggaaaaacatgaaagcagtacacaattaatggaggtttgaaaatttgaatcttttcacataaacaatccatcaaacagcctaatatttactaagattgtctgtgggctagagaatactttgacatcacccgctttgggaagtatttatcatcccttccttttaatgcgtcttcaccccaatggttaagaactttcttttctgtgcttcagaagtatcttgtatagtttaggaccaatcacattgtatagtagttacctaacatgtctctctttcacaatagactatgtaactttcatgggattttattaatcttggtattttcggctactgatccaaatagatattttacaataaaatcatggaacttacctaggtggagtatgcaatgcagtgaaagagacgaacatcgcatcaataggattctgctacaagtaacaaggaaaacatcacattcaaactggtttataaggaattactggctcatgtaattgaaaaaccccaaaatcatgtatacatcagggaaggcttgctctagcagctggacaatatcaccaagaagg

SEQ ID NO: 101483 - DNA, 1035 bp, Homo sapiens
actatagatactaattatagtctgaattttaaagaaaaattcaggcacatctactctgtgccagggaaggtgctgaaggaactagcatgtgtattactcgtttttcaacagagatatgtattgttagtcccatttaacagatgaagcaattgaggcttagagaagcaaatgacttacttgaagtcatccagctcatcagaaagaaccccaaccctcccaaggtatttgaccttgcaggtcagtgtttttcccactcaaccacagatgttttatgtcctcttttgtcgctgacgtttcctccatgtggaaagctttgaaagtgctccagtcacattttgaaatttcatgacaaaaaattgaatgtcatccaaagcatagttgaggatttaaacatccctgtcaatcctggctgtcatcaccaaaagatttctatcccaacgatagatcattgtgacgtgcttggcctaaagggccctgggctgttataatgagtaagattggaatctactgagtaatgcaaataaataaaaaagagacaggtagtctcagactttttcattattgccttctttgctgtgaagctcatggactgctctgtgcaaaggatctttctttttaccattttaatagcctgtgcaatgggattaagaaagatcttgggtttttcattcaacagatattttcatcattaaaatgcttactgtttttgagcacataagtgactctactggaatggtagtaggaaaatagggacacgaaggggatttgaagtcagattatgaaagcactgcatgccaagctataaaaggagcgacaaatcagggaggttagtttctgatactaaccttggcaaacacagagaggggagaagcaagtgcaaaagccctagatgaaaatgagtttggatagtatgttctagaaacagaaggcagcaggacaggtgagaactaaacaaggcagagcgtgataagatatgagaatgaaggtggaggaaggagtagggtgatcaccagcccaggctgctaggagactgag

SEQ ID NO: 101484 - DNA, 2940 bp, Homo sapiens
tctagttagtcattctcctaatactttcatagcaaaagttgaacttaaatagaacccagggccaggcgcagtggctcatgcctgtaatcgcagcactttgggaggccaaggcgggcagatcacttgaagtcaggagttcaagaccagcctggccaacatggtgaaacccttctctactaaaaatacaaaaaaattagccgggcgtggtggtgcatgcctgtagtcccagctacttggaaggctgaggcaggagaatcgcttgaacctgggaggtagaggttgcagtgagccaagatcgtgccgctgcactccagcctgggcgacagagtgagactgtctcaaaaacaacaacaacaaatagaacccattgcatttctaggtcagtttggttctatgtattacgcttttttaaagaaagaattttctaaactgtattcagttttgatcttaatcatttaaaaaatgttgttttccttaggtcttggtggatgtcagtgcttactccccatgaaattaaattttacttcatcctttgagaagcgaatggtgaaagctactgaaataagctgtgattgtactgtacataaaacatatgaggaatctgcaaggaacactacagttgtgtaaagttgttctgttaacttttgtaccaaatagcaatacaaactagttggaacagttggaacttacatacatggggactggaaatctctattttgtccctgaataatatttttcttagaattgaccaaataagaagtggaatttttgcatacttgagcgctgctgaaaagaaatcatttgggttgggtggggcgggatgggggaaaagtatataatgcttgcacctcaggtaaaaatctgtaaatatctaagttgtaaacctgcttgttcaaatactgtgtgtattccttttctctaatgcagctcatcacttggagcagtttctgctattgtgctctttcatttaaaatgtatgtttttttttttttaaactgtcaatgattttgtattatgttgaatccacccaaatctattgttgtcttaaaattgttaatggaagtattgaccctctatgatatgtgctgcagatatcgaggtcagccattcggaagctggcagcattttatcgcaactttgagcatctcagatggggaaggcaccttcttcctcgcctctccagattgtcctggaacctccaggatccttgactgagggcgttgggatggcttgtaggatttttaagagagtgtgtctacagacaagcattttctctgtagagcagccacacgttgtataaacataaactgtatgtgcagttatttaaatttgtttctgtcaaattaatcatttttgttggacgattcagtggcgggggggttttgcctaaattagtatataaaaacaaaaatgctaaattatatctgtgaattgcaggtattggggaacagttttaagggaaattttggggggaacattttaggtttgtatttggtagtcttaatgtatctggcatttgggtgaactgtggacatactagagttgattatagacacattgattttgaataaggaactgctggccgagcccgctgggagtctagaaagagaaaatctgtttctagacctcagttattttcccatttttggttgttttgaagcagtaacatttttctcagtgcacatgcaatttgggttttagagaagatggccaccagctggcttcctagatattttaaacttttgttctttaatatgctgtccatggctgagtttattagtacatgggcttagtgaccacaaaatattttattaagaaactgtttcaaaaataaatttgcactgttcatttttctggcctcgctgttctccatagagcaagggtaatcctagaaaaaattttttttttttaaattatgcaacgtaagatgtcctccttgatagaagtcttagctcctgtgttacaagggagaactcatttgagatcagtctgttggcattgcaatgaagtgctttgtatcaggaaagtgtacactattgaccttttttcctgttcacaagctgagccatatgtacataatctagattttgttttcatagttttgcacttttatagcctatttttgaagattaacacatttgcaagatgattgactcaatctttgcctaatccaatgagtgttacagagagcttgctgtgactagaaccataaatcttaaagggggtatgtgataatagagggctggaatttaaacctgtatttaaaaaaaagaatcaccaaatctatttgaaaacaagtcgatttgtattatgctggaattttttgggctttcagatttctctttttaaccacatttctgaatgtataaaaataccaattattttcctacagccctttgtacttcaaaatatgtttttgtgtccatcagtattaactattggtatactactggttttatatttttttttctttgagacaacagtacatataatagaggtacaattcgttggatttttgtttatgtatttatttcattccagtttgatttattttaattgttgatacttaagttgtcgaacagtagacattacttgttttatttatgatatatttcagcttaaagttatgttattatatgtggaagtgtaaatatagatttggtgttttgcaatcttgagttttagtgtttattgtgtttctggtttctgattttgttttatttaactttttagttttctttcttttttttttttttgagatgtgctcctgctctgtcactcaggctggagtgcagtggtgcaatcacagctcactgcagccttgaacccctgggctcaactgatcctccagctctcggcctcccgagtatcgagccatcatgcctggcttataaacacaattttaaggccagcacgtggctcacgcctgtaatcccagcc

SEQ ID NO: 101485 - DNA, 1032 bp, Homo sapiens
gggtatgattgtaagaaaaaaaagctggccattctgtatttggggaattgattttcctaaacttatattatcttagtagtctagatttatcatattgtactatcatcctggcttttttaagacttaagaagatcaagtaaatttttttttctttctttagacactatatagatcatcaagggtgtctgtcttacaggtggatagtgatatgatctacagtgaggggacatttatttaaaacttaaacattcatgtgttttgggggtggtattttaacggcagcacctctgattgtcttttggagggctggtgtgtgtttgaagttctgtcctccttccagtggactctaacttctcctgatgcacgtgagacacattgtcctattgtcctgcagaaactaaagccaaacactgtcatttggggacaggttttcatttgtcagatctctttcgcccacatgagtgtttgtggacaatacagcctgctttccaaaactttgctaaattttgacagactttcctaggtgcttgcccaatgccagactttcttttctgttgaagattaagttgtgcttgctgccctctagtggtcagttgtttaatcctaaccttaaacggcttatttttcccctggtggttgggaagttgacggtttgtaattggctcatttttctaaattattctgaagaagataatttttcccgccagtatgtatgtccaccttcagtttgccagatcctgcctgctcagagacactgagaaccggaagctgcccgggcaattcagtctatgaaatgatctttcttgtgattaaggcaaacgaagaactgaatgtttaatagtgtactctgctgtacccagaaaaaaacaaaacaaaatcatgttataacactctaaaacttcaaacaacctccaacagcatttggtgtgtgtctagccgttttgttctaacccgatgttatataaaagaattttttcatgctttccaaaaatgtttatgtcaagaatatttaagtcagcatgccttattcag

SEQ ID NO: 101486 - DNA, 1035 bp, Homo sapiens
taaagaaagtctaattgagcaccgcaaggtgcacaccaaaaaaactgctttcggtaccagcagcgcgcagacagactctccacaaggaggaatgccgtcctcgagggaggacttcctgcagttgttcaacttgagaccaaaatctcaccctgaaacggggaagaagcctgtcagatgcatccctcagctcgatccgttcaccaccttccaggcttggcagctggctaccaaaggaaaagttgccatttgccaagaagtgaaggaatcggggcaagaagggagcaccgacaacgacgattcgagttccgagaaggagcttggagaaacaaataagggcagttgtgcaggcctctcgcaagagaaagagaagtgcaaacactcccacggcgaagcgccctccgtggacgcggatcccaagttacccagtagcaaggagaagcccactcactgctccgagtgcggcaaagctttcagaacctaccaccagctggtcttgcactccagggtccacaagaaggaccggagggccggcgcggagtcgcccaccatgtctgtggacgggaggcagccggggacgtgttctcctgacctcgccgcccctctggatgaaaatggagccgtggatcgaggggaaggtggttctgaagacggatctgaggatgggcttcccgaaggaatccatctgggtaagctgccctgtctccgtcccgtgctgttccgcctgtgtctgtctgtctccccgtctccccctctctattcccatctccagacaacgctggccaggaatggggtttggagagccagagtcaagtccaggctctttttggtatcactctgtgtaagtcatttaacctctcagggccttaattttctcatttctgtaataacagggttgagttaagaggtctccttgttctgaaaatatatatatattttttaaacgtgtatcgttttgctcacaaaacacactttaaaaaaaaaataacttgtgcatccagcccaaatgcactgcttcttaactggggcgattttgtt

SEQ ID NO: 101487 - DNA, 1003 bp, Homo sapiens
cattttagtggcatttaaaatgtattcagctgaatttaacaatttctgacctaaaacttgacattttagatttaagtcggtaaagcactgatttaaactggattttaactggatgaaattctgatttaataagtgtactgactggataaaatgccaatgatttaattaacaagcacgtttaacaggatgccctatatattagttaaaagtgaagcaattgaattaggtaccttctctgctgcgtggaaaagaccgtatgactcacccacaccagccttctcttcgctctgagtgtagctaaccgtttctgttttttttcctctagggtttggaaatcccttgtctccaggttgctgggattgacttcttgctcaattgaaacactcattcaatggagacaaagagaactaatgctttgtgctgattcatatttgaatcgaggcattgggaaccctgtatgccttgtttgtggaaagaaccagtgacaccatcactgagcttcctaaaagttcgaagaagttagaggactatacactttcttttgaacttttataataaatatttgctctggtttttggaacccagggctgttagaggggtgagtgacaagtcttacaagtggccttattccaactccagaaattgcccaacggaactttgagattatatgcaatcgaaagtgacaggaaacatgccaactcaatccctcttaatgtacatggatgggccagaagtgattggcagctctcttggcagtccgatggagatggaggatgccttgtcaatgaaagggaccgctgttgttccattccgagctacacaagaaaaaaatgtcatccaaatcgaggggtatatgcccttggattgcatgttctgcagccagaccttcacacattcagaagaccttaataaacatgtcttaatgcaacaccggcctaccctctgtgaaccagcagttcttcgggttgaagcagagtatctcagtccgcttgataaaagtcaa

SEQ ID NO: 101488 - DNA, 1018 bp, Homo sapiens
aggccatcctatagtttaaccaactgcgttaaatagataatagaaagatgtggtatgtggcagtgacaacttgaaggttgtgactagaactcgggtctctggagtgttctattatatcacaccaagctggtcaccagcccatgtgttgatcctccattgtgatagcaacaaagaaaagacttcaggacattctttcctttaccctaatccttgatctgcagtcttatttagaaaagcttaatgttaaagatctagtttattcaaaactaaagataacaaggagtatgagaatttctatttcggagtgtaaaggaggagatgtttccttggcttctctgagcctgcaggccttccttgctctttaaggaagtagagagagggaggaaagtaaagtatgcttttgttttttaaggttactttgctgggagtagtttgcatgccttttggttttcttgggtggaattaactgacttaagttttaagtagttgggactatttaaaaacaatgcctatccaatgtttgccataaaggcagagggtattggctttagaagttaattcttctccaggagtgaaaattagcttctaaaccagaagcagcagagctaaataaagtaattttccacctggccagtgcatgatgtgaaaggtagattaaaaaaatgagagggcccattttctgatgaaagactaagccatgttgaaacagccctgttgaggattttattttaaatctatacattcacaaaggagctttgtgtatgtctttccctatttgttgtttggactaggaagccccacccagtgcttgttgaaggcagaaagtcgttgaaagcaagctgggatttgaacagtggattgaggtttcgaatatccagtgaaccaaaatatatcagggttcccctggccaagatgagtgaccattctgaggtgttaagtatttcttgaatggggattttaggaaaagtttctgtatttctgtgctcattttgttgacctctgtatgtgcaaaatctct

SEQ ID NO: 101489 - DNA, 1130 bp, Homo sapiens
cgtaaaagacagaggaaaaactttcagagaaaatgtaaacttctagccaggtcttggagataattttgtagttttcagggtacaaatgcattggccagagaatagcaatttaagttgaattttttaataactccttatttggacacctcagtaacttgggaaaaagtagctttgttagcagtatgacaaattgtgtataaatataatttttctgtgtttttgaggactttgaataccttattcaaagctgtattatggtagatgcatattccatatcaacaatgtaagataacctgttaatcagaagaaacagaggctgtgctgtttctaaaagttaacagtttgagtacatcaggatgtaaagaaaaatattcccaagttacagtaattgtcagcaaagtggctgttgtacctagttagttgtacttaagcacagattactgtgctttttattaagcagtgtagaatgtgtcctatttgctgatttcaagatctacaggtagtggtagaattcatggtagctttagtcacaaatcagtgtgtaattagtgacctaaagaacatcacacttctattccagccttttctagcaatatggttcctactggatttcaaagattacgctctggtaaattttaaaagtatctactgaaataatcccaatagaagtttctttcaaaatatggctatactcaatagcccacttgccttaggtgttagggggtatatgagttaagttctgtcgtttacctgagtaaagattttaaaatgtttttaaacattggaaaacatttttgtgaagtacttttcagtaagcttagcgtgttcataacgctcactttcttgcaagctagaagcatttagattatagtgttggattataatatcctgcttttctcctccagttctttgtcaagaaagacaatttactttatcagcagtgccatcggtttactgctgccttctgtgtgcaggagtgtggagagctggaggcttctgggaaggcttgtgtttgtgcacacaccccattcaattggaacggtgatttgctgttagtagattagaatttctattttgctgtattctgttattaacgtctttattgttacaaccactttaacgattactga

SEQ ID NO: 101490 - DNA, 1024 bp, Homo sapiens
aagttgtatgagagagttagttggattccttacttagcctttgttcttattaagctttacaaaacttgtttctgacctccacatgactgtacttcctatagaaaagctcccccagactcagaagctaggtttttaacagactcgtgtagtgtttctgtattggtgttccattattttctggtgtgtctggaaacctttggaatttaaaatgtagttaagtggactggaaatgtagactctagacatttcttgaatcagcgttaggagtaatagttacttttacttctacctctatcaaataaggataacaaagcatctcagttatactgaagtgtttttgtttcttttgtaatcaatatagagtttttcttcagtttataaatctactgaacaatgattgtattactaattgaaaggagacttttccccttgattttgaaagcaaacaggtgactggaaagagccagatatacaactttagtatgtagtcagcaaaagataggatggggaggggaatatttaaatcttgcagaagaacgatcttatgccttaaaaggcattgcctaagcttgtatttaactaggttacttgaattgtgtttaattgagagcgctcattggaagaagtggtatggtgtagtggtctagtagtgggcatagttgtgtgtgtgtgtgtatatatatatatatatatatatatatatatagatagatgtgtgtatacacacgttcagtgttttcattacagagagttagtgcaggtaaagatagaacagtttattaacagttaattaatttgctgaaatcttttttttttggtgcagttaggcctgtcaaatttttacagatatttaaggttgtactggttaagtagtagtaataggagaaacggatagcaatgcttaatcttgcttaattaaagtttttaaaaattcactttccttatattataactttttttcagatcaggatgtttttaaaaaccactttgcagatgacagtatctgttaatattgaaactaaaa

SEQ ID NO: 101491 - DNA, 1050 bp, Homo sapiens
aattaaggaatataatggcctggcaatgactaagtccttctatctcctcattgcagatacatgctaatcacttttttctctcttaacaacatttattatgaaatggcatgtttttgccacagcagggtagccatttcccaaccctggagcactcttaattctgagatgcctgattagagcctcaggggtcccaaaagatgtgctgttttcccactttataaaattacattcttttctcacagttgtcacaaacatgatattggttgataagaactttggagtagttttaatgactcttgactgcctgaaagatgccactttaaaaaaggagctacttttagctgactctatttgaaagtaaatgattggaccctttttatgttttatatgaagctttgtttccatttgcttaaaaaaaaaattcaaattgtcccatctcctgtatgcccatatggcctgtatgttatagattttgaggttgctgggtatgatttgttttaaatcgttccttcctaatttcccatttcagtttaatccctgagcggaatgtttaatgaatgaattgggaaggtgaagctgaaggactgagcaatggctgttttcaagccttagaattagaaagtaggaatgaaaaacatgagacagttgcataaactgagtattccactaataaaataaatgtaataagattttaaatccagttactacaattgaaatctaaaaacagaatagtttttagattactgggatgttaaaaaataaaaacctgaaaggtatttacagaacagctaccaacatggaattaaaggaatctcaatcttgttaaatattctaaagagggaagggtttggttacagcatgtaaattaaacttgagacaatggcgggcgggggggtcttgatccgcacacctcttctccagattctgcgggggggaggggtgttaaaatttaaacgcacatggaagaaaaaaaaaatgtattacacaaagacggcaggaaatttcttaaattcgggtgaaggaagcctgattattgaatatcacttaatg

SEQ ID NO: 101492 - DNA, 1030 bp, Homo sapiens
tttgggggtcctgtattattggccactgtgtgtcctacagcgtagctaggtttttcagttttctagatcgtttggaagcattaagctgtatgttttaagaagcctaggtctgatttagttcaggttgattcaattatgtcttcattgcttttgagttggttgaatgacttgacatgagattaagctcaacaaaagaaaaggcgaggtagcaacagctgccgtccaggcctggccactaggtaggggtcttaggaggccttttaccttctcttttgtatatgtcaagaaggagatttacaatgttcttattttactgtacttctttcccctgaagtggatgttctttcttgattgatatcaaacaagacttaaaatgctaagttttatgatacttagacaacgagtaatagatgtagtttctaaaagccttgatgtgtctgcagtgacaagtgcagaggaataacctcattgctttttgtctgaaaatataacaggcaagccactagtttgtgcttacttaatgtgtgctaagaacttttaaggtgtgtccttaatggtagataacttttttccttctgggaagtcatatttattttagatattgttttgttcagggttctggagactaatagtgtttcgttttgtttcttaaccctgatgttgctgccatttttaatcggttatatttaaattcaagaggcagtaagttatttaaaatacagttgtcagtagttccaaggcagattcatcatttattttaattgttagaataggattaataatctgtttgtttggaattttaatgatttggcgtgatgaggaaagctagtcctttagaattgtctttatttgcctacagaaggaggaagtagaggacaagatatgacttttattggtgaaggacacacacttttttctttagtgtcccactcttttaatccttttgtcttcacaacacttttctaacgctttgcagtttgacctttgctgttttttagtaacttgtgagatcgaagtttagcagttgtgt

SEQ ID NO: 101493 - DNA, 1024 bp, Homo sapiens
tgaaatatcctgattagattttaagattctggcttgagattataatgatgattgaatttcaattaatgttagtcaccctcttcttcccctccgtccctcattccaaaacttcctgtttggaatatctaatgaaggcagaaaactttaaagaggcgttcccagtgttgtgttttgtgtgcaatttttaagggagtttttacattaacattttgagtgaaggtaatttcagaaaactatccagaatattagaggagtcatgagttgtgtttgcagtgggggagggcactcatcgaataggacaaatccagttaaaaaatgctgtcaaccttatcaagattgactaatccaatcaagttgggagggtactgaaacctttatttaaattaagtcttattcttgacccctccctttttgctgtgcttataaaaacccgcaatcacatctcttccagtattgtttggagccaggtagagtgaagtcctacagagttatcaggttccagaccctgccttctcttctgaaaggtaagttctgctatatatatatatacatatatataaatatatttttttaatagtatattattgtgatactttacagaagagtgacttgcatgggatcaagaaacttaatagaaaagagcaatgtggtgctccttcgagctgtttgttattcctacttacttgagtgcatttagtcttgttcaaagggctgtccctgtttccttctcaaatgtcctttgtagtttgcagatgctggcaggtttgcctaactttttcatgttcttttcctgctaactcctcactgcagtttttcaggttttcctgctctgaacactgaattcttttacgtcccgtatctatgttggctctgtttcagctccagggatttacacacagtttccaaatagtttttctataatagttccacagtaaaataacgtcttgtgaaataagaagatcctacctcattctgttcttctaattaaggctgagtctcaaaagaggattccagtaagtgttaa

SEQ ID NO: 101494 - DNA, 1003 bp, Homo sapiens
caggaaggttgagcaacagccctcctaatctttatgcttcttcctttctctcaaccttcccttcccccaccccgcacacacaggagaaagtattccgatgtctttgattgccaccaacctacagtggagtcggctgagagatgggtctctctagagagttgttcctgctactctctctggtgacgacaaagaacaaagcccaggccatcacagaaggttcaggagcagtgaggtcttgaaaatttgggagagagagagcaagaacatttttttgaattgaggcaataatataagatcttcaatgtacacacaccaaacttaaaaagagaaacaggctgtggcaaagtcaaaatgccttcccggggccaggcaggtggcaaaagagaggccggccaccaggcgggggccgcggcaatcaaagggggagggggcaggtgtcccttgcccacagcccttctatggccttgcggcttggagtttggacctggtgtggccagagctcacattttgttaaggaaagccagaaatcccaatttttatgtagaagctttagaaatgttggtgactatttcaaaatgtttgaataccatctgagccaaagaaaacatgactgtagcaaacccaacacttgtccaccagtttcctatctctccttaggaagaacataaaagtccagaaaaggattatttaaaacacactggacttacaccatcagttacctattaatagcttctgaacaactggctgattagataaactgactgataagacagacgctttactttttaactttgtaatatgccatttattcattcaacttttttttttttttttttttttgaaacagagtctccctctgtctcccaggctggagtgcagtggagttcagtgccaggatcttaattcactgtaacctctgcctcctagattcaagcaattatcgtgcttaagcctcctgaggtagctgggattacaggcgtgcgccactgcacccggctacttt

SEQ ID NO: 101495 - DNA, 1039 bp, Homo sapiens
ataatattacagtcacttcttattcagaggtagtgctcaacttccccattatttattgattttcccccaaagttatcaagttctaaagcctaattattggtgtaatagctgagatgttaagagaattgtaagcccctttagctaatgcatggcatatgttgaagggattcagctaattcacatatctgtctgcactattaatagagaaggttacatgccaattatccaggcttcaatcagcctgtttggatacaatagaggcagtgttcacacacttgatgtgccacattccttcccgacatcagaagcagctggtccagataaagaccgctggggttttgatatttaggaatcacgtccacggaagagctggagttgagacttgattgcttcatggacaaattccctgcaggtatctttaacctggactcttttgaaaaatgcctagtaggtttgcagttcactgggctttacacttttcctgctcagacttgttgggtgggtgggtgggtggaggtgctgaggaagaggagaaagacaaaggagcaaatagctccaaggacaaagcagggaataataggaacgggcaaatggattccaataaaataaagaacccgcacacattcttgtgcccagttttagaaccaaacaggctaagacattttcctcctaagagctcaacttcgtgtgttgaaaaataggtggatggataaatatctctgtatatttcacctgcattcttttctttttatttttttcccctttcatttctttttttcctctgattcagaagctggactggaagtgttgtaatatcatcagaaaatgctgcttccggtggtatttttaaccaggaacagaagctgaagtgtctgaaaccaccggagaaagcccctgctctcctgagagctgttctctaattttgctggcagagagcattggatcagtgatcagaaagttaaaatggcagatgttggggcttctagggggaggggaggcagatacctgatactctccggcatttgtttttttatccttc

SEQ ID NO: 101496 - DNA, 1087 bp, Homo sapiens
tatgtttatggttcctttgaatacagagttcaacatgaattattctgatttgtctctgcaaagaaaaaagaaagaagggtagaagaaaaggagggaagtgagggagagagagaggacgagaggaaggaaggaaggaaagaaggaaggaaggaaggaaggaaacagttgttattaataataactgctgctacagaagtgacttcagatggatttaataagattctaagtgtaaacccaaacttcagtcacctttgcatacatacagctttacatgcctcaaaataagcaataaagaaaaatcactgaaaagtttgagatactctctctctctttttttttttttttttttttttttttaagaagttgaactttgttgcagtaatctccctgacagcctggaggtctgttttcatgattcatgatgtcagctgagatcagctgctgtcaacacagccttctgattcaatcccaattcttctccaagggctctcaaagaaatggggggaaagaaagcaaattgaaaccttaaattgacagagtccctaatgaatgccaaattgaaacaactaacgggaagtttagaattcctgtctcctagggggcaagtgagagaactttattctctagaaggtggtggagtgctcatgcgtgactcttcatgtccattcggtttttgcctaaaaagccattttgtgcatttgtttgttttttgctgctcaacattcccaaaggttgacagatatgatccaaagccacagtgtaaaggccacttgggaatgggcttgagtaggaagggctcttacgacacagcccgaatttggaggctgaatgaaatccttacgtgtccaaagctttgggtgtgatgggaaggctgacagagctggttatgaggagggaagaaatagccaacagttcatttctttttctaaaccttctcaagcaagactggcctttgtagaacaatgcacaaggcacggaggaaggaaaaacccactttccatgtagacagatctaaattttatggagaggacagtctgatctttgtttgtcaatcttagtgaaacctgcaccaatgatgttcctcagt

SEQ ID NO: 101497 - DNA, 1031 bp, Homo sapiens
aggaagttttggcacatagtaaattcaatcagtgttagctatttttttattatttcattggtactttatgttatccaagtactctttatttgcaaatttgtaaatttaatcacattaaatattaatttttaaatactaaacattcaattttcatcattttttagtaaagtagaccttattaagacatttaaacaggtcctacattataaacataatttttgctgtgaatggaatagagccactgaaatgtacagtgaccctttagccagtaagctcatgcaagttttagctctaagaaaaaaaaaacactactctgagacatttaccaatatatttgaccatgtaactttttgtttcctgggtcatcttaatgaaagaatgctccaacttgagaaattctgctctgtgccaaaagttggctttttttctttccttttaaaaggacttattaattgttctttatgtttgcaatatgtttatagcttaggaattattttatggagtatcagaaaaggttatagatttacaaacaaaccttaagcttgtggagcaaaaaataaggcatttgttatgttctgtacttcttgtgattcttgactatatgagtgcaaatggcttattgagttattgttgagaaatataaaaagctaactgataacttctccgttaaaattttacaaaaacttaaacacttctttcaggctgcagaagatgtcaatgttactttcgaagatcaacaaaagataaacaaatttgcacggaatacaagtagaatcacagagctgaaggaagaaatagaagtaaaaaaggtattgaaaataattattagaagaataaaatttttttatactatagctactaaaactgaactcagttaacaagtgaatatatatttctctgggctgtttgttgcagatgaatgacgcgatccactctagttaagcagaaagtcattttttttttaagggatatgcgataacttacagagttgttgaggagcttgagtctagaccgaggttccaggaacaagt

SEQ ID NO: 101498 - DNA, 1031 bp, Homo sapiens
gagtcagctgtcttcccaatgaggaagccacccttgcagacttaggaacaccaagctgctgctgccagtgccacctaccccagtaaatctggggcctgtgtccagccgtcccccttgagttgaaatccagctcaaatgcatttgattggtggaattgaagttattatcacttatgcatgctggcagaactttcattacccgcatgatttacttacaccctatcagcaagcaaggctgagaaatgtaggctggtttttttggttttgtttttgtaggaaggcagaattcacaaagtcaaaaattgttaaaatagaagaaattttgagtgaccatgtgcctgctgtccaccacagggcgcttattgtccagaggacaaagctttaggtagctctaagtgcttgcttgtgaaatgtcttctaaaaagttacaaattaaggtcttattctaatgtggtaataatacctttgtgagagggtccctcagagagttgctgtccccaaattacaattggcctttagcttctatcagagaactttgagtacattttctttgccattttgcatttatagaaacaactccaaaacctagaagatgcttgtgatgacatcatgcttgcagatgatgattgcttaatgataccttatcaaattggtgatgtcttcattagccattctcaagaagaaacgcaagaaatgttagaagaagcaaaggtatgttaaaggttaattctgaaattagaatttatatcactataaagaacatgtaattatagatgtagggaaatagtagatgctagctatagctaatatttactgccttgttatgtcccaggcatgctccgaatgctttgccagcaggattttgttgaatcataacgatgacctgttatcccaatttagggacaaagaatagaggcttagagaggttatgggatttattcaaagtgacacatagacagtggtcttctgactccagaaccttgctcaaaactaaaagtatttagaaggtatagcatatattgaagcagaaaa

SEQ ID NO: 101499 - DNA, 1056 bp, Homo sapiens
aggatgtctttgcaaaattgaaagcatgccactcaagtaaaattaatggatgtaaatatgaactcttctggacaaattgcaaagacaaattgtgggctagtgaaaaatcttcaaagtatcttgcatgtttgctagaagataattggaatgacctagctacagggatgttttgtaattgttgctactgagtagtctctgagaagtccaataatatcctcttaaaacacaccagagagcaaagatgaacaccatctggcctgctttccaaaacagttggtcatcacagctgatgttaatttgaacattcatttcttctgaaatgaggtgggggctgtattcttgctctccaacaatgtccttaagttccagtctttgattcatgcatcagcctttctgttgctgccaatgtttattttgtttaaacatgaatttaatttagcatatttgtaataactaagtaatttatgctcataaaaatattcagataacaaaggaaaatagaaagaaatgaataaatactatccataatcccaccactcaggaataatgttctatttttacatgtccatctataggcctatgtttatctttctaatttaaatataatttaaataaaaatgaaattacatttactggttttttgacttatctttacttaatactaaatatcatgaatattttcctgtcaataaaaataaaatagtaattgttatggttgtataaagtatatgggtggtttggaatatattaactaatctcatatggatatgcattaggctatttttaaaatttttctatattaggcatccttttctaatatttatttttaatttattttaatattttaagttccagggtacatgtgcaggatgtgcaggtttgttacataggtaaacatgtgtcatggtggtttgctgcacccatcaacccatcacctaggtattaagcccagcatgcatgagctatttttcctaattaggcatctttttcttaaagcaaaatcagctctattgagacatgtacaaaccacctattaatatttgaagcatagaattt

SEQ ID NO: 101500 - DNA, 1044 bp, Homo sapiens
ttgcacatcaatgtttacagagatgacttacttgtaataaagcttaactggaaacaacccaaatgtccatcagtagaaaaacagatacaccaattcatataatggaatactaatcagcagtgaaaaaggaacaaactactgttacatgcaatcacatgttttaatctgaaaataaaacagaaaacttttggtgagtgaaaaaaaagacagacactaaagagtacaaattgtgtgactccactgacagaaagtcctagaataggcaaaattcattgatggtggtagaagtcaaataatggttactcttatcaaataaaagtgggagggcagtgattgagtgggaataggcacaattttgggggctaatggaaataatctatatcttcataagttgaaaggtttgaggattatataaatatatacactgaattgtacatttcagctgtgtgtattttataatctgtatagttttctattaaaaataacacatggggttgcataactataatatatcctttctatgtgttggctgttgctgttaattatgggatagtttcttgctaatttatatatacaaattataaagtatgaagtaattatcatttgtataattgcatataagttatgagttatttatttactcacatattaatgctttaaaatacatggattgttaatatatgctactaacattgcctaagttcaccaacagtctgcttagttgtgagtcagcttcatacactctgaagataatacctaagacatcaacagcatataaaaatgcatttcactcaatagcttttcataagttcaacagaatcctatttatctagctgttaactgaatcttctttttacaaaaacttatctgttttgtaatggcaaataagtgttattccatattttagtatcagcatcacccaacctttagtagttgtcgggtgaaaggccaggactgagatctggaggaaggagttccctgatcaattaagaatggccgcagtgtgcacctgagcagaagcaggggaaatggcagggctgaaag

SEQ ID NO: 101501 - DNA, 1100 bp, Homo sapiens
ttttagttcatttgttctgaaactagaaagaagacacttaatattggtttctgacttttgagcaaattttatttcctcggttaatactctgaatgtaatttacttgctatgcttgctaacaatggaaagcattgaatttggttttgtggcttatgctctttatcaattatatgccattgataaagttgtctacctccactgcaatactgggaaggttaataaagagagagcgtgctcatttgagtcagttctgtactgacagaacgtgcatctctggctatttgtggtatgtatatggcctatcagaaactacaataataattgagaccaatttaataaccattataccagtgacctagtcattcttgtagtttggtatatttaatgcatttacattcatttgtggatccatgtagaccacacattcattcatctattcaacgacttttcattgagtatcttctatgtataaggtaattctttgtaccaggagataactggtgaatcagagtaaaccagaaaatagatgaatggttagtatcgttgctctgctatgcactcatttaatgagtcattttaggattactatagcaacactattaaaaattttacagtcattcacatggctcgaaattcaagaattaaaagttcaaaagggtatacaggaaagattctctcacccgtctacccagagccaccaattctcctcaagagggcaatcaattttatagtttcttctctttcagccatatttcaagcatatatcagcatatacatatataggtatatttgtatatatgtcatgtgtgtgtacaccgcattttttccccacaaaaatagtatatatgcgctatccattattctctaactaccttgtgtcacttaataaatttcaaaaagctcttttaattattacttaaagattggccacatttcttttttattcctgtcagcatggtatttcattgtgttagatattctattaattttgaattcttgttgattatattttatcattattataaatagtactacaatgcatatctttacataagttgctttcacttagatttttttccttaataactagaattgcaaat

SEQ ID NO: 101502 - DNA, 1041 bp, Homo sapiens
gggtgattggagatggtgtcatgctatccttggccttatctgcatttctgcttcttaaacgaatgaaatgatgaactagatgatcatatggtagacagaagggaaaagagtgattttatttatctgtagacagagctctttgaagacctgtcatgggcacacatcaaagacaaatgttgtgtgcatcaaaggcttgttggcttttgaggtggtaggtgagaaaaaagcatagtttggctcatatctgtgaaaggtgttttggccatctcagtacccattggagaattttgtgtagctaaagagacctcatgactttgagtttctggcagacctactaactgtggatggaagcaccaggggctggcttctcactgagatgcttctattcatatctgtcccggtggcattccccaagtggtgtctcctggatcccctccatccttgaatctgtgcctcatcccacaccccactgctcaggtttgaattggttctgcagtttaccagtggtttgaccttggggaagtcacttcaagtccctgcaatgtagggatattataggctccaaatcactgggtagttgtgaggattaaatcaggggttggtaaattatgatccaaaggccaaaatgcccctctctcctgcttgtttttgcaaataaactttcacgggaacacagccatacccattagtttacatgtaatctgtggctgtttgcacacctcgcagcagcaagttgagcagttgtggcagagaccctgtggctcacaaagcctaaggtatttactgaaaaagttagctgacccctggattaaacaagtgaatacctataaattcaattcccaaatgtttatgggctgctatattgaggtattgagcctataagagtgaagaaacacagacaaaagtccctgccctcatggagcttacagttcaaggagggaaacagataataaagcaaaaagaaaacccccaaaatgtaaaatatatgtaaagtgatttagtggtatggagggggaaatgcaggaaataaagagaaagaga

SEQ ID NO: 101503 - DNA, 1071 bp, Homo sapiens
tgtgtgttccccttataacatcctgtgctaagtgctcatgctccccaaaattcaggtccctctaaatgatggtgatgggaatccaactctgacagtttgaccccagatgtgtgctttacactgacccaagatatagcctagcaatatacgatgtaaaaattaacattaactcattgactcaactactaaataggtactaaaagtcaagctttttgctagacctgagaatatagaagttgaatttagctcttgccctcaaagaatttacagtctagggggtagacctgctcctaaactagcaattaagtctttaatatctatgcatttattctgcaacactgaatttaaaacaggtttttctcagaagcaattttgtttctacaaactgtctcctgggctcagagtccctcgtgttaccgagttccttgaaagccatgcttattgcttttaaatgcaacatatctcgggttgatgtttttgttctatagtaatcctttcattcccttttttatttgagagtttgaaaataatgttgtgtgcaaaatccctaaggaattagcagagctgatttgattcaaatataacttcccaccctgtgtgcagtgtcatgcccctgagtttcatatacatgagttctaaccccttcttgtctcttgccaagatttatcagcaattggttaacctatttgggttagcttagcttcattttcttcatctgaataatcggcataggtatggattctcacaagaatcagatgctattttacagaagttttataacaagcttaaattttgaaataaaactaaagcatcatgatgtaggcaacatgggataaaattgtagcctaaccactgtgtatgctggagtcacgcaatttgaattatacagtctttgaggtttcatatgttttagtttaaaggctgactttgccatttgtaagctgggtggctttgggtgatttgtttaatatttctctgttagtttccttattagtaaaataaaataataatgttttcttttataggctttataataacgatgaaggtgctggtggagatgataaagtgatg

SEQ ID NO: 101504 - DNA, 1049 bp, Homo sapiens
gtgattgatacccctgttgtttccactctaggtcaagatttcatatataatcacctgggctattgcaatcaccttctaacttgtttccttttctacccctgcccatttttgattgaggtgatttttgagactgtaagatcataccactcctctgctcaaaattctgcaagtcttggccaggtaaggtggctcatacccataatcccagcactttgggaggtgaaggcaggaggattttttgagctcaggagtttaagaccactctgggcaacacagcaagatctcatctctactaaaaataataataaaaaattatctgggtgtggtggtgtgtgcttatagtcctagctacttggaaagactgaagcaggaggacttgcttgagcccaggaggttgagtcagcagtgagctatgatcatgccactgcactccagtctaagcaacaaagcaaaaccctgtctcaaaacaaaccaacaaaaaacaacaaaaaaacctacatgtcttatattttacgtataataaaatacagagtccttcatggcctctgaagtttcccatgattgtgtgtctgcatccttctgtgatgtggtcttctatcacccttccctttactctgtaagctgacttgctttttcttaattatggtagacacacttgccccagggtctttgcacttaccctctcctaagaatgatctttccctgcttgtggctcggcttgctcccttacatcacctggccttctggttgaatggtgcctgcttgagggacctgtgagcaaccttcgaggcagcacctctctccctcatggcacttaccatctgttatctggtatcatgtcacttttcaccagctgtggtatcctttttttaatgacatgacttctgacatcacatttgctgttctctttttccataccaattctccaataataattagtgctcagcaagttaattcaatgctggtactaactcctggagcttgtagagatcccgctggttaaaggctcaatcccacaagactgtccctacttcagacgccaaccacaa

SEQ ID NO: 101505 - DNA, 1033 bp, Homo sapiens
aggatgggaggtgtccagtggggcctctgtgggtaactgagatttaaactgagacccatgtgggaatgggagtgaggtaaggagagatagagaaggccctgtgccaggagaaccacagtgtcttctgggaactgaacaaagtccacggtggctgagacatagagcacatgggaaaggtatagagaggacagtggtgagatagcgtgggcaagaccacagggggtcttggtggtcattctaaggatgcaggcttttgtcccacgtgcaatgggaagtcactgaagtgttctgtttatgcacagtaatatttcaagacttatgttttgaaaaaaaaatctgctatgtgcagcatgcattaatggggattaaaatggaagtggaaagatcaataagtagttgtgacaagatgatagtggcttgaattggggtagtggcaaaaaataaaaataaacaaacacatcaacagttgtatctggtgagtcctgaggcacttggtgtagttggagaataagatacatggtgctgagtcactgacgtgatcggtttgggcactttttgaggagaagtggtgtgacatttcatgctaagaaatttgcatttatactatgaaaagggctgatggagattaagaagcagagaaatgaaataatcagattagtgttgtgcatggaggatatttatttcacttcccacctactgcttgagctaagcatttattgaatttagagtaacagacgagagaaacggaacaacatcattgcaggcaaagattgatggaaagtggattcttttgtataacagcacaaaagagatatatgaaagggaggttaaacttgtcagtgtgaaaagctattgatcttgtaaatacttaccctgaagccacctaaggcttcgctcaggcatgacccaaatattccaaacctccaatgcagctgaggatgcggatgtaactggatgagagatgaccactgtggaaatataatgagccaagacactttgtgggaagggaggggtttacaaaagtgttaaagga

SEQ ID NO: 101506 - DNA, 1050 bp, Homo sapiens
tccaaatatgcaatgaatatttctttccactatttggctaaaggaagttctttgttgaaactagttcaaatatatgcattggcattttcccaaattgttggccagttaagtgcatagtattactgtggcattttgtttaaatgattgaaatacagttttattcatttagttatagaaattacaagttgatcaatataactttaataacatggaaccatgacataattgttttgcacctgcatcttttgtgagcacaaaagtgtggatctagttaatgtgttcttggcaggaaaaaaaaattgcttttaatggttgtattgctttagtcttttattggcatatacatttttattatgcaaatttaaaaattctaaaaatggtcttcgctcatgtaaatagtgcttagtgtatgttgacaggctgtatcattattatgttatttaataggatctgcatttaagaaattattttctgggactgttaattaataggaaaggtttatctttctgaatatgcaaccgaaatctagaatgtgaacttgaattgtttttaaatgcctctatgttcctacaatgtctttgatgttttattcctggggattttagactaaccttttgtttttctcccagagagattcaatgtgtatttgatgccatctcctaacttagatgtacatggcgaatgtgccttgcagattacatatgagtatatctgtctttgggacgtccagaatcccagagtcaaactcatctcttggccgctaagcgccctgcggcggtatggacgtgatactacgtggttcacttttgaggcagggaggtgagtttaatgacttttaatgactatttttctgtttgtgtgtgtgtgtgttcatttttaccatgctcgcatcatatgaggcggtaggtttacatatgagatccagctgaagtacacttgaggaaattcatagagttgcgattacataatatgaggggtcttgtgaaatatttatatactcaacatggcttttctcccctgtggaagattttaatgtttcacacacatggt

SEQ ID NO: 101507 - DNA, 1196 bp, Homo sapiens
actccatatttcaagtggcataattgcctaaaaagaaaatcagcctccagccaagctagtgagaggcataatgataaagcctgtacttttagaacagctgataaactcttatgcctatgaaaaactggggtccaagaggccattcctccatgatgagagacatccaatgttaacctgtttcttgtgtgtgtgtgtgtgtgtgtgtgtgtgtgtgtgtgtgtgtgtgtgtgtgtgtgtcaaatgatcctttactgaaatattttcctttgtgcttaactggctgggcattccacagcaccactgttgatgtcatctatgatgtcatgagggtggcggccatcaacattacagcccacagactgggcagtccccaggatctctttaatggttccagagagttctctggctaaggatcggtgccgcatctgtcgagcaatgttgacgatctcatcaaaagtgatattcccactgtgtttaatgtttttctgtttctttctgtctcttggtggttccttgagggctttgatgatcagggcagaggcagaaggcaccacctcaatctgggcctgtctgttctgaatggtcagtttcactgtaatcctcaggcccttccagtcaccgttgccttggcaatgtcatcaccaaccttttttggagacagacacagggggccgatcttgggggccagggcagaagtggcaccgacttcacctccggtgcacctcaggtatacgactttgatctcgttggggtcgaacttcggcggcatggtggaggcggctggtgtcggatgaacccggattcgggacgaccgaagaaagtcgcaccttggcctcctccgagcccaaagccgaaagctaaccccctgtttcacagaaagaggttttgctgcttggaaaggaacttcactatctccacctgtgcctcttggtgtcatgtcacagtttctctacaacaagcacgtgcatcccactgcactgagagagagtatgattcagtcttcactgtggttttggagtgtctggagtctcccacctcatgtttaatgactcttctgtcatttgccaaagtcctgccacacctgattttcactctgttctctgtttttcaaacacactggttctttcctttctcagaaaatgatttttctctacctgaatttctcttagctttgctgatttcttttcctctctcaa

SEQ ID NO: 101508 - DNA, 1043 bp, Homo sapiens
aaaagggatcaaaacttcctggaattagggaaattcaggacataattgcttaaggatgctgcattgcagtttctgaatttatccaaggtttctctcttatttgttcatattgagttacagaatctctgactctagggtttatgatgcctcaaatgaacctttgtagaccaagcagtttgatatacataatgtccttctttcttggaaatctcaactcaacagcactgtgttcagggagttacctatgagaatgttaattacaggtgactcccaaggaaataagttatcaattatatctgagtgtttcaatatttcctctgaaatgataataatgcaccttacgtttcagtattatctgatagaatgctgtaaattcagctaacacttgtcaagaggcttgtggcatctttaaatcacagatcttaatgaaggtttgtcaaggcccaagctaagtaaatgtgtttcatgtatcaaagggaattacatttccttttgtccctctatattcaggctaaaaacaaaggggaaattaacttgggaagtaaattacttgttattgggttggaacaaaaattctagcaatattctcctaaacacctttttggtaaccatttaaagatatgaggctaattacaatctgtgtgcaaaatcagatttataattagtactgaaatgaattactgcatcaaaaaattgaattcttgtggtcaaagtagattcttcacacaatagatacactattttgatatacaaatagaaacatttactttaggaacaccaatttgaaaactgagtgttttttgtcatgatactttctgccttttgctccttctgcaaaaggccagatttgttttaaagagggaacaggggcatgatctagtctttttctaccttgctctactacctcttgactgctgttcttctgccacgttgtagcagagagaagttaaaatggcaaagccttcctccagctccctcctgggttgatttttgcagcttctagggctttaaaggaccagttcacatggccctttgtgctttat

SEQ ID NO: 101509 - DNA, 1053 bp, Homo sapiens
aatagttcagtttcccttcgctttctccctcttcttttaaaaaattaaacacttgattaaacaaacagaaaatcatttctttgcaaatgccagcctgcagaagtgtcttcggcagatagtttttccagccagttcttctctaatttttccttgaaacacccaccgttcatttccgctacccctgcgctttcccctaacgcccacaacttggtaataattgggaggccagcgccagactgagtggattcaacagtcattaagcaaaatgcaaaagttaaaccagagcctcgctggatcgcacagctgttcctacacctgaaggggagccacttttattaaattatgcatccggtgtgccttttatttcctcaatgagaacgtggttcataagtggttatggggattaccttaaccaattaatttcaacaatttatagccttgaggcaatttcactgcagtatgtagtgggtggattgagcatttgagcttatgaaagaataatgatttgttttttgaactctggacattccatgggtcagggaacatgtcgtttggtatgctgtacctgcccagctctttggaggcgttctctcactcaagctgggttaccccctcaggaaacagagtcacaatgtccctctttgcagggttctaattgtgtctactatccacaagagcctcatatgttcaggaataaaaataatcaatagcttcctggttagactgaccaggataatgggaaatgggcttgaggagggagagcagatgccaggagcttggcaggcaggtttctggaaaggttttgctttcaaaatcatatataagtagctgggccaggcaacctgacctgttgagaaaaagtcctccaaggccaacagttaagagtctgacaagcatttcttttggtcctactatgcactgagggcagcacaggatgtaagaatgaatgagacctggagcctgcctgccctcaaagggcttacagtctcccaggaacaggtattggcacaaaataggctcccatttgtatttgagtacagaaatcctacaatt

SEQ ID NO: 101510 - DNA, 1014 bp, Homo sapiens
ctccagcctgggcgacagagggagacactgtctccaaaagaaagaaatcccagcgtagatccaaactgagacactgaggcttcgtccttatagtagtcaggagcaggcgattgaagtaattctgtcctgcggggttcagcatcatgcacgttccccctgggccattctctgatgcagggcacttgctccacactctgggaacccagattcaccagtctgccctgtcacgtagttgaaggagttgcatttatctttctggctcctaattcctttaaaattacatttgttgcagaacctccacaaggctaaataaaattacatttgtgaccatcagagaactgaataaaccattaactggccatcctggttttgcagagatcaggttgttgacagttcctggttgacccacagctacccatgtcagttatctccactaacatatccaagaatctttgtaggacaatttctccacctgcaaggtctttcaggtagaactcttcttttaaggcaattagcccattgccaaaaggttttactgtcttaaagctgtctttctgagatctaattccaaggacttctccacagctaagtgagatgcctcacaccattaggtgatgctttggacagaacagagtattttcatcttgtgtttaaagcaattccttggcttcggctcctcaccactttctatgccagtctcccatttatgtccctagtaatgcctatgcaaaaaaaaaaaaagaaaaaaaagaaaaactgatggtgaaacctacaggtttaagggcttaaatctcaaactttgttaggagtaacaggagcgtgctgagcgggcaagcaataaaacaaatcataccaaaaagccacattgctctctcctaagccccaaccccactccactcctgtggccaggggtccaaacagaaaataaccggagaagacaaggaggtcaaaggatcagggaactaagcattatgtgaattcaccagcaagatgtacagaacgcctgtgtttaca

SEQ ID NO: 101511 - DNA, 1860 bp, Homo sapiens
gcagcatgtgtctacatctccaccccagtgctgttacagtgggacagtttctagtgtattgtcattgcgaccaggcttttaagattcttagcatatctgtaatatccacatgcagatgtagaatccaaatcgtatttacagagaactttgcatggcagcttttatatggtagtgatacattcagtttcttacattctagattattcagggaggttctggagttggacagatttggggttaagcctgatggctagctgtgtgaccttacacacctcgcttcatctgtttcctatgggaatttataatagtagctacttcctagggcacaggatctggcccaggggaagacctcagtgttagtggactctttaatgattgttagcagctgttgtgatcataaaacgagaagcacatcaacctgagcctccctccgttttcaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggtaagacgcaactgaaaaggacccagcacatctgctggaattctttccttatcagcctgaactgcaggccaagatccgaacatctatactatttgatctctctaacctgtgttttgtgatattttatcatttgttgtactccaggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtctgtgtggagtgctgtgtaattctttccaccatctgttcattgttggcctggaaatgagcaggggctgagaggagcaggtctcgccctcatctagtcctgcctcttctggtctctcctgttgggtgtactcctaatacttcattatatata

SEQ ID NO: 101512 - DNA, 1031 bp, Homo sapiens
agttgatgtgtgtgtgtgtgtgtgtgtgtgtgtgtgtgtgtagactcctatataatttctacaatccttgctttaaaacctgcaaaatgtattttttgttttgtcttttcctttttgagacagggtctccttctgtcacccaggctgaagtgtgatcatggctcactgcagctttgacctcctggtctcaagcaatcctcctgcctcagcctcccaagtagctgggactacaggcatgcaccatcacgctcagctaatttttaaatttttgtagagatggagtcttgctatgtttcccaggctggtcttgaacccctgggctcaagtgatcctcccacctcagtcccccaaagtgttgggattataggtgtgagccactgtgcctggccaaaacctgcaaaccatgttaaatctatgttgtgttcctttcggaagagatgtctaatattaacttgtgttatataaaatctaaaacataggctttcaatattgttttaacagtatataacagaattggcaaatgccctgtcttactgtcattcgaagagagttattcatagagacattaagccagagaacttacttcttggatcagctggagagcttaaaattgcagattttgggtggtcagtacatgctccatcttccaggtatgtaactttagaggtggaagttgtttggtttaccaaagccctgggagctaaccgtgagctaaatgtaaaatatttcagtgtagattttgtgctgtaagaggggtaggtggctaacccagaagtactttggagtaatttaggcttaataataaactagggtttgcaagaaagtgttattctgtggagatttggggctattagcagtgttctaggcctagggttgaagatgcttaatgtccttagaggctaatgaagggatgaatgagtcaacagataggacacgtatatgacagaggtgaagtgcccacatgttgagtgggaggaactcttcacctctgctgcttcctggatgaggagatggggagatggttcagagga

SEQ ID NO: 101513 - DNA, 1021 bp, Homo sapiens
gaaacatgcccccagatggtctggaagcattcctccctctctggtcacttatcctttttgtggtcttcagcgttgtcatggccctgttcctctgagcatagtacgggcttgggacatttcccatagagtgcttcaggtctaaaacccgagactgctccttgtcactgactctcacacctgacggcagctagggacgtcagggtttcatgtcgtggcagctctttgatagtggttattgccttggttcttgctgaggatgcatattgagtgaagttggaatacgaaattatttgtagaatgtgtctgctactcattgaaaatttgttagaaaagctttgttttcttcacattctaaagtgttcaaattcctcctaggaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggtgagttttcaggttcatgttcaaaagaatgttcaccaatgctgcacccctccccctcctgtaatgtcagcctcccactgcccaggtcccttcactccctcttacgaggcactgccttcaaatgcatggccccgttcctcacctccccctcccctatgaaaaagattagataagcttctgtactgcactgggttataagcattctcctgtgattctcccatgctctgcatgttaaaataaaattgtattcctttttttttttttaagtataaatttattttttagagggcctgcttttcatagtaccacaaaaaatgattaaatttgtcatctttcaaagagcacttaagtgctctgatcctggaaaaatcacttgaggatttaatgttttgttaatagaatagtttatatgggcaagtctttctggtggacagtgaaggggaatggcacccct

SEQ ID NO: 101514 - DNA, 1013 bp, Homo sapiens
ttgaagtcagatgattaaagcctacatggcatcctgagctactgaaaggaatgaatagagaattgggggcggggggcgggaagcagctctaacacaagttatgggacggtgaacggaggaaatgtatggtgaatcaagtttgttatgcagacagaataggtgatcttctgggtggtgtcagcctctaatctctcatgtgatccgagttaatcttccctggtttataaggattcgtgacaattgaggtatttttggagggtcagactttaggcaggtaaggaaagcacagggaaagcctcttcccgcctgctgttctccaggtgccctcagttcaaggtaatcagcccgccaaagcatcttgttttgggctggcatttcctgaactccttcagtggttaagctcagggatctggagttggcaattctggtgtgctttaaccttggacaagtaactcagccactttttacgttgagtaggtgtcctgacctccttgaacccatttcatcatctttatttgtgtcccaggattttctactcaagcatagacctactatgttcatgtactacttcatatacttgaatacattgaatgattttattcagtgaactgatgcttacaaagtacttagcatgacggtatctggcatgcaggaagtgcttaatgttattggttattattaacaccatcagtgtcatacagtgtgtaagaaatcaggctctgggccaggcgcagtggctcgcgcccgtaatcccagcactttgggaggcggaggcaggcagatcacctgaggtcaggagtttcgagaccagcctggccaatatggtgaaaccccgtctctactaaaaatacaaaaattagcctggtgtggtggcgggcgcctgtagtcttagctactcgggaggctgagacaggagaatagcttgaacccaggaggcggaggttgcagtgagccgagatcgcgccactgccctcaagcctgggcgacagagcgagactccgtctcaaaaagaa

SEQ ID NO: 101515 - DNA, 1105 bp, Homo sapiens
tttggatctagaattttatcttggcctttttaagaaaaaacacttgttttgttacgcccttaattttgatttctttcaggaatggaaaacgatgacaccgcagttcagtatgcaattggtcgttcagatactgttgcccctggcacagggattgacctggaatttgatgcagatgttcagactatgtccccagaggcttctgagtacgaaacatgctatgtcacatcacataaaggaccatgccgtgtagctacctatagtagagatggacagttaatagctactgggtctgctgatgcttcgataaagatacttgacacagagaggatgttggccaaaagtgccatgccaatagaggtaaaaattccagtcacatacttattgattgccttctgtttttcatttttggaaaaatgagagtatggttgaaaccagctttagtttgctacagttgtggattgtgcacttggattcagacacattctgtgccttgagcatctcttcttgttggtctaggtcatgatgaatgagaccgcacaacaaaatatggaaaaccacccagtgattcgaactctttatgaccatgtggatgaagtcacgtgccttgctttccacccaacagaacagatcctggcttctggttcaagggattatactcttaaattatttgattattccaaaccatcagcaaaaagagccttcaaatacattcaggtaggaatctttagaaaggagctttacattttttcttaaatacaatgagctattgtacaactattctctttttaaaagtagtctcagtgatcatcctgtaagatgcgtacagaccaggatgcatgcccgatggcacatggatcagattttgttggcacatagatcacatgctatcatgtacctgctccctctggctggtcagagtttataatctgaccctttggagggtttggaatccatatcactctctaaaggttgtagatccctgttataaacaaaacacgaccagcttcactaatatataacttagaggaataaaaaaaaagttcatttgaaagtattaagtatttcctggcaaggtgacattcggtaccctattttgaatatgcat

SEQ ID NO: 101516 - DNA, 1736 bp, Homo sapiens
tgtagctaaactttgggaaatatcaacgggacgaacactggtcagatacacgggtatgtgagacgttgatgttacttaacatttctgtagtgtttacactttccagaactctcttttaagacctcacaatagagcaacacaatatctatgcattgagcaaggcagatgttaccctttcttagataagaggaaaccaagacttacaggttaagtcatttagccaaggctacacgacttggaaatagaacggtgctttctttgctcttctgagcacctcacaccgtggactagggctggattccatgcaagtaacatttgagaacctggtgatccatttgtagactggcatgccctcttcccacagaaatgtgaaagcaatccagagaaaagtttccaatagtagatctcagtattattaatatatgtattcatgaaagaatggctgagagggaagatcttatcccattcctaagagagcagacctagcccgcaaaggaaaccacgttaattctgaatgcagatataaagtaggctcagcagacagaaaaaaattgcatccactgaattctcatttatgtatgttggtctcattggtaacagtagtgcctgtggagtctttttataatgaaatccatttaaatttatcctatcactagtagggcccaagtctggttatttgataatgaatgttaaaacactgtcttctgttccttgtagcagcaaagactgttgtttggtagaaaacctccagaaaatttctgattgtttcttccattgtgagatatgtttgtatcatacactaaaattggcatgagcataactcaaaaaaaatcacaagaaaacagtattggaagggactggattgtgtttaagtttgcattgaagagtcagtgacatctgacccactagggggcagcataacttgccttagatttgtctcattgtaaccaaagttcccttccccagccatctttctggcttctggtaccactagcaaatcttaggaagagccatttttatcataattcttggtgacttcattgaaacacttgtataaagttgttctgaaaagtatttattataaagaactactttataatagttgtgtttgttgcaaaaagaagataaaaaagtgatcagggtaaatgtgaaagtactccccctatagaagttataactgttttaaggagtgtgctgtatctggacagatacacaccagcctactgacaatagcttatatatttgctctaggaatgttttgggtgttttataatagtatgaggttgattggcttgttttagtggggaatagcagtgtggtttttcaaaaatgtgattatgctgaatttatgcacagattccccttttccttttttctcatttcacaggtcaagcgcctgtcatgtcagcatgttaagatttctgttcccagttttaataattagttagaatttgggccaggcgcggtggctcacacctgtaatcccagcactttgggaggccgaggtgggcagatcacaaggtcaggagtttgagaccagcctggccaatatggtgaaaccccgtctctatgaaaaatacaaaaattagctgggcttggtggcgggcgcctgtagtcccagctacttgggaggctgaggcaggagaatagcttgaacctgggaggtggaggttgcagtgagccgagattgcgctgctgtactccagcctgggcgacagagtaagactccgtctcaa

SEQ ID NO: 101517 - DNA, 1275 bp, Homo sapiens
tgtggcaggcgcgggtttaagtggacgccaggtgcaccggacacaggctgtgtttaaccacaccgaggactatgtgttgctgcccgacgagaggacgatcagtctttgctgctgggactcgaggacagccgagcggagaaacctgctgtcgttggggcacaacaatattgtacgctgcatagtgcactcccccaccaaccccgggttcatgacgtgcagcgatgacttcagagcgcggttttggtaccggagatcgaccactgactgagccaccctctccgtagggttctttctcgaggactctaccctcctcccccacgtcctgtctcagctgcagtcgtaagtccgtgcaccatccttgacgttttgctgccacctctgtccacattcttcttggatttgtataaaagaatctttttttaccttgatgtagaatcatggtggaaaaagttggaaacacagatctgtgcagttctacattcactgattattacagtgtgattttcatcggttttgtaagtacaggacttgccgtttcttttgatctcttgattgaaggaggatagggcattaaagtgcttttgacatgaggaattttcatttggttcttctgtcaactttcttgcttattctgctgaaccctctgtgtatttcccttccaggtatatttgaacagataagcaggcatgcagctctgagactcctgagttttatgccattatcaaaagcattttcaagaatccctcaattctatcctgaaatgatgttattctgataataaagctcagatctgcaactttattgttatatatttttcacttctgtaaaattaatggccagtttttcctgacaatttataggaacagtatctttcaacatactccctacattatccttcaatatctgcaatacttgtctttagtaactgtatttctggtaagattatgatttcatgagaaacaattgaaaatatatccgatctaattaaattaggtcagcctgctattgctctcaggtgttgcctgtcttcacgaatgattagtatcgattgacctctttcttaggtggttttaagtcttcagttctcgtcagcatgaactaacttctcatcatggaggcacatagtaactgcattctcagaagatttatgcagttaaccaattgatacaagttttctttttcttgaatttttttttttttaattgaggcacagtcttgctctgtcacccaggttggagtgcagtggcgtgatctcagctcactgcaagctccgcc

SEQ ID NO: 101518 - DNA, 1144 bp, Homo sapiens
aaacataaactttgctttatatttatcccaaaaaacaaataccttatgatctgcataggagtacctagaaatataatctgggatcatttgataaaaatagtaaatagattgaagtaaaagtcattgctttatattataggaagttttgttttgttttgttttgtttgttttgtttttgagacggagtttcgctcttgtcccccaggctttagtgcaatggcgcgatctcggctcaccgcagcctccgccacctgggttcaaacgattctcctgcctcaggctcccgagtaactaggattacaggcgtgcgccaccatgcccggctaattttgtattttttttagtagagacggggtttctccatgttggtcaggctggtctcgaactcccaacctcaggtaatccgcccgcctcagcctcccaaagtgctaggattacaggcgtgagccaccacgcgcggccccatcatacgaagttactgaagttattgcgtaaacattctgttttagtcatccttgaggatcgttttaactccttgatctgtaaaactgtcttaagcatcttaacatgttacatcacagggttttagctcagatttccaaagagccatattttttgatgcatatttccagttgaattccagtgtgaatttccagttgtactttgcattctgattctttgatatttgaacttggccatctgtgggtgctactctcgtaagactaaaaggcacctactaaatacgaacaaggataaccagttctaccaaaaacattaccaaccaaacctcccctgttcttttttcagactttccttttgctttcaacctcttaaactgtaaaggagagatttaatgtttccctattattctgctttgactcacatactaaaatgaccacatggcactccattgaatcttttcagttgttcacgaattaaaataatgcccatgttttacagtttttcgagtagtctcagcaatggatctgtagtttcaggacctgtttttaaaagatcaagatacttttatgtgtttcagaagtagctgttttttcattttttgtgggtttgttttttttgtgtttgtttggttggttggtttttggtttttttgctttttaaaggtcacagtgttgtgagcctg

SEQ ID NO: 101519 - DNA, 1061 bp, Homo sapiens
cgtgagctgaggactcagctacaaggagaggaagaggaggtggtttgagttgaggggagctctgtgccactttcatatctgtgcccaatgatgggcatcctgtccacaccacgccttcctgtctgcaccaccacaggtgatggctttgttttccagcaccaatccggtgcctaagagcagggcctctactccatctctctgcagacttcagggagaagcactggagtgacaaaagtaaacatcggaggcttcacttgggtgacacagatcaaagacttttccaaaaaaagaatgctgcaaatgatgtttaaagtcatgattatatttaatattattagggtggtgcaaaagcaattgtggtttttgccattactgtctacggcaaaaaccgcaattacttttgcaccaaccaatataaattgtaacagatttgagacaaaatataaaatttttcaaattgagcagaatttatcaacccagaatctataatgtatgaaataaattaatagagaacccaacagatcatgttatgttgtaaatataacatctatctttaggttaaagtaacatagcaaaaatatatatttatgggtgcaagacacatacataatttgtaccaatctcacagaactaattcaattcaaaacaacaaaaaacttactctattatctaatggatgcaataaaaattaaccatttgaagataagttctcttgcacttcccctacttacgtttttcctggcacctgctatactgtgtatgtatttcttcaccgctttactgcctgactcccctactagatcataagttccaagagggcaagccctctgaaacactgctatgtctccagcacctagaacttggcatgtagtaggcatccaatacataagtgttaaatgagtgaatttaaaacacgtacatgccaggaatggtggctcaggcctgtaatcccagcactttgggaggccgaggcgggggatggcctgaggtcaggagttccagaccagcctggctaatatggtgaaaccccgactctactaaaaatacaaaaattagctctt

SEQ ID NO: 101520 - DNA, 1039 bp, Homo sapiens
ttaccacatccttttataaactgtcttagcctgcacacggctgtacgtggttgatttgtatcaagtcttccccgctagacggtaagttcctgatagcagaggctgtaccctttttttctctgcaactagcatggttcctggcacactaaatatttcgaataaacaaatgagtgaataatccctgatctcacaagtaatcgaggaaattataataatttctttgctactgacggggacattgagtccagggatattaaggtgactaagatcacacagctggtaggtagtgaagccaggattcccatccacttatttgggatttcaaagttagcacaagtaattactttttaatgataaaatatttgtaaagcacctagtagagacttctttacaaaaatatttgtaaagcacacgtggagacttcatgtattctgattcaggagctggagagcttgtttaaaaggtaaaccccttaagtcactattgtatttgaagcattccagtggcttcccatcacattaagaataaaatctcgtcagacccttgagcagaccttgcctatgtttctgacctcatcttctgcccctctccacctctttcatactgttctagctaaacaggcctcttgttcttcaacctggagtgtgagttcatcaatctgaaatactcttcactgagattgtcacatgatgagtttctttacttcattcagttttttactcaaatgtcatctgtccactgtaactgaaatgtgcctcacttccaatattctctcttctcttcttaacagtgcctaccactgtgttgtttattgtctctttcccacgtagacaggaaccttgtgtgtcttacctctgtaacccctaccatgtgtcagccacataatagacacctaataagtatgtgtgaatatgggaatgaatgaatacccaagaggatgaagtgtaccctctgatcatacgtacatgtaaacaggcgaatgctggataattagcattcatgagtggttttttggctttcaccaaaaaagtgtttagct

SEQ ID NO: 101521 - DNA, 1096 bp, Homo sapiens
atgggcgtttatttgatgtagtattaattacttgtgacttttaaaatcctgacttcagccaggcacagttgctcatgctttcaataccagcagtttgggtggctgagatgggcggatcatttgagtccaggagtttgggggcagcatggcaaaaccacgtctctacaaaaaatacaaaaattagccagccctggtggtgtgcacccatagtcccagctactccagaggctgaggtggaaggtttgcttcagtccaggaggtggaggttgcagtgagtgaagattgcgccactacactccagcctgggcaacagagtgagaccccgtctcaaaaacaaacaaacaacaaaccaaaaacccaacttcctatgtcattatctttgatttaaaaaacaaaaatcattacagtgcggtattactgaatatacttttatatgtagaattgtgaaccatgtgtctttcagagttgaaaattaattgaattttttgttttttattaggtcgacaaagatgctgaattagtggcccaatggaactattgtactctaagtcaggaaatattaagacgaccaatagttgcctgtgaacttggcaggtatggtttttacacttaatcaagatgagtttgttaagtgattttgagaattttgatgtgtaaatgcagttttccattcatcaagcgtggattatcccaagcaaatttgtgaggcataggctgtcgttccctgtctctgaacatagttctgtactcttctagtcagtttggtttatttaatccatggtttgaaaactgaggggctgggctgagcgcagtggctcacacctgtaatcccaccactttgggaggctgaggaggaagggtcacttaagtctaggagttcaagaccagtctgggcaatgtggtgaaaccccacctctacaaaaaaattaaattagccaggcacctggtggctggcatgatcctgtagtcccagctgttcaggaggctgaggcaggaggatcctgtgagtctgggaggttgaagctgtagtaagctataattccaccactgcaccccagcctgtgcaaaaaaaatagcaaactcaggggccaataga

SEQ ID NO: 101522 - DNA, 1045 bp, Homo sapiens
cttcacggtatgtgactgggtgtaccacgggttgacattggaatgaagtgaaggcaggcttatgttttaagtaacttgaaagatgtaatcttttttattgttcctttaatggggtttacattcagttgctattgagttataaaataccggggacataatcgtggctaatctgagctttctgaatgaacagcctgtcagcatgtagccagctatcgcctttgggggcgccgtgtttgcctgtagaaatgtgtgggaaggtggtggtgggctgtcatggggctcttgtgttctttttgaaagtcttaatattttccatatgtgctttccttggattagatatccaaggggaagaaagatttgtttaaacaaaggtgttacttttctgtggttccttgatgtttgatttgtgggatctgtcttccaaatcccttttccttctgtctagcaatgatgttttcccagggctatttcacacagtgacttgacttcatttctatgcgtgggaagcttccatttactgaggtgcttacactttgcgttggaattatgtttctttaatttcctctcctctggttcctgtgttcccatctttaaatctcttgtatgttgtgctgtttaattgtcacgcacttcagtttcatatgatgctgtatgaactcttttagagaaggaggatatatataaagttctccacaacagcagcggcagcagcaaagtcgtggactttctaagggaggagacccagatctgtgaatagagataatcatggccattcatgtctcagatctgtgctgttcagcatggtacaattagccacatgtgcctatttaaaggtaacttaaggccgggtgcggtggctcacgcctgtgatcccagcactttgggaggccaaggcaggcggatcacctgaggtcgggagttcgagatcagcctgaccaacatggagacaccgcgtctctagtaaaaatacaaaaaaattagccaggcgtggtggtgcatgcctgtaattccagctagtcggcaggctaaggcaggagaatggctt

SEQ ID NO: 101523 - DNA, 1050 bp, Homo sapiens
catactgaagctagtgatgttaagaactttctgaagtatttacttttagggaatgaggactttgttaggatttatactaactagggtttttttcaaacattgttgaaacattctgatttcattgagaattctgaatcattactttattattgatagtatcaaccctttatgacttcttataccatgtgcacacctgaggggctcctgttttcaggaagaatctgagccccctgctttttctgagcatttactgactagtcctgacaaacccaagtgtgtaatgacagggagcccctgctttctaaagaaagggcagagctcttgttaacctgttgtttacctgtcacctttctaccatgtgaatggatccctaattgaatcatatctgcttttgaaaaaaccccttcactagaaaattgttccagctctctaacctggtccctctgcttcaggagggtggctgtgcacattggcagcaggatttacttgtctttgaactagtctggtatttgatttacattttttgtttgtctccaatctgtttattttaggccagtcttttaaacagctgaaaaactgggtaaacctagtttatttttaatatctagtctactgtattcaaacccaaggtctctacccaaaatcactgttaaaatcagttattgtatctctgtgcagtagttcctgccactgggtaggaagctgtgtggagacatatggcagggcctagctgttggtgcagagggtatatttactttgggaaattttatcaacctgtattttttgtgatttgtgtacttttctgtatgaatcttatataaaaagtttttttaaaaaattgactcaacctatactaattggatcatcactaattccagattactttaaacatgatcctccgtcttgcccactaggattgaggcagcagttttatagttgttgtaaaatttgaagccttttttgttttgttttgtttttctttttacctttacatccatcatgaacatttccttcctcacttttccgcttaatggctcgaacatttccttc

SEQ ID NO: 101524 - DNA, 1023 bp, Homo sapiens
cccgcaacgaaactgcaacacgtgtgatgtttttgcccagggaagcaaatgagagactcagtacccagagttttggctgagggctggctttataccctcggcccagcatgttccagaattccacactcccataagcaggtaggtgtcagcatagaccacgttgttcatacaaaagggtctaggcacggtgagccaagctactcttgtcagttaaaaaatggcgggaaccctcccaaaatccaagttcccagacaccatccaggcaccagccttgcaagtgatagcactcttaacctgctacgctgacactttgctgtgtgcgggaactttccaaaccaaggctttgaccagaaagccggtaataggaatttactcggagcctgggggccactgcttggggctgagagtgggggactgaagcgtggcctccccattgactggtgatggaatctgccctctcttgtttgccctctccagtgtggggctgccttccaggaggatgatgtcatcatgctcaatggcaccaaggaggatgtggacgtgctgaagacaaggatggaggagagaaggctgagagcgaagctggaaaaggtaatgggagtcttcaggttccgcccagcccccatctctgctccagagccgactgcaaatcactgaactgagctggcagctgcttaggggtttgcatgatcaaggcgatttttataacctagaagggcctggactgtagaagcagattccagctgaggcccaggcactgccttgctgtggtgagcacggcggctctgctcttccccgccgagctttctcatcagtgaagtggggtagtgacagcatgcgagggcacggagctgtcagcaggctccagagaccatggccataaagcactgacactgacacggcctcagcaagcccttggggaagggcagccaccaccgttgctgctgctgtcacttactgttgctgttgatttaaggcagtacatactcaggtctcatagcttgtaaaacaaaggaaaaatga

SEQ ID NO: 101525 - DNA, 1157 bp, Homo sapiens
atcttcactaattaacttcccaaggtgttaacttgtgaatttcagattagatttgtctctgaagtagggggcttttttaaaaagtcagccatggccaggtgcagtggctgacacctctaatcccagcactttgggaggccaaggtgggcagatcacttgaggtcaggagtttgagaccagcctggctaacatggtgaaactccatctctactaaaaatacaaaaaattagctggatgtagtggtgggcacctgctggagaattacttgagcccgcaagctgaggctgcagtgagcagagatcacaccactgcactccagcctgggccacagagtgagactcttattattttttttttttaaataaagtcagcctgcagttgatcgtggggtgtgcaatgatgcttgtctaaagatcactttcagctttggttattggttttgaaaaggtctcttttgctcagagagagctcttgtgactgccagctctgaccttcattcacaggtcccatttccatgaccaagaaccctctgaacctcccctgtcagaaggagctggtgggggccgtaatgaaccccactgaggtcttctgctcagtccctggaagattgtcgctcctcagctctacgtctaaatacaaagtgacagtggctgaagtacagaggcgactgtccccacctgaatgcttaaatgcctcgttactgggaggtgttctcagaaggtacttggggcacaattctaggcatagtggttgggtagttgaaggtgagtgtatcagaggcccaggaggtatttttaacatttatgtgactttatgcctaacactgaattctaatcgggttagagttttagtacatttcttctcctttagaaagtgccaaatgtgggaggaagtgctaaaacgacgctcacaaattctcacttggttagaatttgatcccatgtatgaagtgatagcatctgtattgaggggaggtggggggagcaccctgggtttgttccccagggagtttttgtggggccgttgtagtttcacaagtgaaaatttgtctgctcccatacaatttgaaatattcggtgatgcagagttggatgctaggaaagattgattttgtatcttacggggactaattgaaagaggaccctgctatcactttt

SEQ ID NO: 101526 - DNA, 1917 bp, Homo sapiens
gcctgattacccacgggtttggcagccaggccatctgtgccgcggtgtctgccctgcagaactacatcaaagaagccctgattgtcatagacaaatcctacatgaaccctggagaccagagtccagctgattctaacaaaaccctggagaaaatggagaaacacaggaaataaaattggaacgaagaaaggttaggagagtagggaaggaacaggactgcaaaaatccttctccaccgcacagactgggaacccctcctggcctgggggaagagtttgttacctaccttactatttaaagagccttcactggttctgcatcacccgcccctggacttcttagttgtttctctagcgctgagctatctcctaactttggacctattatcagaaggtgacaagtactggctctttattcattaagctttttttttttgaaccccattctttccttctctgaaagtggtgctataagttttagaatcttttaaatacattccctgggccaacagacccacacacttagccattgaaatgtcaaattgatgtgccctagatcaacagatcaacaataccttttttttcagtgttaaggtaatggttggtttttgtgtccgctaaatatttaccttgaaaaaaagaaaagtgtgtatctagcttcttcagagatcaagtcctctggtaggaggcaaaggttctatctgcttagcaactagttaataagtggtatctgacacactctaaaccccgtgttcaaacgggggccttctggttttaggaaacttgtagaaacgaagcctgctgattgatttttttctcctttttttttttttttttttttaactttgaaagttaactcttcaaatgggagactctttgaaatgacatgttcctttaaggtactgaagctttatttgcatatttatttcagatgtttcgagtaaacttgaaaagggtaggcacgaagcaatttgttgctgcttgtcacccccaagtccccgtggaggttctgtattttaagaaacagtgcgttgagtgtacagattttatttatgcgtaatttaatggggtctgtaaatactggtgcacttcttacgacttttttgagacatgggatccaattttaatattaacttttaatggtgatggggtaatctataacacatcataaggttttattcatatatatacagggtattaagaattaagaggatgctgggctctgttcttggcttggaagattctatttaattgaaactctctgttcagaaagcaataactttgtctcgttcctgttgggctgaaccctaaggtgagtgtgcagtacagtgtgtgtgggtgaaatggagatttggaattgaactctctgcctgtaaatgttccccaaataattgttgtgtgtatgatacgtgtataataaaagtattcttgttagaatctgaaagtctggctataggtttttgtttttgcttttgttttaaagtcttttgggtgaatggaattagggcagagctgatttatggcttgactgtggcttggttaatgccctgagcaggcaagttttgtgtgctgttggggaggaacctgaagtttcaccttttctccctagcgacactgttcagctaccccaggccttatgctgtcatcagtgtctctcaactgcagagggatagaatcatcctccccaccctggaggtgttgggaaatgtctgagggacagtttattgacattaagaggggccaatgttttgggaacaatgtctcatggaaggttactgtattgaggacaggtacactggcatactgtactcagcatactgtatagtggtcaagaatggaagtgaaatgattatgggtgttctttgggcagatgtttctctcttttttttttttttctttttttaagatgaagtctcgc

SEQ ID NO: 101527 - DNA, 1529 bp, Homo sapiens
tgggcgttaaattctttatcttgtaaacagggataatgacacctgtgccaccttctcctaggctatctcctcctcggtgttgggaaactgaatggagatcgtgcgatgggaggtgaaagctttgaaagggaaaagatatcatcagtttctacaggtggggtgggcgtggcagcaggtggcagagcaggaagtggcctaggtgagccagaaccctggtcaggcgtgagtgcagccctgcacccacataagctcacacgtttgcacaggctccctggcacatgcatgcccctgcatgcatgtacacacaatcatgtgtaccccagtaatgcacccactcacaaccaccagagcaaaacaaagacaaggagtggagctgtctgtggtgcacctggggccccagctcccctcccagcccatgactacactgtggagggctgaggaatggggttgctgagaaggagcccaggctgggggccatgtgcatgcgggtcaggctggcaaagccgtctgcctgcctcttgttttaggctgccaggctgggcaaaggccacgtgctcggtggaagagcccaagccaatgtaaatgggcccctttggaagtagggctcatctggagagcaagcaagcaaaacaagcttagcttttcatttagggaccgtcacagaaaactcggaaatgcaccaaagagttaatggtatttggcgctgatcagtggcattgagggtgctttctatttccgtccctttgattccactcatttttctatgtcaacatgcattagcattgaatgattatcaggatcgtcagtgtgggttggctgaagatatttgttgatggtgtttgtccagctcctttccctgcccccagcgcctcagtggccctcctgtgctctgagcggttctgctaggactgtgaattgtgaaagcttggacccggtgctgtgaggtgggagtgtgggctgggcctggtaatctgcagccctcgtccccaagtccatgggaattgtcacatggcctgtgctgggctaatcagaatcctgccttgtcatgttataggctgaccctggggagataagctctccctgaaatattaacattgtttctggccatgttccctttcccttcaccaccgagagaagcaggagggagggagggagagagagagagagagagaaagaatgattgtaagatatgattcattattttatgtacaactgtgatggttaatttcatgtgttgactgggctacgggatgcccagatagcctgtagaacattagttctgggagtgtctgtgagggtgtttccagaataatttagcatttgagtcagcagacggagtgaagaagctctgccctcaccaacgtggccaggcatcttcccatcagttgcgggcccaaatagaacagaatggtggagggagaactagttccgtcttctgcagctgggatgctcatcttctcctgcccttggacatcggaactcctggttgtcagggttttggacttggactgaatgacaccaccggcttt

SEQ ID NO: 101528 - DNA, 1024 bp, Homo sapiens
tcccgggttcacgccgttctgctgcctcagccttccaagttgctgggactacaggcgcccgccaccgtgcctggctaatttttttgtattttgatagagatggggtttcaccgtgttagccaggatggtcttgatttcctgacctcgtgatccacccgcctcggattcccaaagtgctgggattacaggtgtgaaccactgtatctggtcctttaaagaaaaactttatcttcccatgatctaggtccaagaagaactacagagaatttaacttttggcatttccattttttggctcaattgactgattcattcattagacaaatatttcttgagaatctaatatgcattaagctctgagctaggtgctcaggatacagagatggacaaggcagacatgtatgtgcctgtccccaaggaaagcagaggagatggccactgtgcaagcagctcacacattgttagttacaattgtgctgagtgttacaaaagagagggtggtgtgctctgtggacccagccaaggggacagagacagcttcctggtgagagtaatttgtcagctgagaccttgaggatgagtaggagttagccaggtcaatgggctggggagagaggatggagactcctctagacagagagcccagcctgggccaggcaggacagagcatggctccctccaggagtagagtgaggtcctgggaggaaacatggaggttgagcttccagagatgagccgtcactctaccacgactggatctgatgagggactgggattgaccccttcttcctcaagacactgaggtttctattttccctatgcaaatctcagtcttcttcttcttttttttttttttgagatggagtttcgctcttgttgcctaggctggagtgcagtggtgcgatctcggctcactgcagtttccaccttcggtttcaaggattctcctgcctcagcctcctgagtagctggaattacaggcacctgctaccacgcccagctaatttttgtatttttagtagagt

SEQ ID NO: 101529 - DNA, 1134 bp, Homo sapiens
gatccaacaggcctattttggctgcatgggtccaaaaacctaattgaaggaaagaattaatgacttacgtgacagaatcataagccagaggtgaatcaaatctggctttagggaaagctggatgcagggctctagctgaacaaaaggatgaggtttctctctcctctgtattggccccacattttcccatctcacaagatggcggccaggagctccagggccacatgggcttcctgattccagaagaaggaagcagcaagaaccttccggggatcccagtgtcagtctccttgtgagtctttgggttagactgggtcacgtgcttatccccgagctcatggaacagaacgatctgcttggctccggctctcaatattccgcatgggctgggccaaagaaataaaggaacaaaataactgaagggtcaacaaattgaggaaaccaaggaacatggagaaagctgagtggacgctgggtatggaacaagagatgtccaccataacgaattcactcaaccctctagggctgggctctgggggcaacagaaaacaagctgagccctcagcctgcatggagcttacgttctattggaaggaaacagcctcatcccgacggcccttctctccctcccctggggagactggagacagagcctcctctccctcctggtctgagtccagccccaggaaaggagtgaaattaactgtccattgttttagtgacacttcctgggagcaacaaagggcctttcacagtgagaaagtgaagcaagtagatgcgggatgacctggaagtcacagaatgtggttgtcgaggtgccagatggaaaatgcccaacaggtcatgttcagaaattggagctgaaacagacacactcttgaaaaaatatccatatatggttggcatttcagatgcactttgtgaagtcaaggacactaggctgggtactcagaaacaggaagcacctagaaggtcttggaaaaatcagtgagcaatgggatccaagttctctttcaggtccgccctcactcttctgggttcatgcagctgtggaccaagggagaactgaagcacctggcatgtggcctcagtccccatccctctccctgccatgcaaacccctctcaatggaga

SEQ ID NO: 101530 - DNA, 1021 bp, Homo sapiens
tggccactcctaaacctcttggctcagcgcgtgggcaccactcagaagctgatgacagccctccatagaataaataaccctccctgtgagctcattcttcaatcaggcccctcctcgtcactcactctggcccacggaccagggggattgctggggacatagccgaatgtagcatccggtggctcgggggccaggaccgctggcgcagtgatgagcctcctcctcctcgcttgctctctggggtcacagccagacacgggggcaggggcaggtcttcagggctagggtctctgacccaaaatgctgggagggtttcctccattgcagttcccttcggagctcctggcgactcagagataaagaccacagaggctgcccttgggctgcctgggtttgcctggaatctgggtgcatttcttggggctcccaggacacactaacatgaacttggtggcttagaacaacagaaacctattgccccacagttctggaggccagaagcctgaagtcagtatcattgtgctgaaatcatggtgtgggccgggctgcgctccctccggaggccccaggggaggccccttgcctggcctagcttctgatggttcctgatgtcacttgacttgtggccactgcaatcttcaaatcccacgtctccatctctccttctgccctcctcttcttagaatgcatgtgattgcagttagggcccccttggctaatccaggatcacccccatctccagctctttaaccacacctgcaatgatcctcttttagaaggtaacatttacaggttctggggattaggacctgctacgtcctgggggggcttttattctatttcctgcaaactccttcacttacaagctgtgtgggcaagacacttatcctccccgtgcctcagtttcctcatataaaaatagctgatactctgctttttgttttttatttttttaagacagagtcttgctctgttgcccaggctggaatgcagtgatgtgtgatgaccgctcactgcagcc

SEQ ID NO: 101531 - DNA, 1032 bp, Homo sapiens
cgttctatagcgtgaggattgtattcaagtacacagcgagatcacaatgtgtttaactccctcctgctgtgtaggttattttcacttaaacattattttgaattatgctgtggcaaatatccttgaagctgagtatacacttgtataataaggatttatttcttaagacaggttccttgcactggacttgctgggtcagtggtctcgccagattttaaaggcatttcacctaattgcccactacaagcaaggttctcatttttacccctccagctggtgagggagacattttggctccctacatccttgcatcctttcttaaggagaaaactcctgtcccctgaagctcatctcaggcccaggactgctaagagtggacagaaaggggaagagagcagaggagccacttgagcatcagtgagagaggggacggggcctgctctctggccgggctctgcagcacagggtcccagtttagatggagaattatgtgacaaccctaccgataggacatggggaaggagtagacccttctctgccttctccttctcagcctcctggacctcttatttcacttaaaagacatcatcacagtgcaggggtcacaggcatagacagggggccggacagctcgcagaaatggtgatggaaggaaaacatgcccccactcctttctcccgagacactcagccctcttctccagcgctctgcctccctccccaggctttcacagaggcaagagcactgcgagaaagtctctttccccttcaccaggaccgcccagacatgctccagcttcagggcctttgtctctgccggtccctccagctggtgggctcttcccgtgctcacccctccccttctgcaggttttccccagcgccaccttcccagtgaggccttccttccttacccgcccacagcactcttaacccattttcctgctgaaattttcctgttagcgtttatcaccagccacaagctatgcattttatgtattcatatatatttgcaatctgtttttttctgtttt

SEQ ID NO: 101532 - DNA, 1055 bp, Homo sapiens
gagtctcattctgttgcccaagctggagtgcagtggtgcgatctcatgtctgagtctccccagtagctgggattacaggcgtgtgccactatgcccagctaatttttgtatttttagtagagatggggttttgccatgctggcctcaagaaatccacccgcctcagcctcccgaagtgctgggattataggcatgagccactgtgcccagacaataatataatttcttgttagaggccgtcactcctggatttgagatgagttaggtgtcaaaaccggaagtggagatttggtagagtgaagaggcatttccagcacccaaatgggccttgagaatcaagagacctcattgcaaggaaatggtcttggatgggaagtgcaggccctgccaccggtgtggctcactctccccacaacgccaaacagcagcccagtctcaacgggggaacctgggtgtgttggggtttttgtctaacatcttggaatgattcattcatcttctgctctcaatcaaatccactggccttgttgaagaccttcccatcatcacagaaccctgttttgtataaaataaattggaaccactggcattgaatggagcaaaaaatagaactctgtgagaaatacttgctgtccagtaagccgggggcggcttttctttaccaatgcctccttccctttgaaaacaggaagtcaccatggccaaaagtaaatgagtttccagccggctgggtcaaaatccagactccacctcccactcccacctgtgggctccatgtcaacctgcccaactttctctttgggtcttgacaccagcggctgactaagcccctgtcaacgcagccctcctctttgatctgaactttctggcactgtctctgttcttgttcagagggaagcttccatcttcctcctcatgtctcctcttggccccctttcctaatccttggagtgcaggcaaaactctgaatgtgttttttcctcagataaattgtaaaaaggggcaggtgccagagctgtccagccagcactcagtattcttacccaccctggctt

SEQ ID NO: 101533 - DNA, 3867 bp, Homo sapiens
ctcactgcaacctccacctccagggtttaagtgattctcctgcctcagcctcccaagtagctgagattacaggcatgcgccaccaagccaggctaaatttttgtatttttagtagagacgggggtttcactatgttggtcagactggtctcgaactcctgacctcagatgatccacccacctcggccttctaaagggctgggattacaggcatgagtcactgtgccaggcctaattgattgtatttaaaatggatatgcaagaacctatgttaacagccttgatgttgcctctgacctttaagaaaaagtttgccgacccctgtcctggatgcttaataaactcttttaaagatttgtttttcaagtatttaccagcctctccccatgtgccaagcactggagatgcagcagcaagctgccctcatgggggccctggctaggacggaacagagataagaaataactagtgaaatgtagttaactaattacagctgtgcttcctgctatgaagaagtgttaggtgttacaaatgcatatgatggggcagctaatctatttaaggcaggccaagagagggctgaagaggggctgggtagctgaaatccaaagcaggtgaagttagttagcttgattagcccttgaagtgagtgctggggaggagtggagagttccaggcacagagaagaacaaggatgaagaccagaaggtgggaaagatctgtgttgtctggaagtggcaataggccagtgtgttgttgttgttgttgttgttgttgttgtgtaagagtgaagggagaggagagaggcaacatagaaacgaaaagctttctctcctggagctgcaggaaaccattcacattgccatttgcttccgtctgtttccaggagcctttcaaatcccatgaaatagccatttctaaattgtacccactgccctcctttcttttcatcccccctgcctttccctaagtcttttagaaaaaaaaaaatgcagggattccagaaagactggtccagccgcatggaaagcggcccaggaaactgcctggtgatggttgcaaatgccgtgagaaggaaattgtcctgtaattgaaggggaaattctttactaggattgttaaagagttcttctacaagctcctttcatctgtggcttgttccatgccttaattaattttgatccgggaggtttcccgagcctctggttgcacccatgtctcttggagatcaggccttctgttgcaggtggagaaactgaggccaaagaggccctggggtgtgggggaccttgggggaacaagtcctgcatcagaaggctggtttctgaacattttgagcctcaggctttcaggaaagagcccaaagccagccatgtcaaacaagagaaagagtttctacctttaaaaaatgtgtttttgttataaaattggtgaaatcacattttataagtgattagaaaaaaccaacatataaacacaggaatattcatgacctgtttttgtattgtaactggctaaaaaaaaaaccctgatattgcccactgggttattctcctttttcttgattcttgactgaaacccaactgaaactggcttaaataaaaattgtacttcgttggctcacataataataaatcctgaggtagatccaccttcaggcatatctggttccacgggcttaagcaatgtcatcaactttctctctcagccttctttgctctgtggctctctctctctctctcacgctttttctctttcgctcttcaagttttctctctcctctctgctttccagactcatcatgaggtggtcttaacagctcatagagcttgctcagttttgcaacttcaaggggaacgtggtgtcttcttctcaagagattcaggaaaatcccaagagggaacaatattgagaggcacagagatagtaaagaggacttcaaagaattttgcttattgctctgacaatatttctcccttggggatgtttaagtgacgtttgtaaagtttccaattgctttcaactgtggtttttttttggttactgagctgtttctttgaaatcatgtagaaaaacagacacacacaaatcatcacccattattttaccatcactgttattatttgggggtgtcttgttgtctgggtcccaacgcatttctgtgctaagtgtaattggggtggtgatgggaggggtagggtagtgtatttaggctttggagccagatggacttggtctgaattctgcttcttttattcttattaagtgcatggtcttaagtaataagcacggcatggggaaaggaagaaagagaaggcgtccctcgagtcttggaaccaaagccctgagctcgatgctaattggattaaccctgaccattgcctgtggccaggagaatgccacgtgctgactggctcaggttgtagttacctgagccaatcgccgtggaaggcagggagggggggcaccctgattggcttagacaggtgaaggctgctacaatgatggactggactgcagatgtgcggaaaactaccgcagagctggtgcaggctcccgggaggcggggctgcggcacctcctgggccggtagggtccttaggcgcggaggggaggggaggggaggggagagggtcctgtctgggcttctcgccgggcatggctctggggctctgccctccacctgttccctgacctgtgtccctctgctcaccccgcccgtatcccaagccagggtcatgccacgtccccaaccctcgcctttctcctgggcgaagggagccctaaccgctgcagtttggaggccagacggttttttgtttcctccttggcaaaacatgagttctctttttctaagaaaataaagggacttaaaaaagaagaagaagaagaaaatgggaaaatcgtataaaaataaaagcccaaatcccaactccagtagcaaattatactccaaataactcttaacaaactaggcttggaaccattctataggaggcaaccagacccatcagaattaagtttttcataaaggcagagccaaaccgagaaaggttctcaaggaaaagattgctcgaggcttctgaagcagagattttaataattgttatcaatacccacgacttactgagcgcttaccctgcactgtgctaagtgtgttacctattatctataatcctcccgatgaccctgttttacagaagaggaaactgagacacagagttaagtggcttgccccagggcacaccgtttgcaagccacagggctggcacccaatcctgtctctttttccaaagctccgtaaccactgtccttccctacctccctccacatctgggatttcagaatgtttgcagagtgaggttgctggagtgagttggggcttgaggcaggtagagcctcccctcctggtccctggattctgttgggttttggcttggtccttgtaggactacttcaagctggctggagaaggggcttattctttctgatttgttaccccctagattcttccacaaagcgaattagctccagccagcctggagttgcctgtcttcttgttttttagatgagagggaagcaaagcataatgaactgttgcaataggcaagatccctggacttaagaaggaaatagtctcctctcctgctgactttgtgaggcaaagcagaccagaaagggtcaaaattctttcaccagaagtaagtgctaaaaagacaagaagagcaagctaaagtggagaggtactggaggtgctactttgggtgggtgatcacggaaggcctctctgaggaggcgacatagaagcaaggctctgaatgatggaaaagaaccagctgtgggagaacctggggagagagcattgcaa

SEQ ID NO: 101534 - DNA, 1050 bp, Homo sapiens
gggattcttggggctgccttcacccttgggtttagcgacctgcgaaggaaaacagcccagggagggagggatgtggcctgcctagctgccaggctcagagtgctggcaaggaggaggagcacgctttgttgaggaagcatgagtcgtcacttacaaaatgcttgcttgcttctttctttcttttcttctttccagttcagagcaaatggcaccgccttatcctggaggcaacatcaggttgtttttcaaaagtgaaaattgatatttgctctctgcgttgtgttgactttcattttagtagccctccaggcaagcaaataagaaaatatcagtttccaggatgggaaagcagggagatacaatacttgaggggcaacaacccaaaatttaatatggatgatttgcttaaatattcactgggtctgtttaaacattccagataaccaaaattatatcctgaggaggcagcacagcacatatttaaaccagccgagtgcatgagtcctgataacttgggtttcagtctaatttttgcttcttaccagctctgagaatttgaacaagtgccttagcctctatgagcctcagtttacctgcctaaaaaatggaaataactttctcatagtattgttgcgtctctcagtacaggcttggatatacaggaaatgcttagcatagtgtctggaacatgataacagttcacaacatttaaactagttgtctaataatgatgattagtggaattcgtatttgtagtaatagtgatgaatggtagattccagagtcagactttctgggttcagttgcctggctctgccacttaccgtctgtgtgaccttaggcaggttagttgacttcactgagcctcagttttcccatctacaaagtggtgatgagagtaaaacacagtagtatgagaactaaatgtataagaactaagaaccaatcttggtatggggtgagcattatacgagtgttattatattattaacagtcatctattattattctaaggctagaaagtattcttcctgagagcaagggcttggt

SEQ ID NO: 101535 - DNA, 1016 bp, Homo sapiens
cccaggagtctttctggtgtgtgatgatggtgatggactagagagttagtgggtgagtccagccggagctcctgggctgctggatcacaactgtggcctctggaaaatggaagcggcagcttggggccccaccattccaaatcccaggggtgtttgaggcacagagactgtggggtagagatgctgtgtccagcagcagtggactgcttttgctctttcctttcaataacaatttggaaaagaaaattggagttagccatcatcacgggcaagcagagacagatccagggagctaaaccctctgtgtcgccttcctggaagcatttagagaattcagacctacacgttgaagtgcctatagaccaggggaagcccgttccgacgtggacaaaacttcttgagtttatcctaccgcagtgacaggagggtgtttgtgcatcatgaaacaggaaggagattgtgggtaagagagaaagggccactcctactgtctggtatgagattaattccaaggtaaccactcaccctttagtaagagtgagaggaacaactctattgaaaaaggagttttccccactctctaccgtttcacccccaatgccaaccccatgagtcttccctgtctcctgaggtgagaaagagcagctgagagccgcacacactatttttagaaagaaaaccatacagagggtgctgtgttggagaaacgctttgggtgcatgaggttggggagaaggacctgagaatgtggggaaggggcggggcaggaaagtgactgaggataggacagttctatgcctctgtttgggagctgggggcctctgaggggtcccccctccatcagcatcttgaccccaggttctggagagtgccaaggctttgggcaccagatggaagttgctgatggttctgacgaaagccaatggtttctttgcaaagagaacttttcttcataaaaatagaatttgctggttttactagttagaaaagacaaacatgggtggacagaggggagg

SEQ ID NO: 101536 - DNA, 1106 bp, Homo sapiens
ttctgttgcttactgtggggttggcgctgtggaacgtcccagcctcctctgaattcatctggaaaacgggtttaaaaattcttacttccctgcctcctgcctcctccctagaacggacgtcagttgggatgaatcagagcctcggtattttggctcagccgttgttttggcaataagaatgattaaacagatagtttatttattttactctcatcttctgtacccacatctctggaagagctgtgttcataggtgtggagacaagtaaagagctttctgacgagtcagaagctggtcatgggaaggaaatgagggcatctcctaggtaaaggaatttttattttctcactggatttcttctcactttaaactggttcttttgtgttcttacttggctgggaatgtctggaagtcagcactccagctgctgaactccagaactcagaaaagatgcacataaatagactttggttgcagcatgaaatattgggttagacatcaagagggactttctagtcaatgagattgtgtaggcagaggaagaaatggaggaaaatcataaaactttctactctgtgggaaaggtagttttctgggaggcactccagcgcctttgggtgagaccttgtgccacgttcccggaggcctgggtggcagcaatgaaaggaggaagtgaatgcagccctgatggcaggctactgaggacaacgcagcactgctctcccattttacagctgcagaaaccgaggcaagatcctgcaacaaatatttacagaaggtgtctgcatgccagccttattctgagttctgaggacaccgcagtgagggaggcagagtactagcaaacaaggtcatgaatatggaatgtgatattgtgcaatgatggggctggacaaggaagtgagcggtagggagggatggaagctgctgttgaaagaatggtcagggaaggcctctttggggcagggtcatgtgagatgaaatgactcacccagggtcatttagaccccagatacaattgagtctgcttccctggctcctagtcaggggttcctccagggtgtttttgggcctaagtaacagaaaacccaactcaaaaaggctta

SEQ ID NO: 101537 - DNA, 1053 bp, Homo sapiens
aaaaaaaaaaaaaaaaaagtaagttttgggaaatgctggtctagccctcagattctggaagcagaaagacatggattcaaatctcagacccaccccacatgtacagtgaagctttgggccagctgcttcacctttctagccctcagttttctgaccagtaaaatggggctgagaatgggataggagcagtctcacgggagatgttcaggaatctctgagatgtggttatgtgaaatgcctcttctccaaggggacattcagtaagttaactctccataatctggattatttttcccaggaaagaaagaaaaaaaaaaaaggccgtccagctacatgtgcaggaagtgcaagggccagaggtgggaaggaatgtggcaggttagggagactgctgcagtggggtggggtggtccctgcaggagagagcagggatggtgttgtgtcagggaggagaggatttgcaattttacaggaaacctatggagtaaataagcctcctctgggactacatgtggtaccttggaggacgggcttacctgtttcacccaaatctctttttgctcccagcagacctctgagcgccactgtccaccgcagcctggggctgggctcatctctcccccatccagagctttctgtgcagacagattctggtgaacctgggttgggctccatagatttaatctatgttgtttatcttttaaacaccattaaccacaaattagctgattcttttgtggctataaattaatagattccattagtgaacagcaaattacaggatgattacttttcctccctgaacttggagcttttttttatagctttttgagagggtttggttctgtcctcttcctgctgccgctttcctatctaggttctttgttcattggaccaaatcttctgaatggcccgggaggctgagagtgggtgacatggactatctttgtaatgaggttataagcctgttcgctttgcagaagcaaaactgactggaggtttgttttcaagagaatttttgtttcaatcacagaccaaaccagcaaagttgcc

SEQ ID NO: 101538 - DNA, 1006 bp, Homo sapiens
ccccagggggagttgttcacacaagcgtcagtggaaacaactcctccagggtggggcagtgcagagggggccctggccagccctagtctggggcatctgatggcaggaccaaccctccctcacaggacccagcccttgtcagggcccagcccacactggggttggtgcccgtctatccctgacaaggacactcacagtgacctccttcggacatgtttttcttcttgcctgtggatcaattcctcctggctcagacccctccaggactctggcactgatctctcttggtctcggatttgaggaaataaaaatagaagaggaaaaacacagaactctccaaagctttggagtggctgcagccatctggatggaggcagcatgcgcctgggctggaagagccacggtcccttgactgagtctcggtgcttctccccgtccctctcagacacggttctcatggtggacgagatggggccggatcttaggcccgggattctgcagaatgcaaggctcagagcttgcctagctctgagtggcttggagactggtgtgaggactgagggtgtccacagatcaccaacccacaccggcagcctgagttggaagacaggtacgaactactggccggccaagagtccctcaggttctgtgcgcaggagggcctggagtttggtttcatgcttttgttcttgctgtcgtgaatttattcataccttttgaacaagggccccgcattttcattttgccctgggccgcgcagattctctagctggtcctgtgcccaaaggacagagcaaggactcagagtccaattcggcgtctgccacgttcatcattcaacaagtccgtcttgagcacctgcgagctgcaggcagtgttctgggcagagggatatgctggggtcaggagggaggggtgcccgggctctggagtcagtggggaggaagcccaggctctggggtcaggaggaaggaggctccgggctctggggtgacatgtccccctg

SEQ ID NO: 101539 - DNA, 1148 bp, Homo sapiens
ttgcaactcaaccctgttgttaagaagcaccaatgggccgggcacagtagctcccacctgtaatcccagcactttgggaggctgaggtgggcggatcatttgaggtcaggagttcgagaccagcctggccaacatggtgaaaccccatctctactaaaaatacaaaaattagccgggcatggtggcacgcacctgtaatcccagctactctggaggctgaggcaggagaattgcttgaaccccagaggtggaggttgcagtgagccaagatcgtcccactgcactccagcttgggtgacaaaacaagactccatctcaaaagaaaaaaaaaacagcaccaatgaagcctagttctccacgggagtggggtgagcaggagcactgcacatcgccccagtggaccctctggtctttgtctgcagtggcattccaaggctgggccctggcaagggcacccgtggctgtctcttcatttgcagaccctgatcagaagtctctgcaaacaaatttgctccttgaattaagggggagatggcataataggaggtctgatgggtgcaggatgtgctggacttacattgcaaatagaagccttgttgagggtgacatcctaaccaagtgtcccgatttggaggtggcatttctgacgtggctcttggtgtaagcctgccttgccttggctggtgagtcccataaatagtatgcactcagcctccggccacaaacacaaggcctaggggagggctagactgtctgcaaacgttttctgcatctgtaaagaaaacaaggtgatcgaaaactgtggccatgtggaacccggtcttgtgggggactgtttctccatcttgactcagacagttcctggaaacaccggggctctgtttttattttctttgatgtttttcttctttagtagcttgggctgcagcctccactctctagtcactggggaggagtattttttgttatgtttggtttcatttgctggcagagctggggctttttgtgtgatccctcttggtgtgagttttctgacccaaccagcctctggttagcatcatttgtacatttaaacctgtaaatagttgttacaaagcaaagagattatttatttccatccaaagctcttttgaacacccccccccctt

SEQ ID NO: 101540 - DNA, 1081 bp, Homo sapiens
tcagtggcactcacgtggcactcataggcatttgagtctatgtgtccctgtcccacatcctctgtaaggtgcagagaagtccatgagcaagatggagcacttctagtgggtccaagtcagggacactattcagcaatctacagtgcacagggcagttccccaacagagaattacctggtcctgaatgtcggatctggccccttccttccccactgtataatgtgaaaacctctatgctttggttcccttgtctgcaaaacagggataatcccagaactgagttgtccatgtaaagtgcttagaacagggagtgcttggcttggggagtgtcacctgcagtcattcattatgcccagacaggatgtttctttatagaaacgtggaggccagttagaacgactcaccgcttctcaccactgcccatgttttggtgtgtgtttcaggtccacttcatcaacccggaaacggtgcccaagccctgctgtgcgcccacgcagctcaatgccatctccgtcctctacttcgatgacagctccaacgtcatcctgaagaaatacagaaacatggtggtccgggcctgtggctgccactagctcctccgagaattcagaccctttggggccaagtttttctggatcctccattgctcgccttggccaggaaccagcagaccaactgccttttgtgagaccttcccctccctatccccaactttaaaggtgtgagagtattaggaaacatgagcagcatatggcttttgatcagtttttcagtggcagcatccaatgaacaagatcctacaagctgtgcaggcaaaacctagcaggaaaaaaaaacaacgcataaagaaaaatggccgggccaggtcattggctgggaagtctcagccatgcacggactcgtttccagaggtaattatgagcgcctaccagccaggccacccagccgtgggaggaagggggcgtggcaaggggtgggcacattggtgtctgtgcgaaaggaaaattgacccggaagttcctgtaataaatgtcacaataaaacgaatgaatgaaaatggttaggacgttacagatatatt

SEQ ID NO: 101541 - DNA, 1076 bp, Homo sapiens
tagagctgatgattgcctcacaccggaggctccttcctgtgccgcgttctgtccagaagacacagccatggatgtccattttaggatcagccaagccccgtggggctttccttcatttttattttatgtttttttagaaatggggtcttgctctgtcacccaggctggggtgcagtggtgtgatcatagctcaccgcagctttgagccgtcttcccactcagtctactaagcttggactataggccaagactatagagtggtccttctttccattcttttgggaccatgagaggccacccatgtttcctgcccctgctgggccccctgctgctcagaaggcatggtctgaggcttccaccttgggtcgtgagcctggcgtggtggtttctggccagcatgggggttgggatgctgtggctcaggccttctgcatggtttcccacactctcttctcctcctcaggactggatcatcgcgcctgaaggctacgccgcctactactgtgagggggagtgtgccttccctctgaactcctacatgaacgccaccaaccacgccatcgtgcagacgctggtgggtgtcacgccatcttggggtgtggtcacctgggccgggcaggctgcggggccaccagatcctgctgcctccaagctggggcctgagtagatgtcagcccattgccatgtcatgacttttgggggccccttgcgccgttaaaaaaaaatcaaaaattgtactttatgactggtttggtataaagaggagtataatcttcgaccctggagttcatttatttctcctaatttttaaagtaactaaaagttgtatgggctcctttgaggatgcttgtagtattgtgggtgctggttacggtgcctaagagcactgggccctgcttcattttccagtagaggaaacaggtaaacagatgagaaatttcagtgaggggcacagtgatcagaagctggccagcaggataatgggatggagagatgagtggggacccatggggccatttcaagttaaatttcagtggggtcaccaggaagattccatgtgataatgagattaacgt

SEQ ID NO: 101542 - DNA, 1015 bp, Homo sapiens
cctacaggggccttgggagcctgattcagtaggagaagttgtttcgacttggagtggtgcttcttgtctcatctgttaattgttgagaatcgctaatggttcattgacaaccttggtagcttttcaaagccaggaaagtcatccaggcaaactggagataagacagcaggaaattcttgtttataagtttaaaatctgtgtagacatccccgaagccagcctgaaactacctctaaaagagcatggggaagaagaagtaaatgagtcatgaaaaataatctcatgactttaattcagtttggatgtgaaaggtaaacttagggtcttcaaagtcctgtgtggctctaaaaagacttccttgcttctgtcatctctctgtgcttgagagaggaatgagtcctttacaatctttaaaaacaaacaaacaaacaaacaaaaaacaaatacctcattccttatagtcctggagactgggaagtccaagatctaggcgctggcagggtcagtgtctggtgaaggctgccctctgcttcaagatgacacctcgttgccgtgtcctcacatggccgaagatggaaaaacagaaagggtccagactttctccctcaaacccattcataaagacaccaatccatccccaatggcctaatcacctcctaaagggcccacctcttaataatgatgcattggggattttcaacatgagtcttgggaaggacaaaacattgaaaccacagcaataacagaattaagcattttctgaatcaggttctgggggtcattgaatattacttaaaaaggagactttgaggtggcatgggaggaggtgactcctgcgcccatctgtggtcctggtgatgcgtccattgctgtggggtgcccaccctcccatggctaggagtgggcacatagattgactgggccaactggattctgtcccccagagttttggatggagagaggcccagagggaaaagcagctccgattcgttccttctgtgcttgtgcctgagaa

SEQ ID NO: 101543 - DNA, 1184 bp, Homo sapiens
gccagccagggcagcagaatctgctccaagggagtcggccgccaccaaggtcgagatgatgttggcagctggatgaaaatgtccctgggttcatctcagtgattttggctgccaggagggtgacctcagcgtggtctcgagggccaagatttggatcagctgcagcctgagtcactctgaggaagagggagctgccccctgcctgtccccaccacacaggatggattggcagaggaggcctgggctcagtttcctgggtcccttcagcccaggcagaggctcttgccctcgactagccctgggatgggggccctgagtttctgcctttctgagaagctccctggggacgccgtgatgattttggtccataaacctgagaaggtaggtggggctggatgtggtaggaggaacgatgcagccccctcacagggcggccctcgggcagtgggccaagggctccttgcccagtcctctcctggggatgctggggtggtggcaacttatgatgtgcggattcatgacttggtagcaagactctgggcgggttttgccctgccgttagcccccatgagcgtgtttgggcagagagccatggtcacgttccagagcatgtctccaccctgtggttgaggcttcttgttgcgtggtgcttactgtttatgactgtgctggacacttcagctttgtttcatgccttggaaaggttcctatgaagatgtatcatccccattttacaggtgcggagcctggctcagaggtgggaagtaacttgcccaaaagcacacagctacaaagtggcagaggtggggctcaaacccaggctcttagatttcagcagtcaccatcttagccatggccgtgcctcagtgattcccatagtgctgattccctcacctggggctcagatgggtccattgatgagtcctgagctggttttcagccttggctgtgcaatagaatcacagaggcttttaaaactcctgatccgtaggggttgaactgtcattggtgtgctttaaaagctcccaggtgattccctgtgtgctggggtgtgaacaggtggctaagatctctctaatttctcacccatgagctgtcttacatgcccaagaggaaggaaagagattccttttttttttttttttgagatggagtctcactgtgttgcccaggctggagtgcag

SEQ ID NO: 101544 - DNA, 1027 bp, Homo sapiens
ttcttgaaaatgacccgaggaggtcaggaattattgtcccctgggaggaagcagaggctggggtggagcttggtttgagttctgcttgtgggacaggcggctcctgtttcccctgagtggaggatgaacagagcaagagactcaaagcattttaagaatctgtgtcagtgtttgttagccaagggtggagagctgcttgaaagaaacgcctgcctgccctggtggaatggtggaacctcatgcttacactgggagcctgatcaaatgttttctagtaaagggttctgggcacctatatgccttctgcttattcccgtgggagactaacgtgatagggtctgggtgcctccttaagcccgttggttggaggagatgattaggggagaagctgagaggtggttctgaaaaatattttgctttctattaaatggctgctgagcaaacggaactctctgttctcgtccccattgtcttgccttgaatgtggttttgtgaagacatgttgcttggaaccacagcagccatcttgtgactgtgggacaagaggcctaagaattaagtcaacatgcagacaatgatggagcaaagaagacagaagaaattggggttcttagtcatatgtttgaactactacattcaactacaattgttggggggaggctcttaagcagtttgaatcacatgttcactcatgaatcagttgggtctagagggtagaccaggctgcatcaacacagttgctggagtcagcctctggccctttgtgcctgggctggggtgtggaggtgtgtctactatctgattacagctatgttagccattgtaataatcatcccagtagtgaacatttgtcaaaggcttactatgtgccaagcaccctttgtcctcttttggtttttttttgagatggagtctcgctctgtcacccaggctggaatgcagtggtacaatcttggctcactgcaacttctgccttctgggttcaagtgattctcctgcctcagcctcctgagtagctgggagtaca

SEQ ID NO: 101545 - DNA, 1059 bp, Homo sapiens
ggccccttagagacatttcttagtccaggcaggatcttgcataggctgaatctagacattaaattcagagaccccttcatcatctaaatgcatcactgaaatggattgtagacctcagagggctaagacctttctgtgtagcagcaatggattcagagtagccatctttatggggccctcatgcagttctctcagtattctgcagggtaagcagtgtcatttccattttagagaggaggatgctgaaggggcccaaacatgcacagctaggaagtgtggggcagatgtgtctgtccagctcttgctgggtgcagagctgcccattctttcctcctgaacctgtggggtatcgaataggtagcggggagcgtggaggagatgatgttgagaccattaaaacagaagccgagcccatggccttgactctgtggtcccgtgttctgataagtgacatagagataagcaggcacacacctttcccttctgttatccaccctgcttgtgatacctcccctctcctcggtctttatggtttaaaaataattgtcagggcatagggccctgagtgcctgtggggggcacctacatgtaccccataacccttccatggggaaattccatagccagccagagattggtattttaatagcaattcctcaagatgctgtataaaaaagaccacagaaacagtttttttccgtatgtcccagcatgcctttgtgtacggtctgtagtattgtaaactccccaaaatcaaaatgtgcatgaacaggggattcgagagagaagcaggtgtagctctgggaggggatatggaatagtcgccccagcgcagggacttctttttgtttttgttttttgtttttttttttttactgtatcaatgtagactggaaacaatgtcagaaggagaaagcaagtagcagaaggatgtttaggatgtaaccatttgttaattacacacataggcacccccgcccccaacctcccacacaaggggaccaactcataaatgtattgtttgtgggttcatacacattgcagtaataccatggacac

SEQ ID NO: 101546 - DNA, 1659 bp, Homo sapiens
tcacgctcactcttcagtcttagcgggggggctgttggcacactggtttcttggcaagccactgcaaggcttcgccttaatgcactctggcactgtcaccggggttagggcacaggcagggatgtgtgggacctgtcatgttattgtcagaaggaatgtgcggattagcctttacagcgtagtggtgggagagcactgcagctgtgtacacttattataaaagatttaagtcccactggtaaaatcaatatattgaattgcacaaccctctgcttttaattagtttaaatcaaatgcgccggtgccattttgccttctctcgccttcatggggtgaggaactaccaatatttacatagaaactgttaatttgtggtgaaaatgataacacatttagctttacacactcaaattgctccaacttgatggatcccagatcaacgtggagttgagctgaggagatgacgtcaccaggagcggggaggagacacccgtgatgtctgttgcttggaccctggattccagatgcaggtggacatgtgtgtagaggcagtgactggggatgctggtccttcaagaagcgagctggttctttctattgcaggtcaaaaacaatgagatttacctacatcatctaaaatcctttctcggaagcattcttacaaaattgcgaagtgggcacttgctcttgggtcattttgagcctgttctcacagcatgcaagggtcatgtactgggcagctcaaggcacggtgctttatttattccagagcttcacatgcttttctttccaatccctgaaacagtttatagaggaagggcgtttgttcactgcaaatgatcccatgtacgaccgcggctattagtgagccgtttggtattagctgtgtgttcaagctgggattgaattccgggttttgcagcaaatggcatctgacaaataataattgacaaaaaatgtgacttggtatttcttaatatggaacagatagttcatttaagcttccccggcaaaaaaaaaattgctcaaactcaaactgaaatagcaatgccagggaatactaggactgctgctgtgtatttttttccgctccaaagtagagtgtttatgatttggggggatattagagtgcatgaagtttgacacttacttatgcgaaactcaggcaagcatgtgcaataccgccttttcaacatttgtgtcggaaggcattgtggggagccgcgcaaagcctgtgctgatccgcgtggagtggattgaattaatgacaactccgagagcaccagctttagggtaattgctttattgttttggagccagggtgcatataatccggttcctgtgcaaacatgttgaacgtgtgttaatgcatttccaaaccagagcctctcacacaaccctgcttttcattaattgatgtcggtagcatggtacagtatttcaaagggctggccaagtataaactgtgtttccaatttccttcctttcctgtgtttggaatgccaatgttaatttgttcccatgcaggagcgggggctgccaaccgcggctttctataaagggcttcacagtgaaggcttccagccctcgctgatgcttggggctgcctggccaagtctcctgacactttgcagctaattctgggtgatatatggggtg

SEQ ID NO: 101547 - DNA, 1067 bp, Homo sapiens
acagcactaggtttgctccaaggcagggatgagcttgttgtgttcagcggagaaaggaagccagcagagctaggagggctggggtgcagcaaggcgggagagagcgggaagagattaggtgggtcccacagatgactgtgccttctgaactttggaagcttcccagtgctcagcataaggtgtggtccacactgactaacacgaacgattctcacctaccatgttctttttcctaagttcatccctaatggcagaaatgttctctcccaacttgaaggttgaggtagaggaatagagtgaaagtaatatttattaagaacctgtagtgctttaggcagtgtgtgtgtgtggcttcatttagttctcataactctgtgaagtagatattagtgtctctgttttacagatgagaaaatcaaggttaagtgacccgtccaaagccgtgtaaccagcacctggactgattgcagaagccttgtcatgcctttgttcgttcatacagccaactggtgtttcaagtacctctgcatttgagggcagaagtgtggccggcaaggaccacatcccctcacgttcactaaaatgtacatgtgcttgtagctgttgctctgaccttttgttctgcacttatttttcatgaagctgaggaaactcaaatgccttccccaaattccttgcagtttctccgttctgtgttgtcttgttagcaaggatgtcactcagccatttggctccctttggagaggtgactggtatggaggacttttcagcgtaacaggtagtaggattgaaatgtggtttcagtgtacgtaactcctcggggagttggaaggaaaaaagaagggaaaagtcgtttattgtacccactatgaactagatactgcattttctacataatctgatttgatccccagagcagccctggagaatgtgttaatgttctctatgtttgcagagcaggaaaatgaagactggtgagattagagtcccaactcctgagtggcaagaggccctgaccaaaccctggtgggcctgttagattatgatattcaagaaaaaacccaggg

SEQ ID NO: 101548 - DNA, 1015 bp, Homo sapiens
ccacaggataattggcaatagttatcaaaaatccttcagcttataccctttatctcactgatacccttctgggacttgagtaggaaatctgataatgtacttcatctgcattatctaaattaacctttataacagccaaagcactgtgaacttgtgaaaattttgaaaattttaatatccagtagtaatggcaatgtatagtatgtttgtatgatggaataccattgtaagtttttggaaaagcttttgaactgtagcctacagcacaggggcagcaggggttaggagaacaggagggaggatggtagtcaaggttgagcaagcttgctttctacatgtaatttttagaaagatttcagattatttgctgcttaaaaaaaggatgtttcaagttgaacaggctagtgatgcaggtgaggaaagctgtagctgcaaaagtgaagacactgtataatctagtgtcttccagaaaatatgcgtacatggaaagaagactaagagcacacagaaccattagctgtggttgtctgtggtgtgattagggtgatttttatttttttgccatatttacaaaatctctaaaatgtattacttttttaacggaggggagattatataaagtattcagaaaagaggtaagtttctactttggtcttgattctctgaatggtaatgggtaagtgatattctactttaaaagacatatctcatagatgcattgagaaaattatctgcaattttatgtgtaagcaatagaatttgtttattttaatagcttaggcgaagaaaacagttgctttcatagatattttaattcctttgttcttgaagttagataattaggttgctatgagaagtctatgtatggttaaggtgtaccccattagtttttaggtgttaaatgcaagcaatacatcgtaattgctttgtttgcattgaatttttttgttactacaggttcgctgctgggaagttcaagacagtggacagaccattccaaaagcccagcagatgc

SEQ ID NO: 101549 - DNA, 1047 bp, Homo sapiens
aattaagattatagttatgtgttttgtatatagagagaaagataaatgtgacagaatgtttacaattgatgaatctatgtgaagtgcttatgggtattttttgtatttttgcaacttttctgaaggcttaaattttatcaaaataagaaaaaaattttaaagtggtccatggttgctgctgagaggagacctgggatcagggacaagagaaagagtttgttttcactagtttgtgatttctgatttttaaaatcctgtttatatgttctcgcttagaaaagtaagtcaatcatgaaatagatgaaaatgaattttttgtatgatgctgtagtttgcagtacactggtccccaaacaattggaaaaataaagattgccaaagtttgcctcaatatgttcaacgtagtatctaaatatatatatagttaaagatttaatttttcttaaaatgcaaaattttctccattttattttaggatgggagcaaagtgtttacggcatcgtgtgataaaactgccaaaatgtgggacctcagcagtaaccaagcgatacagatcgcacaggtaacagaagcctctgcagaaaggctaggcacaactggtacccaggactgtgatggctctttaagtgaaataattattataattataataagaaaacgtgcagttagactctgtcaaatcaattagacaatataacagaaacctctttagcacaaaaataacaattttataaccattctcattcttaactagtgttcacagattgtcttgtcatggatcttcatatatgtatggatggagtcataaggagttagtgacattaaaatctatgaaagacaggtcataggtggtccttgccattcacaggttggacgttgtgacctcgtgcatggctggtcttctaccaactgcatttggtcacttactcattcagcaagtgttctgtctatgggccagtaatagagcagcgagtaagaggggcatttccccacacgtgtggaacttttaccgttactcagggaccactggcaggtactgtgtgaaga

SEQ ID NO: 101550 - DNA, 1055 bp, Homo sapiens
ccgtgcgggccactgtctgctgccgcctgccggggtggcagagtgagttgtctcaggaccccgtcactgcgacgttgacactcctctcccttcccttcctccccaactccccaaacactgtggaaggggagaaggaagtgatccacagcattcaggccacttggggtctagaccatggtggtgccagcctggggggggcagtggccctcagctctgcccgctggagcggttgagtgcagaagggtgcgcctcttccctctacccccgcaccacctgctgtgtgccagcctgagacggttcctgcctgtcttgggggttggtggagggtggaggcagttctgccagccgtggcagggctgctatggggcatccagggctgtgggggtctggaggaggggacatgaggtgagaggtatcctggccgagggcggggggcagcggggggtctccctccggacctacctcagggagctgagcgtgcaggcgctccagggcaggcctgggacagagtcaaggctcagagaataaaggtagctaatctcatcataatatttttattagaatgttctgatgataaaaataaaacttgttttctttaaagaaaaagttgatctaatttttctcaaaacgcagagctcccctcgtgcctgtgggcatcacccatgccccgccctcctggctcaggaacccaggatttcactggcagccgtgcatagagcgcctggcctgcaccggccgctgagcctcagtagcagaacagacgcagcccctcttcacacccgctaatgcaggggaggcctggcgtcccagccgccgtgcatcatccagcatcagcttcagacccggagaggactgcgcttgggttacttcttggcgctgtggctggggaggggcctggacgtggattgtgattggcagccccaccagatccctgtggaataggaggacagttcccccagagaaggggggttgccaccagaagaccctgaatgtgggttcctgagaggacgttggcaggtgtccaggacagctgcccttagggtagagttgggagg

SEQ ID NO: 101551 - DNA, 1044 bp, Homo sapiens
ggcacgaggcggagggctctgggctccgtggttaatgtgtaccaacgtactttttatctatagctggctttgccaccctaggcctgctttcttcccaagactttcccctggcctctttccagcaatctgtccgggagttatagactaagctacccttcggcaattagactggacttcagtcgtttttgaaagatgaatttagaggtaattttctaattactagcagttgtcaaataaactgagacggaagactgctgagtctttgcctgggcagaaatgagccctggctacagcaggagctggtcctgtgccttggtgatgaatgcagggagacaagcagcttagaaaccaattaactttctgcttcttttgctaatgtggggacagtgaggggaagagtttggctgcttgagaatggagttcaaacagggccagctgtggaagttaagctagcagaactgatgaaaggaacacgcttcaaggacgtctgcgttcttagcaatatcaaaatgttcatcttcatttgatggaacacttctgagtctgaattgtcagtacaaacgttaaagatgtaatagctattgacgcctattctagataataatgcctaaagatatcactgggacattttttcatgggaactttcaactgtaagtgaaagttttcctttcagttgctatctgcaaaaatgtcaaacttatacacagtaatatttataaggtggcttttgtgttttcttctgcaattgtgtgacattttgcttggttaagtgttgcatcttgtcatggtttgatgtcacgtggcaaccaatgtcacagaaggcctgggggtcacctgggagctgttgcttgggcttggggtctggtttgcagacttggaggccaggaacctggtgctgtcaggaccctatggcagagccagacagactcagaagcactagtgtatcaatcagggggccaatgtcttagttcacatcaaaagcaccacttttctggggagacagaccccaaatctgccacccaagttgccccactccttgcagct

SEQ ID NO: 101552 - DNA, 1332 bp, Homo sapiens
tgagacagccgccctccctcactcccgctctgcttcctccagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcggccactacccggggtcctccttccagcaccagcagagcagtgggccgccctccttgctggaggggacccggctccaccacacacacatcgcgcccctagagagcgcagccatctggagcaaagagaaggataaacagaaaggacaccctctctagggtccccaggggggccgggctggggctgcgtaggtgaaaaggcagaacactccgcgcttcttagaagaggagtgagaggaaggcggggggcgcagcaacgcatcgtgtggccctcccctcccacctccctgtgtataaatatttacatgtgatgtctggtctgaatgcacaagctaagagagcttgcaaaaaaaaaaagaaaaaagaaaaaaaaaaaccacgtttctttgttgagctgtgtcttgaaggcaaaagaaaaaaaatttctacagtagtctttcttgtttctagttgagctgcgtgcgtgaatgcttattttcttttgtttatgataatttcacttaactttaaagacatatttgcacaaaacctttgtttaaagatctgcaatattatatatataaatatatataagataagagaaactgtatgtgcgagggcaggagtatttttgtattagaagaggcctattaaaaaaaaaagttgttttctgaactagaagaggaaaaaaatggcaatttttgagtgccaagtcagaaagtgtgtattaccttgtaaagaaaaaaattacaaagcaggggtttagagttatttatataaatgttgagattttgcactattttttaatataaatatgtcagtgcttgcttgatggaaacttctcttgtgtctgttgagactttaagggagaaatgtcggaatttcagagtcgcctgacggcagagggtgagcccccgtggagtc

SEQ ID NO: 101553 - DNA, 1593 bp, Homo sapiens
aatgttcctgaaggatgggctattaaatattggatcctcaggctggcagatgcgtctgcgctgtaattgggtctttcctggagtaattaaaggaaaatgattatattaacccaagtcaccaggccagcatggcatagagaactgaatggcaacagtattgatgtttccctccaaaaactggcctctctcagcacatcaaaaacgcacccttggcttgagtttagggagctttcctttctttgcactttttataattgatcgcgtgtctcctggccttctttttctttttaaaaagcagtgggggatatccgtgccctctaacgtgagcagcctctacctgctcagggagatctgagcttaaggacaagtgtggcgtaaatgcccccggagactgcggcgtgagagatgacattgaaaaaggtctggcttttagagctcaaacctgggaggcttggactcttttttcttcttcttctccttttctgaagagttggagaagccggagtttcaagaccgtcttggtgtgctgccttatttaggaggcgagctgctgctcatttgtcaggcaaaacagatgtggtggggagacaacatctattttcataattcgaaacaaatctggcgagccgccttccttttcagcggggcctgctcatgcagaaagcccagctcccaggcagcatctagcagaaatatttatagctcatccattgaactttccttcctccaggaggagttggtttctgctggcgatggggacacagacttgacagggagtgggtgctgtttcagggattttttttaaatcaaaaactggaggagtgtgggtcacagccagcgacgcagctgtgcctctccttctcgtgtcctttcgtcttccaggtgtggggcggtgggcacgggagcctgctctgtagcattcagcagcctctttactgggagggcagttaaaggctgactttgaaactcctctgggccggcgcctaggaccccgacactccagggagacccagaacctgggcccctagttaccagtgactttgtgcttaggtatgcaagggcagcgggctgtcatttccccattttatggatgaaaccaccgaggctcagagaacagcttgcccaaggtcacacagggaaccgctggtggagctggtcccccgctctgagcaccattcacactcagctcaagccttcattcccactgggagcctttgctacgccgtcacctcccatcgaaggtagctgtgtctgtctgtgtgtaatagtgacctaaggaaggaggacagacccggtatttgggcgaatcacccatcttctgttcatttatccagtaggtgagctccttccctgtgccactggagatgggaggacctggtgaatggaacaggcctgagcctgccctcagggagctactagtctggtgcagatgggaaacagagtcagatactgaacggaggaggagattcgacagtgtcacatgactgtgcctgggggctgctttattggtctgagagggtctctcagcagggctgaccttgtgctgagaatgagggatgagaaggagtcagcggtgggaagaccttgggggga

SEQ ID NO: 101554 - DNA, 2001 bp, Homo sapiens
gtcagggcccgatctagatgcaggttcagacttacttccctggacagggaacccatagactagagagagctcatggctcaggagccctgctgggggcccttgtgggctggaaatgagtttgggcaagcttgggtcagcttggagttgagaagggcaggctgagcagggccctgtagcacaggtgcagaggctggacattgctgtggatatttctggtgactcctggagcccagctgtgtcagttgctccccaaatgcccctgatcttgtcctgctggatttctcatctttcttctgagtattttatcctttcttttcaggtcaaccaccccatgactatgtttggggaagagttggccaaaaaagttgtatttgcctgatggatagagccttcctggtgcagtggggagaggaagctcctggaggcagggctgggctctttgagaaggagtgtggcaattgattagtaatgtcagtcgtggttgccagaccagggagtggctgtaggtatgtgtaggggaagtcacacatgcaaaaagcacctgggttctttcctgacctggttgggttgctctgggcaagtcatgtcccctctggccttggggtccctctgttaaatggcagggctgagtcagtggcttctgggtcacttcactgatgtgctatcttgcggagccttggaccagccccaggcacaggtgccccaggcacaggagatcacctggagaagaaggaagtcgctcagttgaaccccttaacggaaaaagaacattgctccacatcttgaactcattcctccgcgttggcagatcggttctagaacctacacatccacgtctggggcagaaccagaggctgtgcccacagacggcagagcttgtgggctgcttgctgcaagaggagcgaagattaggaacagtcgtttaaaagcaattattaaaaatgagagtgcggaaaccaaaaacagaaatgggggaaaactctgcagtcctctgacatagcccatcacccttttgggaggctgctgtaaggagcagctggagaagtcctctgggtgtatctccctggtgcactgtccttcccacgggattagtgtagacagctgtttttggtggggatcctaagcctgaccatggttttgtttgtggggtgttcactgcgggtccagcactgagctccactctttggtgtgcactgtcatctcctcttcattgcatgggattgaggcaggtacttctggtcactccatctcacaggtgagggccttgaggcccagagagggggaaggagcctgcccagggcctcgctgttgaaagaggccggtggatgccgtgttagtggctggttagtgggtttaatgcacaagggcatttaatcctcacaacagctctttaggacaggtggttgagaccccatttcacagcagggtaaactgaggctcagggaggtgacttcccttggaccacacagcctgaaggtggtggagatgggctttgtctggttccagcgtctgggctttacaacatttgagagagaaaaaggaaggaagggaggacaggaaggaaagacagaggaaggagagcagaccagtctcatatagaagctgccatgagcagggcaggcatggaaaggaagtgaccgcttggccggcaccccatcagagaaaggtcgctggagtgaatgagccctcactgggcatctggcaggcagcaggtctttctctagattggaagctgacagtcccaggggaagaaactagttcccccatttaggagaaccacccctgtccggctgccccggagtgtaacctgaaggagaggtcagcgcacggcttgtgttgaggctctgggagctcctggatgctgttcttcctcccttggaaccttggctgcatggaggcccactccccagtttagagggtgtttgggtgtcaccctgagtgtgtccccgggccacacccttgcagccagcccacctccaaccctgtctttctttcctggga

SEQ ID NO: 101555 - DNA, 1557 bp, Homo sapiens
tgggagatggagttctgtggtccaggctgtggccctgctgcagggctgggaggtggagaggtgtggacagagaaggacctcccatcctcaccggcagagaaagctcagagatgctcccagctggtgatgaggctccagcctgaatctcagcctgctgctgatgatggagaagccagcacttcactgagtacttccttggtgccccgtcaccacccaacacctcctcacaaggcttgcagaagagcctgctgagactcagagtgtctgtatcctgccccaggtcgcagctgtgtggcatcctgatctctgtgtattttaaccaagatctcgatgttccctttttgtaatggaaaaaaaaaatctccttaatttaattgttctgtgatgtctgaaatgggtggatattctgcagaataggtctgtgacttattatttagcctcctcatgtacctttttagctctggggagaaagacaattggaagcaagtgaagaaaagggctcaggtgtgtcccagccccaggccttgcagttacacctgccacctgctggccgccaccgtctgctggcccccaccttcgacttttactgctaggaaaagtcccggggcggggaggtgttggggaagttctgccgcctgtctggcttgtggtttggcagaccttcctggatgcaggtctcggatcctgggcttgagtctcatcctacaagaactagggggaaaggtcgaggaggcagctcctgagcccactggctctgacttgtgtggggcagggagggcacttggcactctgggcctggtctctctgctcatcctgtgggcctgcctcctacctgactacctgtctaggaatttttatggcagcccgcagaggtactgcaggtcggctggaatgtgagatcctggccctgggaggcgtggggtaggcgggcttcagacacagctcctggctgctgggcaggaacgcagagcgaggcggccactcccggcctgctcacaacataagcgtgaacatcgtggttttgccacttcgggacttggctgagttttgccacgtttccttatgccctgattctgccaggttaattctgattaggtttcggtttgaccactgcctgggacaccttgacccacagcagggattgagataaacagttgattatcatgagttgtgaaagatggaaaatagtcctattaccagcagcacttaggcagccccctgctccctgagacattgctgagtgctgtcctgtagaacagaaccctcccacttagcctggcctggatctctgccttttctttccacaatgaagagtatccaggcaagaggaggtggacggaggttcctcaggctccaggtgaccatggcttccacaagccgccctgccagtggcacccggctggcatggggtgggacagccacttggcctcctctgcatctggcagcctcagccctcgaggaattgaatcctcctggggccaaaagtggccgtgctcgtgacccgccagctgcaggccaggtacagacctgggcccttggaaggagcagtggcctggc

SEQ ID NO: 101556 - DNA, 1026 bp, Homo sapiens
cagccccagccagggggcccaggatagtggcagagccttggagactggacagactccagcagctctggggctgggttggcccatcagccgctgttgccagccccgctgggctccagcccagagccaccgcctgcccgcctcacctggcctgcattcctttgcagggaatgaggatgtgggtgaccccagacaggtatgaatcatgtcttggggaggtggttactcagaggcggcaaacgccgaggctgccttcctcccagacagcgtggacctcagtgtggagcttcgtgtcctgggcttggggcatggctgctgaggtgggtgtttgaagggcctcattggagtgagatgggctgacaggcagtggtccctctccccttgactctagcatgctctgaagaagaagaagaaaagagcagtgtggctgtggcaccgggataccaggtcacagtcatggcagcctcacttaccggctttgtggctctcaggcctatttttcatctagagatagaagtgctgggaagcagtcctgacttcctcctgttgtgagggcagcatggacccccctccccttatttcctgaatgcctaccatgtgccaggcacagcaccacatgcagccctgcaagagctactagacttgtcttacatggcgctacatgcaaccctccaagagctactagacctgttttacagataaatagactgaggctcagagggcagaagtcaattgcccaagggtgcatgactcgtaattggccccactggatgtccagcccactgcacccatctgtgtcctagccaccctcccatgtcagttccaagaaatctataaacccgaagcaaacggtagcacatgagaaaactggagatggcacgtggatggtcatttaaaatttaatagttccgtactcatgtgaatgtatgttaggaaaaatataacaagcacattgtcgatttcgtgagtattattgcttaagatcgggttaagtaataagtaaaccaattgaatattttatttcagttg

SEQ ID NO: 101557 - DNA, 1049 bp, Homo sapiens
aagactagtggggctgcagaaatcctggtgcatgcagccaccaggaccaactcccatctgctcctccttgtcaccctgtgtgagtcccaaggcagttccttccatgagttctaaggacgttccccatctgtagatggcccagccccacacttcagctaccatgtagcgggaactcccacacttcagtgaagcagcatccaagggtgactccaagagcaagcctccccgaagagcatggctgcccggagtaagcattactccttggttccttgacaatatgtcattttccttttttaaaaatcaggggtgtaaacggaaatgtgcacagaggcctccattttctcttgccagcctctctccacagaaatcttgagctctgctctgagcgcttcgcggcattccctttcactctagtgagaatgagctctggatccttttcccagaatagactcagagcggagttgagggtggggttcaggaacaaagacaagaaaggggagaatctgggaggcagtcagtatttagggaatgaacccaacacccaacagctttgtctccttgtttttctgggttcttgccggtgacgtcgcggctttttgaaccctagcaattcctactgacagtggcaggtgctcactgagctctttgcacaccctgtctcactaatcctcatggcaaccccatcgcatggaggaggtggagctaagtcacctgccagggattgcccagcacaccgcagagcaggatttgaacttgggctgcagtgtcttggcacagggtgggagggagagtcacagagaagcgggaccctttgccagcccatggttgaaggggaaagttctagacacaaggttttcctggcattcctggagccccaggggcgcccaggctcatacctctttcttcctgaagcctgtgcctcatttgtctaggcagggacgagcccaccttcccctgagcctcagaaccgcctgtcacttggtttaagggatgggctggttgggggcctctgctccttcctcctcctcccatcctccacacacttccct

SEQ ID NO: 101558 - DNA, 1419 bp, Homo sapiens
agatgctcaataaatggccacgagagtgttggtgccgatggtaagtagggattggtggtaagcaggatggctgcccgagagtgtgagctgggcggagctcaggttggctccttcttgcatcaagctgcccactaggcttgcacatccttgatgtgggcaacacccacagactgcacaagctgtcccataaggttcagatgcccagacaacaagattcggttcgagccctgtggggtgatgcattccagagaccacacttcctttagggaggctcagaatttgcatggggccacagcaaacgcctttcttcattcccctgagttatacagcaggtagcagagcttcaatctgaaacacctcgtggatgtcagttgagagatggcgtgagagtttggttgtggtcagtgatgtgcttcagactcccagagaagggagactctcaatgtcctcttatggctgctacatttaaggaataaaaaataaaagttaatacagagacttgccaagtctgtgtgtgtgtgtgtgcctctatatgtacgtgctgacttcttaggatttctgcaaggtccggaacagctttccagaagaaggtggaaagtgaagccggggagctttgcacaggtctgggaaccctgcaggaacttggtgcccgccgcgccagttccgcagattcccctcaccgggctgagctgatgtctgtagctggccagagttctaattgccttcctaaaaacaatttagttggtaataattctgtaaatgtctgaatcaactttgcgcaaacaccctgagtaatttctttgttcttttctttctactttgtaattggtgtctgtaaaagccaaaggtttggtcttgcggaaggcatgattcatttattggtgtctatgcctcctcgttattgagtcatttcagatgccatcacggtgagccagggctgattcatatggggctgagcttagaagccaatagggtcacggccataggaggaagctggttttctaatctgtttatgatatgggaaaaagaggcgggtgtattgagatgatggagagggtgtcaattacatgggtgaatataaccaatgaaataacaccaaccagcctttaaacaccactccatttgctgctgttgatcgttaggatagatcgcagctcaatgcactcctatctcgggtgtatctctccctgtgtttatggatcttgatctctgagcaggctgacacgggagggatgcccccaccccagacctggagagacgtttcaagtcataagccacagatgcagagaatgttgcctctttaaaaaatgtatcagctggacctaccatgaaacaaatgtttaaatgtttaggctcacgtgtaagggagcctctgccccattccctactcatttctctaacaatgacaattattagatg

SEQ ID NO: 101559 - DNA, 1076 bp, Homo sapiens
aggctgtgctgctgccagcctcgggttctgtacggtgcacatgctgagagaaggagattgaagccgagggcccattttttgctttttacaaagtgttgcgtaacgcacgcatggttggggcacgtgcgggagctgtgcgggagacggacctactcttcatgcaccctctggagtgacaaggatggtaccatgctgtgccaggggctccccgaggctgggggagcatggttcagggaagcaaactcagttgtctttggggtgggctccagggaaccaggggcaagagtccagtttaaaggcactgtggccactgctcagcccaccattgccacatgggccctgagtggccagatctttccgttccagggcagccgaatggttagattttgacataaaactcctgggttttaagtgctggcagttccttttgtctcccctgtcaccaagaagccccacagaacctgctggcagaccccatctgtctcatcaagtgacctgccctgctgtgggtgggttaggagtgagaccgagggccagagggatggaggcgtcaaaacttgctggccgtgtcccctttgtgccccccttcactgtcatctgatgggtctgtaaagtggggtgataatagtccctgtgctgagggtgcagagagattctggctgtgtgtggcctagtgtctggagcagctgtgtgttcatagaggtgagcgatgatggtggggcggattggactcgatggtccattctgcctggttccctagcggtcactctgtaacagagtgcctagtgatgagaaggccttcaccagaaaaaggttgcccatcctcggactggctgggaaggttggaatcaacaggcccatctggggcccatggccttgaacatggaggtaattgactatctgtgtaatactccttgtccttgccaggcccaccgcagacctggctggcaacgaccccagcatgcccgttgctggcccaagaggccccagacggtctcttcgggtctgccagcagggttcccttaatccactgccaggcttggtggacagaggctggaagagggggtacaaggcaa

SEQ ID NO: 101560 - DNA, 1066 bp, Homo sapiens
gagcctctgattcttcttctccaaccttttccaaacaaatatgagaaaatatcagaaactcacaggacacccaggtttccctgggcttgcctggcacatgctgtttgacacttgcttgaatcaagtgagggtgtagagacagtgccttggcactgtgacattctgagcccggtaattctttgttggggggcaggaaaggccgtcctgtgctctgtaaggtgttaccagcacccctctcccacacccactagataccagcacccctctcccaggtttgacagccagaaatgtctccagacatggtcaaatgccccctactgagaccactgtttaatcagttagtggtttctcctaaggggcttgagggccagagggcagcatctgcgttgccaggagacccttaattcccgtcagacgttcgtccctgtgaaggcctgtggccactccgcagccactcatccactcagcttttactgagtgcctgttgtgtgccatgaaggaaagataggggcttcctcttgagatgaagttttcccgttttcgtcttggatttgcttttctaaggagagaccctggcgttagtgaaagctgatgttttggattggggttaaaatacagatgtccaacaccagctgttctcccctgtggacccgctaaaccctgggacttttcacccacaggttttctgactgtctgggttttaggttgtggtgcaataggggagttattaagggagttgagttctatgacccgaatcttaggtcagacagttggcctcagcttcccaggaggtctgggttaagccagctacactgcccagtgtgacccagggtcgaggtgagtttagcatttgtcaaagcacaaaataactaattgttcctgtacaaacacacacgcgcctgtgagtgggtgcttgcatgcgcacacgtgcagacacacacacgcgcacacacagtcatacacaggcacacacagcttctaccccatctgtctttcctgccctcttctctttgggttgggaatggttaaaacttctgggcatgtaagaagaaaaggaggaagagtg

SEQ ID NO: 101561 - DNA, 1070 bp, Homo sapiens
cgctgtggaatgaaggcagtgtctgggcggctcataagcaagtgtccgcaggcggctgccagtttgtggcccctgagcctatacagtgagcttcaagtggtaaaaataaccaggctggccgggctttggtggtgggtccttccatccatccacctctccacactccctcccagcctggaatggaaagctctccccctaccccaccttagctggcctgtgccagactagcgaggtgccaggaggacctgcccagagccagcgtttgcggaaccgacttgccttcccagaggccctttgtgaactcaggaggctaatgaaatgcacgagaatgttattaaaatacgttcgcacacgtttggagagtcttgccttagatggattgctgcttcagtgccctccttgcctcactttttgcctttcgctctgtaaagctgccttgaggacctcctgctcgaggggcacacatccttgtgtcacccttattccaagggctgggcacagtgcatcattttgctcttgtctctctttatggttcaggacttaaaaaaaaaaaaaaaaagcattgttcttatttctgtcctttcttaggctcatcagtccatgatgtttttgacctgacatcaaggcctcttgttaaatgccttgccgccgccctctgcactttgccccgccgccgccagcagcctttgagtgattgggacccttggggttaatacctggaaccctagcctgttccagctggcccctgggtgccccagttagtcctgtgttctgtgtatacacagccccctacttattggaagaaagctgcaaggcacggagggaaccaaccagtctttaaaatgcaggtatactgtaacagtttgttttcatcagatttccccgagagactagggtgaggaagtggtaaggcctggtgtctcctggagtttctttacaccaaaagataggaaggaaggagggaaggaaaaaagaaaggaaaaaagctagtatttggtttttcttttaactagtagtggctgctgtttttcatctagtacatgctgggagttgtttgcaacgagaacttg

SEQ ID NO: 101562 - DNA, 1021 bp, Homo sapiens
aggtgctggctctaccacttcttgcaaacctcacccttctggagtagtctgtgccttaaacatgtgaatattacttaaaggtgttggttagccataccagggagtccctagggcataaggaatagtggatgcaaactcacagggttgctcctcagtgctttcactttagcctttgtatttctgtaaggacctccagcagtcttgaaattaaaatgtatgaaatcaattttcctttgcacttaaaagaactggtttatacagtatcatatgtaactgtgcaaatgtaatttttaacatctggaaagataccattgacttcaaggaaagcttttgccttggcttacagaagtaatttctggcattgaaaaaggactctttgaaggggaagtgacaggacagctgcttcctttggagcaaattggtaacatgtccaatcaactctgtaggatccaggtggacccagaaatggaaccagtgaccatctggagactgaccagaggcaggatcccaccccacttgaagagaataaatctaaattacaggttcgtttctttcgggggcgggggggcggggaggcaactcaaaactgtgtattttcttaaagttaactttaagaattggaaccaaatattttttcttctatcaatattgattacatattttaattcatatttcgtgttgctaattgtaaaaaattaattgtaaggtagtgtttaagcttctgaacaatctataatagtgttttcaataaagcaaactaatatgagaaaaaaataagacatctaacactgatttgattgagttctatctcagtcaagcacagtcaaacatagacgtgattatcagagtataaggtctcaggtgctaggttcttggggcagttgtaagaaaagagaaggcagtctccattctcaagagctggatgtaccagcctaagcagacattgctgtctagactgtcctctatgatatcaaatattgtgccaatcttaagaagatgagttttgggtgttgctttcact

SEQ ID NO: 101563 - DNA, 1511 bp, Homo sapiens
gcctcccagagcagctgtcacaccagccgcccatttggtaggcgctctggcatacgtggatgctccagtgctggtcctggcatgctgtttctctttcttttgaaaaagcaccagtgacccccttcctcctgtgggtggaaccagccccttgtgagaccacggccccaaagctggagtgaagaggggcccatgatttatttcttcaggtttctccaggagcttgggtcaaccccttgtagctggaggttcttgagctgtcctagtttctactaagcttccacttggaccactttaagttggggtcttccacaggtaggggggcagaatggaggattaaaatgagggaggagtctgtggtcatacagtcattgggatagcaccgtgtcattatcatgtgccatgatggataatctcttcaatctcatggtctccagggcctaaataccagttgtttctctattcatacagtttagaacttgatttcagtgattaacacctcccttaccccttaggcctgctctaataaagcaaaataaaacattttagaactcaaacataaaatgtgtaggagttggttatctgtgattaataagaaatggggtgatatcctcttctgctggtttgttgctaaaaaaattagcaagaaagctcattattgtcaaccttgttacctagagtgcaaaagttgcaagtgttaagtagaagggtgtgaccacatttaccttggtggggatgtgatagtatttggacttctttatcatagaggtgaaaaaaaaaaaaaagaacagattcctccaggctggggcttttgagttgcagctttaaaagggtttgtgtaatggagcctgttttatggtgtgggagggcagagcccttgaatttgcggcttgactccaagatcctagtgggattaattaggatgcttcctgtcgcaaaagaagggagaggaaataaaaaactccaagaaccatgaggaaaatgttctcttgcacaagacaagaggaagaagtgctgtggttgggcagcttctgggctgctagactccatacctttggtgctgatctgtccacccttcccctctgctgtggtggcttttgtcagcatgaaatgcccagtggaaggcggggcctgtgtcttcccacttgtctcttttgaagaacaaggacaccccaggcgggaaaccacctccctgccctctccttctgcctccctcttcctggccacagtcacggtgtgcattcatgggttgagcatggtgaactgggcagaaacatgggagccccctgagtcgggatcctgctagaaagaaggctgctggatgctgagtggtgggtgcacaggtagccagccagcatggtgtcccactggggtttggggaactcacaataccttctggaggtgccatgacttgtggtgatttgcttaagccttgatttggctcctggattaagtgctgcacatatgcttgcactgaagactttggaataaaattaatttctaaagggataata

SEQ ID NO: 101564 - DNA, 1031 bp, Homo sapiens
tttcgggaagggaactatgaaaattcagttagccctgtgattattctttatccttaaatttatgaaggaaattaaatcaatgtttgctgaaggaatgggcacacgtaacatatcacttctaatagctagagacaaaggtctgtttttggaaaacacattactgagctgccttaatccccagtgtaagacctggactgggggctgggcagtgatgactgtggcccctgaggcccttgtgatatggttaaggggattgtgcaggcagccaccctgtggggcatggcgagggctcggaacggaggggatgcgatgtgtagaggaaatgtctgggagagaccttacatagcaggtgacatttggcctgggctttagagattggctgagaacccaccattcagagaagtcaggggatgagtttcagaaggttctttcagttccctgaaatcattatttgtaaaatcttgcatgtttgtgcatacttaatttctttgtaagacaaggcccatagctttcttcagagctcaaagggatctatgatccccgaagatctagaaataagtgatgcattttatttgtgaactggccacggcaggcaggagatgtcactcaggccattgggaagggcctggtgtgtagcactggagcggtgggacctgtcctgggcacagcgcagagccagctacaagctctcagtgttttgatgaatgttggagtccacgaaatttaattaatagaagcaggatgcaggaagtaatatgtgtgtgtgtgtgtgtgtgtgtgtgtgtgtcttttgggaggttgaggatactaaaacattcgtttatttttacagaaaggtatgtgaaatatgttatctttactgtttagatagtctcaaactgtcatactctggacagaaagaatgggcagcctttggggcttggtgagtgagagcattactcatctgtgtgtaaatggatgtattcatgcatgggtgtgtgtgtgcacatgtatgtatgtgtatgtgagcaggtagccatcctgctttataa

SEQ ID NO: 101565 - DNA, 1069 bp, Homo sapiens
taggcctagccagcaaatttttaatttcagttattgtactattttgctctagaatttccattttgatcttttatagacctttacagtttctatatctctatcatatagaaagtccctgtctattctttatgcattttttccttgtaattcttgagtatatttataacagctcctttaaagtccttgtccggcccatgcaacatttggatcatcttgatgttggttttcattgactacttatattatggatcacttttttcttattaatgcatgagtagtgatttttgattggacactggacattataaatgatacattgcagagtccctggattctgttatatttttctaaaatgatttttgtcctaggaggcagttaccttgattaatctccagctccaaattatctgccttgtgagcagaagctgaaatctctgctgagtttgtttaatttctgacgctgctttttttctgggtcctctgggatccccctcacatatatgtagtttagcagttagccaaagatttaagcacattttatgcacagattttggaccttgcttgcaaatctctcctgttgcagtgtatcttttaagagtagcccctcttccagtttctgccttttggttgctttccgctgctttcaaatggtgttttttttatgttttgtcaagattctataatttttagcttcaggagggttagtctaacttagactttgctattaccagaagtcttggttcttttttatagtttccatttctttgataagattcctaatctgttcattcattgtggccctgttttcctctttgtacttgagcatatttgtaatagctgctttaaattccttttaaagtcttctaattctaatatctggattttctgtgggtgttttttctgctgactgatatttttcttgactgtgggtcacattttcttatttcttctcatgtctatagatttttcattttctattgtattttgttgaaacattgtagaaactctggattttgttgtttacctctagagatattgactttgttctagaaagcagttcagattctgtt

SEQ ID NO: 101566 - DNA, 1722 bp, Homo sapiens
cagggagctgttagctaaaagggtgatgaggaaagaagcaaaccgggctggtcagatgcccgatgtgtttgggggctctctgttgatccggatggtgtgaatattgctacatctgtgctgtacataaacacacgcctactcaaagcagtgccattttggaggaagtgcctcaactcccaaggagactgcacgtcttcatggataaaatacatctgttcattcgacttgtcactctcattagaacttaacaattagttgattctgatgccaacaactctagtgcatatatgattgggaaaatcagagataaccaactgcatgtgtcctgggtgttttagattgagttatgcaggacagcttccatgttgggacatgggtacatggaatcctgggaagggaaatgtgtgtgcattttcctttgtgaagaccttctagaaaccctatgcaatgttagtgactctgtccttgatgcagttagaagggttggctctgtctgtcttctgtcacttagcagttgagttgtgaaattctgttttgtttatttctccctcaagatggtgagcttcttggctcactgggctgcggtatctttgcaccatcagcacccagcacagtgccaggcccagagtcagtactaaataaatgttagttgttggatgaatgaatcggtaaaaactgcaagagctgtatcttttaattatatctagacaggataaacaggccaccagagaccaattataattcctcttgcttgcagggacgccattagcattccgagattataactcattgtcagaagactatttttctctctcaaaactttttcacgttaaggcttcctcattttttgtcatcatttctatttttaagctaatttttatttgtgcacttatttaagaagaatctcttggttatgtgctataaagaacagttggctccaagcaactaagtgaagatcgtcattccatacaagtggttcccagggccacgggaatataatttcttgtcactagtgtgctgacttttaatgactctggatttgttttatactgtatagtaataaggtcatgcaggtgtggcagatggagaggggtggatggagatactgggagtgctttagttgcccatcaccctgcatacggaagcctcacatcctcatttattgtggctgtcactttgtacaactctgctaagcatcacatcagaaatatgtgtcctctctgttctgaggacacaaaccttttccttatttgtgttatgggctagtttccccgttcgctccacccccattggttttctttcccctcttcctgtatgcaaattccaaatagaatgatgggtagattactaacccagaacctttttctactgtaaataggcagtgctgtgtatatagtgagaataacagactttagagacaggaagcccttcctccccccaatccctgcctttctccatcccttcctttcttctctccctactttggtccttcactcccctgccttaaccttcttccttccttcttttgttttttcctccttttctttttactgtgttgggggaatggaagaattctttcacaattttgtttttggcaacttttcatcttgtttcaatttcaaacttgcaagaaagttgcaagaatagtagtatgaattcccctatacctctttctggcttctttagtaatttgtatctagcttcatttattttatcattttt

SEQ ID NO: 101567 - DNA, 1117 bp, Homo sapiens
catcggaaaggatgtggttttgtcctttcattgacttttctttttcctttggattcattcttgaaaatgagattacactgagtcaggggatttgacatttcttgacctttgtccagtagcattgctgtatcttctcttccagaagagccgaggcaggaagcgtggttttgactccagaatctagcatggtgcctgacactcagtctgtgtttgctgaagagtcatattcttggtcgagagcaggcactccgatggtcagcccgagctgtgtgtgcacccagcttcccaatgtgtccgcacccagcttcccattgtgtgcagatctgccgcacctctgcactcccacttccactacaaacacagcttgccctcctttttttgctcccctgccgtgggccttcctgcccccacaggcctctggctctgcagcctctatttcctgcctgcatttacttcctgttgttcctcagcggctccctctcttgtcccaccctttcaggcctgtccctgccatcaccctctatttacttgtccttttgatggtgcttctgccacgctggctttgcctgtcctccccagcccttcagtgtcctccactgcttgtggccgagcttggtggagggagtcctgtcatgcactgattggtgccgttgcaaattgatgggttccagtcgtggctgggcttgcagcattgcttggcagtcctttcccttgtccctcatcagctgcatttcccattatccttggcagttctcttagaccttcgccatttcatcaggcctctcccctctgcctgcctcgcgccaagcagatgaccttgccttttactcagagcaaatagaggccttcaatcttcatcccctatctccatgcagggaaccaccacctacttcacacactccccagagccgccacccaggaactgacgaaatcctctcccctcacctcctccatccagctagagccaagccctgtctcctttgtttccatcaaaagtacctaaccccttgagggcacccgctcctcttcattcccacccttagtaaacacagaaaagtgctgaagttctttctcgctgacctcttgttccctgaggcacagcccagactccttcctg

SEQ ID NO: 101568 - DNA, 1546 bp, Homo sapiens
atgtaggaagatagacagcactcattcttatcatgaaatatttctttttttctttagcattttactatggaaattttcaaacgcacataacagtagagagaatatgaaaatgaatgcccacgtgccctacacctggcatcaaccattgttaacgtttgacctggccgggcgtggtggctcacgcctgtaatcccagcactttgggagtctgaagcaggtgaatcacctgaggtcaggagtttaagaccagcctggccaacttggtgcaaccccatttctactgaaaatacaaaaattagctgggcatagtagtgcgtgcttgtagtcccagctactcgtgaggctgaggcagcagaattacttgagcccggcaggtggagattgcagtgagccgagatcgtgtcactgcactccagcctgggtgacacagtgagactctgcctcaaaaaaaaataaaaacaaaaaaaattcgattaattttttcatttatcttaccgagataaaatccaatccagacaaaagaatttgcagaaaccatctcatttcagctgtaaatacttttagtattgttctctaagaaatagactcttttaaaaaaaaacgatagtatcattaatgcaaatataaaaattatcagtagttatctaatgtcatctaatatctagtcattggtcaaatttcccagttttctcataagtgtgtgtttttgcgcagaggccgttcaaaccagaatacaaacaatgtccacacattgaatctaagtgatatatgtctcttagatcttttaaaatttataatgttgctcctccccacttttttcccttgctatttatttgttgaggaagccaggtcattagttttatagaatttcccacatttgggatatggtttattgcatctctgtagtgttaagatgttgctctactccaggcatttcttataaactagtagctaagttggaagctcagccagactcagattttttatttagtgagaatactttgtagatggtttgtgttttcctgctatatcaaatcgggggcagaaaagctctggatggttatcttttcctaatgctgaatttggccaccttttctgtaaaggtggccaaacttctataaagttctccatcatcgtatgagcaaccattggtgatggttgccctgatccagtatctcattagaggctgtaaattctgacacactaattccaacatctctttttagtttaatagctagagttcttctgtaaaggtttcctctatcaactatttgatagccctgaaaacctgtttgaatagggaagatagaataaatgctttattttatccctttatttaccagtttccaggatcatcgttggcgttttaataatctacaaaggttaccagttaggttttaaaaatttttttgagtattgttaggaactcccacattttaacatagtagatatgtttcaaactgttatagtacttattctttttttttttttaaattatactttaagttccagggtacatctgcacaacgtgcaggtttgttacaga

SEQ ID NO: 101569 - DNA, 1039 bp, Homo sapiens
gcgtttagaacagaccggatgtggggtggactttctgtcagagtcttgctaacaagtaaggccaaactgatttgtttttccttcaactgctttaacctgtttgcacagccctgcgtggtgagcagggcttcttaaacagcagggctttcttagaggtgtacatctgctcacttgctgagttctccagtagaggattggttcctttcactcatgcattagacagactgcactaaaagaaaggcgtccggctcttctttgttactctggtacctattattttcttttgcggttcttcaactgaccatttcattttgggtgaattctcaatgttgcgattcttagagacttcagctgtgaaggtagaacacatgccacaaggccatgtctttgcccaagtgtgacttgtcacagttgatgcacacttttgagcgtgggttcccccccttcactcttcctttttagatggatttgaagactatggtacagattgcgacaacatgagagtaacggccttcttggacattccaggccaggataacctgcctccactcactcgcctggagaagtatgctttcagcgagaacaccttcaaccggtaagcccaaccaggcctgtgtatgttgacaactctgtgttgtgtgctttaagctgacacttggggccacttctctgtgacagctttgaggagacttcatggatgatgaggtaggttggatacagattgtcaccaggatgctgggcttctgtctgaatggtaccatcttattaggctttttcattatttttgttattgttttgctgaccacctggtaagccaggaaggaaatggtgatgaatttcatggtgtttaagtgattaggattgctaactgggtttctttcacatatgcagtactcagaaaaatcatgcattccttaattgagaagcaccaagaagcgtcagttggaagcattgtctgcccgctttgtattttgactgcgctgtgtatcaggaacttcggtggcaatgtgtcatgccatgctccgttgtcaccgtgtac

SEQ ID NO: 101570 - DNA, 1119 bp, Homo sapiens
atagagttgtggggaagcctggggctcaactcctgacacccacagcctggcagggaagtgcctgcagtgtctcaagggcccaggcagaagagggaacacagatctgggcctgtaagaagacagggccgggctgggtgcggtggctcacgcctgtaatctcagcaccttgggaggccaaggtgggcagatcacctggggtcaagagtttgagactagcctggccaacatggtgaaaccccgtctccactaaaaatacaaaaattagccaagtgtggtggcgtgcacttgtaatcccagctactagggaggctgaggtgggaagattgcttgaaactgggagatggaggctgcagtgagccaagattgtgccactgcactccagcctgggcaacagagcaagactctgtttcaaaaaaaaaaaaaaaaaaagaagacagggcaggggtaggaggggaaggcttctgaggggaggtggcatttgagttggggcaggcggaggaaggcgatgggcatttgggcggtgtgtacacaggcagagtgttgcatgatcctggtctgcttgggagccagtgagaaagaagagtggagacttgggaacaagggctgtgtgtgagggagggagtgggagaggctgggagatagcactgggggctgtcagtgaagaatctgctttaccagtccagggtttaggcttaacctgggaggcagtagggcgtccctaagcactgtggtcgggtttctgtcttaggaatgcaacccaagcagtggtacaaacactgctgcttacttaggactaagagcatgtcaagctctgctgtgacacattattgttgtaacaaaagcccacgggctgggtgtttttaatcccattttattattgcaagtctcacagcgggcacagaaaggctaagtaacttgcccaaagtaacacagctagtaagtgacgggtggaatttaaaccaggaagtcaggctgcagaatttatcttaaccactatcctttggaggactcgtcattcactgttatattcattcattcattcaactgatatttattaagggcctattaagtctcaggcactatgttaggcattgtggacacagaagtgaataaaacgaa

SEQ ID NO: 101571 - DNA, 1036 bp, Homo sapiens
aaggtcctaatctgtcttaacggcaaaaacctctcccttttagtacagttggaatttcctaattactctactgaatttttatgacaaccgcttttgtgttcctccgtttataaaatttacacgtctagggtgatttttctaaaatcctgaacttatgccacaaagtagtttttggtgtctgccaaaaggtaaactttttctcagtccctcatctcgttctctttcaggatacaggtgtaggtaaatcgagtattgtgtggcggtttgtggaagacagttttgatccaaacatcaacccaacaatagggtaagagacttttatttgatacacatctaaaggtgcattgaaaatccttccaaatacatagtgtgttacaggtgtaggccctgcgctttgtagtcattgaattctgagtcgctggttcgcatcatctctggaaggacttgaaagagtccagtgaggatctgtgtattttaggaaaattatcttcggacttgttgggggtgagaacttcaaaatgcaaatatgaattggagttctactaattattagaacagacacagaagcttcggtctataaatatcaacagcaattacaccttgaaataaggcagatgaaaatagatcctggtgctattctttcaggcatatcaagtaaaagacatttaaatggtttttgtccttcctgaaagtagtaggttgagatctgaacccttacacattcctgtactggtagtaataataaattaataaattcatattgaaatggaaggttttttcagttctctggttctatggataagtaaagttgattgttcatatgtttttgacgctataagaaaacttttcattttgcaatactaatcctttgactacataagaagttgtgttttataggctttaatattatgttaaccttataaaactaaataggtgctgtgctctagttttaatcatcaaaccctcaaatggtttccagcatttaaagaaaaaatctatgttatccatcattaggataaaattggcctttgtgctc

SEQ ID NO: 101572 - DNA, 1745 bp, Homo sapiens
ggcgcgatcttggctcactgcaagctccgcctcctggattcacgccattctcctgcctcagcctcccgagtagctgggactacaggcacccaccaccatgcctggctaatttttttttgtatttttagtagagacggggtttcatgtattagccaggatggtctctctctcctgacctcgtgatccgcctgccttggcctcccaaagtgctgagattacaggcgtgagccaccgtgcctggccgcctatctgcttttttaaaccctgtgggtctcctacacatttgaaggcatggggatgaaattcaccaataagtttctgcaattaaaatgcttttccgtgtcctttaagaaagagctgggtatgacacatgtaaaacatgaccccatccttctcagggcctgcctgtccctacctgcatgggaaagtgaagtgttgggaagtgacagcaagtactgctggtgattcagtgagtgatacacttcacactgagtcagagctgaaaacctaaaatccacaagacacccagacaccaccttggctagaagtgctctctcaaataagaagagagaaaagtgaagggtgtagcttcatgcatcttggtgaggcacgccccatcctgagtgtccactgttccctttttgccagtagctcccaatctgccagatgcctgtggctcctgagctgcctctagtccactctctgcaccaggagatttggctcacattttcacagggaaaatagcatacaaggctttctcctcattttctttcttctgcctttttttgtttctttttcctcagttttagaaggtggcttcctcctttgtgaccaaccccaaacatgcccctgagctctggagccccacctcttcatgagttaccctgtttcttcctcagccctatcatcttgtcatagcctgcacacaggttccgaatccaccccactccaccacaagagcacccattccccaacctactgctcagatggtggaactcctgaaagagaagttaccacttccgcaactgctgctcactcttcagccctccgtcatctcagctcctccctgccatgccactaaaaccaccttcccctggtaccagtttccatctaatagccaaagtcaaatggccttttcttggtagttttctttattcatagagtgcctgctatatgccaggtgctagactgggtgctggtgcctagaccaggggtgggcaaactgtggcctttttgcccgcctcctgcttttgtaaataaagagttactgaaacagtcacacccaattatttacttactgtcttgctgctttggggctacaatgaccaacttgaatagttgcaactaagccttgatgggccacaaacccaaaaatatttgctatctggtacttttcagagcaagtttgctgaccccgatctagacaaaatggacttctgtcctcgtagaccttacctacaagaagctacattatgactagtgtacaggaaatgatttattctttttctttttttttttttgagactgagtctctctctattacccaggctggattgtaatgacacgatctcggctcactgcaacctctgcctcccatgttgaagcgattctcctgcctcagcctcccatatagttgggactataggcgcacatttgggaatctgcccgccacaatgccaagctaatttttgtattttgagtagagacagggtttcaccatgttggccaggctgttctcaaacacc

SEQ ID NO: 101573 - DNA, 1055 bp, Homo sapiens
caccacgacgcccagctaatttttttgtatttttagtagagatggggtttcaccatgttggccaggctggtctcgtactcctgacctcaagtgatccactcgccttggccttccaaagtgctgggattacgggtatgagccacggcgcccggccgctggttttttttcaattatccagcccaaaatgtcagccttgctgttctttttgacccacttcccttcgtcttgtctgtgccctcacagggcttactgttccccaatttttgcctacatcatctgtctctacttctgtcctggaggatccttaaaagtagagactttaaggatactgcctggaatctggggggataaaaagtattttattgtctcttgggaaaaataaaactagttcatgaaactggtaggttttaaattttaccaatattgttgcttaggcaaggctcagtttaaaaaaagagagtgattttttgaaatattcagtagtaattcaaacgaagcaacataatgcaaatggtacatagaaatgtaccttttttaaaatatttttagaatatctctgaaatattcactagtaatacaaatggagcagcataaatggggtggcggagctctggcctccaggagattctggcttacaaggaacagggcctcacaccaaggaggcacttgttaccagccttcacctgcctggagccttctatgtggtcacctaactgcactctgcccaccccaccctccaagtctaaccctgcagagcagccaggctgctgcttgacattcatgattctctactttgattcttgccgttgctcttcatggaatgggacccccctgggggtcctcgcccatcttctccctcaactttctggctcagccccatacttcacctcttctctgaaggctttcctgatgcatttgtttcctcttgctgctttaacacatcacagcaaactgagcagctttaaaaaacacacacttactcttttatagttctggaggtgagaagtccaaagtcagttcacaagattaaagtcaaagtattgacagagctggtc

SEQ ID NO: 101574 - DNA, 1053 bp, Homo sapiens
ggcttcttgaagccactctaacataagccaaatgtgcgcttaaattcagctaaccctcactgagaacccatcaagttctttgcaccattctaacagagacaactttgtgaaggtcccttgatacctctgttagaggaacttctagatgtcatgtgcctttggtctttttatgtctcaatcttggtattcagtggtgtttccatcagtgtacataatccagagatccaagggttgtttgcatgagatttctagttttgagaagtgagaatcctttgttaattgtaaaatgtgctggattgttcatcctcgggaggcactatatgccattatggggatgacaccatcccatatgccatgcaaagaacagggtttgcagtaaagagaggtgctggaatgtaatgtcagagcacacctatgttccaggagagctaaacaagtctactgcagttaaagaaaagaaatgtttaaaataccttgcaacaagttttttcattgagagcacgtactctgaccaaagttcatgactacttggtgtgcatgaagaaagtcatatttttagaatgccatgataaatggagaagtatatgaaaagcattctagctttaggaaataatgctagtatggattttagattaaagacataataagatctgcctaagcagagtgaagagagatggtttagtagtgaaaaataaggttatcagacaagtaaatggcaggctggaaaataaaaatgtatcatttgaatggcagggagccattgccagtttttcaaaaagcaagatattaaagttatcataccctctgcatcatttaacttgatcgttaaaggagtgatcctagtgatcctagagttctagtgacaacgggagggaaaaattgtagtagtcccactggaagattagggtccaatttatgaatttatttcagggattgaggttcaagtgtagattaaatataaaatgaagaaccagacagctctacttcaaaattggatgcaagtaacaaaggacaaaggatagttgcagacttcgtttctgttctgtggaaggc

SEQ ID NO: 101575 - DNA, 1222 bp, Homo sapiens
gtttcagttacccctcacatatatttgatgatacagcaaagccctcatcataaagaatcatgctgtaatatagattccattatgctttgaatcagagcctgtcctggtatatgcagtggcgtataacatctctttttttctggaacacaaaaaaaaaataacacaaaggtgtttgcctctctccctttctgccaccatggtagcagaagtctgtgaagttttgtacttagctggttttcctgcctcttgcttgtccacttctcattggttctgcaacaggagtagttgctctgagatgcaaacctgccttcagcctgcctgatgcaccatcacacagcccagagctgcacaggagatgctcatggggccaagccacaggccaggggtgctgaccaggatgccctgcatggagaagacaggagaggagcaccacctgatgagcacacactccagccagttgttgctgggcgtgagcacatgtccagggttgccaaagcgcagtgctgaggaaagccacacacctgacagctacccacaaattgtttgaaatgctgggaggatcacacaagacacgtcttgtaagcctgtctgggtcagggactgcccgtttatcctgggcagtgcattgaaggtccagaatgtgccatccacagccaggctctattttcacctcctcccaccagtctgtcctctagtacaaactgcgtgctgttctccagcatgccatagtttcacaccctcatgcccttccacaactctattcagccttcagaaccaacctccaatgtcacctaaagggggctttcctgccatccctgctctcggacaagtaaccacatcgccacactgccgtgttgctctagacccatatctggaggcctccctgggttcctcccttggcctcagtgctggacaccttctccacccaggtgtcctgacagcttcattctctacatgtatcgcaaataggttcacttctccatctccgctcccagcatcctgctctcagccacctttggccattcactgagtactcctttagccttttcgtgggtcccctgctttccctctgtccatgacatgtcctcataggacccagaggaatcttctggaaacaaaaatcagcctgtgttattggcctgcttaatatccttcagtgacttcccactgcacctctcataacagccacactctgaacagagacctcccaagccccacgtga

SEQ ID NO: 101576 - DNA, 1094 bp, Homo sapiens
tataaaacatatttaaccagttttcccaattttgtttatttttccccctcctctgcagtttcgtgccttagcaccaatgtactatcgagggtcggctgcagctataatcgtttatgatatcacaaaagaagtaagactatatagttttctttagattgttttgaaaactcttttggttgcttagatctccagttgctctcttttttgtgtgttacaggagacattttcaacattaaagaattgggtgaaagagcttcgacagcatggcccacctaatattgtagttgccattgcaggaaataaatgtgatcttatcgatgtaaggtaagttattagaacgagagattacaatacctattatgtgttccttttcttaataagcaatatccagtttaagaatcttgcttttattttatctctgacattgaaaaattccttttggttgtgtggttggagtcctaaatttttaaactaaaattaagatttcaggcatttggagctaattatattatgtatacagacaggtgtgcaatttacggaaatactggttgcgttgcatccaacattatctgagatcagagcagcccccaggctcccatgacttagaatacttgaatgcagaaagcacatttattggcagtttccctgggccacttccatcattcccaaagcaagggctttttgaaaattttggctggggaagaaaaccctgccatccctaatcattccattagctacattactagtggtaccgagttttgtttcactttgtttgtttacccatggatgtggtgtaatcgagaagaccatgtctcagggcccatccagcagccatttagtccatcctttgtcatcataaatctggttaactactgggtaggtgggggtacaactaagatcttcatgggtagaatttctgatatgtagttgttgccttccagagaagtcatggagagagatgcaaaggactacgccgactctattcatgcaatttttgtagagaccagcgcaaaaaacgcgataaacataaatgaactctttatagaaattagtgagtatctctgtgccttatccatttcctctgtaaaagccgc

SEQ ID NO: 101577 - DNA, 1947 bp, Homo sapiens
aaatcatgtttattgttgtcctggatgtaaatagcaggtacccagatggatttttgaaaggcaacataaagccagttgggaatttttcacagctcaagctaaaatgtctaagtgtgtggtgtcatgagtatgttaaaattactgctatctttttgtgttcttcactttagtggtattaaaaacaggaaagtaggccagacatggtggctcacacctataatcccagcactttgggaagccaacatgggtggatcacctgaggtcaggagttcgagaccagcctggccaacatggtgaaacccccatctctactaaaaatacaaaattagctgggcgtggtggtgcatgcctgtaatcccagctacttgtgaggctgcggcaggagactcgcttgaacccgggaggtggagattgcagtgagccgagatcacgccattgcactccagcctgggcaacaagagcaagactccatctcaaaaaaaaaaaaaaaggaagatagtaaactataccaacaatgaaaagtcttatataaaaactagtatgtacatattcaatttaactgtgaaaaacaaaacctatatgttcacaaagattagaaaaattgggagagatgtacatagactttcttgttcactggcttagtaaaactgcgtgagcacagtgcctggcacactgactttgtattgaagtataatagacatacagaaatgtgcacgtatcagaagtataaggctcagtgaattttcacaaactgaatatactccggtgcttggcactctggttgggacatggccgttcctacacccaacggtaaccatcctgatactaattcttcagattggtttatctggttttgttttacatatattttgtactttatatttttaaaaacactctgtttcctcttgtgtgtctggcttctttcattctgcattacatttttagaccatccatgtcattgcatctagctgtgaatgatccactctcatggctggtttgtgcgtgtgagtgtcagagtccgagttgtgcgggtaagggggcagtgaagaatacccacaatataattatccattctgctgttgatagacatttgggtagctgtttccaatttagagttattacaaacagtactgctctaaacattctgatcgtattctttggtgaacatctgtacacatttttgttaggtatatttatacccacaagaaaaaatgcttgtcattgagtatgcatgcattcagtacagctttaccgccaaccagttttcaaagtggtagttgtactagttgacaaccataccggtagtgtatgagaagtccgatcaccttctgtctctggtgggtagtcagtgatctccattttcatgacagttaatgaagtcgagcacatttccgaatatatgtttacatttgtcgtatctacatatcctcctttgtgaagggcctgttaagtcttttgcctgttttcctgttgggttacctgcctccttcttaatgttttatagttctttattttggagatgagtcacttattgactatgtatattggaagtatcttctactgtatggcttgcctttgatttttttagtcaactccttcgatggattgaagtttttaatcttcatataatctgactgatccttgttttcctttatgtttagctgcattaggtttttggttgctgttttagaaatcattacctgttcccagctcatgaaaatattctcctcttatttcttttaaaaatattatttgttcaacaattttttgatgtcatatttcacagatgtctcttagataccagctatatttcaatatccatttattgagaataatgacaagaagcttgggtaaagcttttaaacagatttgtagtatattcacagcagtgtctagtcatttgaaaagtagttagaagacattgggagatactttctcaatgtagaa

SEQ ID NO: 101578 - DNA, 2017 bp, Homo sapiens
ttgttgtgtctgagaaagttaaagctcactcccttcccttttctcatcttggtttaggtcgaagaattccatccactgacgccaacctgccatctggcggtaagggcttcaaactccgaagacagccttcagagccaaagcggagctgctgctgaccgaacctcagcctctcagacttgatgatgaagtaggtggtcctgaaagttaacaggagggctggggtccctgccaccagttttcacctagccagtcttgagtcttctccgtgcaaaaaggattcacagaaatggaccagttctgttctccaaagactgcagcaatgatatttcagtctgtgaacttctattatgtaaagaatctctagtgtacaaagggactacatcgttggcttttgaccttgctgaaaaggaacatataattgtatggatggtaggattaagttgttgagtagttttgtaatcaagattttatgtaacatttgtaaagggaaaattagcacttttgtggttcttaagggaaaagaaacagaccttgtggagattataatttccttggtttctgttaccactgttagagggagttgtatcatttaacatatagtaggatagtttaagtgtagggaggacaattattgtctgaagctaaaatgggttatttataggactgatggaaatgatttcatctctgccatctctaaagcacttttcattgaacatgttagcctaggatacgtacagtaaattaacaatgatagcagcagatgcctagctcatcctgggtttgcttctgaccttgtcatgtgtgtgccaccaaacacgttattggcacctttttaaataagctctcatgatcaagatggtgatggtagagaagctgcccggaataaactgaatttcatatgttctaaaatgactagcaatggtttaaaaaggaagaagagtggaagtgaagaaggtggtataaatgctgtcaatttttttttaacccaagtattttggtggggaaaagcaagtatctattgcttagcatatgtaaagttgtagtctatatttatggggccattgcttaaagattataaattatgtaaatacattaataaattctaagtttcatttgacattccattgaatctcgcacccagtcttgcgtatgcctgcccagttttcagcctcttaacgggagactcaagcacattggtattgtataaaggtatagagcacttagcttacaatctttaaaggtttctctgccttcccttctacccacccgcctcccaccagatcccatctggaaatcataataaagacatatgccactttgacaaacctgactagtccttactagcctgagggtaaaagattaagctccaacctcaagtcatttacctggtcttggtaataagtttcttttagcttgtacagcatcctcagaccaactgaggagctttccttgttaacaatttagcttatctttctgtttcctttatttttcccctgcctctgttagtggttaacactcttttccctcagggagcctaatgaggtttttaatatcatctaaaaataaagcattgaagtgaagttggtgaaaatttgttcctggtctaatttggcacccttccaacctgagtattgtaggggaaggaaatttacaagatttaataggaaatgaaacagcttgaatttcaaactaaattgtattttcagagctatcctgaaactgaacagctgaaactttaaaaaataattggtattattttgtgccccccacttaatatggatagattttaatgggaaaattataattcagattaaataaaaaacaattcccttttccctgttgtatatcttaagcatttggaattttttttatcttctgaaatcatataaaaagaatgtcattagtaaaaattctaacttcgttttgtttaaaagacatgtggatgctccatgcccctaggattttgcttcctccccggtgctaaattagcaagctcctagagaagccatgtgattcc

SEQ ID NO: 101579 - DNA, 1094 bp, Homo sapiens
agttcagtgacaaactagatagtgaacctgtgaaagtcattatttacatttgctttaaagggacagttttaccgttcaacttcaagagtttttctacctctttaacagttaatattttttaaaggaagaaatggaatgtaccttcaggggtcaagctgttaactgtatacctgcctctagttagcttggtttatcaaaaggatttttaaatgattcaaggtaatgtttaggatatttgttttaactcctgctgtgctgtgatttaaaaaaaaatagtctaagaaacaaatttatccatgagataaacatcatattttatagttttagaaaaaagggttgggggtggaatttagcctagaacttaaagaaacaacctctgcgaatttctcttgacagcggagttgcttgtcttgacttctaataatataaatccaggcagtttgattatccgatttgcaagaaactttaatggaattctggggcatttgtcctgttttatgtgcaaatgaaagtctaaaaaatatgaggaagatattacatttttcaggagcctccattttttcagtctaagagaatgataagtgagaggcctattgtgatgaagttgcattggacataatgtgggaagtgaataaatagaaccaagaatcttcatctatctctgttggtctttcaggattctcttagcatataggaaaatgatttaccttccagatctcgaaggacttccaatagcatagatcaggtttaatttgatggtctataccatcagaaataactaatatctgttttctttccttttagagtataatcaattatggataggccagaatatttttggcttcaaaacaaaaggattcataagcttaaaaaaacaaaaatcccaaaccttccatctatcccttttattacgttgaacattttagatagtaagattaagatgtatcattagtatatggtgaaattaaaaccgtggtgtctaacagatttaacaaaaagtgtttaatttactgcaagttcatttttagatctgtatggtgcccagtactccacaaaatgcatcataattgaaacaacaaaattattttcatgag

SEQ ID NO: 101580 - DNA, 1063 bp, Homo sapiens
tggtaataagatagttaacataagtggtcagaacttcgctgaatttgtaataaagcatttgttaagcgtgtaaaagtccaaattaaaagtcttgaagaaaaacagctatggcaatgagcctagacatttttcaaaaaaaaaagctaagccgtcctaccagcaatctctctttctcctaagaatgtcatgccttctcaagacctgatgaaaggaataagatatttgtgcctttttataaaagcatctattacgaaagtaaaattcagttgcttacagttttggccgctttgtagcactattataaacagcccaaatttatggccttggacttactgcatgacacatggcctggttacctgtcatggaatgctgcagtggtggtttgccaagcttctgtggatgtttgaagactttatttttgcagtcttaaccttgggctggacctaagtgtatgtaaaccatatgatgcctgtattgtttatagatgctgacaaaagaaaactagaccttttgttttttgttgtaagatttttgttttcatgcctatgctcatagtagatagtttgcaaatgaaagttgatttgccatacttttaaataatattgttttagcttgaatattctataatacacttttatagagtataacatgctaaatcactgttttgttgtaagaagggtgtaaacattttgttaataaaatgctatgtttacaaatatatatttgcctcccaaatggtttctctttgtgatattactcatcatatgttcttcttaaccaaatactctgaagtcatttttaaatgacctttggatactgaagtaccagaattttgacagctgtagtgtctggtgagcagcaagttatttgtaccaaggtatctgaagcttcccagcttcccatatccttatcttatacaactcctccctctccttgctcttcagtagttaagatgggggttctagaagcaggtcagcaaggccaccagtgagcacttagagggaagtttgctgcccctggaagaaaggaacggtgcagtgccctagattgtggaagaaaaggt

SEQ ID NO: 101581 - DNA, 1055 bp, Homo sapiens
actttgctataagtctgctggtttgctgttttgttttttctatgtttttaagtataaaacctacaaaaaatgtcatgaatcttgggtacagctcaattaaatttcacgaaggttacccacataaccaaccctcagatcacaaagtgggacatctgccacacctcaggtgccccaccttgtgctccttctctaacatcactgatgagttttgtctggtttcaactttatatacataccatgtggttccatatgggtctggcttctttcatccaacatggtatgtcgtattctcattcattctcactgctatgtaggattccactatgtgaataaaccaccatttatttatctagtctatattgataggcattggattatttccagatttttgccattatgaatggaccacagtgaaccttacatacatctctggtgtaaaggcttgtacaggtttctcttgggcatgtgcccgggagtggaattactgggtcatgagaaatacacacacacacacacacacacattctcaatgtctgtatttgtttttgcttttgtagatagttttctaaaatggtgtatttagctgggcatggtggctcatgcctgtaatcccaacactttgggaggccgaggtgggtagatcacttgaggtcaggagtttgagaccagcgtggccaacatggcaaaaccccgactctactaaaaatataaaaattagctaagcatggtgccaggttcctgtaatcccaggtacttgggaggctgaggcaggagaaacacttgaacccgggaggcggaggttgcagtgagccgagatcacaccgttgcactccagtctgggcaacaagagcaaaagtccatctctaaaactaaagtggaatatcaatatagctccccccagcagtgtgcaagaattctagttgcacagcatccttgctaacacttgatattattattttctgcttttaaagtctggagatctgcagtccaagctgttaacagaacttacctctgagaagagaggcttggcccacagaactgtcacctggttttca

SEQ ID NO: 101582 - DNA, 1027 bp, Homo sapiens
aatactccagaacggtggctgtcactttgccttccaagttaacaatgtgaaataactctgaatttacagagaaccaaaggctttccaattaaaatgaaaaaaccgaaaaaccccaccaaacctaccgtggattgtaattccaggatagtacttgagctttcatgatgttctcatggccttctggggatgccagattgggaaagaagtccaggtagctaaagtgaaaatagtgagccttagtttccacttgagttgtctgaagttctttctctatctgggaggcctggcttggcttctcctgataattggtgggttcattcggttagtccacaaacatttactgagtacctgatctgtgtgtcagatacccagagaagccaagttatatcagctgtactctcctattttccctcaacctcctcccagtactttagggaagggggcagatgagaataacagccaggacaggacaatgatgtagggtagtccagagtgctccaggagcattgaggaggtcaactcctgaaagaggtgtcatttgagctcagttataaaggtcgagtagaagaaggctcaaagaaggaaagggtggggaacatttcagacagaggaaattgcatgcacagaggcacaaacactgagatgactgggctcctttgggatgccactagtagtttttttttttttgagatagagttctcactctgtcacccaggctggagtgcagaggcgccatctcactgcagcctctgcctcccaggttcaagtgattctcctgcctcagcctcttgagtagctgggattacatacaggcatgtgccactacgcctggctaaattttgtatttttagtagagacggtgtttcactatgttggccaggctggtctcaaactccggacctcaagtgatccgccctccttggcctctcaaagtgctgggattacaggcgtgagcccggccaccactagtggttctgaatgacagcaacaaagaacatttgttgtggttgcctggcaagatgggaga

SEQ ID NO: 101583 - DNA, 1047 bp, Homo sapiens
ctcagtccctttatgcatagatgcagccagtgtccaagttaaaattgtgttgcttctccttgagcagtccttccttgcattaactttctgaaaacccccaaatcccagtacaaactctgttgtctaatatgttatggaaagaggcactcatttgagaaaatttaagattttgttcaattgttttactgaaagatgtgtgaccttaggccacttcactcctcaaagcctggggtggttattcggtcaatggggatgatgctcgtgtccacgttgcctcttgtagaacgtgtttagaaggaatgacatggctgttagtggctttgtaagtgcatagtactatacagagattagacaaccacttaactacttaagtggtttcatcacttctgtacctgaaaggtgtggcagagaatagcgatcattctggccctggattggccaaagtaattatgccaaagtcactggatatttttgctagggaagtggtccaagagaagtggtaccaaattgttgaaggcctctggctcataactttagaagagacatctgtgtgtgttcttaaatgacgtcatgaggtgtgttgtttgtttgttttaaactgaatgctaagacagtacaattaatagagactgaataccctgacttagagataattcatttcaggatgagaaatggcacatttaactggtttcttccaggttactcagggtgacgactctgatttctggtcgttcacctagatgaacctctgagctaactttacttgagaaggtaataactaaaatgcccattcaaaggaaaaattatcttttaaatgcagcctaagttgatcgtatgggattgtatattgtcagactctttaatcttgggaattttgtgtggtatgttaaatttaaggatgttacagaagaaaaagaatgcaaatttatatgactttatgcagttttataggaagtactatgctgcatcataaatatcaaaaggagaaagcctggtggcttcctgaaagaagcatgacacaggaggatttgcctagacttaaggttg

SEQ ID NO: 101584 - DNA, 1081 bp, Homo sapiens
tcaagaagtcttagatagtcctgccattagtagggatctcagatgggagggcaccaatgaatcagtgtagttgagtaccacttttgggagaaaatagaaacttggacactctaaatgatagtttaaggacgttgtttgttttgttttgttttttgtatgggaaaagttggcttagactctttagttcagcccttcaagttgatgtgtaatttaagattgtttaggaagttaaaaaatctaaagccctgtggatatagttcattcagtgcagtaattatctttcagatgccaagtacagcattaattctttagctttagcatggcactgattttcttaacacttcatgatcacgtggagcagactgtgctttacagcacaacagagcgtcagccatgtgctgaagattcttcgtggtagtggtttagatccaccctgaatagattatcttcatttatttaattattaagtagcttgcttatcaaaagcggcattaaacttactaaacttgagtcaaacgtaaatcttcatagatagtaccatttacttctgaaatcttgttcctgggagaaaaatgtggactggaagttaactttcttttatccacctattcactcctttttcttcacagttaactccttaggggaaaaaatgtatagttcttgaccatgtgcttatgtttgtaaagcaatgatgtttccttaacgtgagtggttgtgacatagatcactgttatcttcataattacctgggagcttttcatccaagtgtggatttactaaaataattagtctgaattgatgcttattaaagagctgaactcttaaacgttaacactatcttgtatttattaaaattgtatgcatgtttccttcaaatgctgaaggcagaatactgagaactttgaccctgtgttattatcgctaagtagttgaaaattaggggaggagtcaagggagtatattatattggttatcactcaaatactacccctaggcatgatttttagaaccgaaacttgaatttttacataaagaattatctccaaaagtgtcttttttttttttttttttgagatggagt

SEQ ID NO: 101585 - DNA, 1098 bp, Homo sapiens
ccttactaactttgtattttttttcaggtagctttcctgagtttgatcttaggaattcttaaaatacagtagcatgtcttccagtttagttttcccacccatggaggtggtggcaggctgagttttgtttctttctgctctgaaagacctaggaaactagtgaattgagtaagcaccctgcaagtctggtatagtctatttcaatcaagttggcttctggtgtgcctttgatggcatcatcagtgagagttcttggtgttgatttctcttgctgcaataacaggtgtgatgtttctcagtagctggctggctcccgaggataccaggagaatactttattaatttaaaacactgcattctaagagttcttcaggaaagttatgtgtctatgggtagggttgtttttatgtggttatttcaaaataagagctatacaatcaggctttctgctggaatattggaatataatgtctgccatttaaacacattggttgcaaagctttaaagctttatttttgtttctaaagcattgatttaatgtgtgagctaacaattcgatcaagaaaatagatttttaagaaaacttctccagtgtccttattcttgagttcatggttatttaacagctcactctcttcgaatatctgttagtatggtatctttcattttttagggagggggcaactttaaaaaaaaacaccatagaataattatgatgaaagcattattgacacagtgagcatttttaataccttcaacctgtatataagcagcacaaatttagagtgatttcagatccgggttttgaagtaggtgtctgtttacaggaaatgcagcagaatcagagtacaatgacctctgaggaagtctcgtattcatgcagcatacatttttactatgtttgtggcactgttctagtttggaggatctggtgatgaataggacagacaccccccccccccaccccgccccccactccatgtggaaacaggaaaggaacaaacaaaatatgtcctatgcagaagatgaaaagggtgtaatgctggaacaggagcagcagtagtctcagtatttattcacccagagcctggatgtgct

SEQ ID NO: 101586 - DNA, 1612 bp, Homo sapiens
tctttgcagttgggttcagcgaggagcagttttctgtgttcaccagtgttgatagcagacaaaatcacacagaaacaaatacgaaaattgttttatgtccagaatgtccctctaatatgcacatgagtaacgttggatcaaatttatgttttcaaaataagtctcatagcagaactagctgtcgtttgattttgggattgagtcccatttccttccttccttatcaccattttgatttcttaatttgtattaaggtaagcccatatcagattgattttttttttttccatgcccggagcacctcaagagtagagacaccagcctgaggatcttaattttgctggagataatccacacacaggtagttttcttcttggtgaatatgtagattgagatctttattctatgccagccacagtgctggggctacagagatggataaggtataatccttgtctcaggagcttagagtctcattgaaaagtttttcaaaacacacatttgaatgattttgttgagtcaacattacgtatttgtttgtgaacacataagcgcacaccctttccccaccttcacttcctgtttccttgcaaatgcaaagacaagagtaaaggacttgcctagaggaaacacagaaatactgatttacaggtgaaaaatatgtaaatttgaaaaggtgttgaaaaagacctaagtttttgtagccacctgactaataaacacagagatcacatgtccaccatagatgggtaaatgaaaaaaagcaagtttcaggttaataggaatagtattatttcattatttgttagcccctatcccttgcacatgtgtgtatgtattgtttgtgtaaacatagatgatgtggaaagatctcccatattgttaatattagttatctcaggggacaaaggaaagcttattcctgtttatacatcttttattgtttggtttaagaagcatgttttacttttttaattaaaaaatctaataaagtaggaagtgaataaataatagtaataaaaagtatcttcaggccactgagcctgttgcagtcttcccagtagcgtgagtaattagtaccgtctgtaatgcttcaggtgtggactgcccagcaggactctgaacttcttgctacagcctaaggtgatactaagttttctgtagcaacactataatgttgagagttactgtgtttatagaccattaacacctcaaagtctttcttccatctgctcctcttggcacactgctctagataatcattttggaatgagtttagtcctttacgctctccctgttagatttcatattgttactgtggaaatcagtatttagcatgggtaagaactggccttagatgcaagccatctggttacagatcctcactaccactatcatgaaaacttggacaagtaacttgtctccccaagcctcagttttctcatctgcaaaacagcaataatcataaagttgtgaggtttcaatgagatgccatatgttagaacacttacactaggtacctggtgaaatagtgggaacatggtaaatattagacgttactgctagtgcattaacctcagctcatctctttcatccattggcatgttaatga

SEQ ID NO: 101587 - DNA, 2095 bp, Homo sapiens
caggctagccctttcccctctgtagcctgcagtttctccgtttgcaaaatgcggttggaccatatcatgtcatccaacactgggcataaacagcccatcccgttaagctgtacagttgactcccctttctggtgccttggcttgtctttgaaatgtgcgtttgctcccgtaggaagaagatggactgcggatgaggaagacagtgcagagcaacagccccatttcagcattagccccaactgggaaggaagaaggccttagcacccggctcttggctctggtggttttgttctttatcgttggtgtaattattgggaagattgccttgtagaggtagcatgcacaggatggtaaattggattggtggatccaccatatcatgggatttaaatttatcataaccatgtgtaaaaagaaattaatgtatgatgacatctcacaggtcttgcctttaaattacccctccctgcacacacatacacagatacacacacacaaatataatgtaacgatcttttagaaagttaaaaatgtatagtaactgattgagggggaaaagaatgatctttattaatgacaagggaaaccatgagtaatgccacaatggcatattgtaaatgtcattttaaacattggtaggccttggtacatgatgctggattacctctcttaaaatgacacccttcctcgcctgttggtgctggcccttggggagctggagcccagcatgctggggagtgcggtcagctccacacagtagtccccacgtggcccactcccggcccaggctgctttccgtgtcttcagttctgtccaagccatcagctccttgggactgatgaacagagtcagaagcccaaaggaattgcactgtggcagcatcagacgtactcgtcataagtgagaggcgtgtgttgactgattgacccagcgctttggaaataaatggcagtgctttgttcacttaaagggaccaagctaaatttgtattggttcatgtagtgaagtcaaactgttattcagagatgtttaatgcatatttaacttatttaatgtatttcatctcatgttttcttattgtcacaagagtacagttaatgctgcgtgctgctgaactctgttgggtgaactggtattgctgctggagggctgtgggctcctctgtctctggagagtctggtcatgtggaggtggggtttattgggatgctggagaagagctgccaggaagtgttttttctgggtcagtaaataacaactgtcatagggagggaaattctcagtagtgacagtcaactctaggttaccttttttaatgaagagtagtcagtcttctagattgttcttataccacctctcaaccattactcacacttccagcgcccaggtccaagtctgagcctgacctccccttggggacctagcctggagtcaggacaaatggatcgggctgcagagggttagaagcgagggcaccagcagttgtgggtggggagcaagggaagagagaaactcttcagcgaatccttctagtactagttgagagtttgactgtgaattaattttatgccataaaagaccaacccagttctgtttgactatgtagcatcttgaaaagaaaaattataataaagccccaaaattaagaattcttttgtcattttgtcacatttgctctatggggggaattattattttatcatttttattattttgccattggaaggttaactttaaaatgagccctatcactgagaaatacgtgtttcatgatttaactctgtgtgtgtgtgtgtgtgtgtgtgtgtgtgtgtgtgtattttttttttggttgtcttcagctgacagtatgaaaaatgaaactgctgaaaaagctgagcacctggtcacccttggccttccattgctttggccttcagtaaaaagcagcctcccttctaggtcagggaaccatgccattgagactagtaacgggcgttctgggcacagtcccactgtgcacaggtttgagaggacaagttcatcagaaggaaggcagtccttagaagtcacatacgttgagccacgttgctcctaagcctggctctgtcaagctg

SEQ ID NO: 101588 - DNA, 1058 bp, Homo sapiens
ggttggtctgagtaagtaacttcctgtcttcatgaaaaaagttgactttgaatcccaggtactcacagaaatggtgaacagacttagttgttacccaggcacccatggattgtgttgagtgtgcagacagggaggccaccccaataggaattcgtctccaggatttttcccatgtgtcccccagtacttataaaagggagtgaaaagaccgagctgtaaggcatgtgccttctgccacctgactttccgtgaggggactaaaatttactaattgtagttgctgcagccagttaagtcctgtagcttccaggccctcatgtctttgataggagagtgcttaggtggtccccaacagtgcctaggggtacagtacagtcccattacactagagcagggctctatttatttttaaaggatatggccgtgtgttttgataaaactttattcacaaaaacagccgggtcatgggatttggcttgtgagtctgtaacagttcttaaaaagaatatctgagaaactactctgttttagacctttgaaggtgatttagagttttgtgtacatctaggagaaggtgttcagcttctcagaggatgtggacattttggttgcagctaaaaatcagtctctgaagtctctctcccttctagaggttaggacttggtgaacatgtttgtgggccttttgactgagtggcagaaggaaactgctcaggaagagaaacaggtgactgatgggaaggttgattattttctcagtcatcctggcagccaaaaatgtgccaggaaaagaaagaatgtggagcacgcgtggctcctggaggacttggagatgcatgcacatttagggtgttttccctagaattacataatgaaaaaaagaataaggcaaagaggaggtgaatatggggcctgtcacaacggcctgccctgccccaagagggttaagagtcagataatcgggacgaaactggcatggaaagagcgagcctagggaggatgccgctgggcagtgtgcatgggggagctgctgccaggctgccctccagtctgctcctg

SEQ ID NO: 101589 - DNA, 1042 bp, Homo sapiens
gccaacgaccactcttctggaacaccaagagcagctctgagatcatgctggccctacgcgaattgagtttctgtggcctaattggatttggagaacgccttccctggccccttttcctcagacagatctgctctgataggaaccttttcaagaaagttactgttgtttcaatgccactccttacctgtatagaacatttccaatacattcgctcattgaacttaatccttgcaactgtgactggggggtagatggctctgtttgcatacgaagaaataaaggctccaggaggttaaatcgggcaactttttagaactaaatcagtctctgtaaggcctacattgctaagataccatttcagctctgaaaatctgcttcagggaagtgagtggatgaggccttcctgcctcagctactctgcccgtctgtacatcttttgtgtctgcctccgtaccttattcagttattttcacactaaagtaagtagaattaagactgtagttcagatgctttttctttttctgttggaaactgaacacactacagacagtgaaaaaaggtacatattccattttctcattgcctgaagatctctgctgatgctcctggagaatgactttgggggctttagaaagaatattgccagtccgtctcggcaaggagatgatgggagcgctttatatggaggctttacatgacttgtaaattaaatgtgaatgagggcagttgattaaaattggtattacagaagggccctgctgaggtttgaaaacagctgagctgctgatgtctcaggcctttccctgaattagcactgcggttctccaggatatcagcaaagagggcaagtaatagaagcccctgataaggagcgtcagccgacaggcaagcttgggaggctgtgggaatgggtctgcccccagcttcacagacctcttcctccagcctctgaatcccattagccacagcctagaacattagctgagctgcacaagctcacccacccctgtgccagggggccctgacctccctccatgccatg

SEQ ID NO: 101590 - DNA, 1489 bp, Homo sapiens
ctttcttttgtttttaagaaatagactgaattcagctgttaatcctctagtacagtatccatgttaaaatgtttttccattgcatcttttatgtgaattcaaaggtcagaatttattgtctgtgatattgagaccatgtgtacaagaactactttttgcttttcatcattcactccttagcaaacgtttcgtaagtaccctctgtctgtttgctactatatgaggtgctgcgaaattagtgggcgtggctttttatatttttcattcgtgtgtagcctaagtaaggtgactcaagatgatacaccgagagaaaaatgcaaaatatatttggttctcatttctgttgctgtcgtttcctttttaaagacgatttatcaactgctgccatttggaacttcctataagaaactaaaaatgatctatttcagtgttcctttcgcctttcctctgctttctgaataaatggtttcagtaacccatgctgttctctccctattctacgtctttctccctatgttgaaaaaagattcccacagtttctgatgtgtgtgtttatagtcttcaatgtatgttaacatgttaggaactgagtatcttaagagatgtcttagaatgctttagttttcataatttgtcctttatgtatttttcattgtatttgctgttttgacatggaagtaatttaaaaagttggtgcaggaaaggactctttactgttgcacattttggttttctgatatgtaataaattcatggcttggcagctgacatgatgtttcccagagagaaggagatgtatttctgcagggtccagaccaaaagagccatttacagcatgttctcccatgttccattatcagcctgatgaaacctgccctgccaaggcataaacttttgtactagctgtctccatattatgttcaataaattctgtgctctgaatatatttaaaggatgcttcagtgtaaaattattttgaatggatggcttaattccattgagataggctttggagtgtggactagagcccgttgctcgactctcactgctttgtaggaacatgaaattggtttaaattaaaatcagagaccttttgcaccagaaaacagatctaagagatcacttaggtcaacgtcttcattttactgatgaggaaacttttgcccagagagcttaagcacagggaccagcttgcatgtcagtgttttcctattgggggaagtgtgtgtcatcagtgatttacaaaggtacccacctgtgtaaattgcttccagctttgaaaggtgggtggattctgtcttttaagtagtggttgacagttctccatcttacagtgttaccttgttaaaacgttaatgaaaacaattttaacttcttttggaaaagtaaggtgggcaaatggtaagacttcacacaagaccaaggggtacacagtatacaaaatcaggtttcctccattcccaaacctttctttctccagagatatcctg

SEQ ID NO: 101591 - DNA, 1840 bp, Homo sapiens
ctcccgctccaactccccgcgcccaaaacttcagttcttggggagcccaaatttgcctgccgcgcaacttccactctaattcagcgaccaagggccctggcagcggtttgcagcctgggggccacgctccccaggctcaggcctgctcgttggcctgctcctagtgcctggacccagttgggggaggcgaaacagggcgcccgaggagcaccccgggagagggcggagcactcccgtgccccggggcaggagtgcagggagctcccgcgcccggaacgttgcgagcaaggcttgcgagcgtcgcaggggggcactcgcgagggacggacaggaagagggccaggggggaacgccagaacccgggaccacagcacggaaacggtccggggctgagctgcagtcagatccggggatggagggagccggagaagaggagtgagaaggccggggaggcaggccctgctgtcttcctgcaggccggcagcctgctggcagtggaggaccaggccgtccaggaaaggaaggggtcaggaggtcgggcagggcctcagcaggttcagacaagtccccagaagggagctgcaggcgccctcgagtccaggccccaagcctggctccggttgtccaaagagggcctaggccaggcctctggtgcggaaactgagtcacagccagacctcagggcacggcctagacgcttacgagccaaagttaggggtagagagcagagacctccggggggtctcagggagtagggggcttcagggcctcccagtctagagccggattggcgagttagacgcttgtagatccaaggttggattggggtggggtctctgggacgttggatcgctacgcaaggattggggggattcaagtgcttagagatcgaagtctgccctgggtagggggagtcagacaattggaaagcctaggtagttatttggggaggggtctctacgccttggcgaagcgcacagctgcatctttttggcttgaggcctgaggccttgtcgagaagcttccgtgaaagggtgggccagccgggccacgagaaagaaagtgaataaatcaggaatataagtgggcggggggcccctgagaggggggtcgcaaagggtgagacatggccaccaggcgtttaaccgacgctttcttgttgttgcggaataattccatccaaaaccggcagctgttagccgagcaagtgagtagtcacatcacctccagccctctgcattcacgtagcattgctgcggtgagtctcctggcggcctctccgacacacggaccgtgtgcactgcggctctgcctgtttgtctgtctctgtctgtctctctgtttaaaaagagaagataagaataataagactaagaataataagatctcttggctagagtcagggggcatctgtagccctggatgaggaagaagcggtgctgtgaggccgcagctccacctctgcccggtcttctcctcacttccgcagcacccccccccccgcaccccccgccttggcgtcactgcgctacaggccgcctgtaatttacatatgttttaacgctaacattgggaagcattgggcctttctgaagcctttttgtttcgttttgtttgaagctcccctccccccagtaatgagcctcagtttggtcctaagggctgggtcgccggatcgtagacccaaatccttgcaaaatgaacgactccctcccctcaaagaggagggagttgtgttgttgttttgttttgttttgtttttccgcccgttttcttttaacggccccgcagccctctgtgtggccttgttccctgtgaataattgcctcactgttcttcc

SEQ ID NO: 101592 - DNA, 1268 bp, Homo sapiens
ctccattcgaactttttaaaaaaagcctgaggaggtatatgtgaaaattaaccccgtaaaatagcactttttttttttaattaaccacaacctttagttagcctagcagtagcgttttttaagggtggtcctggaaaaattactgtttggggtttgtttttaatgggggctacttttccctttctgagcctcagtttactgctctgttaaataaggggcgagtctggatgatctataccagacagtgatcgttagctctgtaatgtcttcaattgaaaagtgaagttatgaaactggctgtagttcaggctacctgctgtaggcagactaggttggaatagaagcagcgttggaacaggcgggaaatagccatcccaggaccacattcttgggggttatacttgatattaggcaattttggaacattcatttcacctcttagggactgtattgccagtttatttttttctttatggctttatctaaatgcttcaggaaaattttgccatatgtcatgattatcatgtctacaaagacagtttctcctttttgtaagtcacaggtggagaatgtctttggccatataactgatagaaaagtcattttaagccgtgtgagcggtttcaggaataaaagcatgtaaactcaggtcaaacagcctagaactagggacagagtgtgtgtgagatttcagttaattaagaagttgaagggttttttttacatttataaacggaaaggaattacattatattgaaataaatgtaaagatgtctggtagcatagaaacaggctaattctagcgctaattttgaagaagaaataatccaagaaatcgagtagaaattggatgaattcaattccttaatggaacttcagtaatgttaaataagaactgcatgttccttaaatgacttgattttgtgctgcctcaaaaactactgaaactcatattaagatttctaaggtatcagttttaattgaaaaacatattgtttatttttcaatttttaatcattaaggttcaaaataccctgaacctttgggtaacatgagggtttttttttttttcccgattaagtcagacagtttaaaaacctagtatctgagacgggaagctttttaaaagtgcatctctgaatcagaccactttagaaaattattttctaagttaggcaattttaaaaaatatttaagctaagcagaataattaaaaatggatagttaacgtatacagtttggaaaaatagatatgtcagggtatatac

SEQ ID NO: 101593 - DNA, 1268 bp, Homo sapiens; identical to SEQ ID NO: 101592

SEQ ID NO: 101594 - DNA, 1268 bp, Homo sapiens; identical to SEQ ID NO: 101592

SEQ ID NO: 101595 - DNA, 3123 bp, Homo sapiens
atctttctcagatcattgaaagcagtcatatcatttaaaatatccttatagtcaatccatactatctcaaaaataggttttgcagtctaacaaacatagtttgcctgaattcaaatttaaaaataaaacacagatttatatattttaattgtgttaaaaaatggcatgtcataaatttctgaagtatttagggttgaagtgttacatcttcactttgcttacaggtgattcgtaacaaaatctattctgcacacagtacggcgaaatgctaacaagactaaatagaggttatgattttttcaacttttctggaagttggaaaagctttataaacattttgaagcaaaagccatgtttaacacaatttgtaaaatctattgagtaactcttagcaatgcttttcactgcatatctagctcacaaaaaatttaaagccttgtttctgacttgtaaatttcaaagccatgtagcaaaccaaacaaaatcgtatctgtcaaattttgaatatggactaggtattaggtgacattaaggaattaattataatacattacatttgctaattttattagagatgcctactgaaatgtttagtggtgaaatgtcaaggcatcttacctaagtccttaaacccctccaaaaatagaggaagcaaataaggcaaattgttactcattgttaagtctagtgatgagtatgtgtgcgacattttaccattttgtaggcttttctgcatgtttgaaaatttttaaatagaaacttaaagtaagtatatttgttatagtaaagtaaaacagttaaaaagaggcaatttgtaaatacatgtctaacactcaggcaatttgaaaggaagaaattaaacctaagtttaacttaatttaaaaaataataacctggaattttaagtttccaattagaagaaaaagctgtagactttgatcttgatgcatttgataccaactaaaaatacacctaaaataacagactttttaaaaaaaaaattgtaatcctgaattttgacatcttatttcaggaaaaagctgcagaaattaattgcagagtagtgtgtatcatacacctcaaagcaaagcacacctaaagccatgccattcaaaaaatttaaacatgcattttttgcatcctagtttgagggaaaaaactagaatttggttgttgtagtggggttattgtgtgtccctgtgcgtgcatacagggttttgcagcattcaggcaaatatgtcaaataaacaggaatttaaggaggatacgcagtgaccagataaacacaaagcctcaagggccagaaggaacctaaaggtcatttggcctaatgtccccatttgtgataacccctcatgcctatcttatttggccatggtgtatgacaatgatggaaaatgccagcagctccatgatttttaccactaaaaagtctttgcctgttaatcccaactatttgtgtcctggggtcctgcttttagttctgttccttcgggtcttccttctgtctggtaaccctgcagccttgttacccagaattctttccaggcctagcattcccggctcagagtggttatgcttttttcctataaatgatgtttagtttttctgtatcctttttagatttcagcatccagaactgagcaaaattctacttttttgtgttcttagttgtattaaagttagtaaaactaattgtaaaaaaacagacaggtttgactttatgcactcctaacaaaatacagtcgtatttcccatgcattttactttggcctcagttttgagtgccccatcacgttcatgcctcagggcagcatgaaataaaggaaagagcactgagaattgaatctgagaattgaggcctaagtcctgttctgctgcaggctcagagtgtgtccttaggcaagcctttaatcttttcggacattttttgcctcatttgtaaactgaggggtttgggttaggtgatttccagcagccctatcgattcaacagtattttctcaagttctgttttaatacattgtttctcctgactttagctttaatttgaaaaggagaaattcatagtcaacagtgttgtagctgtcagtccaaggttactgacagaaatccttagaagtagccccagtactgtgcaaaagtaactttcacattattatgccagccaagtgcaggttttaaggtagcaactcattcaagcagcttggctttaggaaactgaaatggatttatgaagctaaacaattattcaaaacaaattgtaaagtcataaagaaatgaatgaaaggtagatattgagatgctcttctgatctgatgaaattctgtatggatttgtgtggtttccttcgatctccgggaatggatctaatataggggttggagctactttgttagtgtttactgcctaatctatactctgctttaaaataatgcataatctataattggaagctagcgttaattggtcttagattagtttgaaacataagcacattatttttaataaaatgtgtgctttaggaaaaaggaaattaaggattaactatggttataagaaacctgaggtccttattcaggcttgactacaatattagctaagatttatggagagtttactttgtgcctggctctgggctaagccctttccgtgtgtaagctcagctcatcttcacagtgctctatcaaataagtactattgtttttctcagatacagataaggaaacagattttagaggaggtaggaaactggcccagtgtcacccacctgatggctgggggctgtgattggaactctggcaaatctggcttcagagccccgtgctcacctcctgggccactctggtgttggctgcattttcagaacttgtgctgcagatcctggaaaatggaaggacctattgttttaaaacaattttttttcttgcaataggctagcatctttctttatctcactttatgaaccttacatagtcaattttaacttgcagattgaagattctaagttttagtacaagctgagtctgttggaaaattagttctctgtctttagaatccaagtatgaaatcattatatatttctctttagatctacttgcttttctgcttttaaagattccat

SEQ ID NO: 101596 - DNA, 3123 bp, Homo sapiens; identical to SEQ ID NO: 101595

SEQ ID NO: 101597 - DNA, 3123 bp, Homo sapiens; identical to SEQ ID NO: 101595

SEQ ID NO: 101598 - DNA, 1661 bp, Homo sapiens
gaaaagacttatttctagccctagaatcccatgattctgatttcacctcttatcaactaataattgtagaaatcagaagatcagggtgtgtgtgctcggttaataatccaagagcataggcacatgtgcagcagagattttaaccgaggtttgcaatagtacatcgttcaaagattaaatgccagggagccgctgcagaataggaagaagactgagatactcaagttagggattttgtcttgcatcatgttttattaataaaagattttaatgttctcttaatgttaagcttttaaaaaataaaaacattttttctttgtaaagtaaaaggtaattaaatcagctttccatttgatttattaatatcgtctagtactactattatggcagggtgtgtatagagttcttttttgctctcatagaaaattgtggaaggaatgaagaggatttgcagcttttcataatgtcatctaattgaatttttacgtggagtaaagtttgattacatttttattgctatcattgtttaataatattttgaccctgatagagcagcttcatttgcactatttttaaataagaaagttatgttttattttctaaatttactgctaaacataaaaaaacacaattgattattgaatttcaccactaattatttcagtgatcaatactgtacaaaaaaaagacctagttgtttagattatctgtcattagtaaatgtctgtccagaagatagagttccatgttgatctaaaaaagaacctttacttttcaattgaaacttaaccctctggtgtcatgcttctcccttccccctccccttaaaagaaaaaaattattcttaccttttgttttgtctcgtttgcttgcttttataagagccttatgaataactgtatgctttctagctaataataatacataccaagagatggtaagagtttttcttttattttgccacctgtgtctctctccgggaaagagtggtttctcagctctcttactaccagggatgaagccgtgtctgcgggatgtaatttgcagagaccttacatatgtggtcactcacatgttatctgaatacagctacagacaatttttgtgggtcatttattttttaattttgttgcatttgcaggtctgatttacatgttaaaatatacatttatttaacatgataaaattacattttagctctgctctcttattttattttcctgagggaaaatagaatgtggtattgtatgtgatatttggtgtttatgaaacagattaacagcatattttagtgaaaccaaagcaagtgtgttttatctgtttccagtgtattttaatatttacagtcattttttgcttgtttcctagctcattttcaaaacaaccacagtaaataaaaattaaagcatatattgatgtagcttaatttaaaaaaaaaaaaggagattttaaaatgccttgcttagtggatctttatatttagtcagcttaaaatctcagtgttttctcaactgaccatgccttgtctgtctgtctgtcccatgctgctttctttgtgctttccccaactggatgggactgatggggacaacatgtctcttcaggagctggacgaggtattgtgttttgaatatttttatatgttgggtaatttgagttta

SEQ ID NO: 101599 - DNA, 2805 bp, Homo sapiens
ggccctggagagggcttgggggcttggagagcaggcgttctgagttaaaatagatgttgctactggctgaacagtttgaagatatggagcttatgacctcaaaaggaagtgtataggatgcgagggagggtaacaaattatggaaccacttaggttgaagaaccatttgaataatgttccaaggaggggcacataagtggtcataattacttcggggtctgctgtctgaaccgatttccagtctttcctacttcctttttcaggcagcaagttccagaaactggctactcactgcatgaacttggcaggcccttttgcttttcttatgtttcacctctaagggcttaaaagggagtcttcacgctctgtgatcagaggccctgcgtagagagcactatctcctccacgctcaccccagtgctattagaaatgcaggttgctgcctcatcgtgggtgcccacggccacctcatttccttgtgcgtttcacttgcctcttttgctcttttgtgcagtgccgttatctttttcatgaagtgtggcttccacaattgtctgtgacgtacattttatttacctcgtgcattcattccactcgtttcttgtcggatcactcagctggttgtgattgtgcgttcaggactctgaagtgccaggtactggcctaggagcagggggtgtggttggggacagtgtccagaggcttctttgaagctgacgcagggcctcacattggcatctctggaaatagtgaacacccagctccagagtggattagatgttagccacccctttataggggaggcctgagcaaatgtccctgagtgaatatcacttgcatctcccagagtaaaggcatctgacggcctcacttcagaggcttcctgcagtctgtccatgtttgattgtcattctcctcctctagcctgagtaccctggagatgtcacttttccttctcagaaaacactaagtaaggtgttccctgaggaggacccgagcccaccattggttctcttacccagggaagtgtctggccctctcctttgttctctgtctttaatctacttcctgtcttatgacaaagaaatctctgggagtttttaaactcaagaattattttaaaagtcacaagataacaaatgtcaagcccccaaaccacactgcctggaggactgcacatctgggagtgcctgggccgggccccagtgtccatgttggtgaaatagggagcggcgctcctctgaaggattgttcttgggactggcatgggccaggtcagtagcagtgctcagtacagtgctcacagaaggcagggagggacggattgctcccctcctttttcttcccctcagagtatgtatgttagttgagaaaaaaggaaaatcagtgaaacttaacaacagtatcagggtgatgtgattctcaagtgtttttatctctatattttttgtatcatttatttttatttttttgagacagagtctcactctgttgcccaggctagagtgcagtggcgcgatctcggctcactgcaacctctgcctccccagttcaagcgattctcctgcctcagcctcctgagtagctgggactacaggtgcgtgccaccatgcgtggctattttatttatttatttatttttgtattttttagtagagacggagttttgacatgttgctcaggctggtctcgaactcctgagctcaagtgatccgcctgccttggcctcccaagtgctaggattacaggcgtgagccactgcgtcatcctatgccattttaaaagtatttattttgaccatttactaatttcataattagaaaaggtaagcattattttaaaattattacgggtttagaaaaatgtagtgctgacatcacttttttcttttatccacatgcttattcacttctccaacaactcggatttcttaagcctaattgtctattagcgaagtagtctgacttcatcatacaggctcccagagtttcacgtggaagtgtgagttgccagtctgttgattttcagtgtcccttctgggctttccaagtgttcattgccatagacagtccagaattatcggtattgttctcattaccaatgcgttacggctaaacttagttgatttttttagatggggaggaggtgtagctgacttttccaatctccacagaggctttgctatttctgtaatcttagtctacactaaatcagccttcagggaaaggcagggtttttaagagtaggagggccatagatttggaacagcaagatttataagagagaatgtgtatgttctttccatagatggagaacttgtccatactggctggtactctttaaatggacaaatgtcaacatttgaagtggatcaaaggcaaaagatacctttagtgagactggcaggaaagccattgggtgtgctgttttgaacatctgttggattttttctgcatttctctcaggaaggatggctctaggttagggtagcggaccccagtagttcttggagagaggaactacatatcaaagaggcaagaattcttaattctcttaagtacaatttttatttaaaaaatatggatttttttttttttacttcagaagcacaaatttatttatttatttatgtattgagatggagtctcgctctgtcttaataaaaggctggagcacattggcacgatcttggctcactgcaacttctgccttccgggttcaagtgattctcctgcctcagcttcccgagtagctgggattacaggtgcatgccaccatgcccggctaatttttgtattttcagta

SEQ ID NO: 101600 - DNA, 2805 bp, Homo sapiens; identical to SEQ ID NO: 101599

SEQ ID NO: 101601 - DNA, 2805 bp, Homo sapiens; identical to SEQ ID NO: 101599

SEQ ID NO: 101602 - DNA, 1736 bp, Homo sapiens
cgagctgggcctgtggtttgtccccctgctttttagtcagtgtgtcctccacagagttgtgtacctcttggtgactttggagcaggagtgttgaggaataaacaagtctgcctctgagtgcttggcacaggccctctctgtgcctgctctgtagagggtgaggtctgcgcctctctgtccacggatggtcagtaagagaggatgatctttactgacactaacgtcactcactggcggcctgtcctatagtgcctggtgtagttggtgggaaatgaatcaaactactgtgttttgttgttttaatctgatggcttgtcttgattcattttcttagcaaattgcagttatagtttatgggcctgtggagtgattggcacctttgagggtggaaggggtttctggagtcagccgacccaggtttcagtctgtcacataatggctctgtgaccttgggcaagcgacttaacttttctgagtttcaatttccatatttataggttagaataatagtttctaactcacctagtttttatgaggattaaaataatgtcaagaatgtaaaattcctattgatgaactcttgaaaccaaacagaaggtagtggtggtggagaattaccacttcacggcccgggagccccagacagtgcgggtttggatgacacaccatttgtttaagaaatgacactggccctgcagcatccgtgccacgcttgagcaccgttgggcttaatcacggctcctggacgtgctgggattagtgaatggggcctagtccttccagcgtggtcattgcctaagatgcgttccctgagtggacacgtgccccagagcacacagaaagcctgaagcagatggtggcagaaccactccagggcatgcagggaggttgatggtgaagataccaatttgcttttaagaattttactgtgaactctttaggatttagggcctattacttgaagtggtcttttattctaagtttttctttatatgatatttttcccccttcatctgtggattttaaaattttgtcttgttcctttattattagaaaagcaaataagtatttaatgaatgaaaaaataaatttagttaaatgcaaggaagagggaagaaaagcaatatgaatttttcacccaactctacagtgtgatttagaaaatttccaaagtattatctataaagggcttttatagattattttccattatattttgatcatcatttggatcttttgaaactggcatttaaaaattctgagctctggagggcacctcaaaatcttttcaacccattcactgcctgcaggcaagaaaacagcttaaccgtgccaaacccatgatttccctctgttttttgtgtgtgtgtgtgttttttttttttttttttttttgagacagagtttcgctcttgttgccctggctggagtgcaatggtacgatcatggctcactgcgaccttcgcctcttgggttcaagggattctcctgcctcagcctcccgagtagctgggattacaggcataagccaccatgcccagttaatttttgtatttttagtagagaacggttttcaccattttggccaggctactctcgaactcctgacctcagatgatctgcccgccttggcctcccaaagttctgggattacaggcgtgagccaccgcgcccagccgatttccctcccattcttaaaagctttctaccgcagtgtgttatatagttaaaataaa

SEQ ID NO: 101603 - DNA, 1736 bp, Homo sapiens; identical to SEQ ID NO: 101602

SEQ ID NO: 101604 - DNA, 1736 bp, Homo sapiens; identical to SEQ ID NO: 101602

SEQ ID NO: 101605 - DNA, 1059 bp, Homo sapiens
attttgtagttgtttcatttactgcctagttttttttttcacttgcaactgatcacaagaatcattgaggttcatgccgttctatcacagtactagtagtaagaggtctttattttaaggatcttttgttgactttttcattacatttctatagccagatcaagtcaaatttacgttctgaagtatgtccaaggaaattaagagctggtgcatgaaaagataggaaaacaatccaaatcctagcagttatcaaaagcaagtttataatacaggcaagtgcattcactcctttctatatattttcagggagcaacatttaagagagagtaaacattcactcctttctgtatcttttcagggagtaacatttaagagagagtaagagtatttgtatctaaattggattagaataatttttttcatgtccctttactttcctgtagcttgctgatgaccgtatggcactggtgtcaggcatcagcttagatccagaagcagcgattggtgtgacaaaacggccacctcctaagtgggtggatggagtggatgaagtaagttccatgttagtttcatagcatcttgtttttttaagtaattatgacaatgtattttaagatatctgtcatataaacgaatttggctacacttgaatgtatatttctagaaatactttagctttaggttaagttgtctatgtgtgtgttaatgattttagctgtagttttaacattggtagtaactacctgaattataggaagaaattgaaaccccatgcaacaaggaagaatgtgattttctggtaatttgaattaaaagctgctcacacatcagcaagccaacaagtttgctgaagaccgaattctgtatgctgagtgtagctgatggaggcagaccatagcctgcctggcatcagtggagttctgtgacttcatttgcttagattcagtatgatgttggccggattaagcagaagatgaaagaattggccagccttcatgacaagcatttaaacagacccaccctggatgacagcagcgaagaggaacatgccattgagat

SEQ ID NO: 101606 - DNA, 1024 bp, Homo sapiens
tgccctgagcctcgggcttgttctcttagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacagtcaggctacctcaaacgtgagtgctgcccgggcctagtgaagggattttgagtaagaaaagcactttatgttttcttttttgccactattttttcatttagtccagtacctttcattgttagcttttgaacatgctcataccttgtacagtaaagggaagcctcctccccatgtgaaaccctggcttggaatgaaggcacagcgtggggtaccgaccaaggctgggggagggcaccaagatagttcagcatctcagcaaacaaaatttgttttgtgtcaagctgcaagaatttgaaaatcaaccaagcacattttaaaaacctgttgttttctggatgttggggtttgggagagctgctcttcaataggtaaaaagcagttgttattactgaaagccacatatttgcataacaaccaaagtgtttgagagcacctgagaaaacctccccagggtccttgaaacacttcctctgctggcaccacaggtttcacccagcagaccttttcttcccaaatagtgcaaagccagatttcagctctcttctcattctaatcaccctgtaaactgggttttttaaaattgcccttgcaatcaataaagtccccacatactccaaaaaacctagttctccctccctctgacaactggcatatttgtattttaattttattatttccaaaatttgattagggccatatggaattcatactagagatgcttctagagagaaatactgattttttaaaatgttttgtaacagcagttagattaaatatttctgcttcacttagagattctcagatggttgtgtcatttttatcttggcatcaagtgaattgtgcacatt

SEQ ID NO: 101607 - DNA, 1085 bp, Homo sapiens
ggccccaggaagtccgaatatggcatttctatggcagctgaaaccaataaggaaacctcagtctgtcagtacttctttctcgtgagctagatgtgatggcactaaccagcattctgccatcgagctcctgacactgcttgagggtgaactccagagccctccgtgtgtacctgcagcacacagggaaggaaaacatcatcttatggatgatgatgtctgtaatttgcatatctcatttttgacgttcagttttcccagttgctattgttgattgtctgtaactgtcatttattacctagggtacagtccttgacagaattgactataacgttgaacagtcctgtatcaaaactgaagatggtttgaaacagcttcacaaggtaatatgtctttcaagacttgggaatcttaggaactattttcaaataatcaagaattggtaagagggttcttttccaccataacgatcttcagcattcttgtgttgtccactctcaatacagtagtgtaaaaagggattcatcatttcatttaaagccaattgtgggggctgttgccgttttattgcagttaatgattccaggtgtatctcacacttaaatccaaaattgctaagaactcctttttgtgacagtaaattctaaagagattggagttctttcttttagaaaatatttcattcttttctaatgcttcttgttttaggaaatcaattgggcatttgctaaaatatgtgttgaaaatctgtctgcttgttgccgttgacttgggcctctcttgtgatacattcctgatgaattgctgatggagaatcattctgcagaagataaaaatctaatcttctctttaattaccacagcatatctgtattaccttgagaaaagagaagtttgttgaagtgagagtagtaattcttttattctgtgctaataaggtagctgtttcagggatgtttttatgatattctcttttaaaaaaatagatggaaagcatcttaggaatcttatcggttataagaaacatgcataaacggctgagactctcatatataattggttacgtattttctttaaaaggaatataac

SEQ ID NO: 101608 - DNA, 2318 bp, Homo sapiens
tcatggggctcttccactcctggtgattgaattccgtgggattgattggagggattacaatcatgtagcctgtagcagagacctcagtcactgtgcagagagatctggaagcctcattctggaaacgagtgggacttgatttgggattttggggaaaatgacggccttttttccctcctctttttgtaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccatctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaagtgaccctttaagagaggatcatctttttttatatttattttcaccaaatagggtgatgagggttggtttttgtt

SEQ ID NO: 101609 - DNA, 1023 bp, Homo sapiens
tccgtctcaaaaaaaaaaaaaaaaaattgttttagcgctgggtttcccaaggtgggagagacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaacatcctgcaatcctagtattaattttaacaatgggttcatgttttcttccagtgcatttgtgttaggggagggcttggccagttttgtgatcctctgggcccctgactctgttttgtgcctgaggcctttgcctcagtgtccgaaagtagatctat

SEQ ID NO: 101610 - DNA, 1030 bp, Homo sapiens
agcagagacttttagcacgtatgaaagtgcttctgatttaggactcggagttagatggtgggtgtcagctgcgtgtgtcttgtccccaactccatgccaccctcgggcagacgtcatggtaccagtctatggccaggctttcttactacacaaagagacattccatggagtcaaatggcagagacttgtgtacaattatctggtcagttgaggcaaaagaaaataatcatttgtccaattgtccaaattagctctgtggattgtcctgaatgctcggggtaactgtgtggttctccacttcagttccgtaacctggctaagatggaccatttaaatgaggctccattcaacacaatgcacatttaaatgaggctcagttgcaagagaccactgggcttagcgttttcaatttgtcaactataattctataattgcttttagctaatcatccaaatgattacatgttgtaatggaggcagaagaccctcgtatgcatcatttggtctctttttctcagaggaagtgctgaaggatcaaatgttttgtgtgtctctgtgtgtgtgtgtgtgtgtgtgtgtccgtgttttaacttggtgttctgacgcacaacaccataatagacctccattttcatcaacggtgggggaatgagaacaacgccccccatcccaacatcccccttttccagagggggaaactgagacccaagtttccctcttgccaaggccacaggactagaactagaatcgtcagttttctgatttccagatcaggactatttctgcttatgccattttaatttttcatttctttccataaaattaaatgaccttcttcaagaaagatttaatggtcaagatgcgatttggtaaaaagcttcctcaaggatttttttcttattacaaagatgagactggctgaggctgagagatttgcaagcagtggtatgtcattatccccagctcagttttttgtgtaattggtgtgaagagattgctgctgatgaatcagcctgctgctcaacagaaaa

SEQ ID NO: 101611 - DNA, 1030 bp, Homo sapiens
cctgtggcctcatcctcttctgtagcagggactgggactgtgtactgtgagtctctgctgagcttgactcccttggacgtctctgaattctcagagtcttgcacgatgcctggcacatgtggacagaatgagtggtcctcctctcatggtaagggacacccttccccagtgcagcatggctgtgtgttggtggagggcacccgcagccctgccctccctcccacaggagcgctcttgcgtcagagccccgagctcgccgtggtctggggtcttccaggtgacacctggcctccttggaggcaagtcacacagcattgacgcacttctcagacagtccttgtcgagtccccacatgccctcacagacagagaacccgctgacaggcggcagggacggctcaggcacattcatatcagagctgtcaaggtccaggtttctacctttgaggctttggggtttaattacctcggcagggcgggggaggtggccaggctgcagtatcgacccggcgcctgctgccctgacattatgagactagaggcagggatgataaacttgctgctgtcctgcacccccgcaaaacagcgctgctcttctcttaatattgtctttctggtgagcaagggaggccgtgcaagcagccagctgtctgaagcttctgtgcctggggatgcacagtggggaacagggtggggaaggggtgcccgcagattcagctgagagagagtgaagctcccagggcagatgtgagacacacatgagaaggcaaagaatggcccaagccagggctgaaggacacatttttgggacccacgtgatgtgtgctttggtgcatgtgcccctctctgccctgccttcgagtgtgggctctgaagccctgccaggccagcagggcccatgttttcagttcctgggtggacacgtcagttccatgaggcgagacctccctctgtgtccttcccctccgtgcccagaaccgtgctgtgtcaagtgacagcactagggcagccagacccccatctgtcttgca

SEQ ID NO: 101612 - DNA, 1030 bp, Homo sapiens; identical to SEQ ID NO: 101611

SEQ ID NO: 101613 - DNA, 1030 bp, Homo sapiens; identical to SEQ ID NO: 101611

SEQ ID NO: 101614 - DNA, 1014 bp, Homo sapiens
ggatgtgactgattttggcgaagagttcacatcaaccctcaccatcattcaaggttgtgatgaggggcagagaatgctgagcctaagtctcgttaggtggtaaagccctctaagtgccagggagaggaagctaggccctgttctggggggcgacaggtggccagggcaggtttgcattgcggcagcagcccctcaggcttcctccctgccataagcacactaggaatctgcaatgggtgcaggaagcacgcaagcccacccaggtccctgaggtgctggccagggacctccagcaagccccagaggctccctggacctcagcttccttctcacgctgtgcggaggagtggagagagtggccctgcagacagacccccaggcggcgtggcagcccgggactgaggtcagggtgcccggcgtcaaagcacggggtccctgtttcaatgtcagagcccggccacagcgaattctgcagctccgggcatctcctcgggttccccctccgtgcagttactgtttgataaccccaaagttctgtcaaaacaaaagggagcctcaccatctatggccatgactccctgttgcttctggagaacaccccacttggccaatatgaggttcatgagttctgtgggtgcccaggaggcctggtgtgggggctgcccaggcctgagagctggggaaggtggggctagcgtggggccgggtgggggtggggggcttccgctgccaggcctggacctcacagctcacctttgtcctggtccctttgtaccacccgcagactaccatgccggggatgaagcgagactgcgggggtgctgcggccgtcctgggggccttcagagccgcaatcaagcaggtgagtgggccctgcccgccctctgcaggggcatcctgggtgtgcctcgtgggtgctcccctctcccctgtccgtcccgccacaggccccaccagggtcctacccgagtctccccagcggatgcttgtcccccctctgcccccaggctcttc

SEQ ID NO: 101615 - DNA, 3135 bp, Homo sapiens
ttcttgataggtgagaaagtgagccccacctgtgtggctcagcggtcagcacctaaggccgcatctccagttccacgacagaaacaccaggtcatgtgcatgggtggctggcgcacaccatcaacaccgtgaaggcatctctttgccattcctggtgcccccactggagcgggcgtctgaactctggagattgagaacctgggggctctggtggggcacagagtgcccaagcccctccccactagatggcacggccgcagaggcagtacggatgagcattcagcaccccttttctgggagggtcacctggggcggggtgcgaggacccctttgccctgggcacctgttggacctgagtccgggtcccagctgttctacctcacactgaggtcgtggtcacctgtgtgggtctgggttttttgtccgtgacaaaggttgggaccagaggtagatgggtttgcctgctctattgtttcatgatggaaacaatcctggttggttgcctggtttctgcttgggttcccattccttgccccggccctacaggatcagtggagcaccatagccctgcctcctttctctggccagccagagggcttcagaaaaggcttatctaagcctggcttcttgccctctgttcttgagggccctgaagaatttgactctggcagatggcttctctcagatcagacacaaaggccttggagattgggactccacacccatttcattgaaacctgctctccccccatcagaaaaagggccatgttttcaaaaccataactgcttctctcttaaatcaacaataaacaacagcctaaagattgcccgtgaaagtaagttccactgatggccgttctggccgttggaagcaagatatcaagttggagtgtgaccgcaggcgatcatgccgcaggtgagtgtgtgtgcgcctggtttcatttctgttgttaatcctttgccctgtttttctctttgtttttattccaaacctgtctgctcccaagggtccctgtctgcttccaagggtccctggaaccttctgcagctgtgcctctccagagctccgcctcattagtgccacgttcctggtttgaaaaccatagtacttcaacctcttctagatgggagttaacctttgccctctgaaagaaaggtttgataagcaaagagagtttggtgagcaagatccttgaggtaagagctgatctctgacgtccgctgggaactggctgctctgcaggtttctgtatcacattttctgcacatgtccattagaattggagatggggcgtatctagtgttgaataaaggcccggcaggccctcccagatgcaccctgtcagacagagcctactgtggattctttagaaatggcttgactcattcttggtggcgaccacaccacccacaggcacctaaaatgaaaggatttttgttagctggttaccaccaaaccacctcaggcaatacgtgggagactccaaaccagctgctgttaaaaaaaaaaaaaaggcagcagagcagtcatagaacagacccttcttactgctgcatacaagatgatcccatggaatgcaggcagccacagctttgtccacatgtgctctgtgtatctggggctgctaggctggttagatttgtggtcttcttcctcctgtggaggaccctagagagagccagcctgagccctcaccgttgttccttccccggcagcacttacagaatgatcctctaagacctcccctccagccctagctgggttcctaattttccagctatttaatatcttctttatgtctcagtgaatgttcccaggcagagtagccagacagactcatactgacagttctcaacagccagtcccatcctcctaaagatctccagaatcagccacatggacctgatgctagaggcctgtcagcactgggggacccgggagaagcagctcaggtcttcagcagaagcagggaggttctcccagtggttttccttgactgtgaggaactagcctgctgctttgctcaggagtgagctgccggctcccctttgatgtgctgcgtctgttcagaactaggcaggggtgcttcaccgtggcagcacttgagttaggcagtggttcatggactcttctcccagggccccacacaaaacactgttagcacagacctgccactcagatcaaggtggccagcagagccatcagagaatagccttcagaagatgaatggcaaggccagccggcagcacgtgaggccagggcagagacgcagtgaaccgttccatggcgccccgagcctgctgccaaggcctccttggagctgagatggaggcggggtggctgagaggcaagctggatgtgcatgtttgggaagagggctccgtagaaagtgctgtaggggccttggctggggaccacgtgagcccttgtgcggagagggcctgtgtctgtggatctggggtccaccacaggccactgagatgggacagggctgggaggattgaggagggaagatcctgagtgaaattgtgaaatcaggcccagcctcatgtgggaggtgaggagaaaggacccttccagagggccccccctcaatcctgttgtgcctaattcagagggttgggtggaggctctcctgaagggctctgaagagcgctgcacccgcagctgtgtgccaggagtggagacaggacagtcgatacaagaggggcccctgtcatgtcagctgctgagtcccctggggcggccgggcactggggaatggtgaactcgccgtgccgcgcctctgccacagtctcccgtgggtccccactgccgggagttttacctacctcccaccctcagccacgagcacctgcaggatgcggtgccatcctcgccggtgcccgctccccttccggaggctctctccaccctcactgacgcctcctcgggaaagcccccgctccttccccgacctcacagcatgccaggtctggggcttccgctggggggcttacctgttttccacccctgctagactgggagctccagggcaaggccgtagctgccttgcggattgttacgttgtccagcttgtctccacacgtgatacccagcaggtgcctaataaacttgtgtagaaagagtggtgg

SEQ ID NO: 101616 - DNA, 4907 bp, Homo sapiens
cttcacggtttttgccatattccaatactgaactgcacttcacacttctctctaagtcagctgtttttttatgtaaatacattggtttttaaaggaaaattatacaactgctattgaaagattaccagtatccctggcgtctggttaagtattttaaaaatactcatgaagacaagtgcatgctctggaaatggcagcgtggctgatgtccctccaggtgcagccctgagcacctccttgatcctgtccccatccacccagtctcttcattgacctgagaaatgctcatctggactctaggagagatggtgagagatggtcttctaggacacaaagatttcccaccaaaggggataaatgaggttttgctcccagtgtctggtcaggtgcctcttagctaaggagaggtaggaagagttctcattccaaccagcggaagcctgttgagtttcaacggggctaaattacttggggcacattttcttcccatgacatttgttgtctaataataagtcaacagatggagttgtcttgatctgcctttaccatgacatttgctcccacttcacgtgtttatgtttgcggacgcagccaagagacagtcggtagagctgtgtcccaagccccagcgagatgagcccgggcacttctcacttcctgctggcatgctctgaagcagtgttccagccagaaggcctctcacagaacccatccactcacctctgttctcactcccagcttttctggggattgggtgaggggagctgggtctgttctcccatagtgctctcagttcttgataggatgccagaaagtacaatgctctcttcatcaagttcaaaagcaggcaaaaccaagtaatgcatgcatgataaaatgtttacagcgagcatatgataaactcagcttctgcatttggtttcttctggcaggggagaccacaaggagtgggagaaggacattctgctagatgaagttcttggctgtgttctttctcgggttgggctgcatagggtcacaggggttgaatgatagtatttttaaatactaaattttaaaagtacgtattcggactgcctccatgggtcagtggcatgggacagctgaaaccaacccagggcatttgggggtgggcctgctgtgctatggcaaaaggaggttgttttgaggctgagctgctgctgaccagcatggtgggactttgctcacctttcttctttctatacaaattaagaaccctcagaagagttcttagcacatattaggccctcagtaaatatttgttgaacaatttttcacatgtgtatttttaaacttgttgttatggaaattttcaagcacaccaaggcagagaggaggccagcgcagctgcgctgcccgtcagcttctgctgctctggtttcctctgtcaccacaccttttcttctggagcccttcacagcaaatcccagaaatcatagtgtttcacccctggcagttttggacagtagactgggttcttctcttctggatttgtggctctgatccacctaacagttcgttcttcatgggttcttttaggatatgttgaagccgacctcttcctccccaaagagagcgtgtcaggaaaatgaagcctttctctgtatctccctgtgggggatttcctcgctgcataggtgtgtacttggctgcatgtttgtgctgggcattgtgctggacctatgtatcgatgatgagagaagaagcctgtggcctggggcctccatgcaaatgcaggctgatggcgcggttaggggagcagacccttgttcctgtgagcactaggagtgctctaaagcgaccactcatcttttgagccccctttcacgactcccaagttgatcattggtgatttcccccattgccaagtcagagtggacattttcagcagacagtaccccagcggactgcagctctgccccttctgacagaaggcacattgggaacgtgcagagcccacatccagggtgatggcagttgtcaccatccatgtggaaagacctggccccggccagctgctgggcctctttgcactgtattaatagcaaggccatggggcccactggggtcgggagacgggggggatggaggacagctgtggcggacatcaccgcatgctccaggcacgtgcgcccgtcacaggcatacagatggccacaccttgacctgcctctccaaagccccccaagcccctgccagccttctccttgtaggggcaggaactggctcgcactgatgacccatttgacaaaggagccaaattaagaatggcatgattggaatagagggttccagtggccccgtgttcagggtcagtttctgcttttattggacgcacaggcatgggggccgaatgaggcagtggtatttaaacagctggggatattaggttctatacgccaaggctggacagatatttttaaatgtcacaggccaaatggaagctcagttggcagcaggatggaggggcagggggatttggaggccactgcattgccgtggctagatatggccaggagagctgagtgggattaaggcttgggaagaagccagcctgggaagtgcccgtgaagagggagcagggaggatcatatgaggaaacagtaggcgccaggggtggcgggcaggcaagagcgcaggtgctggggccaggggcggacagaactgtgtgaaagcaccaaggacagggccagaggagccaggtcagagcccagccctaggtcgggaacacgtagggagcagagctggtggttcagggccctgttgtggcatcagagagatgtgagcgctaacctcagcaccctgctttccactccggggccttggggcgacttatttatctgccaaggcagtttcctgacttcagggaaggggccaggagagaattaagtaagaacaagcagcacctgacactcagaaaagtgtccctaaatgttcgccacctttattaatagtacaaattaatgggtgaccagcctccattgtgggatggagccggaagctgctctccaggcctgctctcacccagatacatggtatgtttcgaccacacaggagttcttttaaggatgaatgatgatgaccgccaacgtttaggtgtccgcagattttacagaagcctttggccatttgacttctcctggtctagtggagcctctagttttctggggcctgcctcttcctgtccatagacaaccgtagctggggtgcggccgccccctttcggccagcagcacacacacccctgtgcctgccaccacttgtgcctgtcactcatctctgagtggggcctggcctccttaggcatttgcacttgttctccctgcagtaaagtggagctattattatcttataagaaacaagggtcatcatcagaattgggcagggacccagcaactgagttctggccggggcctccttgcctttgctgtgacattggtctggaagacctgggctgatggatgagcattgaatggccgggtctggggagccatcatggctgcctgccttcctcctggtgggccccttagtaagctgagcagaaacacaaaatggctagggcagttaccatagccacttaacgtctgtgcatccctcggcctccctcattctcgtcgggatagggatgacttaggaaagccagaggaggcccaggctgctatgaaacctgggccttgcttttcagcacaaggatttcaagaggagaggaggtgagggaggaggggagtttctgttggggctgttgtgggcctcaggcggcccctgagttaatccgtattcgtattcagaattccctccttttccttagtgggtcagagttctctcttgctcatccaggcctcagagaagaatccatggtagttgtgaccacagctaggccttaactccttcagagccatgtacatgaaggctcagaagatcccctcatcttctgaagaagtgtgagtctcctcctgtaggcttccaagggacgctagggttagccatacttgcacagcctgccccacactcaggcttcttggcacagagaagcccttcctcttactgatttatggtgcctaccatgttctaggcattagagaaatgcattaatttactcttcatagcaaacatatgggaaaactgaggtacgcacaggtcagatagcttgcccaaggccacacagcaggaaaatcgtggagtccggatttgaactccagtggctggtcaggctccagaggtcgcctttcaaatgctgcctggaaaatgatggagctgatggaggagtccgaggtgatggctctggtgagtcaggagcctgccaagtcacaggagctggggaaagagcacactggacagaggggacagccagtggaagggccctgaggtgggaaagagctggccatgagctgtagggaagcaggaaaccagtctggctgcaggaagtgagcaggggccagggaaggagctggggtagctgaggaggcagcaccataagggcagcccacggccatggcactggggtctgattgcaagtgcagcgggaagccctgaggcttctgagcagggccctgctggcttgaaggtctccctgactaggagatgggattcttgtggcaagaagagagcggggagagcaggagctgagctgccccacattgggtagctggggtcttttcactgaaggggatctgatatggtttggctctgtgtccccacccagatctcatcttgaattgtaactctcacaattcccacgtgtcatgggaggaactgggtgggaggtgattgaagtatgggggtgggtctttcctgtgctgttctcatgatagcgagtctcatgagatctgatggttttaaaaaacgggagtttgcctgcgcaagcgctctctctctttgcctgctgc

SEQ ID NO: 101617 - DNA, 1208 bp, Homo sapiens
agtggggcggtggggccaggagctctgccatgttgagtggggtggtggggctaagagttctgcctttggtctgttgagaacaaggtgcctttaggctgcacgtgacaaggtatcaagacaaggtatcagacaggtagaaagatgttctaggtctcgggcacagtggaaaggctgtcatagaagcagaaaaagtctagtgctaagtgggagacaagagaggaacactccaaattgagtttccaaccaaagtcattatcaacaggagtcatcctggagctggatggcactggagagatcgagtctcagcccttttattttacaagtaaggaaactgaggcttagagaggtgggaccagctggttagtggtaaagccactcttagactgaatttttctagtcctagttctatccctcaattgtttactacaccaagcagagaatcttcccgtgaaggtggaacatgagccaagggctcagatgtcagcccccttgatatcagatctattttttgtcagcaaccaaatggacagttcacagcttcacattcttttcttgatcactttagaactgacattcctccagctccttattaaagaaagagcaaagcaagagctggctagaagtggtttggaaggtagaaatagactataccatgtctttagtaatcagcctggcaaagtccacatggcagccgggaagggtttggccaaggctaaagccagtaggacttggtggcactctctttttctcttggttgttccaaaagcaccagttattacttaaaattggcccctaaaataggagcattaaggtacaagaaagggaagttcatttttctcgagatcctttttcaagatgtctacactgtgactgataacatatcagcagcttctcccagccatgacttcttaactataatgtgtaactgcgcatgcaattatatgaattacatgtattatctaatagctttaaaatattcgataaagctaaggctaatgtctgctttgatgaccctgcaccagccacagttttcatacatcacctctcaaatcccccagaggttaccaacttcacaaataatgggtttccatagaggatgtcatcttgaaaaacacaaacatagtttcatgtgtttcattgggcttcacattgcagccttttcatctatctacatatcttggagaccctttcctgctgattcctgtagg

SEQ ID NO: 101618 - DNA, 8423 bp, Homo sapiens
tctttcctgcgctctcagttcacacaaccacttctctcctgcggggcagttcagggtgacacggaatcctcactggaggccccttacagccatttcctaggtaggtttttttttttttttttttttttttgagacagaatcttgctctgtcacccaagctggagtgcactgatgtgatcttgggtcactgcaacctctgcctcctggcttcaagagattctcctacctaagcctcctgagtagctgggattacaggcgtgcaccactacgctcggctaatttttgtagttttagtagagaggggtttcgccatattggccaggctggtttcaaactcctgacctcaagtgatccgcccgcctcggcctcccaaagtgctgggattacaggcgtgagccaccgcgcccggctcctagataggtttttaacaaaggtaactcagcaatactcattgggtgccttgcatgtgccaagctgtgttttaggtgctgaaggtagagtagtgaacaacaacaacaaaagtattgtattaaggaaaggatattttggattaatttgctgtgaatcaggagattgaatcagtcagaatccctctgtacccaccaacattgtttaatctagcttgaattccacatgagaaaatgattggatcagggctagggggcggtcagacaccactagatcgtgttgttgtactctgcaaggctgaagatttggagtaaatagtgccgctctttcttggccctagaaaatcaaatgatggcctacaggaggagatccctacagtgggagctaacctggctgctgcttttgaggtgtgcgtgtcttcagtctggccctccatgatgattatggggtgcctttttggccatagtgacaagtccaaaggcgaaacaactcagagcaaagccatcatcctaaaatccctgggagtatcaagaaggttgtttcacttaggacacatgtcatgggttgtggtccttttctccttcttgagtcagtatggggaatcttaaaaaaagaggctctaccactgggtggcccaccaggccctcctggtactggtacttctgcctggtgtctgaagagtcagtcaggtacccacagccattctcaccatgatggaacttaacctcacaccttcaacaccacacccgtattaaaaccactaagtgcagagttcataccccagtgagagaccagcaactgctttggatgtgttgaggttttcctttctgcatcttggctgtgtctagcttgtatcttgcactctgtgttagtttgtagcattaaaatagtgattgggctgggcatggtggctctcacctatgatcccagcactttgggaggccgaggcgggtgggtcacttgaggccaggagttcaagaccagcctgaccaacatggtgaaatcctgtctctactaaaaatacaaaaattagccaggcgtgttgacgcacgcttgtagttccagctactcgggtggctgagccacaagaattgcttgaacctgggaggttagtctgataaagtaggattgacttgtcaaaccccacaaaaggacaaatgtctatgttccagttgtgccctgctctaccacttttcctgtggaacagcaagggttttattatcacaggtgcctgcgtggctgtagtcactgtgtggatattatcatgggacactgggcaggggcatttagagctgtatatttcaaatcctcatctccgcttctgagtcccaactaatggggcacgtttccagagagtctgcctacactgacccacccactttatttcttctaattagcacagctccatcgacagcatatggaacagaaatatattattcaagctgatttcagggcacgttgggggaaaaatcaggaatatatgggtgctagtaaatgccctttgaatggaaactaatgtcagctgtcagcaacgaggtagattatgattctttagtgtacataagaaagtacttcattcttcagatggagtgcttttatgcctataaaggagatggcagcccagagctgattcactaatatagatacaccgagattgcctgcattattaaaaaatgtgcattacataatacatatatttggactagattctgcattagcaatgcgctttctttgcaagatgcattttaatcagcaaacacacatttaacaaaagactgcatttttgagccccagtcctgtgtagttataaatacatctcagtgtacattcaccacaggctctgggaggaaggagtgggggactgcactgagatgccattccatctcacacttagtgccgaggtcgagcaaatggagccgtacagcagatgctctttaaaatgcattacgtgcgtgactttaaaaagtgctcgctgcagagtgaatttcaaaaaggagcaagtgggtgatgaaccacctctgttgttaccgggctgaggaacaaggggctctctctgtctgctggtaaataaagtatgggcatatatcacttgcgggtctctgctggagggaggctcctaaaccagttggacaggaaagcgcagttcccagctcactacagtatcatacagtaagcttctgattcggataaattgtgaagaatattgtctctagctccttaaaggattttcatgtggaagaggccttaagatttattatatatggctctagagggcaaaattagaacctatcggtggtagttgtagcagaaagccttcagcgcaacccaaagaagaatctgacatggagtgggctgtcagaaagttggcgctttgtcagaagcaatgtgaagtcaaaggacaggtaaccacacactggagatgtttttcgtggtgtgcgtgagcaagtggggttggaactcggtgcccaccgcagtcttatcaggttagcctctgattccattgaaggcctctgtaggctgtgggagaagggtttgggggctctactgatggacacgatcctcccccccgcccccactttttactattttggaagcattgaaagtgcaagtggctcagtgacaggaaggagtgttggggtggcagttttaagacagggcaaacagatgtgtgcaatggacccagcggcctgtggagctttcctcaccaaggcagggcgtggaggctctttgctccacaactcatcacttgttgaagcaaagaaatgagtcaagtccatctgttaattacattggttctctttgcctcctctcctggagctgtctcggaaattacaaatgaaattggctatttagcaatcataaattgagccacttctatgatcaagacactattccgggcactgtggggagatcgaagtaattgaggatgagcaattcctgccatccaacatcacacacattgatgtgaagtgcccccaaatattaaaaccagattgctgacaggtgtagagtaatacattccagcccagatagacagggagggaagttgagtaactggttagaatcagaggtacagttcatcttgtgattttcagaaagagatgagtctttacctagtctgactctgagattttcttttgatttttaaaagcccatgagaattgctttcaatccacttgtttctaaccatgtgtctaccgtgtgcaaagccatgtgccagtggccctgggggagacagatgaatcatgggttctcagaaggcttgcaggctattgtcagaggtcccacagacctcaatgcattttctaagatgaaactcaagataatggattggttctgccctgcctggtgagcgggtataatcactcttgaagatattttttggataatcattggaaaggactatttttggagatgaagagcttttccaactttcctttggacagaaatgaattcagggagtttgcagcactcgctacccctcactgtggcaatcagccagtaaggctcaaccccaccgagaatttggtattggcccctcccgcctgttccccagagaggaccaggtacaatgcagaagcatttggctcagctctctagggtgctattttgctgctattcagactgcgctgatatcaattggctctcaccagtagaaatggtgaaaacctcgagctcctgattttgagatttgggggaatgccatctagagctaaaagcaaacaatagagggaaataatcacctttttgacatggctggtttctgtccaggccatttttgggattacaatactgtatttgtgccattcgtttttaaagggcgtaggatcagaaaggagccttcgttctgtgcgtagagattgctcggagctgtcttcccaggagctcccttactttctcttcacttcgtgctctgttgagcttctcctactgataagtgcctatctccctctctctccctctgccacaggaggagcaatttctagactctggatccaacgggaagcatctagaagcccccttgctcaggcaaagcatcagtacccaagaggggtacaggccctcttggacgtggtgtctcatttctctcccgtggccctggagcttggcattctgtattctccggttcagaccctggactctgacaccctgccttgcttcatcttgagttccggctgtctgcccagccggacctacactgagcttgtctggttctttcctgcagccagttgagacatcattgtcccaggacacccccagtctacggggttctggccccagatgtccacctctgccctgcccaccagcagccatgccagccagtgagctgtgggtgaaaacactgctgattgcaaaggaccactcaaccgtcaggaaagctctcggctcatagctttgtcttttgtccagctgtcctggacatcctatctttcctctagcccctagccctgacagagagcctcaaagttgttttcatcttatctgctgaggatctgactcaccccatcagacttctgggagggagagagcgagcgcgcctcgagcccggaggggagaaacccttagtgttgtcacggtttaggcacacgctcatagaaatccttgcagctcgagctcttcaaaatatgattagaccaattttacatgtctagtcactgaggctccagtagattgggactatttctatatgtgcaaagtgaagtggataattgaggcaattatcttcaggcaaatgaatctgggcactgtaatcagtccatcctgataactggggagaaatcggcgtcattcactgtagcattgctttgcgttaaagagaattctaaggtatttgtttgttattttcgcttggcttcatttttctaaaagacagtccagtgaagatgaggtcctgcctcgtgctggtgttaggatgtgtggaccccttaggtctcagtcaggtgtgtgtggggttgatctggacgagttgataatcagatcagtgccctagccgggtgcatccttggcttccttgtggtggatacttggtttccacatcagggttttctttccacttcttctttccttgtgtatgagaaccctgaggtgttggatgggttggtctacaaggtcacctccactgctaggatgataggattcctaatagggcccatgagtgacatacattgtgcatgataaaatatcatggagccaggagaatgaaagaagggcctctcaacgtcagaaatgagaatgcactggaggctggtgattacttctggacccccgcttccccatccattgtttcggctaaaagtcatcataaattgggagtccttccctttactggtctagaagttccctcaggaagcagccgtcacttctctccctgctcttcactgaggagggagggaagaggagcaagagaagactttccggttttccaaatggcagatttggtttcaggcatgtgaggagccacatataaaaagaaaaggcattgaggcatgtgagatttgacttaagtggaggagatcctcgcctttaagcaataatctgtgtatttagggagccaatggcccagcaagaagtccagcagtgcctcctgagtgcctgggcacctggtggagatggtgcagggtccctggcaaaagagcctctgggacaggagttgtagccgccagcctgtgtcacacactcacactcacaattagaggacaacgggaatttaattaacttccaaagtgtgatttttgaccataagcattctaggaatgaggtgctgtgtggggattgagatgaaccttggaaaatacttaaggagaggcttgttttatgctgtcaggaaatcttcatcttgtcacttcgtaaatttttgaccttgctcagttagttagaaaaacaaaaacaaaagcttcctgtccacaactgagataagagagttttgcaagacatctctctgtcctcggagtgttgtggccttctgtgggttctgtagttttaattgctagtggtttcattcctgctcagttagtgaaattgcgacattttcccagtatcttagcgtgactgccctacagccttaataatgatgattttagactgtagtttaagatctgctggggcaaatgccttctcactgcacagtatctcagcattctctgatgttttgtccatttatttttctatatgaatttaagaaccatttttatcaagttttataaatgaccttggtgatattttgactggaatggcgttcaatttataaattaagttgggaaatattatcatcttttctgcatttagtcttaagccagaagtatggcctctcaatctgttcaggtcactatttctctcattaaggatttgtgttttcttcatgtaattttaatatatcctatgtgagtttgatatgtgaatatatatcatatatttcccaagtattagatgcttttgttgcattgtgagtgggcactctttttttaattatattttcaggcctcttattatgtatttatagaaatggtattgatttttgtacgtttttctcatcttctgccactttcagaattggttggtttttgaggcaaccagcagcctactcaggcaaacactcagagaaggtttctggaggatttggtagaagagactacctcatcagggaaagagttgaactaagtcagcggttcccaaatgccagtccacagtgaaatgagaaaacgaaagatgttgtagtggggctttcatcaagccaaatttattcaggggagggacttttgattttgattcttgattttgaggctatataagcttcctgccttttagaattttgatatcatttctttctagaaggattgtagatgataattaggggttttgttttgctttaagattttagagtctttgaaaataaataaatcagaaatccttataataaatgaatgaatgaatgaatgaataaaactgcttgaattctaccctccccaaaagattttagatctttttttgtttttgtttttttttgtttttgagacagagtctcgctctatcgcccagactggaatgcagtggctcaatctcggctcactgcaagctccacctccccggttcatgccattctcccggctaattttgtttttgtatttttagtagagacgaggtttcaccatgttagccaggatggtctccatctcctgatctcgtgatctgcccgcctcggcctcccaaagttctgggattacaggcatgagccactgcgcccgctgatgttgttttttaaattttgcttttatttagttttcagtgactttatctagcagatttttttaaaaaaaagcaaaacagctggcaacccgatgtgagtgccacacatttcttttgaaatattagcgtggtctggccgggcacagtggcttatgccactgttcgtagattttggtctaaaatctcaaaatctaggaacctccaattcgatgtcctttgggttttacagttgtgatatttggtaaatctggacttctttttatattttaaaatcatttttagtttattcttttgggttcttctagttagtagtgccagttagattgatgtttttgttacttattttggctttctctgacttcatcctttgtctatgccttgcgttgtcctctgaaagtgtgtaggagagagaagggtgaaatgggggcaccctcgttttatatctgtttttaaagggatttttctctaatgtcttttctctgacagtatttaggtgggcttcaaagggaaaatagatggtatcttatgagagggctcaacagaaagtttggaggtgagaaaccagaagccagatttgggatcacacaggcctggatataaatcttgcctccttctgcttgctagctgaccagtgactatgcctggtggcggtgatggtgctggttatgatggtggtgtagcattggtggtgatggtagtggtggttgtgatggtagtggtgatggtgatggtggtggtggtgatggtggtgtggtggtgtggcggtggtggtg

SEQ ID NO: 101619 - DNA, 3012 bp, Homo sapiens
tataattaagccggcgcaaaatgagacacgcacaccaggaaaaaaaaaatcaatttccaagtcggatgagattttttaaagacatttcacttatcagtctttccccccaggactggcgaggagagcacgccttcccttccgaaggtgcgttaccagattgctgccgtttttgtgctgggtcatcagagcagattcccctccaggttacagattaaacttaactctacccgtgctgaaaatggccggagcacgccgcctcgcctcccctccccaaggctgccggagccgccggcccctgcctccttttcgacgactgatcgtccaaggactggcgccggatccaacacctttccccagctctgcgcgtaccgcgctctttggaaacgaattgtaagttatcctgatgttagacgcgacccccgtctccagcctgtcccttgttccgctttacctttccacttgcgacgatctcgagggcctccagaggtcctgcgcaaacagcccaggacgtctcctgctaagccgcatgcagcctggccacccgaccagctgcgccaaaagcttggcaataccccgacgtgaccatgcctgtgcgttcaaccctggtagcccgtaggggcatccccaagggtccccttacctcctctacctttcccccaggtactttcccctaaccgcccgccgccgggagaggtcagctccggcgcgcgcgggcaggtgcgcacgctctttgaggcggtctctgtcccgcgagcgacgggaggcgggctgtggcggccaaggctggcgcacggcagctggaggcactggcgcggaggtcccgcggcttaattgtcagctctgggacctgggctccggctctgagctgcttaggcgccgcgcgcgcgtgacttccctcccgggtggtcagtctctagagttctcgcccattcccattcagattactttccgcacatttcaacggtgtctctacagcgcggctgctctcacatcgtgaaagttggcgcgcgcacctccgaaccacattttggacacctgagaaggccaacttatttgagactagtctttctaggaggaagaaaagcgcgcaaaacaagtgacttaccaatgccgtttgggtgtgcagctccaaatctggggtgcgttcgggattcagtcgcgtagccggggcaccagctcggagacctcaggttgtctccagcgggacgcacggcgtgcgccccgccgtccaacaagcctttggccaccagggcgcccctggcatcctgggaagtttgggggagccctcgccgcctcaccctgacccccgatcccaggctgaccagctgagcctcctctcttcccactcgcccctgacctgcctttccttctcacctcctttccacctgcgctgctcccacaccgccctcaggctccccagtttagcggtgggcaactaacctgaatccatgaaaacaaggagaatctggacggcgtcctccattagtgacgccggatggggatgggtccctttttggaaggggactccggggacgcgtcacggcgggtgggcttctttggcttgcagcgacgccgctgcttctcctccttgggctccttcgactcttcggggtcccttggatctttgtcctcgggcttgagctcctccccttccctggggctctggggctcctgagtgctgggcggcgcgcgacttggggaggcgtcggggcttcgcaacttgagagcgtgcagacgctgggtgagggactggccgaaggtggagtgcttgggcaccaccgggccgcgatcgtcttcaggctcggtctcgggctcagtggtgggggcggtctcaggctcggtctcgaagtcggtctcggactcgatttcggactcggtctcgctctcggtctcgtagtcgaactcttcctcgtactctaggcactcggggagggacagctcaaggtctgcctcctcgtgctcgtggtcagattccgattcgggggactcagggaatacctgggcgccggagcggtggtgggcgttaaggaagctccggcgctgttgggcagccgcgcgctgctgggcacgggcgttggaggtggcaagggcgcggaggagcgcgatggagcaggagagccagaggagcgcggtggctgcccggcggcctatgggcgggcacaggtcgttgtaattatggcgagctcggcgccactgctgagcccgggacctccgatccatcctcttaggcacacaccgagaagccggcctgccctctggctctgcagagagtggctccgaagcacattggctgctggagccgggaaaggtacaccctatgaggtgagaagctggcccggaggtcccagcctcacctccttgtgaggagaaaaagggaagcacctaccttcctgaccacttaagaactttctaaagctccgcgccttgcttgcctctctgagcaagaagaagggatgggaaaaaaggggaaagttctgtctcctcccgggctcctctcgctgagtcttagattccgcagcctaagactcgagagaggtgcctccgccggtcctcttgcctgggagaggacagaggagactgaggcgaggagggacgggcagtgaggttctgcgaagttgcgcgcccggacttctgccgggcatgtgcagtaaggaggtgggggccacctccccgcgagctgcgtggtggcgccgagcctgtggcgcagaccctagtgggccggcaggtggcaggagggaaccttgtttgaaaggatttgggcgaagcgatgggcggggggcctggcgggtggcaaggagcaagcggcaagctagccccaggtccagtacttgggcaggtgggcgcaggctcccgtggggtcgtgcccctccccagtttccccagttattggggaaataaacacagcctgggagcagctaaaaacccagaaccccaaatagcaaatattcaggggaatgagggtctgtctatacacgagtattaagcctctagcattttccaatggcttaatag

SEQ ID NO: 101620 - DNA, 1630 bp, Homo sapiens
aagaaactgaggcagaggggtgttgggtctgacctaaggccacttgaccatggctagaagcaacctgggctgctagccctgggcctttcgtcttagatcccactgctccagtttgggacatcaagttataggaaatagagtcattagtgtcaaaaccccacaacagaacaagaaattccatctctcattcttgaacatggggattaaagatgtcatttgagcatctcatccctctgctgggtgattttttagagaagagcagcagttgagccagcacatgacatcactggcctggaagcttaattttattttagtgatttggtttttgtgataggtcaccttccaggtaagcagttaggagacatgctttactcacaccatggtttctgctcagtttcctctcaaaagcttccctcttcttgaagagcagtataataataactgataattgaggtaaatccatgtagattattaaaaaaccaaaaaacctcattcttaccaacactgaagtttcagctttcttcctccttaaccttccacacagctgcagaaaatgaaggctgaagagttaaaggctgtaagcaactccagggtgagaaaggcttgcagtgcattaaagaaacatctcaaaacaatcccaaactgtaacatttctaattcttgaattctgatgaacataaaagagttttgtttgcaaaactttaaacctacatcaggttgaccccacacaatattggaacattgcaacataaattcccagctcagataagttcagttacaagagcacctttgggtcgccctcccctcccccacaaaagcaaatttccattaagcaaatgattaatgtactaaaggaaacaacttcaatattgggggcatatcatcatgtttagctagctttattctcctgctcctcctcctccctcaccctccatttgaaatattaaaagtggctggtaattcacctatgtggttcaccataagatctgctttttcttgggagcctatcctcaccccgcagacctcacctatgtaaaaggggcaagtgggcctattcagatgctaaccccagttgagcagggtggggcaaagggccagctgggagactagtgagttgggaatgcttggggaagttgctaaaaatggctctggaaaaggaaggagctgagtaccagtctctcaggcagagagaaggtttgcgaagtctatatagcaaaatcctgtcttctcagggagggccataggtgctttcctcgggggttggtatagctctcagttgcttcatatggtctgcactggcttttccacccttgaatcagggtgtaaagagggaagctgggggaggggaattgagcgggggaggagaattgagcgggggaggggaattgagcgggggagagtgtgtgccggtaggtaacaggtttttacaattgggctgtaatgcagatggcgaggcagtttgtggaagactgtctgaaagacagtgtgtgttcctagattgcccctcctcgctacatgtgaacatggtacattgcttacagttcaggaaacatccctatgttgggcttctgtttaaaaaacagcaagatgggtgtgaggtgtgggctcgacacggagggcttttaaaaaa

SEQ ID NO: 101621 - DNA, 2530 bp, Homo sapiens
ggcctcccaaacagtctcacctctctattgatgctttcatggcatatgtattcaacgagtaattgtgtttctacttacattctgggattcttactcattaccaaaagcataaggcatatctcaagtttaggtagctacctgtcagctttctgggtttatccctgtagccaacaaagagaaggcaaagtagagagagggaagggaggtgggtgaaagggaagggaacagaaaccacgaaaaacagtatttttttggtagtcattttccttttggtctgcggctttgcagggaggaggtgggtggtgaagtttgcagaagtgccttctctgcagcccattcatgtcattggttgtcagtgggtttctttcaattgaggaaaaagtaaaagcagaaagagaaggtagaaaagaatttaggcaactatgaagcttctcagcctcccagtgacaaatgttttctgagtgctgagtgagtagtaatagactttgaagctgtacaattaattacttttcaatcaagacttgctgctgccatccttttcccttcagactctcctctgcccgccttggccggtggaggcagcagcatactgctatctgcagaggggtctgcgtggccaggctgtttgaagcaaatgccagctaaaggaaaaaagcctcaaatggatgaggcaagataccaggttagaggcagatgcaaggctgatattagaggtagtggaaaaagtctttatgaaaatacttgatatgctcagattaaaaagcccccatcgtgagttcagaccccttcactcagctaattagctgtagctcagcaaccttctcaaaaggtgccccaaattctgtttcagccaaggcatgccactgtcctctgaccacctgtgcttgaacagtgggtccagacatttgtggattccttctccagactagctgatgatgcagcaaagaatttcaggggaggagaggccattccagaaaagatgaacagcaccatgggaaagcaactaagagagaggcaaaagtgggggttggaggggaaagagggaatctcggaaggtaaatttggctttagtggaagctctgcttaaaatttctgcaattcatagtgggaattccagccaccctgggggcttctgggcatcattgtttaaggggaatggtatatttcaccttctagaacaacctcaattacccagggcaaattttcctaatgaaatctaattaagacagcgacataagccaggacactcagaaaccagctctcacatggggttgaggggagaagaaacgtggtcttctgctggctgccggtctttggcctgtgccccttggacccctcaagtttgagagtggggaccttgaagaccaaccttgctgtgaaccaaaacccaaagctttagccttggagctagacagctagatttctaggtgttaaatctttctctttgagtgtagcaattgaagtacttgtatgaaaactccacacctatgaaattggaatttttggaccaggtctgtacgaaactctcagggggacagtgatgttaatggtgtcgaatctgtgagcctcattggtagccctccaatgccatatttggcttttaaaaatgcccttcctaatgttgagctgaagtctgtcccttgatgcacctggttctaacccccttagccaccagatacttgaagctgccctcaacctttctctcttcaagactctctttattccttcaaacgactttctttataaccgccaaatttcctggctttgtgacccccttccccatttctaaatcttcttttctgctccttcccaggggttctcttatctacccacatcttcctttttttctgtgatccctcaaattcttcttttccttttgtcttccttaaatctctccccactttactgtcaccacttaccctctgtccctgctgcctgggtttatgttggcctttctcatagccatgtgccctgctaatttgtaacatacttaccctaaaataaacacaaaaaataaacacacaggctatgcccagtgggagctgggaaggcagcctccccatttctacccgggaatagttgcaggcagagtcctgcctctgctggctgagcactgtcaacaggtaatggtggccccgcattgcaggctcttggccttgggagaactaagtcactaggctgtttattctggcttctctgccctgtgaattaatggccactagtgcttggaccagcatagctattggaggcgtttgaaaaaactcatgagatttttaaacaagggaaagaaaacaaataccagtaaaaaatttatgccccccaccccccacatatggccttttgatatgtaagaaagaaattataaaacaaaaatgggtgctacatcacttaatttgacagaaccagatttttttgtttttgaaatgcttgctttgtttatcccatgcatgtatgatggaggcaaaactggttttgggggatgcggtgcgcaaacaagtcttagctgtgacaaggtcctgcagtgcataaa

SEQ ID NO: 101622 - DNA, 3084 bp, Homo sapiens
gtggccacgcagcacggaaggaggcgaacacagttggaccctgggaaacgtttgggatcccccaaagatatatcgctttagctctatgggtctacacacttccagatgtcaacactgaactttgattcaaactttggccaactacacccacgcaagacggcttaaccacttgagcatccactgaatggcccaactgggtcccaacaccaactcactcccctccgaccccagcgccgggtcagccattgggcaggggtcatgccaatcaaggctgcctggcgaatgagcagggggcgtcagaccggaaaccggatatgggtgggaggtccaatagggggcgccgcgttggaacgcccgaagaggtgctgctggggtggttggaagccggtggggggcgggtgtatggcggctaggcctggaagaccacgaggaccgctagcgccgtggggtcactcttcctcatgccacaggttgccgagcctcgggggagaggtggggtcccaggggccaacccttgggtgtgttgatggcggcaggctaacccagccaacggggtgccactgccgggcaaggtgaggagcaagaagatttccagggctgggaggtagagggccaggaccccaaggagagggcttactgcgaggagcagcccaggatggataaggagttgaggccccagggatgctgagcctgcacaagtggaaggtcagtagacattggggttggagccccagggaggctgccatgggtgctccaaaggggttgtttgctttcgtcaggcctcgcgctcacccccaaagtaccatttgtcgaggaacgggttcagggtctctgttcgacaccctcatgggtctgtgggacccctttgttcattctttctgatatcatgagctttgccaggggagcacatgcatggaggtgactaaaacaaatttaacaagttagacaaataccagttcctcatcctggagagtagagcagcatacaaatggaagaaaagaactccacctggggggaccttgaaagtcttgctggagaaaatgactttttatatgggcctccaaggaaggatagacgccttggctatgaatagaaggtggtagtgggggatgggagacggtttgcccaccacgaacaaaggatttaatggtaggaaacatggggcgtggctgggtaaacacaactggccaccttggctggctcttggggagcagggggagaaaagttaggagaaattagatagaatctctctgaggatgccatggagtatgagggcaagcacttttgaggctattttggcaggaaacggaaaggatgttgaaagttttttgttctgcaagtgaggatttgagcctacttttaggaaaagcagaagcagcatggaggatgatcctgatcgagaacaaaggaaaggggttatgcacaaaggagatgtttaaaggagagacctagcacggtgaaggaagcaggaaggctgaaggacggcactcaagaggggtcccaaaggatcctcctggagcagctcttatgctagaaagacacaaaagatggaggagccaaagtgtggcacccagatggatggaacactgggagtgggacagggaagtcagtgggaggggctggcaaggtggcagtgctgatttggttttagacatggcagattaaggaactttgggcagttgggatggagatttttgcagcccattttctgggaggaaaggtctgaagttcagaaaaagataaagatcacacattcaaattggcaatcgtacttacaaagatgaatttatggagtcagagaaaactctttaggggagaaatacatttggtaatagaatcttgaacaattggcgcactggacaggaaaaagggagacagtccaggagtgagtagggaggactcagaagggagagatgggagcacaccagaggaaggggtttcagaaccactcagcacatctcatctagacttggtgttttagcctctgcactggtggtatttggggccaggcaattctttgttgtggtgactgccctgtgcattgtaggatgttgagcagcatccctagcctctacccactagatgccagtagcatccccttagttttaacaaccaaaaatgtctccagactttgctaaatgtcctctggggggcaaaatctcccccagttgaaaatcaccactataagctgagaaaggacccttagatttaaataggaattgccttaatttaaagataaattaagactaggaagaataaatcccagtatttaaccctgatattcccccttttttccactcctgttatttctctgtagtgactggctaccagactctgaaaaacctaagtcctttaggtgagtggagctaagagctgaaacatcagtaatggggtcagggaccccagaagtgtggccaaatgttcgaggagttgacccacctgtggcacctgcaaggccacagggacctgaggaatccggtatagtaagagctgggggtgatcggctagtgggtttactggggtccaccttgattggcctgattggttggcttgtctggtgatcctcctgaaggctgataattttgctagctcaagacagaaacatggccttgatctggagggagatggccagtgctggatgttagtgggcagcatcgtctggggcctaaccttgccggggcttttttaggatctgccattataattgtataatagcaaagtaccttaaacatagctttccagtgctggatggattgccatcatgggaaaagataaatatgtgataggactgaggaaggaaagtctattaatgtgtttatgcagctaaggaagaggaagtcaggagaggctggtgcctgaaaaaaaaggccgagttgggatggatagacgctgtgtgccagggtcttgacccctgtcatgaggggctgtgtgctggagtgtagggctgcagtgagatgatgtgtcaagtaggggaggacaggattggctgtcgaaacccagggatggtttacttgaaaattgtgtatacttggctacttaaaaataatagcgtctgcacttgatgtactaagaaaggcatgggaa

SEQ ID NO: 101623 - DNA, 1043 bp, Homo sapiens
aggccactgcagccttcctctgcttgatttccatgtagcctccagttggttgaaattcagcatttgctggggagctcagggctatgccctctgctctcccactcagcagtttattgagggcttggcagtgtgcacagaactctcactggcctgtcaggagcccactcaacagcagagcccagatggcactgtgtctttctaaggtccttgctgaccactggaagttatgagaaggggaaaattattcagcccaagcggcaagcgtttgcaaccagtctggggatcagatgaaaaggagattttttatgagctacagacctcagctctacccacagccacgtcccagggtctctgtcacgccgcccaatactgggaaggctgcctctgcctgctttcttgaacattcctgtttttcggttgccttagtctctactaccttctcagattacggctccttttgtgctaattacaccgaaaaaattgaaagaatgtcgctgactttacaaagaacacaaagcagacttgcttaaaaaactaaatatagccagtttctttcagaaggcagacagactcggccttccaatgatttgtactatgcagattaattgcagatggccaattcatttattaggacccaaatgacagaagggctcagctatcggcaggacagattaaaaatgtgtgttgcttttgggggccatttacataaaatgagaaggtctgattaatgacgaacttttttttttcccagcacttaattgtaaattaagatttgctgatgatgatgggctaatttaagctaccgtggaaagagggaagaaatggaagctgctgatcgtaggaagcagtacctgtactgcgcaggtaaaaatataaatgaaacgaaagaagaaaatctaacttctcattctggaaggcagtggctgccacagatcaagaggatattgttttgcagcccctcttctccattatgtaagaaatggccattatgtaagaaagacagacttgggaagggggtattatctctgctagccaagcaaatt

SEQ ID NO: 101624 - DNA, 1053 bp, Homo sapiens
aagacagtttgtggactttgcatatctgggctttccgggacgtaggcctgtgtcccatccaagacactgctcacgtcttagcctgattacctggccgcctcggctcacctgggcacatggtgagccgcggaactggcaggcaccaaacatttattgaatgaataaaccgtatcccagcagacaccatggtggcagcagatgacctaaccaaggtcccaggaaaggcgggctggggtcaactgcttgaaaatttagtaaccctgctcctaatcccgtgcactgctatatcctagtgtgcggcgggacacttgagagttttgaaagaaccctcaaacaagttcacgttccgtaaactacttttccctctgttccagagcccccagggcgcccaggcaaggccgccacctctcccacctgggaggacgcctcgagcaccgactccacagccacggccaccgctcctcggctcccgtgacaccggcgcgcctgctgcttcgagcaggggaggctttgcactcccatcgcacttttctcgtccgaagatacgaaactccgtccgggcgtcgcaaataattcgaattcggctctctgacacctacctcggcgggcgcgcgccgctgggagggcggggtgggtggctggaggtaaggaggcgcacagcaggggtaagcgccgccgtcgcacactttgcacgccgcccagggctacaccactcaccgaaaattgggaggcaggtctgggaggcggggttgagcgcccaccgccttgggcgcgcccgcgccccccgccatcgcggcccccgcgcccccggcccacgcccgcgcggtcccggcaccggcctgcacccccagggtgcgcggcggcccatttgggtgcgtccccggtgggccgatttttcgcgcttccccttcggtttataggggccgctgctatgggtcggtcctctgaagaggctggggcgtcatcggggccggttagaagctctgctccccggcggggacactcagtcgcgtcggcaccgcggagcgggctgcgtcaggtggctggccggcg

SEQ ID NO: 101625 - DNA, 1038 bp, Homo sapiens
tgttgttgggtgctttttggtttgttcttgtccctttttcgtttgctcatcctttttggcgctaactcttaggcagccagcccagcagcccgaagcccgggcagccgcgctccgcggccccggggcagcgcggcgggaaccgcagccaagccccccgacacggggcgcacgggggccgggcagcccgaggccgggggcaagcagggagcccgggccaggcgcgagccgagctccccgaggtggccgggccaccatgctgaagatggccatgaagctcaaagcccgggcggcggagagcgagaagaagacggccgcggcggctgccgaggtggctgccgaagctgcggcggcggctgcggcgttggccgagccgagagagccgctcgcgccgcggaagagcggggaccccgagaagctcgcgaagaaccccaagaacccggcgcgggaggcgctccccgaaaagttcctaacagacaaggagcgcaagaagctcgagaagaagctgctggagcagaggcgaaaggaggagaagaagaaggagaaggagaggaagaagatggagaagatgctgaagaagaagaagaagaaggtgccagaagcccaggaggaggcccgatgccccgaggccgccgccgccgcggccgccgccgacgacgacgagggcgccgaggagggcgccgtcgggggcgccgaggagggcgccgccgccgggggcacgagtagggcctgggctgactgggacacggactcgagcgacgaggacgacgcctactacgcggcgccgcgcgttgggggcatcgtgtggcggcccgggccgctcaaggctggcgcgctgagcgcccacctgcccctcgtggtgttcctggtcttctcggtgcgcagcccctcgtgggtgctcaacttcctgctgcagaagcgcacggagcagggccgcggctgcggcttcgtgttcggggcgacctgctgcttccgagtgttcctgggctgcgccttcttctcctacttgggcggccgcgccaagcgcagaggccgcgggcg

SEQ ID NO: 101626 - DNA, 1115 bp, Homo sapiens
agaaaaaacaaagacattcacaaatcagataaaactggagaatgacatttgtctgtaaatggcttcttggtctggaaatggcgtggtttctttttttttttttttttttttttgtcctcctcaaggtgggaggggggattgagagtgctctaaggagacttttcctccaggtgggaagagataaaaagacattaattagttgtttatcaagtgacatttagttgtttggttttgggttttctttttttgattgcgatttttcctctgattaaaaaaataataataaaataaaaaaaggttaactataaggagatggcctttcctccttttttttcttaaggtgctgttttgggggaaaaaaatgtaatgaaatgaccaaaagaattacacagcattaattaaaaatggaagttttccacttccttgataatttggctatctgaataaatttgtgaatttgctaggttaagacctagttcgtggtcacatttcaacaaaacagcttgagtataaagaaaataataaaaggctgttcttatttattttcctttggtggcttttggtttgctctttttgcataggtcatgactttgttctcctgggtccagatttataaaagcagaaaattactaattaagtcaaaataagtgtctttggtgtttatgcatttgcaatttcagtaattaaatggtacatgtgttgctgtcttgtctaaaacttttaaaggcagaattatgctgttgggatattagtatgcgtataacttgatttcaaagtataaatctggaaaagtctagaatcttttctgtgaatgctatctcagtactactttaagtcaagtgtgatgctaatgatatcttaaaatttccaacaccttttgtgcagtgatcacaaagtctccacttaatttgagactgttactcagaacacgccttgcgtcacgggggctaatctaagtgtcctagtctatatgactacattacatcatgatgtattgattgcctctggcctaggaatctgcagcttaagccagtgacacaatattttgcatttttaaatggtgattctcaccaaataatgcctccccacaaaagaggaaacctaataatgcccca

SEQ ID NO: 101627 - DNA, 1049 bp, Homo sapiens
cattggttgaactaagctaatcaattaccaaactgtagaatgctgcccttcggccttcaaggaggaattcctactgtttatgaagatcgggtttgggtttttggttttttttttctttttcttttttccgtggtggtggtgggtgggcttttgttctttttgttttttctgtggtggtggtgggtgggcttttgttctttgaaattttttttgctacatcacagtccagacatagtttaatgacaatttatggggaacaattatttataaataaaaccattttataggtagtttccttccactgcaagaagtgaggtcattagttttgcaggaaatcctgggcagaaatctcccccgtttatgcctttatgccttaagttacaaccttgggaagattctgacctgggagaattaggagccttatgcgctgccatattctccaaagaattgtgagataaatcactgctttagctccctaatgcgtgtacgtttagtgaaagcacaagaaaacaattatccatccctcctgtctccgaccagagtctccagagagctctgttaatactgcagcaaaggtgtgggattcttcccccatggcctgcagtctcagtggatgttccaatttagccagaaaggcgacctaagaattgccgggaggatggatggctggcgcgcgaattgttgcttttgctcttggctgatggttgaggaatgtagagagactgtgtggggtttgtgtgacactgcggtgccttgcagattaggtgagctttcaatctctctttaaaaggggcggcgaagaggacccgcaggctgcaaggagcaacagcgatgggtaggcacattcaaaaccagaaaaaattgttaacaaaccaaacaaacatgaagatcatactgggaaactgaggccagagacccgggaagaaaataaaaatcatttaaaggaccatcagccatattggcatacatttgtgaataacacacaatttcctgacattttggagcaagtaaagtgcgtaacataaatttttttggccatgcttaaagta

SEQ ID NO: 101628 - DNA, 1052 bp, Homo sapiens
cgcgtctgtcttctgtcttccttcctttgtctgtcttttcccaccaaagcacaaggattaaggtggagacctgaatagcttcccccaccacttagttagctgaagcggggggaggggaggagctcttaaaaactgaacgcatcccatctgctgtatacatagaagggggaggaggaggaaccaagaccctaaaagtacttccagccttagtcccaattttgtagcgaatcagaattctagctaatggcatatgttttgcctttgttgagtagtttaaagacatctaaggaattttctctgaatttcacaatcaacgttaaattcattaagcaatagtaaaagtgatgataaacccgccaacccccagtataatatctccatctacatagtaattgcttcaatggaagaattttatgttttagtattacacacccgaattagattttagatttctattttagctgttttatacttgatatactcccacacctattcacatacgtagatgaatactgaacacgttctcaaaatatccgtattttaagacgggaagttttccaattatcatactactgcttagaccaaaatatcaaactgaatgaaagaaacttgtttctggaaatactttctcttgctgtatgcagatttggatatttagtacccgaatgtatttaattttactattgtggaacctcaaaaccaaaggttaatagctttcattacctgtgaagtggagcctgcttttaatgaatgggaatagatttgccctagggggttttgggtaaattctgaattcaaaagtgaacattggggaccatcaaacacatgtccttttaatttataacatctaaataatcgatgttagactgtaataccaaggccggggattcttaatttcagaaatgagctttgattctgcacatacaaagcagacagtcgcacagagcggtcaggactcactccctttcactctaaggtggttgctttaagagtctgggggccagaatcagatttcagatttgtacacaaggcctgaagctcgctcacctccc

SEQ ID NO: 101629 - DNA, 1173 bp, Homo sapiens
tttggggtcctttctctactggttgatatgcataaaaccttctaaaaatcaagaatattgccagagagcaacaggaataaagaagctaagtaaagaataaaaaagaaaaatagaaaaaataaaaataaacacgaagaacaaagccccaccaccgtgctgtgctgtttgtgtggccccactgcgtcgaggccacaggctagctgctagacgcatctagagttccctgattcctaaaattatttatcttaaatcctgtttgccctaaccttcttaaggcatcagctttgagttacaaatgtaaccaacacacaagcaaatgtgccattgacttagtgctgcataactgtgggacggtcacttccgttgagcctgaccttgtagagagacacaaatagttggcaaattgatgtgagcgctgtgaacaccccacgtgtctttctttttctcccagcttcctggacaagatcgacgtgatcaagcaggctgactatgtgccgagcgatcaggtgtgcaaaacccctccccaccagaggactctgagccctctttccaaactactccagacctttgctttagattggcaattattactgtttcggttggctttggtgagatccattgacctcaattttgtttcaggacctgcttcgctgccgtgtcctgacttctggaatctttgagaccaagttccaggtggacaaagtcaacttccagtaagccaactgttacctttttatataacagagatcatggtttcttgacattcaccccagtccctctggaataaccagctgtcctcctccccaccagcatgtttgacgtgggtggccagcgcgatgaacgccgcaagtggatccagtgcttcaacggtaggatgctgtgggcttggctgttcgtaaagaacgctttgcttctgtgttgttagggatcagggtcgctgctcacgctcttggctttgctctctttggttaagatgtgactgccatcatcttcgtggtggccagcagcagctacaacatggtcatccgggaggacaaccagaccaaccgcctgcaggaggctctgaacctcttcaagagcatctggaacaacaggtttgtggagtgaccgcccaccccctgcgcttgcccaggaggccctggtctgcactgtttatagagaagaaccccgtgc

SEQ ID NO: 101630 - DNA, 1032 bp, Homo sapiens
tatggaaaaatcagggttttgaagacttcaggagctacagagatgctagcaccccagctctgcttgaattttaaattacattaatatgtattccctttttatatagctactcccgagcccggagaggacccacgcgtgacccgggccaagtacttcattcgagatgagtttctggtgagtcgagcctgtctttagtttcctctcttgttcctcctctttttctcatggatgtaaatttacttaattccaaattcaggggttcagctacccagttccatggttttagttcacgcacatccagtgtggatttgagctctttgcgcccctctttttgcttttgttttcatatgacatcagaggctggctgacagccgtccctggtaggtgtccccatcagggatagggtggttcctggcgagggtgtcactgacaagtccccttgtttgtgcccgcagaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaattaaagccttaagcacaattaattaaaagtgaaacgtaattgtacaagcagttaatcacccaccatagggcatgattaacaaagcaacctttcccttcccccgagtgattttgcgaaacccccttttcccttcagcttgcttagatgttccaaatttagaaagcttaaggcggcctacagaaaaaggaaaaaaggccacaaaagttccctctcactttcagtaaaaataaataaaacagcagcagcaaacaaataaaatgaaataaaagaaacaaatgaaataaatattgtgttgtgcagcattaaaaaaaatcaaaataaaaattaaatgtgagcaaagaatgatgggactcccgtgagttatttgtggttctgagcaaattcccgtcattcatggttttgacttggt

SEQ ID NO: 101631 - DNA, 1034 bp, Homo sapiens
tttttaaaattttgagtagagagggggtttcaccttgttggccaggctggtctcaaactcttgacctcaggtgatccacccacctctgcctcccaaagtactgggattacaggcgtgagccactgctcgtggcccaggaacttgcatttttaacaacaatcaagattggggatgtctggtgcattttgaagtggtattataagggaataaaggatgaagtggggcttacgttgataaacatgggtggtggtgtgatggcggcttcggagccatggtctaaaatgccaaggcgggcgatgtgtttctggaactgaaagaagccctgtgatgttagctgcctggtggaagcagtggcaggaggtcagtagggagcaggttctgaagatccttggagagctgctgaatggtatggcttgttcaggagtttggggcagggagtgacacgagtagatttgcatgttggatcatttcacagtgttggaggcttagggtggagtggatagagtcagacttagctaactgagagcttgggccatgtgtgtcatgcgttatccccttccacacacaggattttgagttgggtgttaccctacttatctggtaagtgtagaaaatgagacgaaaagacttactgacctgcccaaggtcatgaaactaataaaggaaggagaggggacccaaacccacatcctttgcctccgttgccacttcgtcaaattgctgactaccaaagtggtccagatgagaaggtgtgaattagcttagtggtaggttggtgtttggggcatctagtatatcaccttgagcctttttttctttttttttttttttgagacagagtctcgcttagctgctcaggctggagtgcagtggcttgatctcagctcgctgcaactgccatctcctgggttcaagcaattctcccgtctcagcctcctgagtagctgggattacaggcatccgccatcatgtccggctaatttttgtattttagtagagacagtgtttcaccacgttggccaggctagtcttga

SEQ ID NO: 101632 - DNA, 2483 bp, Homo sapiens
aagtgctgagattacaggtgtgagctaccgtgcccggcctcaccttgaggctttgagtcataaagtgttagaactggggcatataagggccatctaatcagtaccttcactttatagaccaagcacgtgagttatttgcccaagtttgtgcagtcagacctagaccccactgatgggagattggggagtctcatgtttggggaattttaatcatgatcctaatttggcccactgacaccagtgggctctcatggatgaggggggtggaccagacgttcatttcatgtttattctgtgactctgcttggaagaggtacagaaagttaggaaaggtgttaggagggtggcaagaactggattttaaaagatagttggtgacccaaattctgttcgcctgatgccatgttacatagtgggaggtaggaagatgtgtaaggaggccaccgtgatgttcagtctggatggtggaaactaagagctgcagacatgcaaatagatgagtcctgctacagattgcaaatggggagtggtgagaggtcagaacggacaggggaagtgggaagggcacgctcttgctagagctggggcgttttttcctgaaggagatgggaatctttaagcaggagagagacgtcagttttgtggcttacaaagatcactgtggccacggtgtgaaagatgattgaaaggaaggaataagactgagacttcaggggaatgttgctactgcaagcatacaaaaaataaggaagagcagaggcaaatgtggaaagaaggaccaccttggatagacagatgggagatggaactgatgagtctttgtgacaggatgtgggggtggggtgagggagagaagctgaggatgattttcaggtttggggggtaacaagtagatatatgaaggatacctttacggaaatatgggttgtaggaagaagatctgtttctagggaagagatgtcagttttggacctaaagagtttggatacttgtgagacatctgactggaaatgagaatggaatgttggatacctgagtctggagcttaagagaggaaagacggagagagagatccaggctaattctagattggtgagcaggtagatagcatgacccaagaggtggtggaagaggcaggtaggtgagtgcccagggtggaagcccaagagaacagacaacgtgggaatgaagctcggggtgaagtccggcctctgtcatgcccttaggggctcagcgttccccatgcaaatctggtctgagagaagactccacagcttttactgggaagtcatcgggttctgtctgctcccaaagcactgcttttaggatcttagtccagatcaggagtgagcaaacttttctgaaaaaggctagatagcaaatattttaggttgtgcctgtctctgtcttaactacttacctctgcccttacagggggaaagcaatcatagacagtccttaaaagaatgggtgtgctgtgttccgtaaaagtttatttgcaaaaataggagagggctggattcggctctgggtcatagtttgctgacccctggcccagctcttgccccattatgttagagtaggttgcatggaggtctgtctctcctattagtttgtgaacttctttgatggaaaaagccttgtcttgtcttacattttcttaggttccttggttgatgagcatagtgcagactgaatgttcaaaaagcatctgcttgttagttagggtggcagtgttaaagttggacagggtttgggatcacagtccatcctcacatggtcattagcaggtgaagaagcctgctttgcccttagatggagtgacaggcctgaagttgcttccacatagaattgggactggagtccagccagaagtgtggatgcaaggcgagttagtggtctttactttctaatggtaagtgatggctcacgctttcaagaatcaggttgttactcttcagtggcatgtatgaaataagaatagtgaaaacaataataataatagtttactatttattgcactgttacgaaatgtcagggattatgctgggttcttccaaaaattagctcatggaatcctcacaacagccaaatgggaataggcgttattattatcttcacttaacagaggaggaaatggacactcagagaggttgggtaacttgtgtgagcatggaacgcggtttgccagggaggagttgtacacacccactcagtgtgatcctggatcccattttcctagccactcactatctgtccagcccatttcatgaaattgtcatgaaagtcaaatgaaataatgtgtgtagaatactttcaaaatgggcagcattatacgatttaaggtgagattagggtatttgtattaatgaaaaaaatatcctggctcttcgcatttaccaacagcaggaggatgattctggagaaggagaggatgatgcggaggttcagcaagaatgcctgcataaattttccacccggga

SEQ ID NO: 101633 - DNA, 1551 bp, Homo sapiens
atcattccattcattcgggtgtaattgctgttgttactttccctaggtattttcaggcaggagggtctccagagaatgttatccagctcttatctgaaaactacaccgctgtggcccagactgtgaacctgctggccgagtggctcattcagacaggtgctttgtgggtgtcccctgtcctggctagttacccccacttttttaaaaatagacttttgggtccttataacactgatacaatgccttctttgatttcctggtttctgagacttgtgtaagaaagagctgaacttcttactcatttttatctttatcttactcatttgtatctgcttgcctcttatctttgattcagtaattgaggtttactggtagcctgcaaacgtgattctcattgagctgttttccctaccatgttgtagaattataggattatacagtgtgtgttcagtgtgtcattttcaagacgtctattacagcaagcagtaaatgacggataatttaggactggctgtgattatggcttttagttaatatgatcaaagtagagtcttactgtaaatccacggagccgggtgcagatgacatcactgaagtgcgtgctgtccggaagcttgtggacacactgctgtcccggtgattagatacaagtgtgtctcttttggctgccatctgctccctcctcactgggcagggatgtttttccatccccctacctgttgctggggccatttgtctttatcctcagtgaggctctgcagatggtgctgtcctttccatgaagttaggggtggaccagacttgtgtgttctgttctgtgctgctttttggtcttatcattgataactactttgaagagttccaaaaccttacatgtataagtggtcagaagcaattctttggtatttgattcacatagagacttttgaccatttgctttctaaagccacacagtgaatggacagcttgccattgtctagttgcttttattctctttcaggtgttgagccagtgcaggttcaggaaactgtggaaaatcacttgaagagtttgctgatcaaacattttgacccccgcaaagcagattctatttttactgaagaaggagaggtgagaaattatttttctttgcctagtaccaggccctagggtcttttgcaaattccctgtgtacagtggagcgtggcatatcatgtaagtaatggcagagttgaggactaaaatcagagtgtgagacagaagttgcatctagtcagaattgccctttaaactctgtacccagggtcgtgacatgcttgcacgcaagaggcacacaggtgctgagatcaagagaatgaacagcaagttcccaccatttcccctctcaggctgactccagggcacagcccttggagtgttgtggtggattcgtttggttcctccaagaagcagctgccaagacagggctaggcctgcaggagatgatggggaagcgactatgagggaagatggggtagggctggaggaggctggggtagctgtgatgcagtctgacccttgagggcaagagaa

SEQ ID NO: 101634 - DNA, 1004 bp, Homo sapiens
tgtggtgatgggccagaacacctgtgccatttaaatggcctctttctcttttgctaagggcatacaagctggggcagcatgagctccctgtgtgtgcaaggcagctctatgcggttctcggtgtctcctaggaagcaactttcagtaccctcctgtgttgagtccgattttctaaaagctgagcgggcatctagggacctttctgtcactcagccgactgtgtggctgtggccagctctgggtctgcctcccccagaactagatgcccatggggagtccatcagcaccaatctcctgtgatcgtttatacaacagaatctccactcaagtaaaagtggggcctcctcctatcttgctgtttgtgtgtgtgttggcagaccccagcgtggctggaacagatgattgcacataccacgtggcgggaccttttttataaactggctgaagcccatccagactgtttgatgctgaacttcaccgttaaggtaggaagagttctagagttaaggagaaaagtgtttatgaatgtttatttttggttgttggtctgtttcctttgacagttcatatttgctttttttccataaaggtctttattgttttattttcataagccttacactgagaaagaaaagtgtaaaatttgtatctgtttttgggtcagtgttgactgtgttttaggatttagcagggatacaagaattctcttgtggttggagaggagctttaggcgtgcctgcttgatcttcctcttgcatatgaagaaacgatggagaggtggtcagcccagggcacacacctaggtgatagcagggtgagggcggagtgaaggcctgagacccacgaccagcgcacacttactccacctcaccatgaacactgacaagccagcttcccgtggaggtgcggtcactgcatgcctcccctctgacttcttgttttgtgtcctagcttatttctgacgcagggtaccagggggagatcaccagtgtgtccacagcatg

SEQ ID NO: 101635 - DNA, 1712 bp, Homo sapiens
tgccttgttagtaacggggtctatggtttttctcatcaagaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttgtaagttgcttctcaagaatccccaatgtcagctggtaaggtgactttggaaagtctgtgcttgtctgattgtctgaaggctgtgaatgcaaatccatcattgtcctggtccttcctcagtcacactctctgcctggagcctgttgggcccctgctgtgtagggaaccctgaggggaggtgggtgagcagtgccctcacgcctgccatcccgaactgggcatatgcttctcctcagatccgcgttccagccttcctggacctgttcatgcagtcactctttaaaccaggggctcggatcaaccaggaccacaagcacaaatacatccacatcttggcgtacgcagcaagcgtggttgagacctggaagaaggtaccatcggttctgggaatttgtggattttttaggagacaaatatcctcctctgctttgatattattttggaattttggctgcaagaaatcttgaccctccctagtatcaggcatgtgttttcttgtgtttctgcgtagagaaagcactaaacgtctccagaaaatgtgcgtaatgtctccaatgctctgcaaaccgtaaattgaaatgtgactaaagaaatgaaactgatttccgtaagacatggacaaacactagtctcattgcttttcagtttctgtacactgtgtgactgtgaagtttgacagctgaattgactcccaacttaagtagaaatagggaaagtgctttgcaagaagtggccgacaccagaacaccccgacagcagggatatctgccctgtcaggctcaccagcttgtgtgtgtgttttcagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtaagcaaaacgaaactcagttcttaaatcagtcctttggggaggaggtcgtttgagttttcatattgaaagctcaaataacaaaagcttcagcgatacttgttcattttatttattttttcatttttaaacagtatgtagggaactttaaacagctttagcagcatgagtaattttcagatgtttatttgccagaagtctgttgagtacaaattaggctaagtaaaagatagccagagttaacaaaaattgatttgaagggtctatttataggtaaagttatgcccacaaagtattgcttacatagaaatgatttgtgattatgccaatcatataaatagacgtgtcctagaaatagtgtgtcctcttaggcatgtctttcccctaataatttatactagggatgaagaaagagtttgctaaataaaggtaaacttcaacccagtccaccaaactcactgagtatcactcattaatgatcttttcctttcgataagtggtttaaagtgagcagagaattgaactctgcttcttgcaccgcatgttgagtggctgctgatc

SEQ ID NO: 101636 - DNA, 1024 bp, Homo sapiens
acttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcatttccctcaaggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaagcctttctgctgggttggattaagtcctgatgtgacattgtttttgtgtgcgaataaggcacgggcagcctcagtctcgtgcagagccagatactttattcatcacttgggcgatttgaaactgccaactccctccctccctcccccacccttgattctaaagtgacataagaatggtgataagtctgaactctttcacctcttaaatgccatattattgcccacagttgccaaatacaaaatatcaagtcctctgctgaagaagactgaggtcccatcgtttcctgtgtcgcaggtcacttcttcaccaggtggctgactgcatcattgtgaggcagagccatgctgtgcaagtgtcataagtcatcccactttcaactctcaggaacactcgcagccagtgccacgctgtcctcgccatccaatattgatagccaccccagttcctgccagccagcctggcacacataaccataggatcccctctggtcatgggtcaccatgccttttcttaaactgcgcttctagtgacatggccttaaacgatggggtccccaaatgtacagtgct

SEQ ID NO: 101637 - DNA, 1060 bp, Homo sapiens
aataatttaagacacagaaattcatgattaagaaatggggggaaagcggttcatgtgcaggtgatgaaatgtcgtcattttttactaggtgactaatgggggtagtagtagctggaggaggcaccagtctagagtcaacatgttttgtgagatgaattcacttctggcatagagggccctcatgttaaacattaaccaagtgaaatgtttcacaaaaggtatttcagaacaggggtcatgggaaagctgaggggcagctgagtgggctgtctggatcccccaaggctggcctgagagatggaggcagaaagcagggggcagggggctgacggcagcaaggggagcgggagacggctgcagatgggctgacgcgcgatcccacttctcacagggcgagagaggctggctgaggatcgtgaccagcacctataaggatgggaagggcgccagatacaaccttgccatcgaggagcactgtacatttggggaccccatcgtttaaggccatgtcactagaagcgcagtttaagaaaaggcatggtgacccatgaccagaggggatcctatggttatgtgtgccaggctggctggcaggaactggggtggctatcaatattggatggcgaggacagcgtggcactggctgcgagtgttcctgagagttgaaagtgggatgacttatgacacttgcacagcatggctctgcctcacaatgatgcagtcagccacctggtgaagaagtgacctgcgacacaggaaacgatgggacctcagtcttcttcagcagaggacttgatattttgtatttggcaactgtgggcaataatatggcatttaagaggtgaaagagttcagacttatcaccattcttatgtcactttagaatcaagggtgggggagggagggagggagttggcagtttcaaatcgcccaagtgatgaataaagtatctggctctgcacgagactgaggctgcccgtgccttattcgcacacaaaaacaatgtcacatcaggacttaatccaacccagcagaaaggctttttaaaaatttacttatt

SEQ ID NO: 101638 - DNA, 1014 bp, Homo sapiens
ttttttttttttttttgaaacacagtctcactctgtcacccaggctggagtgcagtggtatgatcttcgctcactgcagccttgaccgcccgggctcaagctatcctcccgcctcagccccctccaccgagtagctgggactactggcgcacaccaccacacccagctaatttttgtattttctgtagaggtggggtttcgccatcttgcccaggctggtcttgaattcctggactcaagcgatccacctgcctcggcctcccaaagtgctggaattacaggcgtgagccacggcgcccagccatatcagattatttctaatgacggtaaattctctcaatttaaaagtggtaattctttaactgcttgctctcagctgtggaataatggcaacagaaagactggctaactacaccggaggcatctatgccgaataccaggacaccacatatataaaccatgtcgtttctgtggctgggtggggcatcagtgatgggactgagtactggattgtccggaattcatggggtgaaccatgggtaagatgttttcattttcttaaggtcattcctagaaaaaaacgtcctggtactcctctcgcttgaatggttctgtttacgtttagctaaaaactggggccttgacagagggttccttgctccagctgtctcagccaccgcgcgagtggcttttggggccagacccttctctgacatgcgcggctgccgccatcctgtgcactttgggtgttcagcagcatccctggcccctccacccactaggtgactccccgcaatcccagtgtgaccaaaaccgtctccagatggtgcctggtgccctggggaagtccctgtgagcactgctggagaggggctctgccaccctcttcctttacaaccagctcattctttttcccatcatggtttttgggctcccctaaaatactgtgtcggtttttcaaaaatactcgagttgggccaaaaatccaggagagagaaattaactgccagacct

SEQ ID NO: 101639 - DNA, 1039 bp, Homo sapiens
ttttaggggagcccaaaaaccatgatgggaaaaagaatgagctggttgtaaaggaagagggtggcagagcccctctccagcagtgctcacagggacttccccagggcaccaggcaccatctggagacggttttggtcacactgggattgcggggagtcacctagtgggtggaggggccagggatgctgctgaacacccaaagtgcacaggatggcggcagccgcgcatgtcagagaagggtctggccccaaaagccactcgcgcggtggctgagacagctggagcaaggaaccctctgtcaaggccccagtttttagctaaacgtaaacagaaccattcaagcgagaggagtaccaggacgtttttttctaggaatgaccttaagaaaatgaaaacatcttacccatggttcaccccatgaattccggacaatccagtactcagtcccatcactgatgccccacccagccacagaaacgacatggtttatatatgtggtgtcctggtattcggcatagatgcctccggtgtagttagccagtctttctgttgccattattccacagctgagagcaagcagttaaagaattaccacttttaaattgagagaatttaccgtcattagaaataatctgatatggctgggcgccgtggctcacgcctgtaattccagcactttgggaggccgaggcaggtggatcgcttgagtccaggaattcaagaccagcctgggcaagatggcgaaaccccacctctacagaaaatacaaaaattagctgggtgtggtggtgtgcgccagtagtcccagctactcggtggagggggctgaggcgggaggatagcttgagcccgggcggtcaaggctgcagtgagcgaagatcataccactgcactccagcctgggtgacagagtgagactgtgtttcaaaaaaaaaaaaaaaaaaaaaaatctggtatgacaacaaagtgtaaacccgactcaggtagtgtatatctgacggttctggataaacttctgttgttattcacatagtgtctt

SEQ ID NO: 101640 - DNA, 1074 bp, Homo sapiens
ttattttttaagcctaattcttgataacctcttaagtcgaaataaccagaatttttttttttggtcccctcagcgtgggcacagaagaaaatgcttttttgtggttgttgttacccaaagtattggcctatttattcaccagccagcaatagagacattttattaagtgctaatcatttgattatgctccattttcagctagaaagtattgtggaaaggtccttctccagccattagaggaaaaaggcgaactcctgggtgcctactatgtgctaattaatgtctgtctcttttcttctctgccaaggcctggggaagggcttttcataactccctggcagctgaaagaagagcgtcattaagcagcacctaatagcaagatgatttccgttcttagctgctgagtggtaggctgcatgatgagagtggagagtgggcttggcgggcttctttgtcagtgggttgatgaggagacggcctcatgctgacttttcttgctctcccccagagtgtgacaagtttaaccaatgtgggacatgcaatgaattcaaagagtgccacgccatccggaactacaccctctggagggtgggagactacggctccctctctgggagggagaagatgatggcagaaatctatgcaaatggtcccatcaggtgaggagaggtcccgcgggcaaagagaggtttgcgggtgaggaaaggtcccgcgggtgaggaaaggtcccgcgggtgaggagagatccgcggtgacagcgccagtgtgggctcatgtcggtgctcatgtaggcatctccgtccttcgccactttccttctggccggttgtactcagtaggctcgagacagccacatcatttcccctctaagaacttcagttttctcagagttaacactcagctgatagcaagtctgcccctatggatggttgtgcggaatgcggatgagacgctccaagctgtaccgagggggcagtttcagcagggaagacactatgtgaataacaacagaagtttatccagaaccgtcagatatacactacctgagtcgggtttacactttgttgtcatacc

SEQ ID NO: 101641 - DNA, 1072 bp, Homo sapiens
gttcacagagctgacaccttggccccctgtccacgagggcagggacggtctctcctggctggctttggggtgtggcccacttgccatgggtggctgagtctctgtccattcagcccttcattcagcaggcacttctcaggtgtctgcagggccagatgctggtgaccgcctggccctggccctgctctcatggcatttgtagcgggaggtgtggcagacaggacagtgcccaaagaaggccaggagaggcctctctgcagagcgacgtctgagcggagacctccatgaagaggtcagcagggagaaggagacacaggcagctgggcagagctgaaggcaggccaggctgggcagcgcctgcatcccgcctgaggcgtccaggtccgttcggggaagtgggtggagagtgggtgagtgctgactggcaggtgctgactgttgcagatcggatcaacatcaagaggaagggagcgtggccctccaccctcctgtccgtgcagaacgtcatcgactgcggtaacgctggctcctgtgaagggggtaatgacctgtccgtgtgggactacgcccaccagcacggcatccctgacgagacctgcaacaactaccaggccaaggaccagggtaggctgctgcccgtgcccccactccaccctcctgccctccactccctcttccacaggccttcgtggctgaggacccagcctgaccccgtgctcctcacattggctggtggctggggagctgcgggagggcagaggttgcagcccccaggggcgctggtgctcttgaccatgaggggtagtgttcccagtgccagctccagcctctcgctgcagaagccccctctgctatcttgcacccgcttgggctggggatcagaaaactggaccccgtagtccctgttgagaagcccaacgaaaaagcctgctgcaggagcggtctgaagagcatccttggccatgcgcgcggtggctcatgcctgtaatctcagcactttgggaggccgagacaggcagatcactggaggtcaggagttcaagaccagcctggccaacacggtgaaatcccg

SEQ ID NO: 101642 - DNA, 1031 bp, Homo sapiens
tcctccgcctcggagctgtcatcctgctgttggcaagttagggcacctcagttcagtgctgtggcccccaagattaaggtactaggaagtatcctccattacagggaacaggaataaatgaatcaaaaagctatcgggcctttttgacatgggacgaataaagtaactaataggcaaaggggctaaatgatttccagtcaagtaattagagataagtcatttattaaggaggcagatggggtattattggtatatagatggcatagtagattgctagtatattggtagattattggtatatagatggtatgttaaggaggcagatggggtattactggtatatagatggtatggtagattggtagtatattggcagattattggtatatggtatgttgaggcagatggggtattactggtatatagatggcatagtagattggtagtatattggtagattattggtatagagatggtatattattaaggaggcagatggggtaattagaggtgagacttagggacagggcttgtgatatggaaaggagtgaagtcactgagtaaaagacaagtttactgtcagcagagattcttagaggctcttttctccgtgattaaaaaaaaatcctaaaccagtagtataataaacttcctgcctccagcagtgctgggtagctggcaggatgactgtgcccagtgatgaggtgaccccagtcagaccaacttaatgagtatcccactaattagttggatgatgtttgaagctgtcagttaatctcttagttcacatcgttcttgtgagcaaagtgaaggaatcggataagctctaaatttcggtgatgctgctgctctgagagaccaaggtcgctggagcaaccgtactgctaaaggataagctcttcaaaatcaaaagggacagatttcttaagtttctagtttgttttgtgtttttacatctatttctaccatacgaaagagtaggatggtgagatgcatttctaaatatttttaactactcagtctggatggtt

SEQ ID NO: 101643 - DNA, 1031 bp, Homo sapiens; identical to SEQ ID NO: 101642

SEQ ID NO: 101644 - DNA, 1480 bp, Homo sapiens
actttttcacacttgtttttcctcctcccagctatcagcaggacaggtattattgtccttttattctgttgtttttttcaggtgagtgagtaaacgtgctgaaaaggttgaacagcctgaaggtcacccagttagtaagaatggaagcaggcattggaactcatacctctgagtccccaaaataaattctaaaacatgagaaaatagcacccctccccgcttcctgtttttcaaaagtgggaaaggtgatctgacatcttttggaaactacagtgttgatgggagtccatctaccaaacaggaagcaggttttacagttttgctagaattgatgatgttctctaagcacttttcagtttgatttagaaatcttcattaggaggttattttcagtggcagacttgtgagacagaattcagtattctcagagaagagtttaaataatttagaacgaattgttttaattcaaaatagttttctcttatgtatacctcattttccaagaataatataattaaagttttaaggagagaaatcgaggagagaattcatgattcatgttatagtctctaaacatttcagtctctttttttctatgctgtgggatttttaaaaacatttatgcatctttcattttgaattaatatacactaaagagaaaacacagtacaaagaagaaaaatcaaagatcatccatccaaacaccagttaatactttggtacatttttttctagttctttttctttgtatagatactttttggcattagtcatatttttaaatccaattctacaataaggtacaaccaaaccaaaataaaaagtacaggaagaaaagcgaaaacacagtaacagctgtctggctggaatattgataattaaccatataccttctctcattttctcccagctacatccgatactcccagatctgtgcaaaagcagtgagagatgcactgaagacagaattcaaagcaaatgctgagaagacttctggcagcaacgtaaaaattgtgaaagtaaagaaggaataatctgtaagttatggatttatttagaagaacagttgcatcttaagtttttggagcaccataaagatcaaaataattttagttttgggttctattcattttttagtcagtgtatttggaagttagttattgggatggtataatttaaagcatgcaggttatagaagtcccctggcctaataaaaagaaagtcttcttgggccctgacaagcagaagtaattggcacattgattttcagttcatttagcaatgcttaggtagagagccatcgtatttgaattaaacctgtttcatttgtctgcacaaatcaaataatttggaggatgaactccccacttgtataattgcaattggagttacataacagtccaagagcatgaaaaactacagttctttacatttttatttcccccacaaccactaatgttctcacaaatcactacttccc

SEQ ID NO: 101645 - DNA, 1040 bp, Homo sapiens
acacgcttgtctgtccacagatttaaaaaagccggcgccgtttccctgaagcgggcgcaaagccaggccctcggggcggccgtgcccgcgccgcctcgcgtcctcgcttcccgaaagcacgcggctcagtggtccttagcgagcggggacaccccggccttcttgcccccgtcgtccccgccggggtaatacggaaggtcgggggacacacgccccgggagctcttggagccaataggtgggcgcggccggccggcccgccccgggattggcacccgcagtccagaccgcgcgcgcccattggctcccggcgccggggggcttccgcggcagggcagcaggggccgtgctcaggggcggggccgggtaggaggcggtgattggcaggtccgcacgccccgcctcttccgcttctgtggtctgatcttcctgcggctgaaccgcccggctgagccgacattgccggcgtcttggcgattcggcccgacgagctccgctttcgctacagcatggtggcctactggagacaggctggactcaggtaggcccaggcctccagagggaagggcttcgcgagccggcccgcgcgcatcccggtgcccagaggtcatgcaggacacagagcagcggccccacgcgtgaccggggttgggccaagcctcgggcgtcgccgccaagatggcgtcgctgtgggcaaagcgctcaggcgggcgcggcctcgacctcgcgtgggagcgcgtctgtgtcctgcctcgcttcccgacggtgcggcccagcacccacagagtgcccctggacacctttgtgaatggcaggtttctcgagagagaggccagctcttatttagcaaacctttttcttctagaatggtgctggagccaggtggtgaaagtagtacagtcacatccacctcgggaaacaggagatttctctccacgtgaccgccgttagcagctttgacctttaatccagcatcgaggtggagccttttacaactttacacattttttttttaaacttttaagtcctgttgatttcagg

SEQ ID NO: 101646 - DNA, 1577 bp, Homo sapiens
tttaattgtagattcatttgagaacatcttttgcatacaaagtaaaagtcagtttatggatcaagccagttgctcaaggcatttgatgtttgctaaataacattagaaaaagccaggacaaaaacgatctgtcatcctgagattgagttaaacttgtcacgccccttgttacttcctggtgtgtcattagttcgatatatgcctttgctctccctcagtaacaataaatgtattggattttttttaagggccgagaagcaatggaatgggtaatacataaattaaatgctgagattgaagaactgacagcctcagcaagaggaaccataaggactccaatggcagcagcagcgtttgcagagaagtgatcgtgacagttggtagacaacatcgggtactccaggtctctccaaactgactatatatttatttgttattttaaaaatacaactatattttgggtagtttttttttttttttttttgataagttggtgtaaggctatgtgacttgatcaaaacagatgcagggcctctaaataaaagggatcatctgaaattaatgttgtttgaaattactatctgattttgagggttccagtatttctgtgaaaattcaacaagaactccttggaaactggtattgatattcagtctccttaaggtagatttttcaagcttttcatacattggaactccacctgactttggaccaaccccagaacagagcagagccacctcctatagacgcccattgccctgctgctgtacacttcagcagcttgcacaagggagctcacttaaaaggagaaattgtgtagttttaaaatatattttgtgtaaaataccttactatgctataaaccaccattaaaaaccagtgttttgatttggtacttaaatatttttggagtgaaaattatcactaaagtaacatgactccaacaaaagtatggtttcattataaaagagtactgtattgatttgcccaagttttgtaacttagtaaaggtattaacttccttggatttgtactttgtgatttagtatgctgtatcgtgggctggttatgttaactgaaaaaaataaagtcattacctgagttttgcagtgctctaacttaaacagaagaacagctgttcacatcttttagcattttacatttgcctaacttaaaaattgccatgtgtcaaaatcatggttttgtaattgctaaggcatgatatgtcaggttatttgaatataattactttttgaagtaattgtgaccacaaaacatcttttttacatgaaggagctgtgtatcatttgaaattactcaaatgatgtcttgctctgaggcataaatcccaggtacttagtgtttttaataatatggtgccactgcaggatttgggggcggtggggaagaacaagcataatggtagggggaggcttggcctgaaactaaccactgagtgaattgcactgcaggttttacttaacgggaattccttatttgggatgtcaagagggcagctgcaaactgaaaaacaatccagtaaatgtactttgttttatgtattgtagcaggcaatt

SEQ ID NO: 101647 - DNA, 1042 bp, Homo sapiens
acacagaaatgagcagggtcagggggtgggcttggggtcatagcacagggagtgacagtggacactgacgtgtgagcctccatcgtaagaacgctgtttttctgtctggagaatgaagctgaggtgccccctcccttgggctgttctaggaagatactgacagatgcctttgagttctcctttttctagctgccatgttgccccaaacctgatttccatatctcagcctcagcgctccaccgtcgcaccgcggcagattcagcgtgctgcctcacgttgcagacgttctcagtgggctggtttctaattgcctccgggaaaagtttttgtgtctggcagtctcctctcatccatgatatgtgaataggcctcctttctgacctttgcttgtttcctctggtttttagaaaacagatttttggttcaaaatattgtaacacattttttccttcaaataaaatattgatagacttggtaagaaattcttcctcctctgattcctagttctgaatgttttacttagcttattggtgcagcaagaacgaaaacatatgtgcaagaacattctgtagttgatcctgtagagaaaacaatggaacttaaatctactaatgtaagtcttggctcccttttgtttcatttcgaactgtctggctgagttctttgtccctctcctagttgccgtagaagtgagtgcgtgttcatgatgtggttcagagaatccctgcttatgtgctggcctaacttggccctggatgttgcttccttacccttcctgctctcatgatcttgcctatctctaaggggatagcactcaataaaatgagtttgggattatgtgtattatcattattatactttatttcctcaactttgctttttaaataaaaagtaggcagtgaatagtttatgcaataatagcagcggtttatttgttgttttgtatgtttagtaagattttggcttgtgtgttgattttagcaacattttgaatcttcagttccaaaatgatttgatcttttttttttttcttcattctgta

SEQ ID NO: 101648 - DNA, 1019 bp, Homo sapiens
tcagggtgccggcaccatgaagatctggacttcggagcacgtctttgagtaagtttggggcgcgggtcggctccgtggagggcaggcacgccggccctggagtagaggcgaggcagaggcggcccgcaggaggcttctaggcgtcgggcctagcgaggggagcgaactctgaagcctgcgggccccggcgacacggagggcagaccaaggtcacgaccccgaggcgccctagccgaggggacggctccgacctccagacccaggcggccttgcgaccggcagggctacggggtcacttccgggctgtcccccaccatgaggtagcctcgggccggcggcctcctgaggtcctgggggcgtcgcggagcacgaagcccttgacagcactcagggttgccccatcccgccctgtgaaaccactttgggacgtggacccgaggatcccaagagggaggtgttggttttctccagagtgtactttccctggccgccgtttgggtggagtttctaccttcgaatgtgaatttcgggtgaactctgaccaccaggatgtgaagccttttcacaactcgttcatctacgcagcagagccttggatttggaattcaaggtctagctctggctgtaacaagcgtgtgaccctgggttacccattttcatctgagagatggaaaaggacgatcgtcagggcctacccgtgttagctctttgaggccacgttcaggaacatctttttggataatgtgaactgtttactaacgaaactaagccttgaaccagttggatgtggagaattatattctcttctaggtccctgattccatttacaaaagagccacaaatttaagcagcgaaatccttttttttcccgagttacctgctctgttccgctgatcttaatgtcgttgccacactgttttaattagtatagccttgtaaataaatatgctacaaagccatttatgtttttaaaactgtctctgaaggcaaattttttttaaatttcttttttgaggcag

SEQ ID NO: 101649 - DNA, 1032 bp, Homo sapiens
gggctggcacttaaaggaggtcacttgggagggggctgaggcagagagtgtggctgggtttcttggtttcaatgttgcatttcaatgttgagtcagataggaccccagtgcaaatgccaagttttgggttggagcaagggtcccggcacccaaggaagaaccaggctgtgtgcccacaactctttgggcactgtgatgccagacctcaagaaggtccctttgacttcattccttttggaaccaggaggatctgtccagctgccacctgaagctcagcttccatgatttgtgtggctacttcccggagcttgcttgggaatcttaactctcacccttaaagggataatgtgctatttctggggccagggctgcattaatttaggaacaaattaaccactcattcttccagacttcgaagtctgatttcgaagtgctgactcgtagtgggttatttctgcactaaatgagttttttttttttcctttaaaatttttgtttgaagggaaaggcgtgatcaatgatatcatgacatgtcccagctgatgctcattaaaagttgtggctttaggggctgcaaaagacagtttgaaatttaatgccttgtttcctggctcagctcagagtcggggctgggcaaggctccctggaggctataactctgaagacccagattgggtctggagttgcccaattcttttgaaatcttaatgacaaccagctggacttagcaggcttttctggtagcaagtgactgaaatggactagacacacagaagcaaaagggccatctgttaattcaggaaactgggcgtctgtagctccagctagcctctccttgtctgtcccagactcagggtgggtcatatagctggcccttgaaccacttactggagtgagggagtggggaggactggacggctgagacctagctgtctcctccggtccagaaatggagctggcatccccgccatagccagcctgagacttccagtaggaaatcaggaggatcgcagaaggacatgggtactgggg

SEQ ID NO: 101650 - DNA, 1124 bp, Homo sapiens
tgtgtctctccacttacgagtgtccgaaacagctgtatgaactgcacattctccgtcttccatgactaaatccccttaacgaccctaattcactctaattccagtaacaaggacgctccagcactggaggcttggtgcatgttcgatttctatttttattttaatggctttgctatctgtgccttttcctataatccatgacaaatcatgataaattaactccatttttttttttactgtttggttaaacattgggatgataaaaaataaggcgatattcctcttatttgtagattactgtgatttctgacctagagtattgtggtcacgggtgaaagtgcagaatattgtacactgatcatttgcgtttgcttgggagtcactgcagtgggggattggagaggagccactctgcagtcactggacagtgatagtcacaccagccaggtcctgtcctcagtcctgctcactcatctacacatctctgtgggagatgagctccacttggtgggaccccatttgacaggtgaggaaaaccgaggctgaaagggacagagtaacgtgcccaaggtcacagctgctgagccgaatttgagcctggacagtctgctggattcttggtcgttctgtgatcctgtctctcatgaacctggatttatattatatcccattggttctggaaagtgtctgacagcaggtcaatgcttgttgttactgcctgctttggaagcccttaaaagatgccccaactctggctgtccttgtggggtgcctgtcttggaaatgagcaggctgctgactgaaaagagcctttccctgtaggtgggatgtggtgccccacaggtgggaccccgtgtgccctacaggtggacactgggatggttctctccacctgtcctcatctgtggcttcttccctttgttagagtcttgagttgatgttggatatgagcgcacctttcttccgaggatcgtctaagcagggtggaggagatgcaggttgcacagaggtgggagaaggacccttggggccaggaggcagatgtggggtgtccccagctctgccccgagtcccagtgtgaccttgtacatgttcacccttctctgagcctggctttcctcgtg

SEQ ID NO: 101651 - DNA, 1035 bp, Homo sapiens
gttcatggctggtcaggaggatcacaggagagatgtctattgctgccagaacaatttaccaccaactcagcagctaaagcatcaccgatttattgccacacacagcctgtgggtcaggggtgcaggtgggcttacctgcttccctctctgggtctcagcagcgctgtgctgtttgccagatgctctgggagagaattcacttcctgctcgttctggtggttgtcagaattcagttccttgaggctgtaggactgaggtccctattttcttgctggctgtcagctggagctggggctggagccggggctggggctggggctggggcctgggcccgggtcattttggttctcagctgtagaggccactgccttccctggctcacgtctaccttcaaggccagcaagggtggctgaatcctctcagccttcaaatctctcctccctcccttccaccctgtccactcctgccttcccctctgcttcctgagtgattccatgaggcccatcgggtcttccaggttcatctccatatcttcaggtctcctgattataaccctgatcccagctgcaaaggccttcacattggtgcctgcattggtgcttgatcaggtcaccgggggtcgggagtcctgagggaatgaatggctctcaaattctgctgtccttactgtgggtaagtggctgagggctgcttggaggaacctcacagtaaaacagacaacctctcacttaaacagcacataaactcatatgtgaggctctgatttgtagcagtaatagtgcacaggaagttttttcatttattacagatttagctgcagggtgcttttgataaaaagacccggttgaatatagttaaaacaaatctgggatccgcccccttgctgagcatttctgtcgcccctgtcccagtccaggctgccccatctctccctgtccgatgcagcagccccgtccccctggtccctggggccatctctgctgtcgtccactttatcctctatctggcggccccaacacccttccaggagaggtc

SEQ ID NO: 101652 - DNA, 1119 bp, Homo sapiens
cttggggtgtcagggggcaactacctcttcatagcaaagcttcattcgttaagttcctggttctgggctattgtccctgtctccgaggatcagagaggtgaagtcccctgcctgggttcagatggttatggagtaggggtcctggttcagacccatggctgtctttcttgccagcagcacttctttctttggggtgatttttcccccaggggacactgcagtgcctggagacattctggttgttataactggggtggagggtgcttctggcctctggcatgtagctgtcagggatgcggctaaacctcctgcaatgcacagcacagcccccaccacagagaattgtgtggtcccaaatgtcaccagtgctgaggctgagaaaccctgcaccaggcccctccccagctgaccctatgttcctgcaactaagccagcagtagacatacctgcagcagcaggtgttggtgctacaggtgaccctaggtcctcgacctccccatctgtctgccacctgggcctgggcctgggcccggaataaaaggtgcaccaagggtccctggcttcagcattttttgttttcaggttgcatatcagactccttcttgcctcctgaggtcccttgggacttggctccaggcagcctccctgatctaagacttcagcagccgcctcaggactctgcatggccaaggtcccctctgccccaggtcaccaaggtcattgtggtagggaaggagaagagagggccctaagaaaaactccagtcccactagttcctggaacttgcctaaggccaggagaagttgctgccatcgtgggttctgtatatgggattcaggactttggttcaggtggtttctgccaggctctggccagatgccagcctaggcagtgtcctggcagtgctgagtgacacgtctcgggcacagagaggagtgggcgcctggccctgagcagaggggaggcttgttgggggccagcacttgatccactgagccggaccctcagaccctgggttgccctcctcacccccacccccacctcatctctgcttcctgcaacatctatatttaaaaatgttgacagataataatggtgttcagccccaaaatgcagaca

SEQ ID NO: 101653 - DNA, 1082 bp, Homo sapiens
cagtcccagagccaccatttcggttgtcacctaggtgcaactctcagcagaaggaagcattcccaataagatgttctgaaaacgtactgccgttgaatctcacaactttcaccccacaagctgcaataagaggccagtatgaaaatgcgctctttcttccccatacattttcttctgttcctgagccgagcccataggtagcttggcagtttgcaattctctgtctacacggaatagatatagatttttttttcctgtatgttttgggtattaactctttggttgccaagctgttgagccctgagtctatattatacaccttcagcccgtggcttacagggcttcaacacatcgttgttatataatgcagtagttttgcttgtggggtgactgttcatatcgtggatgctcagaaaattctatttttaaagtataaaataccactcttcagagcagcctgctcactcctgcctccctgggagccacacgctttgcaccgtggagttgttggcatgaaggcacatgacatatggatgggagtgcgttcctcctgtctagggcctcttaggacccgaggaatggctggaggcagtttctctccagtcctgaggttgatgatccgaagctcttggtgctgagcctgtgctgctatttttagcttcctttcttccctgcatcttgacataattcgacatgtcgcagctgaatctcatctacttgcagagcttaccgtgttttgtaatctgtgttttgtggggcagaaatagtccttgccagagcatattatatcattattattcagggggaaagttatgatactatcaattaactttagaagatgcaaaacacaattgatcctttgattttctttctactgctaatttcctggctgggagcacctggagggtaggcactcctcctccttctgccggaccagaaggcagcaagcagtggttctcacatcttgggaacctgtatcagaagcacctggaggggctgttacaaaggcaattgcagccccactggcagagtttctgagttagcaggtctgggtggggtgggggggcaagtaatttgcatct

SEQ ID NO: 101654 - DNA, 1037 bp, Homo sapiens
caggctgacagtgtggctctcaccctgctgccgtgggagcctggtctctggcttccgtgcctctgacggcgacatcacacacccgcaggcttacagaatcactttagatcagggtcggcaaaccttttctggagagggtcagatagtgcatatttcagggggacgtgcagtctctgttgcaactacttgtctctgcttttgtagcgcaaaggcagccggagacaaaacatgcatgagagggcatggctgtgtcccaagaaaactttatttatggccactggcctttgaattttatataattttcatgtgccacaaactattatttttcttttgatttttttttcttttgtcaaccatttaaagatgtcaaatccaggtgggggagctggattggtccccacattgtggtttgctcatctctaccttccatactctctctcttgctaaatgattgtggaccagggactagagtggcctgaaacacagtctctttccttgagagggaaaatgcactcctaaattgatgccatgacattttattgagggcccactctgtgtcagggtctgtgctagctgctgaggacacaggtgagcaaaatactgttctgaacgcacatccagtggggccattaggtaatcccacaaaaagccggcaactcacgaccacagtgagtgcagtgaaggatgcagcaccctaagatcatgagacaggacctgacctggttctcggggggccgggagatgtttgagtcaggtccaaaggtgggcaggaggacctaggctggttctcagagtctgttgcatattaggatcacctggagagatttaataaccctccaccgctcaggcagcagttaaattagatgcgctgggcgtgggacccaggcagcagtgcttcctcatcctccacagctgattccgactttgatgcaggaaggttgaaaagccaagagacagaaggaagcggggagtgacttccagcccacaggagcagcaagcacaagtccccgcggtggaagggaccttgagatggtggg

SEQ ID NO: 101655 - DNA, 1059 bp, Homo sapiens
agagtactacagcccagacctttaacccaggaaccatgtcttctttcagtagcagcctcttccttcctatcgtgggcaaccaggtcttcccatcagcaagtacttctaattgtgttaatctttggaaataaatatcagagccttagaaatagaactatctttggtgaatagggagctagcaaatgcataactgaaactgactgcccttaccttcagtgcatgaaagggaaaatgggtttcctctgcggtggccatggcaatcccgccataaacactgtgccttcatcagtgaatgtaggtttgtccttagctcggaagccctctctagtgtcctgagtggaaggacctgagaattttactgctaggtttgtggtgggtgtttggttttacttttgttctgtggagatgagaatagggtaactatatatagcctagtatgaaacatcatactcataggctctagatacacaggacttcaagcactcatactgtattgtattttcttcttgtaaccaattcttagaatatcacttttgtatttgcttcaagggggaactcatgactaactgcagtcatatctgaggagcactcaaaactccgcccatataacactataacgtggatagaaaagcagaagagcaggggtccctttatatggtgatggtaattctttattaggcccaatctgtgccagggactatattcagtacttggtatatattccctcatttaatcattgcaacatatttgtgaggtttgcactttttaataaatgaatattgggaaaaggatagcactagagttcaaccccaggtctgcctaactccattgcccatcttcttaactactgcatcagaagcagtaatacatttctggatattcatggaagtctcaggtataactgtccaagctgctggagctatttccagaaaatatgagtatagcagtcctgattatgggtcccttgctttgtataatgcagagggtgttctgggtctggaaataagaaatccataaacatatcactaaggggagctcagaaggggaggtctgtgggct

SEQ ID NO: 101656 - DNA, 1052 bp, Homo sapiens
gattatcaaaaacaagaaaacaaaaacattttgattgttttatttatgcaactatccaccttcctattatgaattttcttatggtctttcagctatttgtaatcatctaataaaagaaatgccacgtttagtttttttaatatgtatactattaggttatacctctctggaaataagttgttttgatttaactttgaattaacaacatcaacaccaaaatacaaatatcattatctgatctggttttccaagtgactttcttggataggttattaatgccatcctaaattaggatgttaagaaatgacaagttagttttcctgttttgggttttgtttttttttgttgttgttgttgttttggtttaacttaccttgcatgacataatgagatgtagtatttcttcatgcatttcaaacttttttttatagattataacaaatcatcaaaagaaaaatctgtttagtgatactgaaacagagtacagatgtgatgacagcaagactgatattagctggctaagagaaccgaaatcaaaaccacagctaatagactatagcagaaataaaaatgtgaagaatcataaaagtggaaaatcaagtaagaaattatcttttggataaatgttgcaaatgattttgcagtttatttcaattattgaaaatgctttatataagcttattgtatttagactgttcattactacatactttcatggataggacaaaacactagtttttatgttttttgttttattttagtaatacggttatatttatttttaataggaccttagggacacaaattatgacttatcattatccttggctcatgattttcgtcacttgtctactcatggcccagtattatccagttatttagctaattattgtgaataatataccaagtactcatgaacccaacacctttaagaccaaggcttgaactttgacactaatctatatatatttacatgtatttacatttgtgtgtgtgtgtataaaataaatatatttatatgtttgtgtgtgtgtgtgtgtatatatatatat

SEQ ID NO: 101657 - DNA, 1192 bp, Homo sapiens
cataattttcacataagtaatcgctttcagtaaacgttgactacattaaaaatcaaggtcttaaagtcacaggctaatgttttgtaacattaagcaaattaatttattttctagattacctggtgttttagacaacatctgtggaaataaaatacacagcaaatgggcatgttggacacctgtaacaaacattgaactatgtaataaccaaagagcaagtacttcgtcaggagacacattgaatcaaggtgaaacttagttttatctatatgtaatagttcagtgttaatttcctcaaatgtctaacaagtattaaaacaaatttaacaaattttacatatgtcaacttattaatttaaaaagaattaatttctcattttccccaatagatattgttataaataaaaaacttactaaacaaaaatcatcctcttcaatatctgatcataattctgaaggaacaggaaaagtgaaatataagaaagaacaaaccgaccatatcaaaatagataaagcagaagtagaagtttgcaagaaacacaatcagcaacaaaatcatcctaaatattcagggcagaaaaatactgaaaatgccaagcagagtgattggcctgttgaatctgaaactacttttaaatcggttctcctaaataagacaattgaagaatcgctgatatataggaagaaatacatattgtcaaaagatgtgaatactgctacttgcgataaaaatccatctgctagcaaaaatgtgcaaagtcatagaaaagcagagaaagaattgacttctgagcttaattcctgggattcgaaacaaaaaaaaatggtgagctttcaatgtgttttgatttctgcatatccataagatgcctacttgataacataagaaagaaagaaacttgattaattgctacacatttaacatgtgtaataccttgtttaattcagtgcccagactctcagaattcctcactcacctctcccttgtcgtagctctgatagaacagtactaggtgcatatcagacatgtaaatatgtgtagaattaatgaaccatgcagttcctgtctcttctttttaggttcctcccactctttccttttgacttggatatagaactgtttgtacatttcttataattcctacctttctttttaataaatggtttttttttctctctttgactgtaacca

SEQ ID NO: 101658 - DNA, 1048 bp, Homo sapiens
aacttttaaaaaactactagcgctctttgagtttgaaactatggttaccactttcaagcaattgttaattcttagtaccttcaaaggtcattactgtgaaagttttatgagcatatatttgcaaaagcaaataaaacattttctgcttgggcaggcctcataagaatcaggacatttcatagcctataggacatttgtcccttaggccacatcatggcgtggcctgcagagctttttcagatgtagagataaatttccctactttgtgtgatcctgctccttcagagtgtttttctcttgcccgaaagtacattgtgggcagggttggagacttttcattcagcaatagaattcctgccacaagtaggacacgagcatggtggcctctggtctataatacaggtgcatttattaggggccaggtaattttttggtaacttttgtagggagggagagtgtgactatttcttataagctggtacttgctgtattctctgtttactggattggtaagttcattgaggccaagtgctagatccttctcacctcacaatctcctgacacttaatttttgtcaaatgttgtttattgtcagcatgttataacaactgtggatttaatagaaatgtttatatgtgtatgtctagaaatatggtaattatatggaattaaagttattgtttttgtttgcctttttttaaattaagaaaatagtattctcagatgtgttcaaggaatattttattaagaatttgttagagtccagaatgtatttaggattctatcttattagttatagccatatcctgtattttatagataagaacactgagactaggaaagctaaattgacttgattgatttacataggtaagtagtgccagaattgattaatttaaacactgttcaatattgagaatttgaattttgattcaattaatctgctacatccatgtcttatttatagtatacttgcagagtagtatcatagaaacgtaaactaatcagtgttgtttctatacagtgagagaatcaaagaagctactga

SEQ ID NO: 101659 - DNA, 1004 bp, Homo sapiens
gtgtctaatattcttcatattgatggatttgtttttaaacaatgtgtttattaaaataacttaaaatttattttctaagctttttgtgaatgaattttaatatggtgatttacatgtagaataaatcatggtttaaagtactctgggataactgtaaacatgttacacaagaggaaaacagactttgtaacttacagacaactgtgtgggttactttgcattttatatctctaataataatgaaatggcagtgtctttgaatatttagaagtctcaacatttttttaaattttacttatttcttctgttggcacacttgttatttgggctgtgttaattcctcaaatgatgagatatttctaatccatatgaagaaaatattaatagattaatcaattacattaatatattcttatttctcttgcttattctaataccttgtaaaatatatggtcttttataaacttaattttcataattgtaaatcaaacattaactatttttttaatagattatgacttacaggtaggcattgtagaagctttgtgtagaatgaccacagaaaaacaaagacaagaactggcacatcagtggttttcaatggattttattgctaaggcatttaaaagaattaaggactctgaatttgaaacagtaagttgtataacaataacagaaattcgtgaatttttaaaaattattatgatttttaaaagtatttctctttaaaattaggattgcaggatatttctcaaccttgtaaatggcatgcttggagacaaaagaaggtaaacttaatgcaagatacaaccatttactgtcaaataaatagagctcaagagtgagcacccagtgttgcatctttatacatttaactttattcttgttctctacactatgttggagtgtagaatgtgcatagataatttaaaacaataacatgattttagcaaattactacaccagtaatctgaaataattctgcactggccttgttttatttt

SEQ ID NO: 101660 - DNA, 1048 bp, Homo sapiens
gctggcgcaggattcactcgctgtttttattctgcttggtgggagtctccaaccatagctgtttctagttggccatcttggccccagaaatgctctttttctagattttgggttatcagttggggccccatcttaaaaaaaaaaaaaaaaacaagtggtgctgatacttatagcagaagactttctaaaacagatttttctactttaacttgccattttcttcaggccagaaaagctgagacctcagcactttgcaggaaggaaataggtctctagtgcatcccggagacccgggggacgaagggctctatgagttcacatggtttcaatatggtgatgtcatgtggcacagcaatgtcccctgaacctatgccggattggtttttaacagtatcatcaaacagcacatctaccaggactctttaggttaaaaaaaatccagctcaaactggattagaaaaggaagaggggaattaattggctgcaggcatggcagatccaggggccccaggtgacataaggactcactctgttccatttctcactcactatgttggtttcattttctaagatgccttatactcagcagtctctctccatgcaatgacaaaaggtggccttcagcagctccaggcacacagcctcccagctcagcaccctcaccagagaaagcacagatccagcaaacaattagaggatggcttcatttaattgcattaggttatgtgaccatctctgcactcattcccatgattagatgtgaaaactattcttagaactagcctgtgggtctgcaccatccttaccacatggtctgagagtagggaaggggtgaggtccccaaacaaaatgatgacagcacacctggaagaaggggaatgcttgctgggcagtgaagaggtgtctttcacattaaggctgagaaatggaaaattaatcggtgatccaagtgaggctcaagaggaaattctccctactgcctattcaattggaattcccctgaggttggtgctcaatgaaactttgttaaatatgttaaatgaaataa

SEQ ID NO: 101661 - DNA, 1107 bp, Homo sapiens
ttatgtctgcatcaatccattgcaaatggaaaatttgtaaatcaaaccatagtaagtcgaggatcacctatattcatccaaagataaaaatcacttacaggcagcacctgaagtcctggtagttttatctttcattttctgagtgtgcagtacagaataaacactccacacatccttccttcagcagcaaacccagtgaaatgcaaataaatggagacgcagagtagattcgtggtgaaagcagggcttggaagtccaatggccctttctgttttgtgatcaattctagctcagccactgcctggtagtgtgacttggggcagggtgcccacctctggaggacctagttttgcacacctgtctcacaaggtggaagtgggtggtgggtgggtcaataaagggctgatatggcatagaggcgaggctctaaacaggaagcaaggactttcccctttacctggagcagctggtagaagagaatggatatttgaaataaaaaccgtggagcctgcaataatttaaataggcagagcaaaggagctactccctaatcaatcttttatcgtttttttttttgtctttccctgagagatatggaagtaaatttggccattaaacaaaactcaacacttaatggcactttaatcagttaaagacagtgtgtgacttatgatcccattttgtctatatacaaaatatatgcggtgggtgaagttactcttgtctgtatccgtggatgtgtctgtatctgtatattagctcttcttctatgtatattgaatgaatacctgcctgaataatagtgcttatttttaagtcttgaaattataattcaatttaatttttccttttgcataacatttgtttctactttctccagagttaatatataataatatataattataggcacaataataaaaaatacaatgtgttaaaataatatttatggagcataacaacttagaaaatgtttgcaatgtgttaatagaagtaaccagttgcaaagctgtctatccactctgattacaattgttgtaaaaacaaacttaaaaaaatctgtaaacagaaaatagatcagaagggaaatgcccaaatgctagtaaa

SEQ ID NO: 101662 - DNA, 1037 bp, Homo sapiens
cttggcctcttcggccgcaaccgggcggctccagacgtccaggagggcagaggctgggctggtgcggcgcggggggcgcgggcgcgggctctgcgcctttaaggcccgcgtcggcagagcgagcgcaggggccgggcggcggggcggggcctcggcggggcggccgcggcttcacctgcagctccgagcgcgcggaacagaggcgcgggcggctgcgaggccggcggacgcaccggcccgagggaacgcgccgccggccggacttggcctggctcccggagccggggcggcgagcgcggcgggcgcagcggggctggaggctccgggcaggcgcgggggagcggcggcggcggcggcgatcggagcggcggcggtggtctcggcggcggcggcggcggcggcggcagggagcgggctcccggtgccgggcaccgggcgggcggcggggaagatgaccgcgggcgccggcgtgctccttctgctgctctcgctctccggcgcgctccgggtaagttgccgcctcccgcccccgccgttcggaagccccgggcagcgggaggtcgtccccggatcccgcggggcgctcacacacccggcggggctctcccgggctcccccgccgcgctccccgctgcatccagcccggcgcccgcgctcggcgaagctgcctgcggtcggcaggagcgggaagccgcctgggcagcggggagcggcggagcagggtgggagtggggctcggtggaggacccggggagctccgcctgcaccggacccgccgagcctccctcgaacgcccaaagcccgtagccgctacccggagctcggcttgcctgcatggggcaggcttccactggcggagccggcgcgccctccatcgcccgggagccgcgcgccgcgggagttgccgagcccagccccggccgtggctgaaggcgtggggcgcccggcggctgcgggccagggatccgcgagtgcggggcgcctgcccgacctctcctgcccaaggcctgggggtccgtctagcggcgccgctcagt

SEQ ID NO: 101663 - DNA, 1032 bp, Homo sapiens
attgctgccatgcttttccttggggaaacatgtagatgggagaggcaaggcttgcctcatctttgtgctctctgtgaaatgatggtggtgaagtccacgaggtgcaaattggttgacctgaaaggcgttttgcataacaggtgaatgattcagaaccccggtcatttttgagtgaagtgaatcatttcctgggcagcaaactgtaattcggatgtaacatcacccaaatagtgtgcagagagagaccttcttaccaagtatttttatgcatgaagttctggatacttaaattatccctgctttgaaatgtatgataaagcagacgatgttgttggaaatgcggtaaataagcccacagacggtctgttcacaaatgtggcattcattttcattactgccccactgacaacacgaaaacacacatgcaggagggaactaccaattagctttatcgtaattgcaggattatatccacacttgtgatgggaaagtcagagacagcttcaaaactcagatgacagtagatcatcctgcttattggtctgtttccctttcaagacaaactaattagactttatatttgcataggaggggacataaatcagttctgtgccatgagcaccttggctgtgagcctttcctctctgcatcagtttcctggaagtggcagcctttgaattgatttcaaagcgatagaggaagaggacttttgataaagtatcgaagctaaatttccacattcaggactgttgactgccctaccggttttgtgtcccagggaatgtaaacttttccctccagaactgacagcggttcctgtgtatgtgtgtgtgtgcatgcatgtgcgtgaactcgctcacgcttatagtgaagtgatttttcagatcctcgcccttcaagacagaacttgttgacgtgccttgttgattcctggttatgtggataggatttttattttgcaccgaatccaagttttctgacttagtttttttatctaaactgtgatactactgactcattaatcatcaaaaa

SEQ ID NO: 101664 - DNA, 1174 bp, Homo sapiens
aagggacacggtcatgtgcctgcctaatcctcttcttccattctgccatctttagtgtgtcatttagtgcctcgtcactgcaaactggctgctgtggttccagtcgttgcttctgagttcagagcagaagaaggtgcagatagtagcaccatctgcatttcttccctgtaccaggaagacaaacactttctcagaatccctgcagaagttttcattgactaggtcacaggccactcttagctaaactgatgggggtggagcactgggaatgcagagaattgcattgtcatgtgtgtcttagatccattataatccatcacatggtaggtgtccaaattgctcgtctcagaacagaattggggctttgttttaggaaggaagaaggagggatggatgctgagtagaccttccccagtgcccagtgctgtacccgaagcagagttgacagacagtgaattgctgaatgagtgaatgactcatttgcatacaaaggcattcagacagaggcatggttgaagagagatcagatgcagtgtctggaatccatatctaagaatctgccatttctgccacactgcatggccagaagtactattatcttgtctttacaagtaggttgaagataggctctttgcccatgcagtttggtttgaaccacctctgcatagataggcaactcttccagggcagacacatgctagatacacaggcaagaatgtcatcccatctccctgcatagccgatgtccagcaccggcctaatgcatggtggctgtgaagtcagtattagtcaaataaagtaatgaatgagccggaaaatactgacactgttcgtgtttccgagtcgctttggttaactcacagcagacagggagctgctatgaatattcccataagtggcactaatgataagccaaccacatatgcctggaattattagacactggaagttgcctgtccagtattgattctctctctctctctcccttgccaacaaacctcatctgtgctagtccattggctgacaatgtgccctgtttaatacacctctagactcatttacaccaatgtggcaatgtggcttctttctggtcaccggtatctaattaggttagtctattaggttaggctttggggaaagctgtttttattcttgataacaaggaacaaactga

SEQ ID NO: 101665 - DNA, 1007 bp, Homo sapiens
gttcagaaagggaagtatatatcctgtctttagaaagtggttgctatcagataaaaggtaggagcggcccaggaataaagcacagaaagcgctgcatggtgcatcatctgcaggccaaatcccactctgagagagggtcctggtagccctggttagaaataaagcgaggcagaacactgccgccccgggctctgcacagccacttgcccctgtgtgcagctgcttctcacagctctgccttccatcgcaagagggagctgtggtcagtggccctgctgctacccaggaggaatctaggctcaaggaggtggccacacctgccccagattcctaagtcagtggttccttagtcagtgattcctaagtcagtgattcctaagtcagtggatcaggattcccaccctgcaagattcctaaccgctgcttctctatgctcactgccactaagcagacccccttcattgtagaaggcagtgcatgcaccagctacagaaatgaggatgtgtgaactcactgacgctgtgacttaaagattcaggttttgcgtttgagaaatatgtgttttaatgagtcttcagatgagggagcatgaggctttgcagaattataatataataacattatgttctgtccagtccttggtatacgatatctcatttaactttcacaaaagcccttccagggaggtaaaattgttctcattttatggatcagtaactgatgatcggtgagttctggagattggcctaagggtaggagatttgctctgttttccctctttgtgcagtcctaggcacttagctcattcctatctccaaattaatgttaaagaagatggttttagagcaccactgtcacgtgcagacaggatcggacccagatgttcagggccacagccataagaccagcagtgaccaggcacacaggtatgtgcagtaaacagaggccctcagtgtgtcagaaagtgcttggttgcagttgctcatgtataaggctcaactgaagtg

SEQ ID NO: 101666 - DNA, 1094 bp, Homo sapiens
ggagagcctggcttccgaaataattgctgatcgtgagttaatttcccagtgccctttggggctggcatcctctgctgtattaaatccagcccattgacaatggcgctccttcttcctaagtgatagaagacagccctcagcatccagccctgctgagtcagcacagcagagaggacagcgggctgtctttgtcatttctttgtgagcagaggattaaattgccctgtgggctggcacggagccacaggccgtggctttgcatcctacaacgtgaggccccggcctgggggttctcaggtctgtgctcacatcccaaacatctcccacgctctcccccggcctcttcttacagcggtgcgtgaagccacgtgaactgaacatcagaatttgatttttccaccccaccaacctggaggttgtgccttaccctgggcaagtgagagaaggtgcccctcacgagatggttctgtcacaacgccatggtcctggttttgcctttttgcaatggaaagatgaaaacgaggtgtcgctgagctctcccctcaacgtgccaagattctgttttcggggataggctgggactccgggctgacccacatgggtttgcacgtgctatgtttaaacaaggcagctcgctgattgggggcagggtgggcagggagccgtgtgcatggaggacggccagagagagcgggggaccgggaggcaaggcgctgctcttgtacttggtggcttccttctttcacttaaaattgtgtcattaatggcttttcctccttttacaaaagaagccccaagaagagttttttcatgccaggcctcctcctcctcctcttggcagccccgaggctgcagcctgctggcactcaggattgtcagagacatgccccattgttggattctaaaaggaggattctggaaggatatcaatctccgacttgcacataaaaagtcccccagtggctttctaaggttgtggcttcaaggaggcactaattaatcacttcctccagccccagtggaatggaggggctacttctgagatagggaggctgcagtcgccccctgtctatctgctcctctctgccaggcag

SEQ ID NO: 101667 - DNA, 2598 bp, Homo sapiens
accatgcgcagtttgggggagtaccatgcgcagtttgggagagtaccatgcgcagtttggggggagtaccgtgtgcagtttgggggagtaccgtgcgcagtttgggggcgtatcatgtgcagtttggagtactgtgtgcagttcgggacacctgactgtgcttttctgaaggatcctggattctgagtatcactgggggtggaagcaaacacttatctactgatttgctaacatattgcactgttaatctcaacttgccttctcccagtggaactgctcttggtgagactgtagcttctctctaggaagtgatttgatttttgatgtaaggaaaaggattagtgtggctggattttgataaggctggccgcctggcacatcagcgacactctcatcccatcagtatcactgacagcgggttcgttatgcaggagcactgcagagcggtgatacgggacgtgcagagataattgtagttttgctatttaaaaaataagtctagtgctttacaatgtttaagtgataacctgtttagaaaaactcacagtgcctgtcttttggcacagaaaaacctcttctagcagcttgacttggattttattaatctatttttattttcctgagtataaattgaagtctcatttctgtttgaactcttaagctagaacttaagaccggaagtgcacatttgcactttcaaactcaacatatttccaggggttttatagcaatgttgggcttatgcctttgcttttcagtgatctccagctttgagattagatgcacttggttagactcaatgtaagtagcttgctctatggtgggtgttttttgatcaaggtgctaatcttggtgtttacctggggttgtgagaagagaggattaggaggccgcacttgagcagtggctaaatcccatgctatgtcgctgctgtctttctgtccccaccaggagaatgacagggccgtgcctggcatccctatgccattcttgggatgatgttctgtgactctctcactggctttgctgcttctcttgtggccaagtcagctgttttgatgggatggacatccatggaggccaagaatggtggtcctgggcagtggagattccatcactgtggctctaagaactccacggggtcaggggctgttgggcagagggaggcacaggagccagcaagatgctgcacttttcatgaatggatcacattgttcattgctgttattggggttttacttcctagacacctgtgggttcctggatatcaaagtagttgtagtcatctttgtcccattcagcaggggatcctagagactctcaggttctctaaaagctttgaaggctctgctctatgcagattaaagtccaagtgcaccattccaggccctccatgcagtggtccccaggcctctgtccctttttccctgtcacacgcccacccccttctaggcaccagcactggtctgcctgctgagcttgctagaacttgctagcccttccctcatgtgttcctttgttttggctgccacctctgactggcttgccatttcccctgtgggaatcttccagggcttctgaatttaagagttactcctccactgagccctcttttgcgtcctctcccttcccctctacctgagctaagtaagatgaattatttccacctcttttgtctcagttttattaaagtgtataatgatataatgtttttgtactctcttctgcgtcttcctaaattgtggccttgttgtgactttgtgtgtgcgtgtgtatgcatgtgttagatagcagcgagagaagtgtgaggggtgtgtatgatggaaatggggagagagaaaactacctcagtgcactcacatgaagccttcttcccaggagggaatcttcataatgaaaaggagaggagccttctcccacctcgtggagggggtggcagtggtggaaggctggaactgacaagcaaggaaatatgaaaggattataattggaaaaagatgggcataaaatgaaaaagccaaagtatgttttattttgcacctgtgtattcgggcttgctcggtttatttattaagccgttatcaaagtaaagtaagacaagtgagtcttagtctaatgaaattgcccctctgtgggccatgttggcatcaggtatccagagcataattggataacaatgacaattactgtgtcgggagtttcagcactggacggcctccgctttcctgtgctttctgtgcggtgtagctcatgagcgttctgatggagcaggggagggccggcttttccagctctggttccgacttggaactgcagggtgggtgccgatcgggcctaatgggccctcacatctcagcccctggcgttgatctcagattcagagcctgcgttatggcccaggtgaaaagcacgtctgttgccatttgataaactttcactcagtggcagtttgcctgctccgggcatctgtgagccaggcaattgtctgtcttggggtcagggggccaaggagccccacctgtgactcctgcttcattttttaaagtatggactcattgcttctcctgccagccatccttccctgagtaactccattgc

SEQ ID NO: 101668 - DNA, 1383 bp, Homo sapiens
accggggcttcccattgtcttagcgtgctcctttcatctaatgagcaggcgcccttggctgaacttttcaggaatccgtggggaaccagagtgaatatattatggcgctgtggagcgaatgacaatcgggcagtgctcgcctgtggccgtggaggtatctgcgccaccgcaaaatgcctcacccttcttttgggttttggggtttcaggtcagctctgggggcccgttatcccgtgtcaaggaggcccacgcaggcacccgaggaaggctttggctatcacgaggtggcctttgtgcaggcgggttcagcaactttggcattcattggggcagcctgttactggtgcttggagtaagtgaagagtgcgattgggcgccagagctgacctggcagggagccgggtttccggcctgtgtcagcggctgcctaaccgtggacaccagcacgatgactcagtcctgaccgctataagcatcccggccaccagctctgcatcatcagggagatcaattaaattgagtgtgtgtaattctcggggattagacggaagtgcacaggcttcattgatccactctcctagacaatcagcaggcccctccaagggctgaggacccaccactcagcaggaagcctggctcacttctcccccacaccccttcctcccgcacttccccacgttcctctctcctggattggatttctggaaggttctgctgggccacgtcccgtcaggtcctcaggaacacggcatgcacaaccacacaccccgtctgcaggggctgcaggtaccctgaggccctgggactctgtgtttttctgtggttaccacttttcctttgaacaataacattttttttctgagacacactctgagacttctggcacccaccgtaccttctaattctactataatcatcacccttttctcttgccaaaaaaaaaaaagaaaaagaaaaataaacttaaaagaacacagactgaagaaagtcatttccaagttaagctgcgaaggggtctgaaatgtatcgctggtgagagtctttttttttttcatggtaaccacaaaagcaagtgcactagtgtgtctgtgtatgcggtaaacaaaatggtttgccaaactcaggaactaaaaatgctctaaaagaacagagttcatttctgaaaacagccaatttggaaccctggcaccagtattttgagtcagaagatcactgagcattatgggttgaattgaatctcccaaaatgccttttgctgaatcccaactccagaacctgtgcgcgtgatcatatctggaaaaaaaatggggggtctttgtagatggaatcaagttaagagacagtcagagtggatcagggtgggccctaaatccaaagacccgt

SEQ ID NO: 101669 - DNA, 1022 bp, Homo sapiens
gcctttacattttgtcagtggtgccagcggtggtgccctgcccatatgttggccatttgggaaaacagcagccatgtttgaaaacacattgcccctttatttaaatgggcagctgctggtactcactggcctgggcgtgtgcattttgctgacatttggggcagacccttctgttgaattctcgatgcttcgcgaggcctcttgccttggtcatatgacctccagagagtttttgctgctttttaagtcgtttcaagcgattattctccggccataaaactcagctttaaaaataggtttcataaaggccccgacttttcttctaattagtgtaaagatttattgaatatacatcatatgcacagatcataatattattaaaattactattaagactttacacatcaaaatatttcaggcagtggggagacaggaagcctgatggtccctgagaatcgaatctgcattggcaagataaaggacaattgagggcgattacaaaagccatgatttagagtacaacataaaactctgctgagaactaattcgtattgccagctgctgctaagcttcttaatctttatctagttcaattaaaatctgaatgtttgggatttcattaacaaccgggggtttggaaattacatgcgcttttacgccatacttccgttgctgactgacaatattggaagttgcccaaaacgtctccaggtagacttatgtataattaaaacttaagtatttaaaggctaatgcaaaggtaaaagcagattgttttaatttgcaagtcagatccgactgacaaagtaaggagactccactacaaacggtgccccttttgtggggagagagagcatttagtaggccgaggtctgggcggtgacctgcagctcatggtcgagccctcaccacagggccggtttccgtgtgagggccagggagctgctttgggcatcttcttagccactggggaccttgtcacgttcctgtgtgtgcagtccgtatcctcactgtggtgcaga

SEQ ID NO: 101670 - DNA, 1075 bp, Homo sapiens
ttgttttttgtagagatggggtcccatcatgttgcccaggctgctttcaaactcctgagctcaagtgatctgtgcaccttggcctcccaaagtgctgggattacaggcgtgagccacagcacccagctaacaatgtgttgattttatatacgtatgattctccagatcaagtcagttcacatctccatcacttcaccttgttaccttttgtggtgagaggtgagaacatttatggtccgttccttttacagatttcaaattaaccatacagtgttgctacccctggtctctgagctgtaccttagatccccagaaatcacccatcttagaactgaaactttgtcccctttgaccaacagctcccctctccccactcccagccccaggcaaccattgttctattctctgcttctatgagtttgacgtttttagattccacgtagaagtgagatcgtgcagtatctgtctttctgggcctggcttgttttatttagtatcgtgtcctccagtttcatccatgttgttgaaatgccaggatttcctttcttatggtggattactagtcccttgtgtgtacgtgtgtagaccacaattcatttgtctgttcgcccaccagtggacactgaggtggattccatatctcagctgttgagaagaatgtgctgcaatgaacttgggactgcagggatctttttgagatcctgacttcatttcctctggatagatgcccagaggtgggaccactggatcgtatggtagttctacctttaatgttctgaggaacctccatgctatcttccataacgctcatcccaatttatcttcccagcaacagcggaggaggaggaggaggcttcccttttctccacgtcctcaccgaggcttgttatcctcgtcgttttgacagtagccgtcctaacaagtgtgcgatgacagcgcattgtggtttgaatttgcatttccctggtgattcgtgatattgagcactttttcataaacctgttggccatttgtatatctgtgttgagaaatgtctgttcaggtcctctgctaatttttttattacattgttttc

SEQ ID NO: 101671 - DNA, 1040 bp, Homo sapiens
ctccatggagggagttttctgacaatttgcacgacttattgatcccacctcagtttgaattttcttgacggaaatctgaatgagtcatggagattcagagaaatgtgttagttctcttattaggaacaactgctggtgcaattagggtcccactggggctccctctcagtggtgagaccaccttgccctggaaggccccactgagtaactggctagcaggaacccaagccagatgcgacttattcatggtgccaataatcacatctgtgcatcacacacagtgcaactgaatattttaaatgtcacatccctttgcctgtaatctttaaatactttacctgtggcttattcctaagtttttgaacaacatgaatataatgaccttcgatctccgttggaccaaatacacggcagctttacctgttatgttgaacacagggacgactgctggcttggcccctgcacattcatcccagatcggctgggccaagaaggaaggcatcaatatcaatatattgacatttgtcaatggccgcgagacctcctcttgccaactctgtaaagtggctcatgctgaacaacacgaaaccacgttagagagactcgctggatgtcttgtatctcattggctcctcagccgcatcatcgctgtcatcatgcttattaagaggcagaatgcctcttactgagaagtctttggaggacaggctggagcctggggctcagcagcctgggaaaaggaaggtctcaaggtttcctgcagaaaactcataagcaaatgaaggaggcaaagtggagtttctcagcacatccagcaccatcgtgcacaggaggaagcctgaggttccaaaagctgaatgccaatgaccctcacagactgagcaaaggacatgagcttccaccccaggaggcgagggctacagacggaggccctgcagaggtgtgggtgctcatgtcccccacccccaaatccatatgttgaaacccagccccagcgtggtggcacaaagaggcgggacctttgggaggggttgggtcct

SEQ ID NO: 101672 - DNA, 1003 bp, Homo sapiens
aggccctgcccgcattcagaagacaggtgacagcccgtgccgctgcctggctaaatgcttgctccacacattttactagtggcggctgagtctgcgtgatggccaacgtggttttagaaatatacacctagattagatgaggcttctgtcttagatgattccaaatgttcttacttggattttgcttaaaggaaaaacaaaactatctacacatttccccctcttcatactttaccaaaaagaaagagaaaaaatgtaagaggatattgactcccacgatgcttcctgcggtgactaaatataaatatgtatgacagatcgcagaaggaatcattaatggcagctgtcagtgctatttaaaatgaattagacctttccagtttccctctagtgtgagcgctgagagacacataaggctgttctgattcatcgtggacctggaagtccattgttcagcttagtcgggagatgtatatgcttatcaggcaaaataagctggcgggggctggtgtttgcgaagcgccaactcgccttctttgtctcataacatttggcggggtgtgctttcctggttcggcacgggacattggtctcttcaacttcagctgatttgaattgggacccacaaaccaggtgggaagcatggcgtttgaaccgtgcctggaatatcagatgagtcctgtgtctgcaaagtctgatagtcagagggaataacaagtccttaaaatgaggaacagccctttccatggttaaagggaagagtggaaacccacgtgtgtattatcggggaagactttcttctgggaacaggtgtgcctgtaacatggtgacttcccactggtctgtttcgccccataatggtaagcattcctacatttggagagagtaggtatattagtctgttcttacactgctaataaagacatacctgagactgggtcatttataaaggaaagaggtttaatggactcgcagttccacatggcttggaaggtcttacatt

SEQ ID NO: 101673 - DNA, 1005 bp, Homo sapiens
cagggtgccgccgaccgtcctacagtgcttaggacgccccccaccccccagaggcccaaatgtcccagcgccgaggtcgggcctggctgctctaaggagcggaaatgtctcccggcagcacgtgagtgggagagggcggttttccagacagtcctcctggatcccccaagaccctggagtcaaatcattctcctttgaattccaagacttacctcttcctggcaacgtgacctctctgaaccacggtttcctgacaagggctctcgagatggccatccccactttgctgggtccttatgaaaatggatccactgatgcacattgacagcttagcacaatccaggtggtggctgttgctgctgctgttgccgttgctgttgaaataaatcaaagatgataattgaggggagagagaagagacttccaggctttcccttgccccacatctgaggggctgtcctgacccctccctgtggctcagccccgctgcacctgctgggttccctgtatggcctggcagtgtggagcccacattgcttgccgtggctgaccggggcctgcccaccacattgctcggccaaggtttagccctggccttcacaggacctcgttggcttatcgtcccggggatgaccagcccagttttgatcctacactcctagtcacactgtcatgttgctggaacctgccaggggtgcaggagcggctggagagcatctgtgaggggagagcagggcacagggagcctctctctggctgccgacgcagcttactccgcacctaagagcatcctcttaattaggcatcaccggccacatttggaatggcgcattaacattttatgggccattttcccataaagaaaagcaaagccgatgtaattcttgctggctttggggttttggcttcacactcagcacatcagacaaaaccactgtgggaataaaattcctcaaatgtggctgcagtcattgagtagggagaaaaacgcaccgttaagtcctt

SEQ ID NO: 101674 - DNA, 1035 bp, Homo sapiens
aactttggtttccgacagtcgtgcgtggaggagcccggcctgactccttccttgaacagacatccgctgagcagcaggtgacggacccaacccaagctcagggtctaagaagggagagctggagcccgagtcaggaaagcggtgcaggcatgaagccagggcaatgaggctttcatcagtctgtgctcgggcatagggaggaggtgccgtggtgcggaacccggggtgcctgcccgcaagaagaggccagcccagcacatagctttctctcatgcccaagtactgttccagacccaggggatcagcttcctctcatgccccaggtactgttccaggcccaggggatcctgtgcacagcaagtaagccaggcatctgccatcccggagcccacactctccgagaggggaccagcaagtgtcttgcccagttggagcagctcggagagcagtgggtgctggtgaagaagatgcagagggctgcgcgtcccttagccagcatggtcggtgaagacctttgtgaataggagacatttgggctgagacctgagaagcaagaaagagccaggaaggcaatgatgaggaagaagaaaggtccaggtgggggcacagcaagtgcaaagcctggcagggggggatgtgcttgctgcatttggctgtgtgggccttggggaggggtttggggttttggggtgatggaagccacagagtattcagcagggaaggggagagcggagacgtggcctaggacagcgtagtggagagcggagacgtggcctaggacagcatagggcagggcagagatgtggcctaggacagcgtaggggagagcagagacgtggcctaggacagtgtagtggagagtggagacgtggcctaggacagcgtaggggagagcagagacatggcctaggacagtgtagtggagagcggagacgtggcctaggacagcgtaggggagagcggagacatggcctaggacagcgtagtggagagcagagacgtggcctaggacagtgtagtggaagtgaagggaag

SEQ ID NO: 101675 - DNA, 1041 bp, Homo sapiens
aaagacacacacacagaaatatagaggtgtgaagtgggaaatcaggggtctcacagccttcagagctgacagccccgaacagagatttacccacgtatttattaacagcaagccagtcattagcattgtttctataggtactaaattaactaaaagtaccccttatgggaaacgaagggattggccgaattaaaggaatattgggctagttaactgcagcaggagcatgtccttaaggcacagatcgctcatgcaattgtttgtggcttaagaatgccttcaagtggttttccgccctgggtgggccaggtgttccttgccctcattctggtaaacccacaaccttccagcatgggcgttatggctgtcatgaacatgtctcagtgctgcagagattttgtttatggccagtttgggggccagtttatggccagattttggggggcttgttcccaacaggaagaaaaacggtaaaggaagaaaaccataaaaacagcatattaacggggtcatagccctggacaactggagcttgggccctttgcggaccctccagacaccacacagaacacattgcaggcaacgagacagcggggcccatcgaccccacccaccccattgctgacagagagccatgccgggactactcactcgggcagatccagtccacccaagccctgactgagcaaatgtgcaggtcctcagggaggagggcgtgtgccaaagcagccaccagagccgtcacttcccccaggccagggtgggacagggctccagagtgcctccgggggctccctgagatcacatttcctaacacacctgagagtgtcttcagttaaatgctcgctctgtgctaaacacattctggagctgaagcacagctgtaaacaaggctgacacaagagacagtcagtaaataagtggacgaatgagtaaacagcagagctcctgctaattataagtgaagccaattaaaaaaaaacaatggagaaagtaagaaagtgctcaaatagtggtgggaatgtgataaaagaaaaccac

SEQ ID NO: 101676 - DNA, 1008 bp, Homo sapiens
tggcccatgggtctgtcccatgcaggcacagaggcagccgcaatgggaccaggcacccagccctcctgcccagtgtttacatcagaaggaaacagcgtgctcacgtgtctacccgcacacgcttcgcctccttctccgtgcagcaccgccctgctgagcagctgtactgtggactcttctgcctgcaggtccccatggctctatttgcagacccacctcaggggcctgacacagactaagcagcacagattcatatttcagtaaagggtgacatccaggaaaagctggagccctgccggacctctggattgctcctgggtcaccccaaagctgtggtggacttgggtggctgcaaagatcttggtccccctggcatggctccagttctcggttaccctgacgtcccctgagatccagacctggagccaaccctcccccaacccccacccacgtgccagccgggtctcagttttgccacagatgaggagcaaagcctcccaggtttctgcccacataggagggatggccgactcctagtagcaggacacacttaccaagctagactatttctttccacacctacagggaaggctaaaaagcatcctggaggtttccgggaatgagattcaaagggcggaggcctcagcagcaggcgtggacacgcaaccccagccccgtgccctccgcgtccttgcatgcatttcacacgatacttcagatttttttttcatttagatgttaacgcttttataaaaagtacttttcataaaaatcctgattcctggctaattttctagacagttggaggatttggcttccagagcccacattgctgcaatgccccatggctggcttagggcagcagctgtcccttaactgggcacgtcctctgtgtggccgacactcccgcccccgtctcaacacccaggtgtgtgtcctgccggccccgtagcctggaacaacaccctgtgtcctgtgccctgggccgtcagcactaggcagctcctc

SEQ ID NO: 101677 - DNA, 1029 bp, Homo sapiens
aagtaagtgagcccaggaacgcaataatttactcaagtggacagaattagtgccatttagggagaggggctgagtgctgtattgaggggcctggaagccgtcggggctgggctgggtccggacttgctaaacctatctgatctgacacttgcgtcaggagaaaggtggggggcagctggtttttgtgggtgacctgctagccagggcacttcctgcggtagatgagaatgtccaccacctgcgccctccgaaccgctttattggactaagggacatcgccagggctagacacatgccccaccactctgcacgtgtggcgtaaggggctcagcaattgtctaaacagaggaggctccttcttagacagcaaagctgtgtgttttgtatctgttggtctcatttcctgtgggatgtttcctggttgcagcatgtctgtgcttggttagtaagacagttggtccaaagctcttcttctctcccgtggggaatgtgagcagaacgatccttaggtagaaaagcggagaaccagtgcttctgcttcttttgcgtaggtggacaagaaataacagtgggaggatattgtctgtccctaattacctgccctgcatccaatttgctggtgtcaggcagctttcctgaggcaagcccttgggtacactgagacgctaggagggacagcagctccggggcctgcagggctctgggatttttttctgccaggtacacttccccctgcctgcattgtgcagaaaggcaaagatgagcaattgggagaaagacagccccagtgactcagcatggagatattatgggataggggagagctggctacttctcaacccttcccccgcctcgcttgccgtgggtttcagcatcgcgggggctgtggagaaaggcctagagagctttgcaggaccaagtggtggtcgggcagcccgtgctgcaggaggtgaacccgggcatgtgacacggtcacagggactcctccagtggtttaacgtgcagtgtgagtggccttaacacgggacc

SEQ ID NO: 101678 - DNA, 2046 bp, Homo sapiens
tttataaccaacccttgaggtagggaccacctttatatccatctcacagatcagacacatttgaaacttcgaaaatttattcaacgtacctaaatccatgcagctggtgaaaggcagaggcagcatcccacattcagcaggcagcctccagagcctacacatgccctggccatcaggctctttttcctagcctagtgattaggttccagtttatagcaaatcgtatgccagatactatagagagcgcaacacccagtgaggtctctcatctctgtatctccagtacagggcagcaaattaatgcctggtgtgtgttgaataaatggataggtagatgggtgggtgtgtgagtggatggatggatgggtggatggataggtggacagatgggtgggtgggtggatagatggatggattggtgggtgggtggatgtgtgggtggatagatgggtgggtatctggatggatgggtgggtggatggatgggtggatagatgggtggatggatgggtggatagatgggtggatgggtgcatgaatagatggatggatggataggtgtgtggatggatggatggatggatggatggatgggtgggtggaaagatggataggtagatggttgggtggatggatgagtgaatggatagatgggtggatgggtgggtaggattttcaaaaagcgctacatctgtagccttcctctggctggatctgcaggtaaggaattccctgagaaaggcgtcaaaatttcaggcatatttgtgtgccgagcatggcttggagccatgcttctcacctggagatgcccttaaaacagattccttggcccagccgcagagattctgagtcagcagatttcccatggatctggacaccctgaatttccagcaagctcccaggggatgcccctatacttatctgtggaccacaacagagaggcaaagacataaagctctccagtgcctttggtgccatctctcttgcaacaacagtcagtaatgtttcccttaaccctctgttaattggactaagcagagataatgaaagaatgatttttagggcatgccttcagggccctgcagagtgggtgtgcgcttgcagagaagggggcgatatgttttttcagcaacctcccccacacctgagtctgcactcagctttgacgcccggctcatcagtgtgccaggcggccttctgcctccaggccatttatagtgcagaagcttgtgaagccaaaacagtttgatgtgtaattgcaggaggaaatgggaaacctgctgagcgtggcaggatatagtgccttatcaccctttatgtgcagccactgcttgctggaattgccagcagatccacaccatcgacagaacggtgacatttttcatgggccgccgtgttctgaatcaacactgcaatggtgcgattagaggaggtaaaggaaggaaacaatcccagcctcgccggtgacagatcagtcgccagtcctgcttccctccttattacctgctgtcttgtgtgatatgcaaagcagctgctccacacgcattacaccttcacattaaccgaaaattgaattttatttggtagcctgcatatcatttataatactcctcccatacacttcagctctcatttggctaaaagtgtattctttacttcctactggccaagaaacagagaaaggagcctgtgtgtccattggtgcctgcagcccccaggcttcagggttcctgtggaacagggtgtcatcggcaagaattgaaaagcatttccctgtctccaaaatgccccagacgcctccttcccgaggggccacatgctgccatcagcctcgatccagagactgtgttgctgtgtgtttctttgcttggctgtagcatgctggctctgtgtatgcaaagaaacacagcgcagcacgcacagatccacccaaggaattcccactccaggggaagcacgtgggtagaggatcaggtggattttaactttaaaacttatcataatagttatcttctaaaaagcaaacaagacaaaaccctgcctctc

SEQ ID NO: 101679 - DNA, 1034 bp, Homo sapiens
atctctgctaatgcaaaatttatttgcatgtcagaactttatttgagtggataagggcagaaggaagctgctctgaaaacatttcatatgaaaaggcatattctgtacttccaaaaaaaatattggtcaaaactttgccatcctgtgttagtagggtgctaaagtccactaactacccacagaaaacatcccagcagtgtccagaaagagaaccttggcaaaagtaaatcctgccatgttattaaatcaataagattcccaaaatcagtggaaggaagctcaattcattttcaatgcccccagacaaatagtaaaaattagctaaaaaaaaaaaaccaaaaaccttaacttacctaaaaacatgaagatcataaaatttcattcttatttacacaatgaaaacacattgggtaaagcttttcaacgcctctttcatttttccccccaagcctagcatctgccttcggtgttgactcttctgactgaatatatttttaacttttaaaagacttgtcttttaactgaaaaatagtttgattttttgtcaaaatggtcaaaacaatcttggtgcttgaagttgtgttatttgaagattcaggcctgtcttaaaagcgagagcccaagaagggtgttgcggtgtgcgttttggttgtgctgcagtgtgcgtttcggttgtactgcagtgtgcatttcggttgtacagtgtgacaaaacaaacccctcaaagctcagaggcgtcaaacagctgctccgtggctctgagggttggctgggctcagctggcctgtccggacttggagtttctcatgcacctgcactcagtggggttaaggctggcatcatcccaagccatgaccagccagggcatgcaagatggcacatgtatgtggctagtagtggacgctggtcaccagcttggagatatgctggcagcaaagactggacatggttcagccttctgatggcatagggactaggttctgagagcagatgtccccacagggagcattccaagagtcctctgtggaaaccag

SEQ ID NO: 101680 - DNA, 1046 bp, Homo sapiens
gcaaaagggtggcttgttggatcctccttcagataactctgttaaaaaagacactaggatagagagagccagagatgtgaacaggatatagagccaccctgagaaattcaactcccaaagcaggtgaaatttggtggtgactgtgatgtgagtgacagtggcagggatgatgacaatggtggtgatagtgatgggggacaggtgacagtgattggtggtggtggcaaagatggtgatagtagtgatgatggtgatgctgatggtcaccatggtgatggtacgatggtcatgatcatgatggtgctgacagtgctggcactggtggtggtgatggtaagatggtcatggtcatgatgatgacagtgctgacactggtggtggtgttgggatggtgatggttatgatggtgatggcagtgctgacactggtggtggcggtggtggtggtagtcttatcatggtgatggccatgatgttgatgacagtgctgatgctggtggtggcggtgatggttatggtcatgatggtgacaacagtgttgacactggtggtggtggtgatggtgatggtatgactgacactagtggtggtgatggtcatggtcatgacggtgatggcagtgctgacactgtggtggtaatagtggtgatggtatagtcatggtcatgatgatgacagtgctgacactggtggtggtgttgggatggtgatggttatgatgttgatggcagtgctgacactggtggtggcagcggtggtggtggtggtggtagtcatatcatggtgatggtcatgatgttgatgacagtgctgatggtggtggtggtggtgatggttatggtcatgatgttgatgacagtgctgatgctggtggtggcggtgatggttatggtcatgatgttgatgacagtgctgatggtggtggcagtgatggttatggtcatgatgttgatgacagtgctgatgctggtggtggtggtgatggtgatggtatgactgacactagtggtggtgatggtcatggtcatgagggtgagggcagtgctg

SEQ ID NO: 101681 - DNA, 1072 bp, Homo sapiens
aagggcatttttatatgttctattaaggaaatccctgctgtggcagatgctagcagcaaatactctagagctgtctgttgtttctgccttggatgagattttatagcattattgagcatttcagaacattatatcagaagtgcacgctgcagagtttggttgtaaacttaaggtttccattgccattttagaaacctgcttcctaacataatttactttcagtatctgaaaatattaaaagacccaaagcaaataaaacaagagcagtatctattcagttttgatttgtgatgccttttgattatggcgatcccacataattaataatgtgctttatttgagaatcctgcattatataagctagctatgaaagtcactgtacaaaagggggcatgtgttacacttttttccccataattactctgagcactgtaccaaaaagcactaatagaaatgtggcgtctgttgacttcatatctggagaataaaatcagccaaaccacaggggtggaattaagaagtgaccccttctaccaaccccagccccctccaacttagtttccttcaaatgcccagacatgaaattctgatccagcaaaaatgacaatgtctagaaatctgactgttctgaactagaatcctcagtgaccctgcctccagcctcctccaccactttctcccccatggaatttacctccccccctctctctccctcctctccctccccctctctacctcccctccctcctctccctctctctctctccccctgcccgcccctccctctctccctgccccccctccctctctctctctctccccctgcccgcccctccctctctccctgctcctccctccctctctgtctctctccttgcccctcctcactcacccgcctcccctctctctcttcctctctctctccacctctcttctccctaccccacaactgtggactctgagacataggatctgagcttcatggcttaaggtaaaccttattcctgtcttcatggcaatctaaaaatattcatgtaattgctggttgatcacgaactacaaatgaacacca

SEQ ID NO: 101682 - DNA, 1467 bp, Homo sapiens
caaaaaattagctgggagtggtggtgtgtgcctgtaatcccagctactcagtaggctgaggcaggagaatcacttgaacccaggaggcggagattgcagtgagccgagatcatgccattgcactccagcccgggtgaaagagcgagactccctttcaaagaaagatgagaggaggggaagggaggggaggggggtggagggggagaggaggggaagggaggggaggggggtggagggggagagggagggggagggggagaaaatacaggctgggcacagtggctcacacctgtaatcccagcactttgggaagtcaagacgggaggatcacttaagcccaggtatctgagaccagcctggcaacgtagaaagaccccatctccacaaaaaagaaaaggaaagaagagaagagaaagaagttagatggaaggaaatgcaaagtccccagagagggggagaagaggagaccaaagctgcgggaatggagatgaacaacgatgatttagataggctggaaattgccctaagatgaagctggaagcatggcggggttgcatcctgggcagtgcggggcctggctgctctcccgtgtctggccgtccttggaaggggaactcgtgatgatcttgatttttttttttttttgtaaccagtgcaccgcccttgtcccttattattacagatttcttacggtccatagatgacattcactgatgtggggaattagacattttagaaaggttcccaacagaggccaaagcaggaagggttttctggtgaaatgttcggttttcagtcagcctggagtatttcgttcctaataaagatctaatcacagagattttgggtttcaaatccataggaaggaatgaccattttcatggtgagacattgatatttcattcctgagacccaaagccacctttgtaacctttcaagatcctttttgattgtgtaaacttcagaagtctggagatcttagatatcaggaagataaatttacataggtaagcaccataattcttgttcctcatatattttatattgcatcatttacataggctttaaatatccagtgaattgtaataaatggggaactcataataaaactggtaataaaatggattattcaggtgatgctgttttattacagtctcattatgattatataatccttattaaaatctggaccaaagatgaatttctcactggaggcgcttcacaagtactttaataaattctatttgttgcacaatcctggggtgaatgttggtttttataatttcatacaaatgtgttgcaacatgccatggaatctgactataggaatctgtgcagtgaggaaagagaatctctgtcatctgcaggtctgttcaatgcctcgtgtggtttgggaattatgtctgctgtttcatacgtttctgttgaaacatggggagaggccctgtcctgtgttcatggtgagcg

SEQ ID NO: 101683 - DNA, 1054 bp, Homo sapiens
gtctgccctgggcagtggtccgccaagcattggcttggggctcctggtggtgtcccccccaagccctgctgtcacaggacgagagggagcagagcagggacacgccagctcttgacctccatggcttctgcgcatattcccttggccggagctgagcacatgactatgcctctccagagggtcttgccgagtggatctctgtgcacacaggatttgaaagagagtgtttggagaactgtgtggactctgtgtgctcaccacattccctgtccaattccctcccagcttcccaccgttctcctccccgatgcccgcagcgttcagagcagcctcacctgggaggcaattcgatccgattggttggtggtcaggtgtagacctgagggtggagggggagcaatatgaagagggctgaatagggtgcatgcaccgtagctctcccaggtcctcctggagcagggcctggcaccacatggacactcgacaaacctgatgggcggacgaatgcacggcagcgtcgtcttgatccaattttagaaactgccgttaggaagacctcatatcacaatggaagaatttcctttattgaaagaaaaaaaaattacctatgaaatccagccaaaaatgtatcctttgacatggttcttgtgctctagaagttggaacagtcttgaaaactgttcatgacggcaccggaagccatgtttgaaagggatgacctcacatgataggagggaagtgcccagatgttgatatctgattcctggaaaattagctcacctgtcatcactgagacaaggtggtgccttctgtcacataacttcaggggctggtcttggggtttaggagcaactcataaaatcctacctggtgggttccacgtgccatacgaaatgccggcaggaagaacctggtggctggtgatctcctgtcccagggaagatcttataaagccacatgaaggagtggtgacgattcaaaataatgtcactttcaacagatttttctgtttctaagatctgactttaggatgaagttttctagaatccaagca

SEQ ID NO: 101684 - DNA, 1082 bp, Homo sapiens
tgagccgcctttttaaggaaagcagattggaccaagtgtttctcgcctttccgttgcttttggttcttccaaaggttttgaaagtggttggaaaacattcttattttctcagggaccattttcagcttctctaccaaggatgaagagttggagtaaaaatgaattacaaactggcagagtcagtatccacctatttaccacgagccggagactttcagtggttgccagcgtagaacgctcatttttattaaccctatttccttcaagtgtctccttccatggagattgacaggccccgcacatggacatggggagagaggaggtctctgtgtctgcagcgctctgacatcctgcaggacgggacaaggtggccccgaggacccgtcagtgcccacggggtgcccataaaactttagcagtggtacatatttacccaaacttcactaaatcactttctaatttaccagtcattgcttgagaggccggaaagattggaagcccaaagaactgagcagggccgattctaccgggagaaagggtcaccgagacactcaacagctcgcttatcggtcactctccgggctgcgcctcctcggggagttctgggtttgcgcgggaggctgccgatggcacgcggctcacagataatgcgggaatggactgcgtgtcttcctcccagtgtcttcagcacacggctgttgccagcggcggtgatgggcttgcctgcctcgggggagctgatgggaggagggggagctttgtggacactgaggagctctgtgaggtggagagcagctctgttccaaacgcccatatccgttagcatgggactcaacctgtcaccctacatcccaccaagctgccatccaaaaatcactgtttagtgtatctgttaaaagtagcatgtttcaaattgcacagaaaattccgaaagctgacagcacgcagctgggcacctgtctccgagccccccaggaaaggcctttgtaagctcttctagctggggacggcagaagttaccttagtctatttaggctgctacaactgcagacagactgggtggcttagaaataacagaaatg

SEQ ID NO: 101685 - DNA, 1022 bp, Homo sapiens
accacactagcccgctgctcaccatccccctttctcctctgtctccagtgcgtttatctttcattcatcattcctcgcaaacaccaccagcccaaggtggttctcagccatttggcctccgattccgttctgtctttcccgagaaaagccgacaaaaccttgcacctcataaattttaacagcttttccaactgatgtatttcatgtctgaattgttttatctgtcctactttgattgtaagcctcgagggctgagacctcgtcctgtttcatcttctgtaccgctccgagcgcactgttggcattctgttcgtaaaaacacacgcggagataaatatatgcaaacatcgataattgttttagttggagccgtttgacgacagatcagagctgtgtgtggacccctacatctgaggctggagcgtgatttcaggccacctcttaatctgttccttgggtattagtaatttgtaaaacatgatttatttgcttagaatttttcctcataactttaaatgtgtgcataatagtaaatctctgatctctgattaacttttgccaaataggcttcccagagtgatgaatgcttgtgtggtgactcataaacaagactcaaagcatttgtttaaaaaacacgaggcttccttctgtctaagcatgaagagatgttaaaacgaaaaaggttcaacttagacttaagacagacagaaattaatcaggagtgatttcttcttggtctgaattttaaattgtttgtgaaagggtaatgatcgagctggctttgttttactccacttcactttgtttctaatgtgtaaattttcagatgcttttctgctagaaaattcctcttggtgaatatgatgtgcctatcctcacataattccacaagtggcatgcagaaaaacagggtgagtcccacaagaaccatccaaagctcttgccttcactctgtgtttgctgaacacccactctgtgccaagtaatgtgctggatggcaaggattcatggttgacattgaa

SEQ ID NO: 101686 - DNA, 1092 bp, Homo sapiens
tgccccagcacagtagcctcctgctgcacatggcccaggcccttgctacggaagactcacctaaaactctgcaaacagaaaacgtcagtgacagggacagcatgccactggagtggggtttcctgacctcagcacttgggattggataactctctgtaggggctgccctgtgcattgtggggtacttacctgcatccgtggtctctgcccagtagatgccagtagcacccaccctgcccagttgtgacagccaagaccatctccaaacgttgccccatcccctggggacagaattgcccccagctgagaatccctgcatttgagttagaggggacctgaatcaggggaggtggctgcggagtttaagagcctcgcagtcatgggtgctcactgagggcccaggaggcctggagccctcactcggaagctgcttgggacagtgggataggcctgttaccaacatggaccacaaccagtcatttaagacagtcagggaaacaaacggggaggtgccttagaggcaaagcttcatttaaaataatgacataagacgtgtgggttggagatggatgcagagaagtggagtttccagatgaggatgtggaggtgggagtagaagggcctgggttcaaatctcgaccctgcctatgccagccgctggctcaccccacctgccacgctgcaccccactcaccacactgcggcgcctgctttttccttgagcatctgggacgtctgtcatcagcagacagctgctggtttccgtggctgccttcctaggggagcatggtgacagcttcctgtctgttacctttccccaccccatcacaaagccccctttaaactcccgtttagaacagtgattgaaggtgctaatttcacattgtcttctttatatagattacaccttccaaagccttcagaaataccattacaatgaaaacaatttcaagagcaaattgaatacctaaaaaagtataattaatcaaaccatatcaagagagcccgcagggtcatcaagagctagacccagcggccgtgttgtctttcctctacatgagcatcattcgtgcaaagtgcatcacagctgat

SEQ ID NO: 101687 - DNA, 1082 bp, Homo sapiens
aggcaaatccaccccagtccctcttggacctcagccaccatccccagccagcccagtcaggcgtctgccagctgccagttatgccttggtgtgtgtgcagcgcatgttgcatcctcctaacacttctgtactgtgacctcatggctgtacctgatacacctgggagtaggacttgggcttgaagagtctgcctgggcgcccgctcacaccagccactggggccccaggatgctcttgaccacggtcagcagggaagggcgaagtgtcagagatccccaggactctgcttggctcagggcttgtggtttagctcaacatgggacgctcagcggggcaggtcaggcagggccttggtttggggctcacacctgctgggaagggcacggccacacctgcaggcccctggctgtgggatccaggctccccgttttgcactgctcttgcatggggcttcagcgccttcctcctcctcttggggaagaagtcacatttggttggaagttagcttatattgtgatttaaaattctcccagagtccaagacactccaggatcccaaagttagtgttggcaagaaccaacttatggattataattcttggtcatgttcagatcctccctgatacccatttgaaactgaaatgactctctgggtagaaataggtagaaaacagggttcagttattcattcaccaaacccgtccagagcccttcagttgctggggctggggtagagcatgaacggggcccttgctacatttctgtgcccgtgggaaggtagacgggtgaaacccacagttactgacaagggagacacaaggtaagaaggaagtgagcagggataggaggtgggcgtgccccaggaaatcctggagggcctctctgaggaggtgacattgactgaggaatgagacaggatctaacgtgtgaggacagaggagaagtccagaggttcccagtggtctgcagttctgcctgctaagcaccgctgtgtccaaggtgttcgagctgggactggggatgcacaggggaagcataagacagcgtggctcccctggaggcccctgactctcccaccgtgat

SEQ ID NO: 101688 - DNA, 1051 bp, Homo sapiens
agaagctgatttctgtctggcttggcgtatcagagaagagcacacatcgggaccatttctccaccagcccagcttgccttgcatcggccggacagctcagccacttctgaaaaggacacatcggtagttcctttttctcttcctccccctttaaaaagattcatctcccctgcccttgggcaacaagcagagtcttcgggggaagcaccagagatacttctcagcaccagcctccatctgacagagtgagtcatctttaggaagaagaaaatccacaaacatcattgccgccgtgtctaattaggcagagctatgtaaattgagcgcttctacttgattaagatgtcaggagaggcttcgataagacctgagcggttcaagtgtctctcgtgtaccagccgaagatgccccacttgctaatcctattcatctggcgttgtttcctaattagaatatttatggcctaatgaggaggtgaacgtgccgcccgagccccgtcctgaaggtgagagtgggctctgcagacgcaggcgctgttccgattgttgggcagtgaaattagcaccgggccagcattgttctcagcgtcccttccaggctgctcccgaggatgttgattttgttattagaaactgaatccggccttccggtcctatcacaagaggactatcacctggtcacctccatcagcttgaaatttcttcccaaacaaggggggccgaattcgtgatctcctggtctgaaaggattctggggaaagcaaaacccacacctccccgaacgtcttcaagaccctctgcccgcccggtgctgtcatccaatggatggagagtgataacgtggctctgttctactgctcaggatatcgttctcaccaccatcgactttagttaatgtattcacatgattcaaattccagtagaaagtgttcgtcggtgaccagaatgtcccctttccctctgagagcggcgtggctttctgaaggcatttctcccagacagcgagcctctcgtaagccccacccagaggcatctgcctggggagggcagta

SEQ ID NO: 101689 - DNA, 1057 bp, Homo sapiens
ggccctctgccgtggctgcagggctgacgcacctgccgggcaggtctgcacgcctgcttcagtggggccccggcagccgtgctatgaggcgtgcactcccgtgcacccctgagcagcctgtcttctctgattcctgatctgggcgtggctgacacggtgtgttctgtttgtgaacactcgttgagctgggctgacacggtgtgctctgtttgtgaacactccttgagctgggctgacatggtgtgttctgtttgtgaacactccttgagctgggccgacacgttgtgttctgtttgtgaacactcgttgagctgggctgacacggtgtgttctgtttgtgaacactcgagctgggctgacacggtgtgttctgtttgtgaacactcgttgagctgcacatatgctacgtgcacttctctgtgcatatttacacttaacacgggtttgtgacattctttccttccattttgcagtttgcaggggaggtccccgaaaaccgcgtggagaccgtggtcgcaaacctcacggtgatggaccgagatcagccccactctccaaactggaatgccgtttaccgcatcatcagtggggatccatccgggcacttcagcgtccgcacagaccccgtaaccaacgagggcatggtcaccgtggtgaaggtgcgtactcttctcacaccctgccaggcaccccaagttctgccacctgcacactccctaggaccagtcaaacaggagtgatactcggtgtaaagttactgcccccctaatatccaagggtagaggcaggtaacccaacctgctggaggcagacacaaccttcacaaggacctgtcatgtgaccttcaggggcttggcagaccccccaaaaataccctcccattcccttttcaatgtctatatattcactcccaccccctaatctagtaatgggcgaatttcattattagaattcctaatgttaaaccatctttgcattcctgagacagatcccactgagtagtgaggtaatattttgtaacacattgaagaatttgttttgctgatatttgaagttt

SEQ ID NO: 101690 - DNA, 1709 bp, Homo sapiens
gagacaagccattcactgctgctctacaaagcattccttaagtgacacaggaggacgcctggggactttttatatatttgcagattacgcctttttgtaacgagcaaatgggatattgtttaaaaaacagccacctctttacaatggaacagttttatattcctgtttctaaatcagctcttcagtgtgaaagaaaacacgtttctgtaacagagagaacacaaaggcctgtggatactcttaaaggacaattaaatcttaactcatcttgattgagtggccttcctgccaaacaagccatatataaagactgatggaatcgttagcaaataattagctgccctctgtcaactcatagcagtttctgcattatttgtgcattttggtttagttctacctaacttactatgtaggtgtatgtctacagccgatgacctcatttcgtttattttatttttgtaatagtcagttggcaaagcaaactgattttttagactatttatcttccttcccttcccctcccaccccgctctcctctctgccccctgccctcccctcccctcccttcccctccactccgctgagaatcctggaggaatacacaattcatcgttgcacccccacctcagagtgtaatcgcatttctgcttggtagaggccgagcccagcaaaggtggctccttctgaatgtgtggtcagcatctgtacaaatgcattttatttgctatagtttgtaaagctgtaaagttaaaagagatgaaaaccttttcagcataaatatattttacttgcactgtgttttttagctaaaagtgaaaacctagattaaataaaatcaaagttgagaagaatcatcaaaagactgtttctcggtgtgaatcaagtgttgaaaaatggttggtgtattttgtcagtaattgtacataacttttggcacatgacatagaaatggctatgtaaactataattattttgctaagagactgtatgcaagccttgggccgactttacagacgtccagagcaaagccccttctttgtacctatttttttattacaaatatactaattggttctttctattttcagaggttattgtatgaaattgtctattgatagtacttttatgactgtaaatactctggctttctccgtgtgaattctcacattagactttaattcgagcgcgtgtgaactgaacgctgatcagtattttttatcaacacctgagaactgttacaccttttattttgtcttttaggaaatccctgtctttccattttttcatgtaaattttgcacagttacttgttcatatgtaaatattttactttcagaaatgaagtttttaattgctattgttttatataggattgaaagaaaattaactcctttattaaaaacaaatttatctgtatttgttttgcctatttttcctccgttttccagttttagattctactgccagattgcactccggctctgctgaggtgctggtttctgagccacctgttggaatctgtagctgagccccatcagagccgggagaaagaactttctctgtgaggacaggggccgagctactctctgcgtggagtctgggggctggcggctgcgcttaacaccttctgctgtcacaggtggagatgagctgggcacagctaggaggggcggcgggaggcccagtgctgggggagatgtacacagaaac

SEQ ID NO: 101691 - DNA, 1041 bp, Homo sapiens
gactcaagttgcaaactctgtctttcctgtctgggtttggctttaggctttgctaaggtaggtcttactctagggtgtgatccttacgtacaaggaaaggtcttgttactcgggcaggctggactcccatgcttctggactgccctctactctgcccgacccctgacttctctgtttcgctctcagccccgtggcagctgctgtctgatgcacattggctggtcttgcaccgcttcttggtatgcaggtgcactctgggacagggtcagggtagtgacctgatgaggacagagctccccctccccaccaggactgttggaaatgtgtgggtgggatgtcccagacctccgtgctggggctcgcctgcccacatgctagcagtgacctctgagaaatggctgcctggtgtggagaggagggactccaggtgtaacagacactagagttttggcaatatggcatcccagaggttcagagaaatccctcctgggacagtacaggttaaaatgtctggtacaatgtaggaagaaaataaagatcttgtctttataaatgcgtgtgtgagatatagataaaatagggggattcttctctgggccagaaataagtaagtaagtacagattcccaaggctaacacgggctctggccactgtgtggctgggagtcttggcccgggatgggccccagcaggaacctgcactcacctgggcctaggcctgagtgcccactggctgtgaggcccgcagcccacgctgaaaatgtagttgtataccaagaaagaactgaaattctgaacaacaacaacatatatcgagaagagcacttagagttaaggacttacttttttgtgggggaggtgaaagatattgattagccttttttttttttcctggatttcttttatggttaactgaattctcaaaggcatagattttgtagcccatcatcagttcgagaactagaacgttgtaatcccagcactttgggaggccgaggcgggtggatcatgaggtcaggagttcgagaccagcctggccaag

SEQ ID NO: 101692 - DNA, 1005 bp, Homo sapiens
gaagcagctcttccaagtaaaacgtgccttcctcaccagcagtcacatatgaacactcttccaagggcacactgggtgaggtggtgcctgctgccacagccgggaggcagtgccttcagggcagcactgaaataaacacacttagcccttgctgtaaaagtagttctgtgttgcagcaaaaaaggtaaatgttactttaagaaatctgacagcatcaaagtgtataaaagggacactctcccacaagtgtgcccctgagacagccaacacgagacttcgttctgtggacgtgagcatcgatagagctctcgggcgcagcatttgcagggtgggagggatcgggtcctcgccgcattcagactggacggagggagggcgttgtgcacggatggtccagtggtgctagacaacccctttgcttgctgggctctcagatttatgacaagcagtattttaactttcttcataggatgacgacagatatgagcaggcgagtgacgtccgggcacagctcaagttttttgaacagcttgatcaaatcgaaaagcagaggaaggatgagcaggagcgggagatcctgatgagggcagcaaaggcgagtgctgggtgtctgctgctgccgtctgggcacctccgtctcagccacaacctgatgagctcactgagacagtggggttttgggtggtcagagcatgttttgggctggccttgaagcaaaggtgatgggtgctgtcagtggagctgcaaagagaagcctcattcatttggcactagcgtagatgcttgaaaagcggggcttcttaagattcccagcacctcacgctccacacagtcacacccaggtgtgaagcacatgttcctagagccccctgtgtgcgctggactggactcttcacactcacgttgtccttgttctagaacattcacagccaggcgaggcactgctcattaatagaatcagacaggagaccacagttccccagggacgggggtgggtactgtgga

SEQ ID NO: 101693 - DNA, 1523 bp, Homo sapiens
aaagtcaggttagcaactttcaggtgattcaggaaaaaattgtgcgtactcttcttccaacttctgagcctttaaaaagaatttaatgctgcctctggctttaaaaagctttgcatagatcagacccccacaagtccccgcgctgctcccggctttgctttctctggacttgagtcccctgcgcatctgtgtgtagatgttaacccggcgccaactcacagctctccttccgcagaacaatcgagctttccaggaaagcagcgaggcaccctctctgctgtggcagatgcagcaggtgcaggtgcggggaggacagaggcctggcctcctcacggccctgccttccacgtggggtttcctgcccttaccaccccagcccacctcccgatgaattccttgtacagttaaagtgatcttcccttctttcctcaagggacgatgatgacattaatgatgttgcatcgatggctggagtaaacttgtcagaagaaagtgcaagaatattagccacgaactctgaattggtgggcacgctaacgcggtcctgtaaagatgaaaccttcctcctccaagcgcctttgcagagaagaatattagaaataggtacgttggtgtttaatgactgagttcttattaaacagctgcgctgctggggcatgggagcttcaggtgagcacacctgacacctggtcatgtgttttgtctgagtttgtgatttccacatggttgctggtggtggttcttgggtaaaatatgggtaccactgccttccaccccaccagcctttctgggctccccttgggttgtataaaagcagtaactgctggatcagagattagccgtaaagaaagaactgtgcttaatgattttaaaatactgtttttcttgcctgacctttaggtaaaaaacatggtataacggaattacatccagatgtagtaagttatgtatcacatgccacgcaacaaaggctacagaatcttgtagagaaaatatcagaaacagctcagcagaagaacttttcttacaaggtaacaggctgtttgccgaggagagcgtctttatgttgttggcccccactctctgctggctgggagcctcctccccacaccgaggcagagggcggtgggtcccaagtgcctccatgttccttacgaacgtgttttggatttcttataggactagattttggaaagatttctttttgaggtagggtctcactctgttgcccaggctggagttcagtggcgcagtcttggctcactgcagcctccgcctcgtgggttcaagcgattcttgtgccttcgcctcccaagtagctgggattacaggcgcacaccaccgtgcccaactaatttttgtatttttaataaaagggacagggactcgcgatgtagcccaggctggtcctaaactccttgcctcaagtgatcctcctgacttggcctccttaaatgctgggattacaggcatgagcctctatgcctggcgggtttaccttttggaaggcacctgcctctctc

SEQ ID NO: 101694 - DNA, 1360 bp, Homo sapiens
cttacttagctcaaaagctttctgtaaaagttgatatttctgaatttttaagcaaggaaaaccgacgcatgagcagccgcctgacccctcgtgtctgtctttccacccagaggagcttacccgccttgagacagctgacccccgactccgcggccttcatccagcagagccagcagcagccgccaccgcccacctcgcaggccaccactgcgctcacggccgtggtgctgagtagctcggtccagcgcacggccgggaagacggcggccaccgtgaccagtgccctccagccccctgtgctcagcctcacgcagcccacgcaggtcggcgtcggcaagcaggggcaacccacaccgctggtatggaaggggcgcctgactggtctgcacagcccaccgtgcctctgctcccgcccgcttcttagataaattggccacggctcagaaaccttttccaagcatgcaggaagcctcctgctagaggaagcttgggtattaccttaaatagttaaaatagaaaccagaggttgaggccctgggatgttgtattttgtctcagtaaaatgaaatagttgagttggctttgaaccaccggcacgtccccgccctgccttgtctggggatgttactggtgtaaatgaatgcagcgtgcttttagaggatcttgtagatagatgttctcttggattaggagcagcggtccaagcgtaagacacgggcacctgcgtgggacaggtgggcaggagactggaggcagggtagcagctcacagcacagggtggatttaggtgagtcccgggaggcgaagccgcggctgctcatagcggttcacttatgtgcagtttggatctggctttcttggttttatagtcatgacgtttgctctgcagctagagaaaggatgtctttgccagaagaattacattttgagcacattccctttcatgggcagagggattcaccaaacgtagaggggcagttttaaaaaaatttcagaggtgttttcttcctctaaagacagcttaaacaacaaaatggtgcgggctccctcatcatgagctggtatgtgttgtgatggtgtacacatcagaaccagctgggtgaggagtagccattagggggctggctcttgtgctctgttcaagttgcatttgtttttgtcttgataatagcgaggagaacagggtgaaatggcatggagggagggtgtcccttataaaggccagggaagggctgagcgcctgtgtaaagagagggcttccttgcctgccttttgactccagagggaaagagatgtgccgtgcctcttgctttagtgtaaggacagaacttccctgttcactagtcagtggagctacttt

SEQ ID NO: 101695 - DNA, 1010 bp, Homo sapiens
cagcccctcctttctgacagtttgacactgatgacccatcctccattgctcgaatctgctctgaaaactcccctctgtgggaggcttcttgttgacactcacttttggggagtaaagaaaggtgggtttgggtgattgcagggagctggggaccctcccctatgggaggctgcggctgtggagccctgaccgccctgtagccagcctctgcacctgggaggatggagctttcaggagccgttcttctgtttgttgttttgatttctgagagatggggatctgggttgcctgttaggattatttactctggtctctatgtgactttttccatggacttctgaggactggggtctctgcagtgcctggctttgtgaacgtccgtttttgatgcaggtgcaaatcatgccttcctcacccgctcaggactgcgatcgtcagggcacagggcaggcctcccagcagcactcccgtgtccagcgggctggcaggtggccggggtccttggcttcctgggcgtcctggccaccgcagggaggcttgttttcttttgctgggcgtgaggctggtctccccctcgtcagctggtggcgtgagatgcccttaccttgtgtttttggattcttgtagcctcagctcgttctgggtggcgctgcccagacggcttcacttgggacggcgacggctgttcagacggggactcctcagcgcacggtaccaggggcgaccaccacttcctcagctgccacggtaagagccactcctttccgtgccttcaaagacggtcaggcccgtggcgcaggtcagaaaatgcagccttgagacctcaggccggcttctgtcccagaccgctcactgcttgcttcacaaagcagtgaacagtctggggcccacgtgagcacgtggggctctgctgctgtgctgtgtgaggtgggctccgagggccttagaccgcagaagtctgcaaacagcaaaagcccaaacacctgcctttgaaaaagtcactggtgcac

SEQ ID NO: 101696 - DNA, 1322 bp, Homo sapiens
tattttgaaaggggcgttttggggggaagttttcttaatgggcataaatgtggctttttggatcaagaattttagatgttagcccaggagaggcatcaccattattcttgataccatgctgagtttcgaaagagctggagccgacagccctgagagtgccccagcgtcatagcgcaggaggaggaagccccacgctcatttgtcatcatgaccaacaggaggttttcaggccttacttcatctttttcgaggttatcatttcccattctccataaaggggaggaaggagaggctgggaaacgcagtggccgccccctgtgccccgtggcttggccagtgtgtgatgggtggtggggacggccggtggcggtgcctcattgcacgtgtgtttagtttctcagctccttggtgctgggctgtctgccgaggcttcactcgggaaagagtgcagtgtttatagccctgctcccacggctgcatccccacctctgtcatgggaagttaaatttaaaagttggacaattgtgttgctgtttctaatggaatttatgatataactggttgctgttttttgaagctaacattaatgccaaacctgaatggcaggatttgctttcctgtggtttagctcaagaaccatgacgggcaaatggttctcctgtcctaagggttgcgtcgcatctgcgcctgtgttgtggttgtcagggcagtgtgggggcagcactgccctgcctcccgagaggagggttctggtgaggagcctcgtggcccaccctccctctgttgggtctgggtgtcacaggacagcaggctgggagaccctggagtatgggccgtagacatggttgtgccctctaggcccagcccagcggacgtggccctggcacaggcaggaggtgggggcaaggagactggcatgtctgtggggtgtatgggctggttgggggcatgggggcacgtggtgtggccggtggaagccattgctacactgccttgctgtccagctcattcataaaaggaaggctcaggtgccattttttttccatggccttttaacaacctttacagtttttttgtcttgtataccatcttgactcacaagtgtgttttgagtttgggggattcgtgtgtttaagacttgatttcctttgtttccttctcacagctgtcagcttcccctgggtcaggccagggcctcctcatggctctggggtggttgcgttcctgacgccaggtctcctttgtctgcaggaatggtcctcgtccgaagtgagaatgggcagttgttaatgattcctcagcaggccttggcccagatgcag

SEQ ID NO: 101697 - DNA, 1051 bp, Homo sapiens
ttgtggaggtggtggggtacggagagcctcctgaatcaggccctgccacgtgtttatccatgaggttccacatctgtgctgtgtggcccttggtgttgctttcgtggtcacctgatacattttgtggggccagtttaaaaagtagataagacaattcaacattattggcaacttagtaaagtttttggacgaaatttgttttcaaaaaattattactctaagcatgttaattggaaaattggaggctgtactgaggtgtgtggagtagggcaagcaagacccttcccagcactgtccagcccatcctgcgagtgcgtcctctggcttcagggctaattgaaaatgtgcttcgaggcacgacaggccgcagtggggtgtgacagttaagaaaaagccgaaatgggcactgctgggcagggtaaactttattaactgttgaatgactggaaaatcattttaatgtttcagagctgttttaaattatgtgtctgtctacgcatgaaagcgaatctaaattagtattgggctttggcatgaaaaggctgtggtgtcctgactctgggtggtgacgtctgtgatgcttgtgatgctgctgtgtcgtcctatccaggacaccagaaactcagattcgttgcctgcactgaccgggcactgtggagatgcaggtgtccagtttcctggcgggctcgttggcgtccctgcctgtgattccgctccctggagtgctgcagaggcctctgctgcctcctctccttgtgcacgtggccgcacacccctatcggggctctggcccgctgcgctgctcgcctggcctcgcagcgctggcattgtgcgtctttcctccacctggccagctcctgacacccacatgggcagcttcaccgtgaccatgcccctgcggcgcactgttcttccttctggcccagccctgaggcttcccctgaccactgtgggttacctgtgcctgccattcttttttttgttttttttgagacggagtcttgccgtgtcaccaggctggagtgcagtggcgcgatctcggctcaccgca

SEQ ID NO: 101698 - DNA, 1031 bp, Homo sapiens
gcgctgggtgtggcccaagcacacctggggcagaggctttgtgggtcagctggtccactgggggctgcagacactgtgggcagaggtgctgccggtggcaaggtgggcaccttgttccatggggtcgggggacacagcctttcattttctgactttgcagtaaagtgtgtgggacaatgacctgtgaaagtttttaaaggaagttctgtgtcttctgcggaggagcgtggtctccgtggtgttcataggagccacgcacggtgctcagagcatgcccagaacgcacaggcctgccttgctttggagctttgcagaaggttacgaatgtcagtgtcagaagcatcatgacaggaacaagggtgacacgggaagcaggctcgattggcttttttatgtaactgtaagtgtaaaaaattattagttacttcaacatgatttttttgatgataaaattagtttttttttcattataggaagtttgggaagtaaactgtaaagaagaaaatacagtcacttgtaacgtcacctggcccagactgctaaaatttcggggtgtctcacttcagcctgtgtctgctgcatatctgcttctgtgtttttctgtaattacagttctcctgtgacccaagtctgtgctttgccttgtcctgtgtctggtgcactttcccttggccctcggtggtctcaggctccagcatttggtaacggcccctgtgccagggtgctgtgctgatggcgacaagtggccccctgtaggtgaatgccttcatgtctaactgtgtgtgtgtctggtgggttgagcattttcaaggctttgatacatatcaccttccaccagattacacttttaaaaccattgccagaatacgacttttgggaatggataccattctaaaggaagaaaatcgtgtctagttttaagttgcatttctttgagtgaaattagacctcgttcatgtggatgttggctatttattctcgccaactgtgcctatttgtataagcgcgttcttgtttttttcttttttttc

SEQ ID NO: 101699 - DNA, 1975 bp, Homo sapiens
gaatttggtttaggtagctgtcatgatattctttgtcaggacagtgttgtaaagacagttatgttaatgtaattgtaatttgctggtttgaggtgccagagtttagattttattcactgaggaaaaatgagaaaactcagtctttagtgagattgttgcagatgacacagttgtcccaagatcacggaaaagcactagttatgtacagcttaggatagtcataacgtcatagtcaggttgtgattacagctgaaagaagaaaaaggtgatttgacacccacattagcatgttggtaaattgttgagagatcttttcagatcggtgtaaggtaaagaagctcatttctaaaggttatcttttggcctggcaaattcacattttcttcagtgtatcttggtctattgtgctttcatgcagaatttactctccttttgctctaagatttggcccaagtgtagattcccattccaggacagaaaagcactttctcaccatgggccttgatcccttggcctagggggcgtgtgcttgctgcatgttttaggatgagtactcccaggtgaatgtgtgtctgtgggtgctgtctggagcattggttcccatctgtggggaaagggggaaaatgtccactagcccttaatcgcgctgttgggacgggttggatttggcgagtccaggcccatgctgggtggcggcatgcagacggccacccctgaggttgcaggagctgtgagttctggtggccagtggtggcagccagtgctctggcacaagggacattcctaaaagtttagattttgtgacttgagggccctgttgccgtttgacctgggaggaatatgttgttcctcggagccttggcttacccagctgtaaagtggggttgcccttttggtgaagaatgtgaattctgtcaggttgggccagataacatagctgtcaggtggcgctcactattccaaactctcccagttcccctcatttttcactgattttcacacattaatccagactggatgttttctcagtgactgaggtgtttggtgtggcagctgactggttctgtcaatggggaagttaccgaggtctgaggtgggtcaccctggggcggtggttgccaacataggggagggttgcagtggcctttggaggcctggacctgggtggagggctcactttaggctagaggccttaatctggtgtttcttttgacatactcaggtaggagtgacatttgaaaagaacaaagaaaaagaacttttggggagctgtgtaaagacagccctggacagctctgcctagcatagggcaagggcgccgctctgggtcttcccttcctccctgccccctgccccgcggctggggtcgtcaccatcgccttcgggatgaacagagtcatcttggtgacaggttgggatggacctcacctgcctttggtgtctcagagctggtgaccctcatggcttagtggcagccaggagtcggggtcctgtgacgctcttaggagcctctctcctcactgcttactgtgcccgagcactgcattcacagcagaggtctatgagtttgaacagaggatgacgtttgaagttcgttacggttgccctggttcttagggcctgtgagaagctttgtaggagagggtgtcccgcttgcttctgtggcaaatggacctgaggcaggccccgggcgcctgggaagttggccttctcccagggcagagagcagagccaccctggcttccaggactgcccccgggctccccggtgtgctgtggaagttgccccttagacatcagcacagggaggccgggaggcggcgtctggtcagagcagcacagaccgggctcagcagaacagactggtgggcgtgtccgcatcccgaaatcagagtggaatggagacagttcctgttctacctccaaagccttttctactgtataatgtgagttttcttccacttaagggataaatt

SEQ ID NO: 101700 - DNA, 1135 bp, Homo sapiens
tgtcgcagcgcgccctggggacggggaccggcgcccggcccctccaagccgccgcggggaagctgggtccgcctctggctcagccggtcccgggcggtggggaggggtcctgcgcgcacggctcttctcgccctccaatcgtgaccacccctggcccttccctccatttttaatcaataaacccagccgccccgggctgactgtccccgcacccagctgccttggagacaggagtgtcgtataagcccgtaggtaagagcacggtgcttgccaggcgccaaacgaagttcccgagcctgaagccggcacgtctggaagtagctttttttaccttctgctgggggaggggagtaagttacctaaagtgttcccaagcaccttctctctagaaatacttcagtaaaagttccagtcccctctttctgcgtgttttattttccaaccaaaagatggtgttattggacatttctagtggttttcctttctctcatttcttcctaagagcccagaataggtttcagagagacgcttccttgcctcggacctcactggggccaagaggccacagggtcagtcttcgcagctgaagacagcgccgcaataagcagagacctcgggacgatgaatgacgttgctgacaaagaaaatgatttttttaattgctttaacaaaggagactgctagtctcgaaagcagacccgaactggacccttgtgcctgttcgaactgtagccttgcaaaggaatggacttactgataactggaatacgggacttcaccccaggcttgtttctcgacagcagcagcagccaatgagcattgaggacggagcctaggagaggtgcctcccctataggggaacagtgtttgggggaaatcactgcaaacgtacagctggagttttgtacctgaactttggctcccagaaggcaggaaaggaaatgaatgaagcaagctgagtatggcggggagggcccctgtgggtacacctacggagcaccttgagctcagtagggggacagtctgagttttccagaaagaacagaaatataaagtgatgattaaatctcgggatttttaatttttgagtgttgacaactaattagaacatttttaaagcaggtcaaagcacagg

SEQ ID NO: 101701 - DNA, 1517 bp, Homo sapiens
ccacacttctggggaggtgcctgtttgtaggcacggtgtttttcctgtccttgaggttccctaacttgggaagctcagggctttgggagtggggagtccaaagatgaactggccttggtgctgcccagtgactcttggccttcttttgctgcctgggctagcctcagagggaatggcccagtctgggggtgctttgcctggatttgatagaacatctaggcagttgccctcctttccttcctgacatgccagcagaagagaaatgcctggagatataaggcttgcttcttttctctctgtttttaaaccctcctcccctcctcaattcaggagctggttttccatccatcccagtcggcaagagccccatggtggagcaggctgtgcagactggttctgctgacaacctgaatgctaaaaagctgttacctggcaagggcaccacagggacgcagctcaacggtcgtcaggcccagccgagcagcaagacggccagcggtacttgaacacatcatttcctggagtttgcttgatgttctaaaagtggcacactacttcctgggctatttttttttttttaattaaaaaaatactactcccccatcctaagccccatgtgcttttgcagggcaggcctgtgcagcagcctcctgcggtgccgccctggccgcgtgccccatggtggtggggcctgcttccacagctgggttctggcttccggctgctataggagctttgccttactcttcccttttgcgccgtagatgtagtccagccggcagctgtgcaagctcaagggcaggtgaatgacgagaacagaagacctcagaggaggcgatcaggtaacacctgttgccacttgatttctggggaccacgagtgatcaggctgagctctgcttgccctcctgcctgcttctctggttgacggtttcaggggtgctggtgtgaagtcgctgcttgtgtgctctgttccttctgtggccttgggggtgtgcctggaaattccttgtgaggtgtttgagatcactgggttggtgacctacttcagccagggctgtcctttgtcctcacaggaaacaggcgaacaaggaatcgctccagagggcaaaaccgtccaactaacgttaaggaaaacacaatcaaatttgagggtgactttgatttcgagagtgcaaatgcccagttcaaccgagaggagcttgacaaagaatttaagaagaaactgaattttaaaggtttggctcattatatgaaaattattctctgcacaggagtacccctagagagtgttaggaggagatgcctggccgggtgtggtggttcacgcctgtaatctcagcactttgggaggctgaggtgggtggatcacctgaggtcaggagttcaacaccagcctggccaacacaatgaaaccccatctgtactaaaaatccaaaaattagccaggcgtggtggtgggcgcctgtaatcccagctactcgggagactgagacaggagaatcgtttgaacccagg

SEQ ID NO: 101702 - DNA, 1022 bp, Homo sapiens
ggctccagagctgacggggccgccccttccctgtagtggccctggtgagtctgtccctccttccctgggccgctctgaggacgaggcctggccagaagcctgggagtcagtgcctgctacaatcagcatttcctctgtggtttagctccaggcggacgacgtgggccgaagagaggaagctcaacacagagacctttggggtgtcagggaggtttcttcgtggccgcagttctcggggcggattccgaggaggcaggggcaatgggaccacccgtcgcaaccccacttcccacagggccgggactggcagggtgtgagggtgcagccaaaggtgagtggatgaaccttctggacgctttggtgggagggtgtagggtcaggcacacctggagagcttaggaaggtggggagcaggctcggtttcccaggaagaagagaggcccagaggtgtcaaagccaaaccgagggcctcgaccctatgagtcacccgggaggctcttggccaacttcaacctgcatctgtgggggtaggatccaggccccagcatcctccaagtgagattgcaggtatgggaggtgaggtggtgcgggagtcgcgtgggctgggggctcaccacccaggtgaagccagcaagtgagaccttgctccaaagccagtgtcttggcccaacccggccctaagtgaatcagaggcttcatttttaaccaggtcccagtggatttgtgggcaccttagggtttgggcggagcgtcccacatggggtgcctggtgccaaccccacccagcgcctcgggacagccaggtgggccctggaaagactagccctcctgccactagctgcgtccctgtccccagtgtattgtacaagtaggattctcagagtgggttgtgagaagaatgggggtagccagtctgactctgggggcaggagggaggctgagtggctcctgctcgccagcaggggcaacagtgctagcttatcccagcagatgcttgacttcctgtcatctcttgcaggctc

SEQ ID NO: 101703 - DNA, 1081 bp, Homo sapiens
gggtggggtctcaggagtcaggcagggccagcacagggtggcgtggggggcaggggtgggtgggtggagggcacggaaggggttttcccatggatcatgttgtataagtgaaccagaccaccctgatggcatccacagtgatgtcaaggttggggctggccaggggtgggtggactagaagcatttgggagtagtggccaggggccctggacgctagccacggagctgctgcacagagcctggtgtccacaagcttccaggttggggttggagcctgggatgagccccggcagcgccttggcccttctgtggtccctgccagcctctgacctgggccggtcagtcattgctggactctggccacacactggcgttctcatccacttggaaacaagccagtcttttctgcaaggtcagttgaccaagagcatatttcccctctgttgtacatcgttgttttgtgtttgtgttgtaacagtgggtggagggagggtggggtctacatttgttgcatgagtcgatgggtcagaactttagtatacgcatgcgtcctctgagtgacagggcattttgtcgaaaataagcaccttggtaactaaacccctctaatagctataaaggctttagttctgtattgattaagttactgtaaaagcttgggtttatttttgtaggacttaatggctaagaattagaacatagcaagggggctcctctgttggagtaatgtaaattgtaattataaataaacatgcaaacctttaaaattttcttttctgatgctctaagaatcctgttgactcttctgcccaagtcacctctgcatcatgtccaggtctggagcacacacttaggctggtggaatttggggagacttgggccccatcaggtgatggaacgaggtggctgacccaattggtcgggtgaagtgcggccagcagacccgggttctccctgtgggccacccttctgggatgaatggctctgctctcagaaactggatacaaagttcttttaaaaacccagctcacagataacacctgtatcataagcagtggcccctttgccaccttcctgctgc

SEQ ID NO: 101704 - DNA, 1070 bp, Homo sapiens
ttgaacttgctgtcatgaggcgagatcaatccctcaaggtaatcaccaagtttgtctgctttctttacctgtcagttttctcccatgatcagggctgagcagtaccagttccgaaggaaacatcatagggccattctgtggttttaacattaggaaaatgtctttctgaggctccccatacgtcaaagagaagattcccatcttcctctgattagatggtccacgcgtgttctctgggcatgctgagcggctgccagtcagatctgctgctgctgctactgctgcttaatacttgtctaggtcaggccagcatcctcttgtttttcttgaggttcctctccaaagaggctgtatgagcagcagtgccaaagcctggccgccctccccagaagagggcgctggttccttggcaccttgtgtggcttaggtaaccatgaagtttttttctatagattttaaatcctgaagaaattgagaagtatgttgctgaaattgaaaaagaaaaagaagaaaacgaaaagaagaaacaaaagaaagcatcatgatgaataaaatgtctttgcttgtaatttttaaattcatatcaatcatggatgagtctcgatgtgtaggcctttccattccatttattcacactgagtgtcctacaataaacttccgtatttttaacctgtttttttttttaagagaatgtgtatctttaggtgcaatcacagcagtcctctcatctctcacccttctttttcaaccctgagccaccgtaattgagctttcctttctgttccttgtggctaagacagtaagccagtgtgagacacaggttcctcccttgggaagtcagagctgctgccctgggtcctgcagagaaacctggccttcagcagacctgtttctctgttgtagacacagaatgacttccgtttgcttttagaccttcattctagtcccctaatgaatgtataatgtcaaggacacaaacacaagtagccctgggttcattctgtagagcagcagctttgttcaaagcagctttgcatgtctgactttcatagaccacatcttgacgtctg

SEQ ID NO: 101705 - DNA, 1096 bp, Homo sapiens
gcctggccaacatggcagaaccctgtctccactaaaaatacaaaaaaaatttgctgggcatggtggcacatgcctgtaatcccagctactcaggaggctgaggcaggaaaatcgcttgaacccgagaggcataggttgcagtgagccgagatcacaccactgcactccaggctgggcaacaagagcaaaactctacctcaaaaaaaaaaaaaaaaaaaaatctcccattgcctcttgatagcgcagtaaaacatacaatcgtataaccccattctcggtaagaatcagcatcaactctaaagagctctttgcaaaaggaagccacgaggcagggcctgtgtccacagctgctgtccagcactccagcttgcctcctgccactgccactggctgggcggcccatgtagggcagctgtgttccagggctggccctgggttgtcatgccctatgccacgtgagaacatacgtgtctgttttaggccaatgccataggtcggggtgccaagtcagtgcgcgagttcctggagaagaactatactgacgaagccattgaaacagatgatctgaccattaagctggtgatcaaggcactcctggaagtaagtttgcatttggaatccaggcaaggtggtgaagataccacgttttggtggtgagtggtaggtagatgagcaggaaggaaggtggcaaggatccagcagtaatgcttaatgactgctgtgttccaggcactgctctggtctatggtgtatcctaactgctgtgttccttgaaatagccatgcaagatgtgatcattagtgtctttatccagccggggcagctgagggttgtgcagggacacacagcatgagaaccagaggcaggatgtgaacccagctgtccagctgtggaatctgttctcgagccatcactaggccttccagaggcttgaactgttgctaaagtcaggggattagagaactggagatatggttgggctttgtcaagaccttgaagtgctagcaggtaaaaccagagagggactagctggaaggccaggcgggagcgtaggcatcaggattcctggttgtaaccactgtgtcaagaggagggc

SEQ ID NO: 101706 - DNA, 1069 bp, Homo sapiens
ggtgccagccacagtgacagacaagtagaggagaaaggggtgtgggtgaacgcaccttccagtgggagctgctacccggagtacgtaccccccaggacccaggttcagatctgctcctactgctcgctgcctggcagtagaaccatgtatcacttttttgggaggatagggtggggtgaggggacagggtcttgctgtctctgtctcccagccgtcatggctcactgcagcctccaccttccaggctctagcgatcctcccaccagcccccacagtagctgggactacaggcttcagccaccacacctggctaatttttgtactttttgtagagacagggttttcccatgttgtccggctggtcttgaactcttgaatttaagtcatccacccacctcagcctcccaaagtgctggaattaacaggcatgagccactgcacccagcactcatatcactttcttacgtggtttgtggatcttaattaaaggttggtgttcgaggaagagacattgttgttcttggtgtggagaagaagtcagtggccaaactgcaggatgaaagaacagtgcggaagatctgtgctttggatgacaacgtctgcatggcctttgcaggtatgagtcggtggggagcgctgtcttactctctagagtctcagcgaagaatagggctttggagattaacttgggtgtgtgggctattgtgagccatataaactgagtaaatgaaaatcatttaaaagaattggatttggacttttaagttggctagtttctttggtggcctctctctgccatagcaggtgaaacaaatggctaaatggatgaaaacacttctggctgctgcgcaatttgacctccactgttatttttctgtatcaatcagttacaatctagagaaaggctggactttctagagctaactgcatctgtggcatggagaggacagaaccacgtcctgccatccccagcagtaaaaaggaccacactggtggatgcaggccatgcctcgccatgttctcagcgctgttttggtcttgctcatttctcctctcagcagatgcaatc

SEQ ID NO: 101707 - DNA, 1086 bp, Homo sapiens
attgatgttttgttttaaaagttaaaagtaattcttggcgtggtggttcacgcctgtaatcccagcactttgggaggccgaagcgggcggatcacctgaggtcgggagttcgagaccagcctgaccaacatggagaaaccccgtccctactaaaaatacaaaattagccaggtatggtggtgcatacctgtaatcccagctactcgggaacctgaggcaggagaatggcttgaacccaggagacagaggttgtggtggggcaagatcgcaccattgcacccgagcctaggcaacaagagtgaaattccgtctcaaaaaaataaataaataaataaataaataagttaaaattaattctttatccagagtcgggtgctttagaatttataagtcacttatgtgttttgcttgaattaattctgacagcccctatgaggaaatctggaggcaggtaacagttcccattttagagatgaagaactgaggcacagattaaaggacttgcctgtgttgaataccagtcctgttctaggacattctcccctctcctaggagacggatgtcacgcacaaatggggagagaagtgtttattttgtaggcactaagggtttctaaaacccttaacactggtaagggctcaaaaataaacgtatgtgttcatattcgatcaccgaaatgagagttcttaattgctaattgacaaacgcgttagcaatttcagttagggagtcatctcccttgattgtgttcttttcctgtcaattttcatagacctaatttgcaaactcaatcggggactaaaatttcccactgaaaatgttaaacattttagataactgtgaagatagtttatttttattccttgccaatctgggaatatgccttttttgtgtgtttgtgtgtttttttaagtgctgtattaataatactttctgaaagaaaaggacacttaccccaaaacttcaatctgaaatgtcttacattaagaatatcttgaatgttgtgtatatattttaaaaagcactttgcaaaatagtttgtacatttatttcctaatttatacatgatttttggtgttaatatat

SEQ ID NO: 101708 - DNA, 1035 bp, Homo sapiens
gacctgtcttgcgtgggagatgagtacattgccgcgctgggcggggcaggagggaaaggcaaccgcttcttcctggccaacaacaaccgtgcccctgtgacctgtacccctggacagccaggacagcagcgagttctccacctggagctcaagacggtggcccacgccggaatggtaggtgtccccactgccaacagcatctgcacacactcagctctagaaaatccacttttctcaatggggatttgccagtggcctggaagagaacagctttgcgactcacctttttcccatcagtacactgctgacttggtcgtgagcatgagcccttgtgactcccccagccctgaaatcctccctccaatcccagttagttacagactctgcgctaacaaaggtgctgccgcgggccgtgccaccgtcttccctctttcccccaggtgggattccccaacgccgggaagtcctcactgctccgggccatttcaaacgccagacccgccgtggcttcctacccgttcaccaccctgaagccccacgtcgggatcgtccactacgaaggccacctacaaatagcaggtagaacttccagaattctcccaaaggttagatttaaatgatgtaattcagaaaagtaatgatgtaactcttaaatttagctttctgtttaaaatgtagcattgttggccaggcgtggtggctcacacctgtaaccccagcactttgggaggccgaggcaggcggatcacgaggtcaggagatcgacaccatcctggctaacatggtgaaaccccgtctctactaaaaatacaaaaaaattagctgggtgtggtggcgggcacctgtagtcccagctacttgggaggctgaggatggagaatggcatgaacccagaaggcaaagcttgcagtgagccgagatcatgccactgcactccagcctgggcgacagagcgaaactccatctcaaaaaaaaaaaaaaaaaagtagcattgtttttcctaatgtaaacaacttttttttttttttttttttg

SEQ ID NO: 101709 - DNA, 1010 bp, Homo sapiens
ggcatcatacgaggcgcccaccagaacaggggtctggggtccgccttcctcaggcacatcgagcgctgccgctttctcttgttcgtggtggatctttctcagcctgagccgtggactcaagttgacgatttaaaatatgaactggagatgtatgaaaagggcctgtctgcgaggccccacgcaatcgtcgcaaacaagattgacctccctgaagcccaagccaatctgtcccagctccgggatcacttgggacaggaggtcatcgtgctgtcggcgttgaccggcgagaacctggagcagctgctgttgcacctgaaggtgctgtatgacgcctacgcggaggccgagctgggccagggccgccagccgctcaggtggtagccacgccagagcggggtcgcctctgggcctctgtctgagcaaacctgggtgtgaattcggtggttttgaatgcataaagtgccttgtggacacgggggagttgtggtgcttctgggtctctgggccccgcctgctggcctgagatgccctcatgttgggaagcattccgtgccccctaccccgcctgccctccgtatttcctgcacctgtcagcctgcaccgactgatgagccagttgctcatttgtgctgattaacacccctaataaggggttggggtgcccataacggggtggccctgccgctgactcaggtctccgccatgcacgcgtggactctcggatgagctcagcagaaccgcacagccagagccccaggtcagaagtgcagaccagggttctcagcacagtgcccgtcgtgcttccatggcttgctacggagagagacctctggatccacactggggctgcgtctggcccgttgtccagcagccctgcggtaccgcaagcccaggcaccagtgtctcggggggcctcactgctgcgcaaggggtggggccgaggatgcaagtccaggcagagcggcgcaggcagctgtgagcttttctccatcagccgtctgagaagagca

SEQ ID NO: 101710 - DNA, 1001 bp, Homo sapiens
actggaacacggacctgggtggctcccgcaggcacacgccccaccaggggacccggcctgggaagggggcgtccggagcccatggggtggggggcacaggcgaagttccttgccactcaggcctcgggacaggggctggggagagatgtccccgggaagggacacgggcactgggcgaggcgcaaggcgcaaaggcagcgggtgcagctctggctcctgcgctgtagccaaacaaaggctgctgcggacttaggacgcgcggagggcgcagtggggcggtttagagaaggtctgggggaggggacatggaagggggatttttagagctgtgttgggggaagggacggtggggaaggtgggggttgggggagacgctcggaggagcgtgctctcacgtgtccaggctctgctgccggctggggggcggggcacgcggagggggctggagcgccagacacctgttggggctgtgaggtgcgtctcccagacgctccaagcccgcttggcagtagtagtagcggctggcggctggcggctgcaaccaagtgccctttcagccaggagaaaggctttctccttgtctaagctgagaccgagggttgtccagcgccagggtaggggctggagtccagcgggggaggggagaaggaaattgtcttctttcctcctttgagggctgggagggctggacagaagtccagggaatcccgactccaggctctcgggggtcttgtggtggccagagttccccatgcctggatcatccctcctgcccccaggcccaggggacacagatagtgctgggagctatgtgggggtgaaggctggcggcagggcagagtttgtggctgacaccaggtggaggggtggtaagatgaggatggctagttccagaaaagcagccaccatgtgaccccaggtcccgccggtgtctgcgcttaggtccgtctgtcccctggcccctggctgcatggtcccactgtggccctactccccacagg

SEQ ID NO: 101711 - DNA, 1092 bp, Homo sapiens
tggctccaacacctgctgaagctggagcctctcagcagtgcagcagtcacaccctcaggtgtcccgggatctttgggtgtgggctgattttctcctagtcattgtcatacttcctgtttgggtgttgacatttcgtttagtgtttagcacagattgtcaggtacgaggtttaattccaatatgtagtacattttcaggttgatttataaccttatctacactgaaaggaagtcagtatttgaacatgactgattattaaaaaggaccgaagtcctgagttaatatggtgggttctggtttgatagtttaaatgcactttccacatatgctagttgatttgtaaatctgctgtcatttttgctttttcagagtgttcttgctagtgagtttcaggcatggtgtcccggcctctcaggctgctggtttgggctagggtcccactgtggaagcgtggtggtgtcccggcccacctctgcagctcttgataataaaagcatctgttaaatagctcacagcactgtttgcgtgaactttttggcacttctttccttttccttccagattcagaaaagaacttgggatcattcagcagaatgtcacagcatccacattctttccgctggagcttctgctgatgcaaatcctgtgacctctgagttgagctgagtggtggaagtgagcttttataagggactggatctgagactcgtgcctgatgtttgtggctgtttctctttgcttgccttctgttttcagtggaacactcgcttgatgtattttgagaaacaaactctgggatcagtcctgttgagctagtggctggctccatagtttggggcctgaagaggttcccgcaccctcagggcttgtggcggtcatcaggcctctctcctgggtgtaaggtgtgtacttctcacctgcgcactgagggcctgggggctgtggccccgacgctgaggcaagtcaggggtgggaagggtctgaggggctcttggctgagcagacactgagcacatttctttatcaaaggcgctgggactgcaaccttcaggggtgcccagagagcgcctgttgtgggctcatacggggagt

SEQ ID NO: 101712 - DNA, 1035 bp, Homo sapiens
ttttgtatttttagttagagacagggtttcaccgtgttggccaggctggtcccaagctcctggcttcaagtgatccgcccacctcagcctcccaaagtgctgggattacaggcgtgagccaccatgcccagccaataatgctttttagaaacaactcttgttatagggctgaattattggtctgttattcattgattgatcttccgttataaatgctccctctcgtttactttttgaaattatgtttgtgatgtgataatttattttactaatttgcttacatggaatttagattgattttaggatggtgaatgggtatttttaaaatgtttttaaaccgtgaaacttctggaagctaagtatgccaaaatttttttccctttagatcttcagtgtctattggatttttccaagagaaagtttgtaaaattccttacactgtagatgtggatcagatacgatgattcagtagaagagcacatgtcaggggcagtggaggctggctgctgaaggatgaacggagaggaagaattctttgatgccgtcacaggtgagtcaaaagagaaccaactggggacgtactggaagggtgaacgtccctggattcagatgttggacctggcgtttggggtgtaaagatgctcagtaaagcagtgtgtgggtgagcgttcacgatcccaaacacggactgttcagcaaaacctgacatccatctcagaggtgggaaaagccttgactttggctgacagggtttaagtctcccgaagagtttcctggggtgcggatattttcatttgtctcctgagatagccatcttcttcccctatttctgcttcatgatgagaacgttctagatatgatgaccctgtcttgcttggcactgcttgatgcatcccatcagacagcaaacccctgggtctgcagctgcgctcacagccgcagagtgcagttatttttttctttcgcacgatggtttaaagtggcggcatgcagcctgtggtctgaatgaaatcctgtggcctaattgaaaagaat

SEQ ID NO: 101713 - DNA, 1050 bp, Homo sapiens
gtggggtgttttcttcttgggcagggccatttgggaggatgaggagtaaaggaaacaagtatgtggagtgcggttgaaaaccctgcacccctccacagccatgtgccagctccccagaaagccagggccgcatgcccaggaccctgcattactgccgtgtgtgtttcgtgaggtggcctttcttttgacgacttcacaggaaagccatttgtctttgttcagtcttctttgattgcttattaacttgtcttgacatttaagtagaaagctttgtagatgctacaaaggaaagaagaagtacatttcaaacgcatgctaaatacacagcctccgtcgcaggggcttcaaagcagcgtgctgctctcccgcgggtgccggttgctgtgacccagccccgcctggtcgttgcgtcttgggtcacgtcgtgtcttggcttttctggactctcactgcttgttttctggtgtcttcacagacataatgaagcctacacctggaccaaccccacctgctgcgtccacaacgtcatcatcgggaagctgtggatagagcagtatgggacagtggagattttaaaccacaggtgacagcaccccaccgttgggtgagagcgcgaggctccgggtggggatgggcgagccggggagcgtgagcatccgtgctcctggtgggttttagctcagcctcacgagctgctgccgtgtccccgccagcccaggcatagcagctgcctagacttgactctgaccggtgttggccatgaatgctcctcgttcaagacctcgtttttcgtcacggttgttactttaaggctttgagctatgctgaagagctgtgtcattgccaggtgcagcgcagtggccgtccacggccgttggccactgtctaggcttgaatgccctattcctggaagctcatgactggtgggctttgccttttcaccactttagtgaggtataatcgatgcatcataagactcgcccattctgaatggacacttaagtgatttttagtaaattgaccgaatcatggagccgtccccacagccca

SEQ ID NO: 101714 - DNA, 1102 bp, Homo sapiens
cagcctggccaacatggtaaaaccccgtctctactaaaaatacgaaaattagccaggtgtgatggcgcacatctgtaatcccagctactcaggaggctgaggcacaagaatctcttgagcctgggagatggaggttgcagtgagccaagatcacgccaatgcgctccagccggggcagccaagcaagaggctgtctcaaaaaaataagacagttggtgtttctgctctgtccaccctctatggtagaccagaaatgcacccgtttgaacagcctataaaataaaatggccaggcttatgactgaccatttctcccataaaacatgtgaggatcaacatgtggacctagaagggacagcagtcttacaacagggtagcagtcatcagtgccttgacacctctcccccttggaactcagcccagggagcagctggctgtctgtttccagaaataggcgggggcgccgaggccaacactcgctgaccctcagtgagtgcatgtaaaacatgtttttccagaaccgggcagggaccccgaggccagactcgctgaccttcagtgagtgcatgtaaagtgtgttttggttgtctggttttccatcctaaatttaagggtgctctgtccttggagacagagttgtccccaggctgtctactaggtgaggcctggcccagttccccgcgtctgtgtgctggctctgcaggcactgcagtgacaccgtcccctcctgggtcccgagtctgtcagagttgcacttcccgggagtctgtggtcacggttgactcttcccagcaagaggcgaaaggagaaagaaaatggagtctggcactatttggcttcatcccttttagaatcgagagctctggtggccactctgcaaaggtctctgggttgttattgatgaaaaaaggcaggcggggaaccaaagatcaagcaagcagcattgactgcactgattgatagaaaagggctgaaggacacacacacaacacattgagtgtgttgaaaatgatcagtgggcgcatgcagctttacattttaaaacgctcactcttttttgccccttcccgtctcctgcagccccctggaccaaccatcctttg

SEQ ID NO: 101715 - DNA, 1053 bp, Homo sapiens
gatcttgaagctaatcctgcagagagttttatagaggccagggattgccttctaaattatgataaaacagaagtgaagagtttcagagcatcagattgagtgaaaagttgtcagattctgtattttttaacaatcttcaataatgtaaagattacttttaaaatatttaagttaaaactacttgaatagtattttgctgaagagcaagatatgcattaatcaccggttttatactgtccaaaatgaagcatccccgtgacaaaccagagtgggcagaagcatcgagagcgtgacaggaaatcccaagactgcttccgcctcagaggcgtcccggctgcgattcgctgccctgttgtcagtgaggcctggctgtcaccgcacaccgcgtccgtgtctccagggggttcctttcttctcacacgtcgcgtgtacccatagcactcttgtgtttctgtttttcccagtatgcatgtttaaaatagaagtgacaagaatcacatccggttgtgtcctgtgggagggtcagaggcagaatctacttacagtggtgtaattaaagttatttaaccaaaaataggtatgtgtccatctcagcattcacctttatcaagtgactgatttttttttcttttctttccttttttttttttttttgagacggagtttcactcttgttgcccaggctggagtgcaatggcatgatctcggctcaccgcaacctccgcctcccgggttcaagcgattctcctgcctcagcctcccaagtagctgggattacaggcacgcgccaccacacctggctgattttgtatttttagtagacacgggttttcaccatgttggtcaggctggtctcaaactcccgacctcaagtagtctgcctgcctcaacctcccaaagtgctgggattacaggcgtgagccactgcgcctggccgtgactgattttttttcatgtagaattgtcaacacgagagatcacagtggagcactttgaaagaccgtcggttgtgtgcacgcacgcacacactcatgcacacgctgacacgcggtt

SEQ ID NO: 101716 - DNA, 1274 bp, Homo sapiens
gctggggccatgggctgagtccctgcttgcatgccttccatgtgggcacttaggctgtcatcgagctgatggccgtgttcttgtgccccagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggtagaggccgggcccagggtgtcctccactgtgtgctcagggagtgggcaggggggaggaggaggccctgccccaccttcaccatggccagtgcttcatgtgcctgacccgcagagctggcagctgagcagtgtggctctggggtgcagcccgggttggagctcagccctcgcctggctcttcttgcaggccctgggcatgttcagcgcagccttggcctcggggcagctgggccccctcatgtgccagttcggtctgcctgcagaggctgtggaggccgccaacaagggcggtaagtggctgcgcctgcacctccaggccagagccaggggcagggtccattcctgtccccctggatctgcagaagtggggctgagggggtaaaggtcacagcccttctgcccttgatcccatcgctttgatccccagttctgggcaagggttagacaccaccttgtgtctttaacgtgttctagatgtggaagcgtttgccaaagccatgcagaacaacgccaagcccgagcagaaagagggcgacacgaaggacaagaaggacgaagaggaggacatgagcctggactgagccacgcgccgtcctccgaggaactgggcgcttgcagtgcgttgcacaccctcacctcccacccactgattattaataaagtcttttcttttacctgccaatgcttagtttctttgcccaaagggagtttcggctggacaggtgctagcgtggggagctgctgtagggtcccagagacagttagttatttgacctaacaacggaaaacggtcaccccaggaagagtttggtgcctctgtccaggccggttccagatctgtcttgagactcactctctccgtatttaagtcaacattcattcggttacacagaagttactttttaatttttaaggaggaaccagtgatgattggtgacaaatctctcacaattaaaaatgggtggaagggccaaatataaaaacattttgcagtattttattctttcgtttaagaagctataa

SEQ ID NO: 101717 - DNA, 2251 bp, Homo sapiens
ccctgcacaggctcctgggcccacagcgcgtatttgatctgcagcagaacctgggcagcgtcaatgtgagcacgggctgtgcacccgccctgcaagcccagaccccgggcctggggcctagaggactgcaggccaccgcccggaaggtgggcaccccaggggtgagcaggcagagctggggtggctggaagggtggcccctgtgtgggcggcccctgcattcaccatccacgcccccaggcctcccgccgcagccgtcagcccgcccggcatcctgcctgcatgctgcccccacacctcaggaccacccgagactcctaccagtttgggggttccctgtccagtcacctggagtttgtgggcatcctggcccgacataggaactggtaaggccaggcccggctggggtgggctgagaggggccgcgcaggctgacgccagctccgcttccaggcccagtctctccatgcacgtcctcccgcgaagctcccgaggcctcctcctcttcactgcccgtctgaggcccggcagcccctccctggcgctcttcctgagcaatggccacttcgttgcacagatggaaggcctcgggactcggctccgcgcccagagccgccagcgctcccggcctggccgctggcacaaggtgagggccgagaagaaggaaggtggtgggcagggcctggcagccctaccctgacccatctcctgcccccaggtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccggtgagaaccatcttgccccagcccccactccccacccactgttccctttcagctgccctgggccctgatccctgcccggtctgctcctataggtgaccgtcgggttcagcggctgtgtgaagagactgaggctgcacgggaggcccctgggggcccccacacggatggcaggggtcacaccctgcatcttgggccccctggaggcgggcctgttcttcccaggcagcgggggagttatcactttaggtctgtgggtgctggcatcccaggcctcagcagggcagggcagggggctccaggaggttctggggaggggccccccctttcttctccatcacaacccctccccgcagacctcccaggagctacactgcctgatgtgggcctggaactggaggtgcggcccctggcagtcaccggactgatcttccacttgggccaggcccggacgcccccctacttgcagttgcaggtgaccgagaagcaagtaagcctggcagaggtggcgtgccagggcagggtttgcctccccattctggtgacctcgggggcatagcctgaccctcccttcctaccccgccaggtcctgctgcgggcggatgacggagcaggggagttctccacgtcagtgacccgcccctcagtgctgtgtgatggccagtggcaccggctagcgggtgaggcccctcctgtggccagggcactctgccacccccacccttctgcagagcgggagccaggcgggactctgggtggggtggcttcttttggggctggagagaggctgggctgaggaccacctggcctcaggagtccccctttctcccagtgatgaaaagcgggaatgtgctccggctggaggtggacgcgcagagcaaccacaccgtgggccccttgctggcggctgcagctggtgccccagcccctctgtacctcgggggcctgcctggtgagtgcggccttgatcaagggtgggggagctgcccctcaggactaggtgctgcgtaacctaccaccctccccccacccctccaccccctgccccctcccaccctcctcccacccccctaccaccctcctatgatgtggaatgagacaggggctgggtggggcactgacgtttgggaagggcctgtgggtctctagctgcccaccaaccagccttcttccatcttccctgtgcccccagagcccatggccgtgcagccctggccccccgcctactgcggctgcatgaggaggctggcggtgaaccggtcccccgtcgccatgactcgctctgtggaggtccacggggcagtgggggccagtggctgcccagccgcctaggacacagccaaccccggcccctggtcaggcccctgcagct

SEQ ID NO: 101718 - DNA, 1262 bp, Homo sapiens
cagcaccaccaagcgcttcgagcaggagctgcggctcgtgtcctacagcggggtgctcttcttcctgaagcagcaggtgcgccaggcacacccgtcctgccatccccacttgcactgaccctgccccacactaaccctgccctgtttctgcagagccagttcctgtgcttggccgtgcaagaaggcagcctcgtgctgttgtatgactttggggctggcctgaaaaaggccgtcccactgcagcccccaccgcccctgacctcggccagcaaggcggtagggccagggtggggaccagggtggcagggagaggagatggaacgatgggggcggggcaggccgcagggacacagctggccctggagcccccactggtcctgtagatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgaggtaagcactgtgcgcagctggggctccgaggccaggctgttggggcggtaggctgggcttggaggtggcgccctgacccgcatccccgcttccccacagcctgcgacggctcttccccaccggaggctcagtccgtggctgcgtcaaaggcatcaaggccctgggcaagtatgtggacctcaagcggctgaacacgacaggcgtgagcgccggctgcaccgccgacctgctggtgagcagccctccccgggctgggggtggcatctgtggacatgcaggggcacccgcgggcactcagggatggcctccccgcaggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggtgagacctcacacccgtgcccattccccaccccgcggtggccgtcggagcagttgggactggggtgtctggaatgagtctgggtccccaggccggccggctgacctggctgccgtccccaggatgggctatgccaggtgtccctgcagcagggccgtgtgagcctacagctcctgaggactgaagtgaaaactcaagcgggcttcgccgatggtgccccccattacgtcgccttctacagcaatgccacggggtgagcctggccgctggg

SEQ ID NO: 101719 - DNA, 3237 bp, Homo sapiens
gccagcccagccaggctcagggctcagagccaggagggctgcctggggtaggggtgggggtgcctggccgagcttggcctggaagaacaggcaggatctgtcttttagatgggagacgacgcctctggagtgaacagtagggcagggtcaggaggtcggcgacacagccgtgtggccagacaggtggccccgggagacgtcagacccctcgacagcctccccaggaaatgtgccggttagatgttcgcgctcacagatatcccgtagtgcacactgagacatgggactcaggagagatttggctccctgagcctgcctaacaggacctgccagcccagcctgggggtcggcagggggtgccatgtcagagagagctggccagggagcagggtgggccaggcggagaggggcaggacgagaaggctcagaagctggctgagcagactggtgtcagggtgttggaggcactgcaggaggtgagggccgggcaggtgaggcagctgtggcctttcgccaggtgctctaggggccacccaggtgcgctcaggttccgggcccctggcctgccaaggatggcagggctggggtcttgggcttggaagccagcaggcagaggtgcactagtacgggcggccccaggctctgacgaacccctgccccacagagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagatgtgagtggtgttgtccctggcaggcggggtggggagaggcagggacctgggagctccaagggggaggtcagcatggagtggcatcaggtgggcatcacggggcagatggatctggcgggcaccaagtggagaccaggggtcatgaaggggcctggcttccagagtgaccaccctcaccctggtctcggctagtgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctggtgaggaccccggacttgttcttcctcctgctcctcttcccgcctcctccctgcaatccctctcctctccggctcctcccctcccctcccctcgtcctcccctccctccgtcctcccctccctcgtcctccccccctcctcctcttcttccccccctcctcctcttcctcccctcccctcgtactcccctccccctcctcctcttcctcctccccctctccccttctcctctctcctccctcttctcctgtcctcttctcctgtcctctccctccccactccccatctgcccatcatccccctccccctccttgtccctccccaatcctcatccctttccccacctcctctattctctccttccccttctcctcctctcatttccccatctctcctcaccccctcccatcctttcctcctcttctccccctccctgtcccctcccccttttgcccccttccgccttcctttctcttcttccccacttttctctctacccctccatcctcctccttccctcatactcacacgttctaaccctcccctcctcccccctcctcaccccccatactccccctcttttcttctcccttccctgccctgctgtccaccccatcacatcctttattcttttcttacccctcattgtccccaactcccctgcattgccttcagcaaaggaagcaggagctgtcccgggacaatgccaccctgcaggccactctgcatgcggctagggacaccctggccagcgtcttcagattgctgcacagcctggaccaggctaaggaggtgagtgcagcccctggcccctgtcgccaccccatccacggccaactccctcccaggcccgtgggcagctttgtgtgcacacttgcgtgcagagcccgccctcagggtcgtggatcaggtggctgtgagcaggatgaggggctaagtccactcaaattccaggagctggagcgcctcgccgccagcctggatggggctcggaccccactgctgcagaggatgcagaccttctccccggcgggcagcaagctgcgtctagtggaggccgccgaggcccacgcacagcagctgggccagctggcactcaatctgtccaggtgggtggccaggagaggaggggccctgggcccaccctggggatgcagacagggccttgggagggccagctggtctgggaaggctcctaggggctgaggccgttgtcctcaaagaagccaggccttcctcagctccacggcaagctggggcccagagtgacaggagcagtacacccagcaggcgacaggcacgggcaaagacctggaggcgggacttggcgggcaggcacgggcacggctggttgtgagcgcaggaggctggagagccaggccgagggcgtctgcgcttacccactccttcgaccctcccttccgctgcagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcggtgaggcccctcacttcccctcagccccagcaggagcgcccccactgcctgcacctcccgcagccccggcctgcgtgtctgagccacggtctgccctggcatccacagacggtggtgcggcagggcctggtggaccgagcccagcagctcctggccaacagcactgcactagaagaggccatgctccaggaacagcagaggctgggccttggtgagtgctgggctccgatgggggcccttaggcctgctgggcatctgagctcccagggaccctcagcccccagccacatgcacacgtggggtttgtgggtcaccgcagcatggtttggggtgggagagctttggagatggctccccagctgcttgtgtgtcagccccggggagccctgcaggggagtccagggaggagcagcctcctgcgaggcactggctgccactgag

SEQ ID NO: 101720 - DNA, 1286 bp, Homo sapiens
atcaggcctcccccggaccatcacaccctttctccctactacaatcagaccctccccataccaggatcacatcccccctcccctacccatgatcaggcccccaccttcaccatcagaccctccccccaacccatgaccagcgccccccccacctcacgatcacatcccctctccccccacaatcagtcccccctcatggttagacaccaccaccaatgccccaccactggcagcggacaccagccgtcagagcagggcaggccatggcagggagtctgcaggtccctcgggcccaggggaggcagctggggagtggggccaggctgggacacgagtgggtagccgggtggtccgggcggcctggaggagacacagcaggaggcagtgaagtgagggcttaggagggtgcctaggggctccctgggggggtgagagggcccagggctgcagtcacggaccccttctgcagggtgcgactgtaccccatgtgggacagaggcctgcgacccccacagcgggcactgcctgtgcaaggcgggcgtgactgggcggcgctgtgaccgctgccaggtagggctgtggggtaagcagggctgggtgggtggggcctagggactagagttggggcctggggagaatctgataggtggggctgaggggcagtgtttgatgggcagagcctcagggggtggggccagatgggcaggacccctggcttccaggttggtctgggacagtcttgagggctgggcagggcagtgaccagcctgtgccacaggagggacattttggtttcgatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgtgagtgctggccggtcacaggagggcggatggggacttctgagtggggtacgctccaaggtcccaggccagccatgctcacccaagccccccaccacaggctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaaggtgtgtcctcaacaccccacttccccacacctgatggagtaggaatccaagtcccacacagcctggtgaccccagtg

SEQ ID NO: 101721 - DNA, 1171 bp, Homo sapiens
tctcgaactcctgacttcaggtgatcctcccacctcagcctcccaaagtgctgggattacaggcatgagccaccacacccagcctgagctgtcttctgatgaacggccttatagttaatgtacttgaatttatccttttttccttggcagcaagcgtttttgcatcttgtttaagaaagtatttgtcactacttgatcagaaaggacctgcctatgttttcttctagaagcttggctgttctctttgtgtatttcaattcttaaggcatctggagctggtttgatgtgtggtgtgaggcagggatctaggtgctggctggcctcatgggagactggtttttctacctgtgtgtacctcctcctgccccatggtctttgtgcccctccatcccctacagggttggggggtctgttctaggctccctgttctgtcccattgagtgtggccccactgaggtgccatcctggacccacaggggaacttccggcatacggagacgcgcaacactgtgtcccgcgaggagctcatgatggtgctggccagcctggagcagctgcagatccgtgccctcttctcacagatctcctcggctgtcttcctgcgcagggtggcactggaggtggccagcccagcaggccagggggccctggccagcaatgtggagctgtgcctgtgccccgccagctaccggggggactcatgccaggtgaggttaggacagcaccagactgcgaggcggctcacctgtgcacacccttccctccagcatcctccctgtgttcccttccttgctgcctccacttcctgtcaccctactcacctctcttcctgcccctgcttttcacaggctgctggccaactcatgggcctgcctgtcccctgctgcctgtctgcctgcccctcgtccgcctgcctgcccctcatccgcctgcccctccatgcacacaccctccatacccctttcccacctaccccagcccccaccactgggtcacctggacatcccccaccgaccatcctggcgtctgcctgtcattctgcccatccctcgcccactgtgtgtctgtccagctgctaatctgccctgctaatctgtctgtctgctgtaactttgctccttctgtatgaggaggtttgtggttgaatacctcctagaaggagtggaaagag

SEQ ID NO: 101722 - DNA, 3715 bp, Homo sapiens
gtccccagctggaccccgacctcggccccccaccgctgtggaccctgatgcagagcccaccctgctgcgtgagccccaggtgagggccatagtctctagagggacgggggtgtcagggcaggactccgggtcccaacccagggcaggttgtccagggggcagcaggggctcatagctcagcctgctcactagggcctatccctgcaggccaccgtggtcttcaccacccatgtgcccacgctgggccgctatgccttcctgctgcacggctaccagccagcccaccccaccttccccgtggaagtcctcatcaacgccggccgcgtgtggcagggtgagtgtctggtgtggggggtggagaggctaccacacacgatgaggctggaatgccggcgccacagcgtggcctgtgctacctgctatgagcgacaggcaacatgactctgtcctgccatcagttctcaaactagctgcccttgcagcccgcagcccctacccgcccgctcccgttcccagaaaagcctgggtctcgcctctgtctcgtgcgttgggaagccccgttgtgctccatggcacgtggcgaattgagggcttgccccaggatgccgctggcagcacatgtggccctgtgtgtttgtctggttcctggctcggccaagcctggggtcccgcacatggagttgaccggtacctagaggtgtcccgcatgacatctgtaggtcatgatgcggccaacccccgtgacatgaggggccggccttgcagacctcttgggcacgtcccgtgcctgtggccgttggccagcgggcactccttggctgccccaacgctgccatcttcaaccctctgggtgtcttgggggcgctagagatgggggcctgaccctgcctttctcccccgcccaggccacgccaacgccagcttctgtccacatggctacggctgccgcaccctggtggtgtgtgagggccaggccctgctggacgtgacccacagcgagctcactgtgaccgtgcgtgtgcccaagggccggtggctctggctggtgagtcccagctgatgtcctgctcagggaccagctgtccttatacttgtcattaccactgtggtacacttgggctgggtctgtctcttctgggcctgctgaggcctggccttgtgcccagcaaagcagctcctgcctttggggacctcccgatccaccttgtgaggctccagaggggccctggaccctgcaccctgcaccctgctggtcagggtggccttcctggaggaggtggggcctccaggaaggagagggaagaggaaggcgtggccagcagacagagatgtgggagacaccaggaggtctcatgaatgctgctgcctcctcatgcccccgaaagctgctgtttggcttggagtggcctcccctgagcagccagggcccagggctgggctgggctgggctgggctgctgctgccaggactctgagctgcctgcaggaccctggtcccagccagcctctgggggcctccccgctgcaggctctgggcccgcgggagagtgaccaggcctcaccccctaggattatgtactcgtggtccctgagaacgtctacagctttggctacctccgggaggagcccctggataaatcctatgacttcatcagccactgcgcagcccagggctaccacatcaggtgggcagggctctggcaggtcaggggtccggggtgggggtctgggccgggagctggcctcaccacgtgcccctccatgtagccccagcagctcatccctgttctgccgaaacgctgctgcttccctctccctcttctataacaacggagcccgtccatgtggctgccacgaagtaggtgctacaggccccacgtgtgagcccttcgggggccagtgtccctgccatgcccatgtcattggccgtgactgctcccgctgtgccaccggatactggggcttccccaactgcaggcgtgagtaccccagtccttgggcgcccagtggcagggagttggtgccagagcccaaggtggacgggtcgaccagaaagcagggtcaggagaatgttctagagcctggcagggcagcattgctgccccatctgcgggcctgggcccaggactccagcttgcgggccatgcagaaggtttcagggaccagcaggtggtccacagtctctgacgatgatgttgattctgagcagctgcctccatgtcaggagctgtccaaggctcagcacccggggcaggggtccctgttcttgtctcccccgcccccgtcacactgccacatcccctagggctgcattctgggcctctgagaggggcgggactgggaagaggggtcagtaaaccctgtacccgccccacagcctgtgactgcggtgcccgcctctgtgacgagctcacgggccagtgcatctgcccgccacgcaccatcccgcccgactgcctgctgtgccagccccagacctttggctgccaccccctggtcggctgtgaggagtgtaactgctcagggcccggcatccaggagctcacagaccctacctgtgacacagacagcggccagtgcaagtgagagcccagagcggcgtcagcgcggcccctggtggccttaaggacagcatttcctctagccagagggtcctggcacccaccctgctcccatttgtgctccctgggtgcagcagcgccctctcctccacttctgggaggatgctgcctgggtggggggtgcctacgaggtctcactttggtgtgagtgacctggggtggagggggctcagctcccgcccctgccacaggtgcagacccaacgtgactgggcgccgctgtgatacctgctctccgggcttccatggctacccccgctgccgcccctgtgactgtcacgaggcgggcactgcgcctggcgtgtgtgaccccctcacagggcagtgctactgtaaggtgagtgagggctgggcccagatctggcctctccctccggcctcatcagctgaaagtgtccttacgggcctttcggggcagctggggcttcctagaagcttttgggagagtcatccccattggcaggtgggtaccaggaacccggggtcaggcacctggcacctgccgaccactctcactgtcctctcatccctaggagaacgtgcagggccccaaatgtgaccagtgcagccttgggaccttctcactggatgctgccaaccccaaaggttgcacccgctgcttctgctttggggccacggagcgctgccggagctcgtcctacacccgccaggaggtgcgcctgcaggactgagggcattgccttctcggggaggtcttaggtgggactggatgcaagatggggccctgtgatgtgtgggcatccacccgtgtgcagccacacgtgtgtgcccacagttcgtggatatggagggatgggtgctgctgagcactgaccggcaggtggtgccccacgagcggcagccagggacggagatgctccgtgcagacctgcggcacgtgcctgaggctgtgcccgaggctttccccgagctgtactggcaggccccaccctcctacctgggggaccgggtaagcagggcatcaggtctgggggaggcactttgaggatggccaggacgcctgagagggttgggagccaggagcggggtctgtccagggagggggagctccatgggggtccgtgagggtgcccag

SEQ ID NO: 101723 - DNA, 1059 bp, Homo sapiens
cctgtgctggtcctcagctcctgtgggaccgtgggttctggctgggcctgggacacccttggccttccgggttggtcactgggaaatgaccgaggcatggtcctctcttcacagctggctcttgccaccctgccggtctggccccagtggatcctgcccttcctgaggtgagcccaagtctgctcgtgtgtgggagatgggtgaggacccaggccaagctaaaagtcccgagtccggtgagaccagggcttcctgcctgctgctcagttgccatggcaaccccagggcctgtctgctccttaggctggtcctctgcccccactgcaggtgactcctgtgagtcacaggtgagggccctcagccctcaccaccccttgtcagggctctatggctctatggtttgtgggtgggagagcagggcgcccgctctgacctgcagtcttgtcctctcccaggcacaggttccctgtatgtgccgggctcacgtggaggggccgagctgtgaccgctgcaaacctgggttctggggactgagccccagcaaccccgagggctgtacccgtgagtgtgccctggagtattggggtacaggggttccttggggaactgtgcccacaagtatatcctggagggagtgttggggtgcagggttcctggaggggctggagccagtgagtgtgccctggagggagtggtgggatatggggttcctcggggattgtacccatgagtgtgccctgaagggaatgttggggtgcggggttcctcaggggggctgcgagtgtgccctgagggagtattgggggtatgagggttccttggggggctagagcctgtgagtgtgccctaaagggagtattggggtataggggttcctcggaggggctgcacctgtgagtgtgccctggagggagtgttggggtgtggggttcctcaggggatggcacccatgagtgtgtcctggagggagtgttggggtgtggggttcctcgggattgcacccatgagtgtgtcctggagggaatgttggggtgcaggggttcctgggggggtactgga

SEQ ID NO: 101724 - DNA, 1058 bp, Homo sapiens
ttgttggaatttttttttttttttgagacggagtctcaccctgtcgcccaggctggagtgcagtggtgcgatctcggctcattgcaacctccgcctcccaggatcaagcgattctcctgccccagcctcccaagtagctgggattacaggggtgcaccactacgcccagctaatttttgtatttttagtacagacagggcttcactatgttggtcaggctggtctcgaactcttgacctcatgatctgcccgcctcggcctcccaaagtgctgggattacaggcgtgagccactgcacccagcccttgctgggatttttattattttattttctagttagtgttgtgtaaaagtgtaagaaaatgagtttgtggagagggaaggtttgccaggaggggcgtactggggtctgcagggcatctgagactcccctgcctgtccccaccctccagattgtgactgcagcgcggcagggacccagggcaacgcctgccggaaggacccaagggtgggacgctgtctgtgcaaacccaacttccaaggcacccattgtgagctctgcgcgccagggttctacggccccggctgccagcgtgagtcccctctccccgctcaacctctacctgcgctcgaggtggacacctgaggcctggtgcctctgaccaagcatgtgggccaccctttcctgcagcctgccagtgttccagccctggagtggccgatgaccgctgtgaccctgacacaggccagtgcaggtgccgagtgggcttcgagggggccacatgtgatcgctgtgcccccggctactttcacttccctctctgccagtgtgagtggtgcctctccacgtgggcgtgggtaggggaggcccgtgggcctggcctaccgtgacacccgctccgctctgcagtgtgtggctgcagccctgcaggaaccttgcccgagggctgcgatgaggccggccgctgcctatgccagcctgagtttgctggacctcattgtgaccggtgccgccctggctaccatggtttccccaactgccaaggtgagcagagggt

SEQ ID NO: 101725 - DNA, 1042 bp, Homo sapiens
ggccctgtgagaccctgtcctccaccgcctctttccttgtgtccattccctgagcctggggaagttgcgtcagagccacaggctcggggacgctgagtctgggcgagcgcttgctgccggacagctggagaaacagcagcggggggccgtgtccatgtggcaagccaagccatcgaggggatcacaggccccttcagggaagggactgagcacctgccacctgcctccaggatgggcctgatcccccctcctgtgtaccccacaggctgcagtgcacctgccagcacaacacctgcgggggcacctgcgaccgctgctgccccggcttcaatcagcagccgtggaagcctgcgactgccaacagtgccaacgagtgccagtgtgagtgcctcctcccacacacgtgtgtcctgcccacaccctggcccatgagagggccccggtgcccgggcctgtggagggcgtgccaacagctgcgctcccctctctctagcctgtaactgctacggccatgccaccgactgttactacgaccctgaggtggaccggcgccgcgccagccagagcctggatggcacctatcagggtgggggtgtctgtatcgactgccaggtgggctgggctagagggctgggaatgggctggccctgaggtggggcagggacctccccagactcaacggccattgcactcccagcaccacaccaccggcgtcaactgtgagcgctgcctgcccggcttctaccgctctcccaaccaccctctcgactcgccccacgtctgccgccgtgagtgggctcagctgggcgggtgtcctgggtctcagggtctgcctggaaagaggtgttcttgggcctttggggctgctttggaggggatgtcctgagcttccaggccagcccaggaaggagcctcccaggccacggggcgggtccccagccctcatgtccccccagggggcctggctgtagccctcatccccatggccctggctggggaggtagagactgccacatcttggagcccaccccttgagtcctgg

SEQ ID NO: 101726 - DNA, 1692 bp, Homo sapiens
gcctggcagctcccacctcacctcctgccagcctagccacctgcgtcaagagtactggagtcctagcccggatgctggccgtccctggccccgtgccaccctgaccagtcatgctggtgggagtgggtgctcctccccaatagggcaggcctggtcacgtgtcccccaaaattccctggcctgagaatgggggaggggcgggtcagtgatgggcagtaggcgtctgtccccaaggaagggggtgaggatggtcgtcgaggggggtcactcgcactcaaagcgtgcaagggagagcggtggggggcagtgcagtccaacgggccaggccccttcagccagtgagctgtggtctctgtcacgcggcctcttggcctgtgggagcctcagtggcaaggcccggagacgtcaaggggcccgggcaccgcggggacccaggcttttctggtgatccagcgccctcccctcccgccattccccgcagcctccaagagggactgtctggagcggttcgggccacagacgctggagcgcatcacacgggacgacgcggccatctgcaccaccgagtactcacgcatcgtgcccctggagaacggagaggtgggccggggaggggcagggcggtacgggggctggagaacggagaggtgggtaggggaggggcagtgccgagcggggctggagaagggaaaggtgggcccgggaggggcagtgctgagcaggggctagggccacactggcgtcaccgcatactgcccacagatcgtggtgtccctggtgaacggacgtccgggcgccatgaatttctcctactcgccgctgctacgtgagttcaccaaggccaccaacgtccgcctgcgcttcctgcgtaccaacacgctgctgggccatctcatggggaaggcgctgcgggaccccacggtcacccgccgggtgagctgcccatggcgcaggcgggggagggggactggccgggtggacccgggactcagggtgagtgaggcctggccgcctggtgctcacggggcctgcgggtgcagtattattacagcatcaaggatatcagcatcggaggccgctgtgtctgccacggccacgcggatgcctgcgatgccaaagaccccacggacccgttcaggtgaggccccattcaggtgaggccccgttcaggtgaggccccccccagctccctgcctgtccttgtcacccctgcctaacctgagggtgggtgacctggttccatggcccaccacaaccctgctgtctgtgtgacctgcactgaccaccgccgtgtgtgcctcagtttcctcatctgtgcagtgatgtggaggccagggcatgtgcagcctccccagggtgccctatcttggtttggggggccttgccctactgccagcagaggtggggctctccggacccccaggccagctggccttcccaccatagtggacacctggggccctgtggaggggagtcagcaatggggatgattgatccccgactccaagactgcatcccccggaatggacaggtgcccactacctgccgaggcagccctaattcactttgggggtgcccgcccagctcccccaacctttcaggacacaacagacaacttccctgctgccccagccctgaccttcactccagtcaagcagggaccaaggcccaggacggggatggcagggtggg

SEQ ID NO: 101727 - DNA, 1291 bp, Homo sapiens
acccacccccaacgtatccacccacccacccctacccatccatccacccacccacccccctacctatgcagcacccaccctttattccttgtttccatccatctgtccacctgtctgctcattcctccctccacacctgcaccgtcttccttccttctcacccactttcctgaccacgtggatgtatctaccaaggcccctgtctcggcctaggccagggggctgccagccttggtcagggtgggggcagggactccctggagtggggtggggaaatgtccttcctgggcttcagggctgatcctggggcggggctggggcctccatcaggaagccaggctgagcggcgggtgggtccgggcactccccctgcagcgggctgccagcagcctttgttctgggatctggagcggatgccctgggacgggggtgggggcggctggcactgggcatcgggaaggcttcctgctcctggaaggctgaggagggcggggtgggctgcatcacggttcggatctcatacccctggtgtgcggtggggcaggggctggcgcaggggaggggagactagtccctgtggtgtccacccagaagcagctgagcctgggcccccgggagtgccagctgggctcctggcctgggtcccgctgcgcccagccgtggaggggttctctctccaagggtggggcctcaggaagaggctccagcgctggtcactggtgactcagggggcagtttccgagttccagacgtgaccttccccagggggtccttctagggggttcttgcgtatctccttgcatcctccggaagcttctggaactgagcggccacatcactggcctcaggctccttcttccgagaaccacacccaggccccaggccccaggccccaggcccagggaagggtgagcgcgttcatgactgcccaggcacatggccagcgggtcctggcttgagctcccccaccccctggctctgccgcagggtccaggcccttgccccactacaccagcacgctagcccagcgggcccaggttgtaaggagctgggcagggtgagtggggctggctctggcctgtgtcccctccctctccagtcggcccctgggtggcctgaccgtgggggcggggctctccccagcagaggagggcattgcctcccgcctccctcagatgaggagtgaggacgcacgggcccccttccggtagggaggcccctgctttgttctctgtagagcaggccacgctgcaggtgctacaggtggggtagcggctttgtcccagtcccc

SEQ ID NO: 101728 - DNA, 1695 bp, Homo sapiens
ccctggacctgggccaggtagggacccttctttgcgtgctgcagcccccatctctgtgtctgtgcccgtcgggcctaccttgggccacaggaccagaaggcgaggtctccaccgtgagcgagacctggggcctgggaggctggacacgaaggacttggtggggggagtccccacagggacaaaggcacggcagtggtcaccttttgtttgtgctttcagcgtccccatgacacagggaaagcgggtgctcatgggggtgtttccaaaggccacagagtttggttgcgggtgctgagtagacagcttggggctgggagggcggaggtgctgtgagcagtgcggtggtgccccctgcgtcaggcgccctgctgtttaaggaattcctggcaggtgcgggaggggctgcaggaatgcagaggaggctggcgcaagtggacattcctgggatacctgtgccgaggtggcggccactgagggttaggtggggtcgggtgcctgctctccagtccccagctctgggctctccttggccttggaggcccctgcacaagcaggaggctgcagctgggtgcctccaagcgaagagtgaaacccccaaggtgggcctgcctggctgccagccctgagcacccccagattgggggcgacttggcccgggtacccagccttgaggtcctggcctgtaaaatgggccagtaatcctggtgcttcttaggtcagggacagtggtggggcaggtggaggaggctgggcctgagagcagccagtgcctggagtgggggccccagggctgacccagaggcctgcatcccagccggctccgccgctgccccagtcccagtgtgtgacacatcggtcttcacccctgtctgagcctctgtccctgccattgtcccgagggtgttagagatagaggaggtctccctggagcctggctggagggccggccccaaggggcaggcacctttggcagccttggtggtctgcaggcctggcccgggctgggcaggcagtgaggggagggctcaagctccaaaagtggcctggaatttccaggggttcctgaacttgcagagccctgtggagaagggcggggagctggggaggggttgcctgtcctgggctccctgcctgcctgccaggcccctagccctgccctggcctgggtctgggtgtggctttgcctgtttaccttcatctcactgggtttccccgcatctgactcccctgtcccctggagcctgggggtccctcatctctctggcacagcagcagaggcccccaccttggctgtagcgtacgtgtgaattctcagctgctcggggcgggaagctgggcactggcgagttcttcccgcctctcctcctttgagaaactagggggctgggctgggggaggggagatggcccagtctccacggcaaccccagggtggctgcagagccagtgggcgcagtgcccgatgtgcctgggtggggcagggaagccgggactgacactcggacccacgagcctgggctccaccaccccttggctctggggctctctcggcctcggtgcacatgtatgaactgggctggaaacttcaggcctgaagccagtttgcttttagattgttctgggccagaaatcaggttccgccatgtgagcgtcttgcctctcacagcctcagtttcaccaactgtaaaatgatacg

SEQ ID NO: 101729 - DNA, 1057 bp, Homo sapiens
gggtgaggagcagcaaagtcagctccaacggctcccaaccggccgctctaggcccattccccacctcagccccaccttagggagagtctaggggccctgagggcctgtgtaacctgagctgtctcctccctggtacctctgccttcccggaaggagaggctggggcaggggcgagtagctggagatttgctgggtgggggcagagggccctggagcaagacgttatggggatgaatggaggagcctgggctgggcccgccccctctgcctgccccacccccttggccctggtggagggggaaggagcctccccaggcttctgggctcaccgttctctccttaagcccagcacagtcctctgagataggaggtctcaagcccacacttcagatgggggatctgagccctggaaagctgctgacacctgcttggagccccccagccagaacagggtccagcgggggttagctgtgggaacctgggtgcctcctggctgcccccttatctggtcaactcagaggggccgggtctcaggacggagggcctgtgactgtctccttacctgctgccacacctcaccacagagggcctggctgagtgtccccagctgagattttgccgttctggcaggggaggctccaggtgccctgtgaacctcagaccacccccccacagcctgcccatgctgcgtggctgggggccacaggccccctctcagatctgtctcctctgtgggggcttattacccccgtctcgtgagtaaagggccagcctgtagtcaacgcccctctcctctgcctcagctgtgtggcttccctctgtcagcctcaagctgtctttaaaatgggcacagcgtgctggcccccctcacctgagactgtgagcttggcccgaggagcctgggaagtggccacagtttcagtggcagctgtgggctgtggtgctccatgcctcagagccagcttggatgagaaaccagccggcctcgcccagctcatgtctagcaatagaggtgaacccttcgcttccaaagtctcgagctctgagcagtgagtgc

SEQ ID NO: 101730 - DNA, 2354 bp, Homo sapiens
gagtagcaggcaccaggtgagcaggcctccgctcgcagcggctacgtgcacgggcaggagcaccgccccacgccccaggtggccgcagggtgaggggaccggagggcgggaggcgcacaatggggggcacgcccgtatctctagcccggccggcagcgggcagcgaggctcagtcctcgccccttctcccagctgctattcggggctcccgaggcgctcagaggggtcgactgcgtccgtggggcacaacccaggggccaggctaagacgccacacacggcaacgaccctcaacgacaacgacccccacgacgccccgcgccccagggccagcaggctggggtccgagaacctccttgccggaagcggaagtgcgtcacggcgacggccggcaagcacgcaccgcgcagactcgctgtggtggcgtgacccggaagcgctcgccgaggcccctccttgcccgccgatatctctgccgggtgactagctgcttcctttctctctcgcgcgcggtgtggtggcagcaggtgtggcgcgcggcgcgggcttcgggctcagggctggggctggggcgggagtgggggcttggacgcgggggacggggtgcggggtgctgggtgcggctggggccgtgaccctaggggccggtttgcgccgggagccggggcacggttccggccgtactcacggcgccgcgcggtgactccccaggcgcagcccagcctcgaaatgcagaacgacgccggcgagttcgtggacctgtacgtgccgcggaaatggtaagcgccccccacatgcctctcttccgtccttacctaaccaccacgtcccctcgcctgcccttgttcccccacacccctcccgtccttacctcgtcacgtccctaacttgtcctgcccccgacgttactcttttccattcatatacccccaacctccctcgtcccctctttcattcttaccgcccaagtcccctctgctcactgcgccctttctccacagctccgctagcaatcgcatcatcggtgccaaggaccacgcatccatccagatgaacgtggccgaggtgagctgggagcccgggaggcgggaaggttgtgatatatgtgcgggaaaggcaggctgtcccattgtggaggagcccctggggtgaaggtacaggcagaggctggctttgaggattggtgtttcccaaacctgggggagtggtttgtgacccttcttctctttctaggttgacaaggtcacaggcaggtttaatggccagtttaaaacttatgctatctgcggggccattcgtaggatggtgagtgtttccctgggctttgctcatcacttcgggacatcgtggactttaccgtgcgcattggagtgtgtgatggtgcctgagtagatctgctggcagagtagtttgagccagctggactgggctggccgcctgccgcttcttgagggtggaagaggggtgctctgagaagacactcaggcagcagactctgcctctcactaggaggtgcccccccgaccccgctccaccatagtcaggctgcaggctgccccgggagaggtggctccccttctgcgcctgtctccattcgctcagcgggggagagacgtgggctggtggcacagctgaccttctgccatctcaggcagccggagtggaaatattcttagtgtgcttttttttttttcttaagggtgagtcagatgattccattctccgattggccaaggccgatggcatcgtctcaaagtaaggttgggggctcacatttgggcagagtgagtggactaggactgctccagaggcgtggtcttaacgttgtccttttcccctggttctaggaacttttgactggagagaatcacagatgtggaatatttgtcataaataaataatgaaaacctacctgtgcaggttcattctgtgtctgtaggcccagggttgaggttttgctgtcagtgggtgacgggtggggtagggtacccagttagttgaaaggagacaagctgtgaaacatattgcaaaactgaggtttaaaggacaaatacattatccatttaaaaacagatatctaagacaaaataactcaaacattctgaggtctgatacttgcttatgcacactgacatccacaactgctaccggtgcggaagcaacgccaggcctggttctgtatagtcacagccgagctgaacaccttagctccgacacctggatgtgttctagagaatgacaggctgagactgtagtttggtttaactactggctttgttgcaataatcctcgaataccacacagtggcagcttttggcatcataaaaatgggacataactgaagggaaggcttca

SEQ ID NO: 101731 - DNA, 1589 bp, Homo sapiens
aacaggcgcgacctgatagggtttgagttcacagtgctcgtggccttggagctggccctgtatcttcccgagaaccaagtgttacctcattacaggcgcctcacccagcagttctagcagaggccccacagaaggctcagggcaccgaggtgcacttgccggcctgggaggtgtcccactgaagccccgcgcctcctcctgccagcacccccagcacctgctagcaggaggcacctggcctccgctggtgcagctttcctttttgcctctttgccatttccttggaaagagacgtcgctttcatccccaagtgcaccgtccctccgaggggatttctgagaattctcctgcatttttacataaactaaatgtgaggtttgttactggtatttttttcacgtgcctgagaccagcctggtaccaggaccttttgttcacagcgtgcagcagcgagccggctgcagtgtgtctcccctggcctcgccttctgcaaaccaccgcagccaccacagcgtcagggtggagatctgggtttctagacctcactgaacacactggaatggctgagtttaacttatttaggcattcatcttggagatgtggtttttcgggttccccagcagcatctcccgacaccaactgtgccgctggctccctgccacctgaagccgagctcctccagagctttctccgcccacctcactgcatcccaagtggagcttttggtgtccagttaggccagcgggagcagtctcctgatttattttgatctcattcttggactcttggacctctctgttcttcaagcatcgtgtcactgtgaaatcctaacgcccctgtgtcctacagaccgacggcacaacagacagctgcccatcccatgccatgctctaccctctgcctctcaccaggagacactctgggcctccaggacaattgctgcttgccggctcttatttttctaagcaatattgtgatggagaaaaataacatatttattgggatttggttttttgggtcttttttttttaagggaacaaaaaatggttaaatgaggtctgctgaagttgacttgaaaacacacttgaccctcaggcaggagggcactgaccacaccccacacaacctcaaagggtcagtgcgtcagtgccttttcttctgaggcaggaaacaggtgccatcttggccacctcggccagggcagcccaccatgctaaaaggaccccaaatggtggtcgttgtcccttctgtgcaggccagcagggccccatctctagtttttccacgtctgtctgaagttcttgcaacaaattctgcatggtccagcgctccagctagctgcctcatcaaaaacactgaataaccaaggactgctgagtttttcttcatggggggtcagctggtctcaaaactggccactgcctcagccaccaagctttttcctaccactaccttataaacctgcctggccctggaggggctctgggacgactttgtctctagcccattaatacaatacatcctatgctttctgtgcagactggtgcttccgcagaaaggagatgccaattctgctatcacagaactcc

SEQ ID NO: 101732 - DNA, 1207 bp, Homo sapiens
atggtctttgagctagaaggtgtggagctaggagcagacgggaaggtaagagcctcttcgctggtggacacccagcgccgtcagggccaggcaggcgggtgggagcagtcccacgtcagtgcccacgaggcacacgtgaagctgtgcttcactccacgtaaaacgcaagggtggagtggatgcgggcccgtgcagccctgagaacgtggccctggagcccgtcggactcccccgcctggccgtgcctgaggtctgcgccactgccccacagccaggtgctcctggacacccccctgctgcagggtggggctcgccaaccctctggcctctgtgctggtggtcagcagtcttcagaggcagggagaacgttacaggctacagaacccagataaagcacagtagtgttccggaatgttctagctatgtgaggagcagcgtctagctcagacgcagcctcaacggcttgatctgagttgttcccttcattttccatgcagggctcctggcatgtgcgtctgggcttcctgcagcgggagctcactttgccctctggtcccgggaggcagagctgaggccagatgcatttgcttttccaggtcgtgtcttatgcgaagttcctgtatcccaccaacgccctggtcacacacaagagtgacagccatggcctgctgcccacacctcggcccagtgtcccccggactctgccagggtcaagacataaacctgcccccaccaagtcggcaccagccagcacagaactaggtagcccacgtgccttaaccacggcctggaacagggtgacccgcgtgccttaaccacggcccagggactgcagcagcatcagcaagcccctttcaatctgtagccctccgtgcagatggagcctggggaacagggtcaggagaggaacagctccacactgaatcgctatccctgggcttggcctgagccaggcagtggggaggagctgcatccacccacagatgactccagggagggcccctcctctcaggacatccttttcttgccctaagccctgggcccttcaggagagaaccatggcctagagcccctcccctgctcggccttgccccgccatggcgctggcctgccaggccttggggctagatgggtactgctcaagactcctggtgggtcaggggttgcctctcttacagggagtgacgtgggggacaccctggagtac

SEQ ID NO: 101733 - DNA, 1173 bp, Homo sapiens
ttacttggggcctcatcagcccaggacaagggggtcaggtgacctggggccttgtcagccctggacagaggccaggacaaaggggttgggttcacctggggccttgtcagccctggacagaggttcaggtgacctgagcccctgtcaacccaggacacaggggtcagggtcagtctgggccctcatcagcccaggacacaggggttgggttcacctgggaccttgtcagtcctggatacagaactgggggttcctgggctggctgagggtttcctcaggccctgtcaccccccacacatagggttcattgtcccctgaattctcccagcccctgaatacggggtctggatctccacgttgtcagtgctctgaaatgggttttagggttcagcccttattacccctgagacccccagccctgtgggttctggacatgcccccacccccatccactggtaccagtgcccgggacacagggacacatggacagccctgtgcatctcttcgcattctttgaaccgggccacaccgtccatgcccacctcctcagacccagcatgtgggccggggtcctcctggcactgtcactgacacctgttcccagaggcccctgcacagccacatctcccatcccacagccactggtctctggcacccctcctctccctgtcacttccctgctgagccccgcccttccccacatcactctcagctcggtatctttgggtctgtcacaccctgggtctccactgctccccctgccttgattccatttctgggaaccacctcagcccatcccagggcaaccccaaccatgagccctgcctgtccagcgtgtgccccctgcccagatggcccctggctgcccgacaccctgtgtccttctcccagagaccacaggacctgggtgaccctgcctcccacagccctcacctccaggagtgactgtgggctctgggcccaggactggctgcttgttgcggttccttctcaaagggagccactgtccacaggtccaagtgcctgctgggcggctgttcccagaggcagcccctgcaggtgtgcagcaaaggggccgacacagagctcttgggtcaaggctggcacgtgctccttgcttacctggaggtcatcagagttgccccacgcccctggccttcgggcaggtggagg

SEQ ID NO: 101734 - DNA, 1028 bp, Homo sapiens
cacagaccccaccttcccacagaccccgccttcccacagaccccgccttcccacaggccccgccttctcacaggccccacctccccacaggccccacctccccacaggtcccatcccacttcctgtctacaggaacttccacagggtctcattgaggtgccagggcagaggggtggtgaggggccatagctttggggaggggaacacagagggagagggaagggaagggggaagcacagggttcacctgggaaagcccaaacaaccccccatgtgactgcctcattctgagcttctcagggaagctccctcagccacctcccacccatccccctcccccacctcagggacccaacctcctccctcactcagcctcccctgtctgccttagctcacacccagccccttctccaaactgcctgcgtctgctgccggaaccctctgttggcccctaatcctactgatgggtggtctcacctgctgcgaggcattaggcgtctgtgtgattgtgtggtggggggatgggagcgtgtgtgcatgtgagtgtgtgcacatgtgtgcctatgtgtgtgtgttgtgcatgtgtgggtgtgtgcatatatatgtttgtgcacatgtgtgtgcctgtgtgcatgcatgtgtactcatgtatacatacatgagtacctgcattgctttgtgtatctgtgagaagctgtgcatacatgtgcgtttatgtgtgtgtggaggggtgtgcctgcatgtccgtgtgtgggaatgtgcaggtaagtgcatgtgtaagcatgtgtctgggtgtgcacgtgtgtgcctgtgtgtgcatcgtgcatgtgtgcattgtgtgtgcctgtgtgagaatgtgcatgtgcctctgtgtgtgtgtttgcacgtgtgtgtgtttgcacatgtgtgggtgtgtgcacatgtgagcctgtgccagtgtatggggtgtgtatgtgcttgtgtgtgtttccccagctgtaagtgcttggcattggactgagccagaggcgcactgacgaggagaagcac

SEQ ID NO: 101735 - DNA, 1023 bp, Homo sapiens
cacccacccaccactgtatcgagacggcggggctgcgggagtcggcccaccaggtgggagggcagtgcacggtgggtgacagacgctcacgcggggcctggcatcagcacactgtggaggcaacggtgcagggtggcctcactctgcctgcccagcgtccctcctcctttcattatcaggtccctggtttcaatccggggagcctgggtagttctaggggatggctttctcccaccccaagtggtcaagtgacccaagcctggccagcgagtgcccatcttgggacctttgctgggtttcttgaaatgaatctctctcgtgcttgctcttttggtgtctttttccctctgtctctctctttctctttgtctctttccctcctctctgtctctttctctcactctgtctctttctgtctgtgcgtctctcactctctgtctctttctctctgtctctctctgcatctttctctccccctccacctctctctctctctctccctctctcctccctctctgtcccaccgattagatatataagcctgaaatctcagtgtccattttgctccgcctgcagacagcctgccaggagtgaagctagccccaaggaaagtggagctgagctatggagaaagatttctgatgacatggtttgggttctggatccagccctattttcagacctcttggccacataagcaagttgattcatcttctgagttgagtttctatccccagccaacccagcatggcaggagtgacagcaaccagccccatgtggctcctgcagccctgcctctgccctctgcaccctgtggaggctgagactctcgaatgcccatcagcaggccaatggtgtcgtcatagaatggagcccttctcagcaaagaaaaggaacaaaacctatggaaacacacaacagcgcagaagagtcttaaaatgatgttgaaagaggccaggcacacagcccacacactgcatgattccatttagaaagttccagctgaaacagatctgatccatg

SEQ ID NO: 101736 - DNA, 1095 bp, Homo sapiens
ggagcttccctcccgagtggccgtgacctaatctgtagctcactgggtgtggcccctaaagcaggtgctgggcaagtccctcccatggtggagagctggctgggcacgtggcaggcagggcaggctgggccaggtgaagggtggccaggtggatggacatgctctccttgctagactaagcccagagaggccggctctcctcggggctctgatgggccccttggcttgaccaagccccattgcagttttggctccaggtcggtctgacttccaaatggcaaaatttttctcagcccattgtagaatgaaaagttaactcatcgagcttagtattgtgcctacaaggtcttcgatccggatgtctccatgagtgttaatccatttctggggtgggtactgctgagccaatatacattcctggcttcctggactcgtccactggaacgtgttgggtcctggtgctctccccagcagatggttgtaggtggtcagagatgagccacagaaaagccaacgtgcagcctggtgctgggggcaggagggagcagggcccttggagctctgggagagagccacgccaggccagccctcctgcttcctcaagcgggctgtggacagaggccacaaaacgttccctcacgagccacatgactgcctcatttgcaagtggcaaggtgcacactgttggcttttggacaaggacatgggacagtcctcagaccttgctgttgccttcgttctgggacatggaccactgtctggccccccagtgagcttgctgagtgtcagctgacttcaggcaggatctgggtcttgcccacttgttggaatgggcacgtggggattgcaccccttgaacagggagggaggtgccagtaactcacatgctaggttaacaggttctgggtgactctgagccttggccctgccaggggtgtgaggaggaaactggccctgctgctgggacaacagactctgggcgtgtcctcctgtgggcctctgcagaggaagcagactgggactacaaagaacaacctggtcctggggaccctgctgccttctctggcccctgctggcccttcaggctacggtgag

SEQ ID NO: 101737 - DNA, 1045 bp, Homo sapiens
gggggcatgggtgtgccttccttgcgtgaggaggaaaaaccattctatcaccagaaggcagtgcccagtgtgagtgcccagcgtgctgggggcggtgcaagcttggcaagtttgtagacccgaaatgcaggctgcatggggacgagccccatggctgaccctgtgcctgctgggcgccagcatggctctggcctggaccctaccactcgcttgtcccccctctgcagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaaggtgagtggagccgctgcctaccgcccctgtcctcccctggaccctgggaaggggcccccgtgccttccccttgtaatcggagctattgttgggcttcccaggtgtaccgagactgtagctgtatccctcagaatctttcctctggttttggccatgccactgcagggaaatgcacttcaacttgtcagagaaagcccctccttctggttttcatattcgttgtaattttctttacattcctcagcagcattcctgcactaacggcaactctacggtaagctggggtcgggtgtgcgcttgtccagagctttccttgcagcaccctgaggcggagctctgcagatcctgagacaggagcactccaggaaacacccaggtctaagcgggcctgtctgtcactggtggcaggagagacctcactgtctctgatctctgacgaggggcttcccacttgggggggggtgatgatgtggctggggactggtccaggaggccactggcctagggggtgacttggcatgcaaccccacttctgtgggtgctgacgctgtggttttctattgcagatgtgtccgtgaccctcagagatcctttgccctgggaatccagtggattgtagttagaatactaggtactgtgcagtgtgaggaag

SEQ ID NO: 101738 - DNA, 1043 bp, Homo sapiens
cggacgcgcgtgggggcggggcgggcaaccggcggggcggggcggggcctgcgctcgcgacaccctcgcccccacgctccccgccgagcccgggccgtgacaccgccgccacacccgtcccgggacccccgccccctcccacgcgcccttcggaccccgccccggaccccgcccacgacccctacccccgtgagaccgcgaggtcccagcccgcagtgccccacccccacccccgccccgggacagcccaccccctcccacacacaccacccagccctgcccccccacagcccctccacaccctggccctccccatctctccgcagccacccttgcccctccagtccccagggcagcccgtcccctccatcccctttctcctcaccgctcaccggttatcccgccgcccctcctcccctcaggtgtgaaccgacacttccacatgatttgtattcgggacaagttcagccagaacatcgggcggcaggtcccatccaaggtcatctgggaccatctgagcaccatgtacgacatgcaggcgctggtgagcccaaccgccctccctgtgccgcccgatgggggcacgaacccgcacaccgctctctgagagtcagcctgagctgggcagaggcccctccatgtctgctggggtctgctgggcagagtagaggcccctccatgcctgctggggtctgcagtgagctctcagggtcagcctgagctgggcagaggcccctccgtgcctgctggggtcccctgggcagagacccctgcagtgaggctcgtccttaaggaggacatcccggggctccagagcctgtcatggaaagcacaaacacagtgctagcagctggctagcttttcaggggctctgctttagactgggtgctgggccagagtctccagctgagaccctggggagggagggaaggatgcagagtcccgggcccttaggccattgtcagcctcctgggaggcccccgaagtgctttaggcagagggtgaccctatctgagtcacaccaaggtgaatttggtgacttc

SEQ ID NO: 101739 - DNA, 1009 bp, Homo sapiens
gaagtaaagagggaaagctccagggagcttgtgggtcatggggccgccaagggcacccgaggatgctctggcctctggaaggcagtggctgcctctgtagacaaggccgtggcaaagccgtggggcttcctgtggtgacaggcgcttccgtggcactcagtggccaggatgcacgagctctggttccctcaagtactacaggagacgcttccttttacatgtttgttttgctccggtctctctcggtgatgactttgggttttgactataggcgcagaatccgcatttgctgtgatgagttgaatctcttagtgccgttctgcaatgccgagactgacaaggccacaactctgcagtggaccacagcattcctgaaatacatccaggaaagacatggagattctcttaaaaaggttagtggtaggccaggtagattttcagaattttacaaattttacttaacaatgtccctcctttttcctaaggataactcaaactatcctttgtttcctggaatctaacatcaaatactaagtccagtatgagcaaagctctgctctttaatgatataacttgtcatttattaaagtaatagtcacagcctacatgtgttacactcagtgtgtaaataactgtgaagaggcaattgtcagatagcaaattgggcacctgctgtgtacggtatattgcactggggctgacgggtgtgtaggacatgatatttgccctcagaaaaacttgtgaaagggataaaagcaagaatagaaaaacaaaaaccggccagccacagtggttcacgtctgtaatcccagcactttgggaggctgaagtgggaggatctcttgagcccaggagtttgagaccagcctgggcaacatggcaagaccccatctctactaaaaaatacaaaaattaacctggtgtggtggcgtatgcctgtagtcccagctgctcggggcgggggctgggagggaggatcaattgagccagggaggtcgaggctgcagtg

SEQ ID NO: 101740 - DNA, 1685 bp, Homo sapiens
tttttttttcttgttcttagaataattgtatataaagaaaatatttttgggaggaaatatgtccaggtggtttgttgttgttgtttttttttttccattctgacctttagaaaaagtaaacaacttcttgttttctgtattcatagataacacctgttaattaaaaagaggggctttggatgaggtcatattggttgcatagcacttggaaaacgtatttagtgtgatgattgattcttgttcagtttcgttgtataaaataggcttgggcttcatggtccctgctgatgctgaaaaactgcattagtacatctctttgtgtttcggttctctgtgctgcttacccaataatgtttatatcttggattgaaaaggccaaaactgtattcagcattaattgagataagaatacaaaattaaaaaccacttttttcttctttcgcaaagaagcagcgctatgcaaacaagcactgaagaggaatcggagtagaatgcgtcagttggacacaaatgtagagcgaagagcccttggagagattcagaatgtgggcgaaggtgccaccgccacacaaggcgcttggcagtcctcggagtcctcacaggcaaacctgggggagcaggcccagagtgggccccagggaggaaggtctcaacgtagggagaggcataaccgaatggaaagagatagaaggtaatacgtgtgactgcttgtcaggctgactcatatatgattaccttagtcatacatggttatcacagatgagtgatccttagccgtttctgcgttcagagggaataaagcaggtaggagcatcgttagctttcccagatggatcaaggatcccccagactatgcccaggctcgctggctcactaggaggactcccgggactccgcatgcagtcactctcaggctgtgacttactatggagaaaggatgccaggtgcgatcagcaaaggcgcgtggggagaaggcaggagctgaggtgcaagcttctaagagcgcgccctgtggagtcaggcaggttgcccctcatgcccccagccatgtggtctgaaaacgtgggtgaggtgttgccaaccaggaaagctcgctagagaccaggggcgtgtcacgtaggcactgcccccatgcatgcaaccacagtccagtctcccagaaggaaagcagttgttcagtgtcagccatatcgtttgcacagtgtaggttctgggggcactcttaactccctgaatctaggtttgcagactccactaagggccagccctgactgcaggcctttctgaggagagtggtcaggctgttttggtaactgctgcttaccagccagcttgagttcagcaagttttgcctggttctttttttttttttttttttttgagacggagtcttgctctgtcgcccaggctggagtgcagtggcgcgatctctgctcactggaagctccgcctcccgggttcatgccgttctcctgcctcagcctcctgagtagctgggactacaggcgcctgccaccacacctggctaatttttttgtattttttagtagagacggggtttcagcatgttagccaggatggtcttgatctcctgacctcgtgatctgcccgcctcggcctcccaaagtgctgggattacaggtgtgagccaccgctcctggctattgcctggttcttttaagatt

SEQ ID NO: 101741 - DNA, 2073 bp, Homo sapiens
gaggcgcgaccgggaccggtcccggagcagagagcgggaccgagacaaggccagggacagggagcggggccgcgaccgcaaggaccggagcaagagcaaagagagcgctcgggacccgaagcccgaggcctcgagggcctccgacgctggcaccgcctcgcaggcctagacgccccggccgggcagagaccctttttaaagccacgttcgtaagatgcgttgaacaaatagcttttgaaatagccacgatcttagattcaggatagaatattctggacttaaacattactgtaattttgtgtaaatggtttcttacaagatttcacatctttacaattctgatgcttttttaaaaaaactaaactttaatatttccatttaaaattaaaagaaatgggaaattgcctacggagcatattgcttttcagatcatagttatcttttccaataactttattgtaaattttaagggagtttcgttggaccctagagccataccttcactgacatctcatccgtttgtgtttccaaaagctgcttttacaggtcttagccgccgccccggaggccggtgtgggcgtgacctgcaggcgtccaccctgcggctacgggagaagtcttagtagcttgtatctggagtcttgagaaacacaaaccttacaaatgcatctttcttttgtcataaaattggaattacaattttcaactgggaaacagaaacacatttcttagcgtgctcagattttatatatcaccttatcaattttttccaaaacatgatttaaagcaacatctgtcctagtataattgttgcattttaaataacaatttattgaaaaatgttaagttttaccagcctaaaaaaagtaacaaaccaattaagtgtactttgggggcagggaggagtccttgatttgaataatcaggagttttgttggtccagtttcgccttctgagcagttcttctgtatcccgggaaaagtacgctcggccccaaactggtatttgtcagacgatacatgtaaaagtttgtccttgaacgtggaacaagacttgtgtaaagtctgagacgggaactagtgatcactagctcaagaactgcaaatgagacaggaagctgttcactgtgaaacagtctcttgcttgtcgtgtatttttcgagtacttctgaagtgtgaagtaaaaaaatctggctaatttatttgtacaaatacactttgataattttttatattttcataaacttttacagatgtaaaattaaagaacttcacttgttctttggagtctgttattccattgtacgtcactacagatttttcactttatagcacagattttttaagttaagaaaacattgagaatgtatcagtttgagatgtttggtgttgaaagccaagtgtccataggttaaattacattaaagtaggtgtcacgttccaacatctagtacgatgagaaggttttgtttgtttaacatataaagcaaatttttctaatttaaatacacaaatgtaaaaatcaagtgtgtttctttagtttacttgatagagattcctgtacattgtattttatattgcggaggcttatatcactgtacatgagaacatggaacgacctaggttttgttactcgcagtagaataaacagctacaggaagtttctgtctcgggtcttcatcagcctttttctaacgcggagaagtttggggtcgtgcacggacgccctggccacccagtttcttgttgctggtttgcctgggcgtgggcaggagtgccctttggacccctccctgaactcatgctgagcccagggtgagaccggccgggtgcgggtccccacatccttccgtcacggggcagctgtctcgctccctgtggggacccagcaccatccagctctggagacgatgggcaggaaggtcgggaggagggactcacccccttcagaccctctcctggggctgagtgggagcccgagaccactgcaacagcctcaactgcggtgaaggagtctcatggttggggagtgagccccgaggccccagcccatccaggctgcagcagagtgtgc

SEQ ID NO: 101742 - DNA, 1063 bp, Homo sapiens
gccacctccttatggggacagcagaggcccctcaccctcttaccttggtggaccacgaggagtggcaccatcccaatttgaagaacgcaaggatccccatggggagaagagggagttccaggacgccccgtataacgaggtgacgggcgcccccgcccagtttgaagggacagagcaagccccatttctgggaagcagaggcggcgcgcctttccagttcggaggccagagaaggccactgctgtctcagctgaaaggcccccgaggcggcccccctccctctcagtttggaggtcagagaggaccaccccctggtcatttcgtgggcccaagagggccccatcctagtcagtttgaaactgcccggggccctcatcccaaccagtttgaaggacccagaggccaagcgcctaactttatgccaggtcccaggggcattcagcctcagcagttcgaagaccagagggtccattcaccaccaagattcacaaaccaaagggcgcctgcacccctgcagtttggtggactacgggggtccgcacccttttctgaaaaaaatgagcagaccccttcgcgatttcacttccagggccaggccccgcaggtgatgaagccgggccccaggcccctgctggagcttcccagccaccccccgcagcaccggaaggaccgctgggaggaggccgggccgccctccgcgctctcctccagtgcgcccggacagggccccgaggccgacggacagtgggcatcggccgacttccgagaggggaaaggccacgaatacagaaaccagactttcgaagggaggcagagagagcggtttgacgtggggcccaaagagaagccgctggaggagcccgacgcccagggccgggcgtccgaggacaggaggagagagcgcgagcgcggccgaaactggagccgagagcgggactgggaccggccccgggagtgggaccgacaccgggacaaggactccagccgggactgggacagaaaccgggagaggagcgccaaccgcgaccgagagcgcgaggccgaccggggcaaggagtgggac

SEQ ID NO: 101743 - DNA, 1932 bp, Homo sapiens
gaaagcccttaatgaaattcacctctaaagggtaaaagctggatttagattctaaaatttgcacaaatattttgtttttcaggtcttgagtcaccacgtccgaatataattcttgggttagtaatctgccaaaaaatcaaacgtcccgcaaacagtggagagttagacaagatggacgaaaagcggacccgacttcaaccggaagaagcggacgttccggcctatccaaaagtagccacagtcccgcagtcggaaaagaagccctccaagtatccactctgctctgcagacgcggctgtcagcaccacacctcctgggtcgccgccgcctccgccccctcttccagaaccaccggtgctaaaagtgctgtcatccctcaaacctgcagcccccagcccagccacagcagccacaacagcagcggcagcctccacggcagcttcctccaccgcttcgtctgcttccaaaacagcatcaccgctggagcacatcctgcagactctctttggaaagaagaaatcattcgacccgtccgccagagagcctcccgggtccaccgcaggtctcccccaggagcccaaaaccacagcagaggacggggtgccggcacctccgttgttagatccgatcgtccagcagttcggtcagttctcaaaagataaggctctagaggaagaggaggacgacaggccatacgaccctgaggaggagtacgacccggagagggccttcgacactcagcttgtggagcgagggcggcgccacgaggtggaaagggctcctgaagcagctgcagccgagcgggaagaggtggcctatgaccccgaggatgagaccatcttagaagaagcgaaagtgactgttgatgacctgcccaacaggatgtgtgccgacgtgagaaggaactccgtggagaggcctgccgagccggtggccggggctgcgacgccctccctggtggagcaacagaagatgctagaagagctgaacaaacagatcgaggagcagaagagacagctggaggagcaagaagaagctctcaggcagcagagggccgccgtcggggtctccatggcccacttctcggtgtcggacgccttgatgtctccaccaccaaagtcgtccttgcccaaggcagagctgttccagcaagagcagcagtctgcagacaagcccgcctcactgccccccgccagccaggcgtcaaaccacagggacccccggcaggcgaggcgcctggccactgagaccggtgagggggagggggagcctctctccaggctctcggcacgtggtgcccagggtgccctgcccgagagagatgcttccaggggtggcctcgtgggccaggcgcccatgccagtcccggaggaaaaagagccagcctcttccccctgggcttcgggcgaaaagcccccagcggggtccgagcaggacggctggaaggcagagcctggggagggcacccgccccgccacggttggagacagctcggccaggcctgcccggagggtgctgctgcccacaccgccttgcggcgccctgcagcccggcttcccgctgcagcacgacggtgagagggaccctttcacctgcccggggttcgcgtcgcaggacaaggctctcggctcagcccagtatgaggacccaagaaatcttcattctgctggaaggagcagcagccctgcaggtgaaacagagggggacagagagccacaggccagacccggcgagggcaccgccccgctccccccaccaggacagaaagtggggggctctcagcccccgtttcagggtcagcgggaacctggacctcatgctttggggatgtcagggcttcacggccccaatttcccgggaccaagggggccagcccctccgtttccagaagagaatatcgcttctaacgatgggccacgagggcctccgcca

SEQ ID NO: 101744 - DNA, 3559 bp, Homo sapiens
gaagaccgagaagctggcctctccgcacctgtgaagacccactggtcagttgcaagtgcgacagtgtgtgcactcagtgcagacactgcagcacctcagcacctccctaccggggtggaaagagcactttttctttacagaaacatgattcttagatagcgagcctcccctttttaaaacaattgaggcgatatttcatcctttcttgagcttctctccctgctcatctccaaacttggagctgtcaggtgagcacggttgtagggtgttgagcgagccccggcgcatgccgggcaccgggttccccacactgggcagtgacggggcccagggaggccaccagaggagcggcgcctccattctccccacagcaagggctggctgtgcaggtgcagccccggggcagagggaaaggacaggtctcccagcacctcccggatggcaccgggacaaggagggctgggctggggtcactcaccttgtctgctgagtgcgatggcaccaaccacccacactgtcagctccgcgaccagctgggggaacgtcacactcgcccaccaaggcacttgctgaggccacgacgccgcctgacggggacacacaaaagccccagggactttgatccacgataaagagcagaggcgtctgggtaaagtaacacagggcaagggactttagaaaagtaacagctagtgaaacctttccatacacttcagaaatgttttaacttaagacttcagtataatgttaacttctcctgatgtccttgttgacatgaatgcgtgtgcgtgaaatctcacacacttccatggtcactaaacagccttcaccccgggccaggccatcgggtactcggcccgcttcacgtactgattacttgacttggcgttttctagatataaacatgtacatgtgtgtcctggctttgtggtgtaaatgtgtagtgcgtgtgcatgtgcgcgcgtgtgtgtgtgtaaggctaggtcctggcatgtttcccctgtctcagcggaccctgtcctcacggagatagcccagaagcccttggacagcacaggccacacctgagggtgctgatggtggtgactccacagagctgtggtcaggggtgagcgtgtgctgcgcagcttggagtcacgcccccagaagtgctgggtgagggtctgcaggacccagctccattccacagcctcagttctctgcggcacatgcagcacaggcctgaaggagacctggcgccccagccttgagctgcccgtctgcatcagggcactgatgtgggagcatcttcccctggggatgttaaggagaaggtcctgttgggggtagagattcacgcagaaaagagtgactgactcgtccatgtgcctcagtttataccacacaattgcaggtgtccatgcctcccacacatggggacctagtgggttttgacagcgtggtgtccagtcctagccccctcagtgcttgctgttcacacttaagcaagtgaaggcctgaaggtgcccagctgtgccctcaggggaaacttaagtcacccgccctgtcagcacttggcccttgtcgggcagtgagagtggagctgcccccgcagcaccctcaggagccatgcagttcacagcagtagctggatctccctgaggacatttgtccttgcatatcttaatgatttgtccacagaaacaccgggttgtcttcctctgcccctctgccccgcagtgggggcactctctgtaactcagcatcacggtggggggcagctgggaggcctggttccaggtgaccttctccacctagatgttcaccccactcagttccagctttaccaacagggccccccgcagggacttggggtcgcagagtcccggcctgtctcagggccttgttcatggaagggagatgagtcaggttgaaagctcatcgtgtagggttctgtgcagggcccttacaggactggaccgcagccaagatgcctgcctgttaaccatgcccagcccccgtcatttccgcgtgaagccgcaggcctcggagccttggtctgaaatgcctgtggagtaacctcggtccataaacatgggtgcacagtctgttctccccaagtacagggcaggaggaaacaccgccctctgtagctgctcgaatggaaagggctcttttctctgaggtctttatacattagaaagctcttctgggaagaatgtttgaatccatagtgtctttctgtattcacttttaattgctttctaaattagctgagaaattctgacttgaaatattgtcaggtaagcatttcttcagttttcatgtgtgtatgtaacagtagctttgcatggaaattgtaatcagagtcaaatacagtattgaatggaatgtactgccttctcctcctaaatcaataaacatctttcatggaaactggtccttgtttgtttgaattggaaccatttggtggctcctggtcacctatcctaggcccctgtttgctttccataagccagcgcagtgcaccctagtgtgcccagctctgcagcccacccagcagctgctggagaggacgcagtgcaggctggtgctgccctggggcccttctcggcaccccggcacccagaagaagatggacgtcgctctcctcttacctgagacgtgctggacccagtggctttgtgcaggtcttagagattcccagttggaacaagggagggtctgtgtgtgtgtgagtgggtgtgtttggtgggttgggggaagtcacttcttcccaccttaattgccaagtctttctatccaagtcatacgtcaccccttgttgattaacttccacaccgtttctgttccagcaggtgtgaacattttgttttgacaggtgcagaccattgagagagttttcattttaaatcactgatagtgggatgtgccaggtggctttaggggtaaaggcctcactgtgatagtttggggttgggaggagtcaggtttcgggtggttcatttagtaagaaggagcgtcttcctgcagcctcaggttcagtaccgagggtgcttcctgcaccctgagaagcaggtggttccctttgccagctgccttgtcccccagtccctgttgcgacacacctggacacagatcctggttttggtcttggcccacacagcttttcgaatacacccttttatcttcagtttcttgagttcttttcctgtgcgtgtggtctgattctgaccactgagtccagacccctccgtcatgaatacgcaaaggacacagatgtgctaaaaaggcctgttggcttgcacgtggtacgccctgaagaaagccatttgccttctggcctttcagagggcgttgggggaacatccacacccttgttccaggcctgatcagtacccttcagtggaagtgcaggggcacgtttagccgcagctggcgtctccaggccctggtccctggttgctcctgagccccggcccctggttgctttatgaactgaggccctcagtagccctcaggaggaaggtgggtaagtaagcctaccgtgccctgtgccacccgcaacctggctggtgcc

SEQ ID NO: 101745 - DNA, 1295 bp, Homo sapiens
ggcttccctgaagtccaccttttatcaccacattagtctcctgtaaacattgctgtaaaggtacaagccagtcgcttcactgggctccaaaataaagtccagttcttcatcccagtgtatgagggtgtccgtattccggcctcagacagccttttccaccttattttctcatattcctcatcagccgagtgagcctgatggtttgggctgcttgagttctcaccacttggagcaggggctgctcacgcccaggtagtgggatcagtccttcctcactgcagcatgggccatgcgacgaggacagaaactccagctgggagggataggccgccgggctgacagccttgtggtgttctctctccatcggcctccaggctcctccctgtttagaattttaggataatgaaataccctgactttgcatctcaccattgaacagccctaaacagaaatgatttcttccttcctttgttcctgacgctacctttttgacttgtgtccaccttgtgtacataattgtttttcctgaggtgttgtgtgttgttttttttttagcagagccagtgcagcacaggccgtgaaacccactgttgaaccttattacctgtgctctctgggctcccatttgctcacagcagggatatcctggggcgcactctcataaggccgtttggggagttaggtcacaccctgcagggagggctctgcccagtgccacacgcaagtgggccctgagggcctttgtcctgtgcccgctaaacttctgggcagctgtgttttccagaagctctctgtattgacagatataggaatattatttgagtaaatgaaaaatacttgtttatagggactcttccatcgtgttctgcgtgaggaaatctctttggcgaaacttgtgagactgaagccagaagaacttgtatctaaagagctttccacgtggaaagagaggccagcgagatctgtgagtgctgaggggtacctgcggaggcacccaggactcgagcttaatagaaataaattcatagacggctgcataagcgatgctttcctcctagaaaacaaggcctaagctctgtttcgtctttttcatttcaggtgatggagtccagaactaaactgcacaatgaaagcaagaagacggcccccaggcaggaggccatccccgatctggaggactctccgccagtgtcggattcagaggtaagcatttgggagattttgtgttcaccgagaatagactaatccatcccaaatgttttgaggttatcttaaattattgggcaggacctgag

SEQ ID NO: 101746 - DNA, 3752 bp, Homo sapiens
cgggttcaaatgattctcctacctcagcctcccaagtagctgggattacaggcccgtgccaccatgcctggctaatttttgtatttttagtagagacggggtttcaccatgttggtcaggctggtcttgaactcctggcctcatgtgatctgcccaactcggccttcccagagtgctggaattgcagatgtgagccacagcgcttggctaaaaatatgcagttattgagtatgagtagcttcataaaagaagaaaaatatgtccctcgttttgatcatgtaaacagcctagacctaagaaattgagccgcacataaaatgaatcatgcaattgctgcattataatgaatctcgataccttacattgtttgagctgagaattttatgctagcaaatgtctcaaatgttcatcagattctagcacctctacgatagagcagttctacagagctaatgggcttaaagtgtcacccacctgtgaatgcagagagggatttttaatgctgtactaaaatttagctgtacattggttttagacacataacagtgaagaaaagaaaaactgcggttatagcctcagttcagataagtgggtgataatttcagtttggttaatttccatctgtgtcaaccaaaattgaaaagctgccagagactccacatgtggagttggaagagtccgtgtacattgtggggagggagcattggtgggaagatggggaaatgaggggctctcagccctgggttattgcttcctgcctgcctcctgcactgtgagcggggagaggtcgaccaggaggctgctcttctgcccatagcggggtactctgacctcttctccctcttcccttctttgccacacatcagctcctctgggaagctgatttgctccagggacaggaggtgggggaaattgcctgttaaccttcccaacacatcacctcaagttaaaattggtggatttccagaatttgtataggatgggaatggggacgacacacttttgagctagtagcttctgctcgttttgttatcccgtaaatgttgtcttcccaaaaggtgattgattggagcagagttagagacattggtgacagcagctaccatgtctctgcctctcccctaaacacctctgcacttttgtaggctcaacaagtactggggagcctgccaccactgtatgcctttgaggcccctgccctgcctccctggctggccacggagctcgccctccctggtagggggtgagtttggaagtgagaggctggtgtgggtctgtcccatgagctgactcacacttgcctcaccacacataccatcagaagacccacgtggtggagctaccgctgctgctccccacagtgcacctaggcaccctcctgtccttcccatggcactcggttgacctgggggttcctgtccaacaggtgaggcctggtgtgcacagacactctgccattgctagaaggaggctgtgccccctgctaagatatcagtaggtccttcacagcctcaccttgttcctcccatttgtttttaaaaattgtttcttatatatacagtttatttagcttacgtaaacatttggtgcacataacttctctcaaagatcatgatgtttcttttgtggttttataaattcttattccatttttttctctttatttccactgttcacctcccattattgtcgaggcatgaagtcagttggaaatgtttttctgagatgtacctgactgactagaattttgagatggaattctcaaaattttgagatggtatttgataggtgcaatttctagtattttgtctccctaaatggctcattaagtgacttaaacactgaggatctgaacagattttgactgcaaagcagattctacagttcgtttcatctaaccgttggaattaaaatggaaaacgttgccagtttgtaaacccaaatccagatgctgtgttaagcatggtgcccaggtggaagcactgcctcttgttcccacgtgctgccacagagatggccctggtggggtgaaatggacggagaacaccgttcacaaggataactcatggtgtgggctccagaagcacatttcactgaaatcctaagaggacccagtctcagttttcattaataaaaaatacatggggggattctagaacctaagagtgttttgcaggaatttaaagccgggagaggagggtggcttgtttcactggtcgcgtgagctctttttttatctgtctcctccagagttgtcagcggcaataaaacgagactgggagtcatcagactctacgtgtccaccaatctcttcctcccaattagaaaaatcagaatttgttctgagaaagaatatagcttgatagttgtttttttacgttatccatataactggaagtttcttggctgtcagtaatgacattcttttgttatttttaagtgttttactttttataaacttaaaaagcagcctgccattgagaaaattacatcagggaaaggtttcacacctccgtaaccgtgaccctgcacggtgaagtcccacatcagcaccgtcccgtggtgcccctgtccatccctcaggtgcccctttgtgcttatgcttcagccaccttgggcaggtggggtgcagggatggaagtttccagcaggatcggtccccctgaattcaccacctcttcagtgaccttcataggacctttcggagctgtggatctactcatagtctaaagatgaatactcgggaaagcctcctcggcattctcggtgtcacagagtgcagaggtcagctctgaagacgcctgctacaattcctccaatgtggtacacaagtttcaggtagatttgtataaagttgtaaaataatactaggtttttttttttttttttctgttaacacatcaacatacacatagttatattcttagcttctaaaagttagagaagtaacttagaatattgacaagaatttttgctacttatttaaatgaaggttgcggcaactttcatttgccgcaaacctggaagagttcggcaagaagagcttaaggtaactggctttatcctcaactgacctgcttggtgctgtcagctaggggctttatactgagtatggccctttaggactggagggattacaggggagggttgtggactaattttaacatgcccctaacatgttggtttaagtagtaaacaacttagataaaggttaaattactcgtgtgggagatcttgggaagagcagcagctctgctcccaaatgggcttggcagccaggcacacaccatgtgcagctgggcacaactgaaattgcagttgagtggaacgtccatctgtccacgtggccctcatcacacgagtttcttagggagaattacacacctctccattaagttggaaggcactcaagtagcgggtattagtaagaaaactgaccaaggaaagctttgagtattccaaaacacggcagtctagctgtggaccctgcaagggcgtcctggctgtagtgatggtctcctctgaggagcgtctgcgatgtagtctgcctgctgtatttgggaagtaactgtttccccgcaacatgaaagcaaactagtaactacttataaaaggcgaattcatgtgaacacattctagcatgttgagaggagcaaaagcagaacattttctcttgccgctgccaccttgattgttcccactaggggcaatcttggagtgaagaaacaggtaaagcaggaaactgcattgtt

SEQ ID NO: 101747 - DNA, 1278 bp, Homo sapiens
gaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatgtatgtatcacctaggggttggcctcctggacccctcccgttctttctggatagccatcccctgggcctgtccaggactgggagttgcagctttgtgttaagctgatcacagacaccggctgcaccatcagcgggaagcagagcccatgtccaggatgcctcctgctgccctgtgtccatccctagtctgtcaggacttcctgtcactgttttccaaagctgtaaacctcactggtgaacgttcaccttaatgattgattctttaatctctgttttcactctcaggctctggtaagtattcgtattctcttcatcccagtctgattgcatagccacactgcccggcacgccacatccacccctgtctgcacatgagttgttctgacaacagcgctgtatacgcttcagtttttccacattgtccacggccagcacatgaaagcatcacttcttttttatgttgtgggaatctttgcaagttagtgttgcatctgattttcaggtgtacatttatttttgactgggcagataggggatttttttttttccatgtccgattcacacgctacacacccacatgaacacattcgaacttcgaaggccacacactcctgcttcataggccccacggtaagtgagttcacacctagaacactgtcctgaccgcaggacgcgtgccttggacttggtattctacatgtgactggctttcttgccctcgtctcttgaatgtttagactcttaagatcatatcctgccccaaatttcaaattaatgaaatgaagatatttcaaacagatctttgaaacctcagattctgtggtgcaattttaatgttttcttgtttctcagttttctgctataaaactattttcaattcagtctttaatgccttctgtctatagtgcattttgtgctttttttaaaaagcaccgaaaggttaaatagtctcaattcaaagatgatcacagagtgccccactttcccgtcgtcagactttgagcagattccctaagggaaggcactcatgcaggcaagcagacctatgctaggtctggtgtgccttacaaaaaagacactttttttttttttttt

SEQ ID NO: 101748 - DNA, 1076 bp, Homo sapiens
ggtgtgacttggcgtgttttcactctggtccctccagggtcccgggcctgtccccacccagctgcctgtcctctggcaggtattggaaattgctgtgtctagaagcatctctgccttcacactcttgcactgcattagctgcaaggtgaggatgtccgaaggctgggccgtgcacctgggagcgtgcccttggaggcaggaggggctgaaggctcatgctgcgctgctatcagaggccacatctgggcattcagagatgaatggagatgggaattcatgagaaaagtcattggctttatgtctttattttttaaatatattgattctgttttttgtgcagttgaggcttcgctctgttgcccaggctggagttcggtggcacagtcccagctcactgcagcctcgatctcctgggcttgagtgatcctcccaccttagcctcccaagtagctgggactacaagcacacaccaccacgcccaacatctttttttaattgtcattgtgcttgacaataccctgcacaaacctaaattgtattctcaataaaacttagattctgtggaggaaaactgattatgttaaatatttaatttgagaaataaggtttcgcttaagtatgtgtgagggacatgttcgtgtgtgttgaggcctgatcatcgagacagactttgtaaacagcagtggtcaagctgtttgtggtgcgtgagtttcctcctgctgcacgatgagttactgcagtcctggcttgaaggagctcacatttatgcctccatttccatgggaagcctggacctgctgctcaggtctcacaggactgcagtcacggtgcagcgggggctgtggtctccagaggcttggcaggggattcccttccagaagccctcacgctgttttttactgtataagtgtgtctggccgggtgctgtggctcacacctgtcatcccagcactttgagaagtcaagatgggaggatcacttgaggccaagagttcgagaccagcctgggcaacgtagtgagacccccatctctacaaaaaaataaataatgagctgggcgtggtggtatgtgcctg

SEQ ID NO: 101749 - DNA, 3935 bp, Homo sapiens
atctttagctggacaggaaaatgagaagtgacagcatttagagggaagcaaaaagaacaacacaggttacaggttgcaagtaattttccattttgtattttcgttctttttcttttttttgagactgagtcttgctcgcccaggctggagtgcagtggtgcgatctcggcttactgcaacctccacctcctggattcaagcaattctcctgcctcagcctcccaagtatctgggattacaggcgcctgccaccatgcccagctaatttttgtatttttaatagagatggggtttcaccatgttggccaggctggtctcgaactcctaacctcaagtggtctgcctgcctcggcctcccgaagtgctgggattatgggcttgagccaccaggcccggccccattttgtatattttttaaggctttcattttatgccagtccttcccccaggatggaacatggcataaaatcagagtcatcattagcattgaaatgtaattaaagcttggacagcttggaaaagaattctcaaagtatctactgtctttttcagatttttgtcatttcaacaagagtaaaagtttcataaataagattctttagtaatgtattagaatgaaagtgaaaaataatacagaaaaaaaaatatactggcctggcacagtggctaactccagcctggggacagagcaagactccgtctcaaaaaaaaaaaaaaagaaatataccttaaagtgatcgccttgaccatgttttctaagtgtcccagttgtcttgctgctaacaatatctccaaagctcagtagactaaaacaaggtttatttcataccacacaatctgttgggtcaggagttaggcagttctctcacattgtgcccgtgagggtcattcacttggcagcagggctggtatggagggtcccagatagtgatagcatccttcctggccccagcccctggttggggagctgaaagtcgggactcagcttcttcatatcctcttttcagcatggtggtggccagcccatacttgcaaaagtccagaacagacttgggtccctttgcaggccacacccaaactggcacagcgtcttgttcactgtgcttgtggtcagagcagcccatctgcctgcggaggtgctggggagctcgtgccacctccgagctgctcgcgtccttgctcacgtccttactcacatccttaccctgctatactgtccaatatttcctatttgtccctactgtctggcttgtgaagccttgtcctgagcagttaaatgatgaaattgtacatttgatttgttagctgtatttttgtctaaacgttagttgtttaactatattaaaattatctttacaaatcatcttgaatcatctcacatagcacacattaggaaacactggtcagaaggacttgctttatgtagagctccactgtttgtagggaggtggcccctgctgcgcgtgtttggcggcaatgtcaccttttgttctgtggtcagttggtcactatgtgcttacactttaccgctaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtgggtcatgtgtgggcacccacagaaatcccagggttgcaaacagaattttccatttgttttcattttaaagggttacaaagctgggctggatgagcgatttgttggaaaagatgaacaagttgtcaaaaaagaaacacataagagtggctaaggacttcctagagccacctctccactctggtagccactggccacacatggctgtttccagtcaagtgaggaggtgaatagcgccccaccccagtcacgtgagccacgtgcagccagtggctctgtgtagacggcatggaggagaatgtgtccgtcactccggggtctgtctgagactgctcctctagactgccccttgggagacatagcagaggggcatgtgcagaccgcaagtgtcctagtgcaaacattggggcagctcaaaagatctctgctaggactgggtgtcagacggtgataggcagcctgttggcttggcgctgggataaaggcattgtcgcagttttggggggagacttgctgaggtatctgtggtggaatgccttagagtttgctcctaaaatgcgctactcttaaaaaacggtgaagtaaatttggttgaatgttaaaatcaaaggaaaggcatgaggacgttcttaatctctacttttctgtatatttgcattttttcatgaagttaaaaccaattgtcttattaatgtgttgaaaagtgcttgtcactcacgtcccattgctaataccgttattttataatttcaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtaagtgtttgtccgctgagacgagcattcagcagtcggcctcactggtttcagtctcgctctagatagaaattcctcccaggacgggtgctgcacccatgtggggcggtgcctctcccgggttcctgcctcactccacctgggtgaggcctttctatttttattcttaccctgtctacctcctctactattaatgacttaattgttgaaatcagcccatctttgaggatttgggtgttgcttacatgctttgtatgcattagcagaaaggaattgtttctgaacgatgggagtggcggtgctcctgtgtcacctgctgtctccagctgcctcgtggttctggtgctggctcctcggggtgcttgtgttgagagtggtttctctgtcttgcagctgtgttgacacttaattctctccccctgatgtttatgacatttcccacatgctgtcagcttctgctgctgtcttgtgtttgcagtctccatt

SEQ ID NO: 101750 - DNA, 1624 bp, Homo sapiens
ccagtgttttctgagcagtcgtttctgaattcttgaagtaattgttttgaggatgatagttttaccacattgaagagatggtgactatgacgatgccgtttggcttatcagagggaatgcctgtcttatttttattttttgtagagacggggtgtctacatggtgacacgttgcctgggctggtgttgaactcctgggctcaagcagtcctcccaagcagctgggatcacagatgcgaaacactatgcccagttgtcactgtccctttaaaaggaggggagttggaatgtttgtccctttgttctgaggttgccagggagaccacagagggaaggcagttggtcttgaggctgaggaagaggtgagagctggggctcagtttggaagtgtcggctttggggcaaggacctagctagaaactcggcacctggaacctttgagtgttgtgatgtgactggttgagagaggatacaagagaattgtttcttaaacacacgtggtgaactgtatcgtgttgattttagtacgtcacaaacattagtattctaaaatttttcttgtttttaattaaaataattcagatacattattaagaattttcaattattacattcttatataatttcgatgttcagccttttcactttttgttcttgttcctctgttttgtggtggattttattgagtggggtccatctcggacataggctccaaatggaaaagaagctgatgcttggcgactcctctctggccctggtctggctgggcctctgcctgcctccctggggcaagcctgggactccactccttcctgcgctgccccggcccctttctcttgggggttggtagcatctgctgtcctgggtagaggtccttaaggacactgcttgcgtgctggttttcaacccccaagctgtctttgtgggtcacacagtatcactcaaataataggttacttgagaagttcggtactcccttttaattgttgtcgatacgtagtttacttaagatatgtaaaatattttcttattttcttttaggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtaaggtatcaacactgttagtagcaacaaaattttaacttaataagtctgtatttgctatttataaagtggcatttgtaaagaaactgatagtagaatgtagtattcgtattcatttgaaatacattcagccatttgtatcagcagtctctatagcagcagattctgcatctgtggattcaaccagctgcagattggaaatatttgggggacaaacaataaataataatctgacaataaaaaataataaaaatgttataaaacagtgtagtacagcaactgtttctatgatgtaatctagagatgatctaaatatttgagaggttttgcataggtcatgtgcaaatagcctgttctctctttaatgagaacccagttttataaact

SEQ ID NO: 101751 - DNA, 1051 bp, Homo sapiens
agttatgtgaagatggttacaatactccattctaaagacctatctgtgtgaggcaagattttgatgacatgttttagctgaaacactctatgggaacagattgagggcagaagtagacatgaacatggagctgtcttcggttatgccagaaatttgcaaaaatgtacaacagggccactcttcctgttcatttttgtttgttttagaaataactttcatttaaagatactattaatgtattaataggtttatttttaatacatacttagaattttgaaaatagcaatacattccacataaacaaaagctctttggtgttctcaacttgtaaaagtgtcttgagacaaaaggtttgagagccgccattcaagcatttggaagtcagtgtgtgtcctctgcttgaatcgccgctcatcagctgcttctagtcaatagaaaatgaagcagttttcagctggggaaaaaaatgtgcttagaaatgtggaaatattaaatttggtacattctgttttaacctgtagtttgttcacttcccagcttcaaggatacccacatttttctttctggggaaaagttgttactgatacaatatggttgcagttttatgaacacattccccctgtgatgggctgtgtagtgtgtagaattacacactaattatacacacaaaaagttgtgttagaacaggtttttttgcttgtgccttgatatacatatgtttttattttacaagctgactgaaatgttatagtaaattttctctgttgaagacattatgaaatcagttttgtaaatataaagtgatctgatcttttccgaaggtatatccttcattgaattctacttaacagaaataactacatttttctgattactcagaactcaaatctagtagcgtgtttattcgcagattaacataaattgaatttttaaaaatcagttttcgttcccgagaacttcttaatttctttgcttttataaatgttcagtgttggctgggcatggtggctcgttcatgtactccccaaaactctggaggctgaggcaggag

SEQ ID NO: 101752 - DNA, 1413 bp, Homo sapiens
ggtgggagctgggcactgtggctcacgccagtggtgtcccagctactcaggttgaggcagaaggatcgtttgaacctatgaggtagaggctgcagtgagccctgatcatgcagctgtaccacaacctggaagtgggcacgcttgagttaatgacttcaagcagattttagagtagtaaaagttgagcatacagatttgcagtggttgcaaacccatgcattgtaatagttgcagttaggctttttaaagtaacagagctgaccttttgggaagatatttttatttggtttttaagaaatttcacttttggctgcttactgttttggtgagttggggaatctgagggaagattaacaggtagttacagaacccttgtggaaggaaatgtttaaagtctcttctgatgtctgaagcataggtatgtattactgctttgcacatatccagtgtactcctaaactggtagaaatggcatgttgccacagttctttgtgtttcatggactcctgagggggaagtccttgaagccctttctggggctaagaggtaaagatgacttctgcataataatagtctaatagtacaggccttttctggtgagtttgacatttgcatcggtggcacagggcagattggagccctcttcagcaccgtgcatgggcaccgaatgtttagaatatgccaattttcccaaataatgtccctgatgatgcagtaaatattaatttttttcggaacccgcaaacatacatcttttttactttcgctgtgattaaatgtcaagttatatataaagcttctgctgcatccccacgtggtactgtccacgcacagccctaggggattgagctgggagccgagtggtctcggaaacgctgtctgtccctgacagaacaacagacggaggacagttttcagactcagcatgtggcaggcgttttgtccaaaacgagtgatgtctcaaagaaaaaacgaacagtatttgttgctaaggataaaatttgagctttggggtgaaaattggaattttagaaaacttgtatctgccattgtaaacctgatggctttctagtaattaaagtcttcttggagattggacccgacattatcggccaggtgaggtgactcacacttgtaatcccagcactttggaaggcggaggtgggtagatcacttgatcccaggagtttgagaccagcttgggcaacatagtaagaccctgtctctacaaaaaaaaatgcaaaaattacctgggcatggtggcatgcacctgtagtcccagctactggggagggtgaggtgggaagaccgctttgagcctggcggtggtgtgggtgggggaggtgctgaggctgcagtgatccttgattgcaccactgcactccatcctgggcaacaggaaaaaaaatgttt

SEQ ID NO: 101753 - DNA, 1899 bp, Homo sapiens
aggcagatgggaacgtcttttcggtatattcacataactttgctatataccccgtgttccatggtttccgtagggccacatatgacttggttgaaatacagttctgagaaaggtccttagcagtgccttttaaggagtaaatacagtctttttttaaatgagcattcattgcttactgttagcacgagggatacagcagtgaccaaggtggcccctgtcccagtcctggagacaagttcactggggaacttgagagattattccagctccttcctttaaatcaggtgttgccaactcgtttacctggagcctagggctctttagtggccctttgggttgctgttagtgtatgtgtgtctgtgactatttcactattttaaatacggcatagacatctcagaagtgtcacccaggaagacagacacagccctgttgtgaaactccctgcttaatgcacacttgttttcctacttgctgtgtacatggggaggagatgtctgttcttgtagacttgtttcagcaagtttcataagatacctcttgttttggaaaagcgcgtatcttgaattttttcaggctttccaccagaggctgtcccttattagtagttgattgaattcagactatgtcaagcagagctcattgtgctgtggtgagaagacagggcacaaataagataatttgtgattgactgcccagccgtacccatggttaccagacagcccagcccatgttgcatgtgcatatgtgagcctcgcaaaggcttgtctaggacgtgcggatcatcggttgggccttggagggtgctggggtttcttcatgtaaggaggaaatgattggaatgggcattggctcccgttttgttcgcggtgaagttggcaggttctgctgttgatactgtgagtttttctacagccttagggtcataattcccttaaggtcagttctgtggagcccagtagggtgcttctcttcagtgtttatttttaagctgtgccacgtcttcattgtttggaatctctgtaaacaagacacgtttttcctttttatatgcctgtcccataataccaagtggcttatttggctcttgaagagctaagattgaaagtgtttaacaggtgactccctactatctgtgggtccctgcactgtgcccttgcctgagaggtctcatctctctggcaggctcagaagaccactagaaaattctctctaaacagagtctctcacttacatttcttatttaaatgacggggtcccttacagtggatactaagatcagcctttttatgactactatcaaatgatgtgtgttaattgcattacaaaagttctataattaacagttaatggaaatgtactaattgggaaagaggaggtcaaagaacaaagtccagtttgctcatttcatgtacgtgtacacagtcatctgtgagacagtctgtgttgtctaggcctcattttattttttgagtagtaattttgaggttaagttgttatatgaagttgaataggtaattgtacatattttaataagaattctgtaaccatgtccataaaacttaataggcggttgtaatcgtgtgtaagttgtaaaggaggcatttctctccttgggtatcaaattttgatgccgtggttttgttttgcgtatgctgatatagacatttaagtggtacttaatatacctttataataaggtaaatcaactttttttccaaaatgaagataccttaatgtgtttgattacaaaagtaatacacatacaggaaacttaaacattatgtaaaaatagaaagtaaagacactagaaagggtgctgtccagaaaagctccacgttacagctgttttgcactagtgaacgggatgcgttggaggctgtggccactgccctggcc

SEQ ID NO: 101754 - DNA, 1064 bp, Homo sapiens
cggtcttaagagcgaaatcctggcggagtgcagtccctcggggctagcatccacgttccgcctgcgccctgcccgggctgttccgagggatccccgcaagggcactgccccagctttcactcttggagtcggggaaataaggtgtccacaaaggatgcaagcaagtcattgtcagtgcagacccgaagggcgcgtccggagtgcaggtatgaaagacgggcgcatgcgcgcagtccggggccgggcttcgcagcccgggctccgctctagccccgcagcgtctcggtggccggtctcgtcctccgcccgccgcgcgggggcgccgctctagccccgcgccatctcggtggccgtccgcccactccgcggcgttcggggaaatggctgcgagaccctagaggcctgcggcctgcggtaagtggcgtcccgggcgccgggtagaagagccggccgccgcttgggccgccctcgggagcggggcggggccggcatcggagcccggctggcgagagccgcggatcccgcacaggccgctcccgccgagaagatggcggccgcggaagggaaggagcgggcgggcgggcgggcgagcgggcggggccggtcagagccgccgcggcctggggcgcgggcctcagacgccggccctggtgggctgcgtgaggtcgaggggactggcgagcactcggtggtcgcggctggaacggttccgagggtgggagtcggggcggccgctcgcggggaagagcgcagggctggcctgggcgagtgcggcccggggctcgggggctgcgtagctggcttgtaagcgcagctggtttccctaggcattctcggggacctcggcgcttcctcccgggccttgggtgcggtcggggtggccggcttagcttctggcgtgccttcgggggattccggcactgcaggggcggctggcgctgcaggaagcgcgaagagcccggattcgcttttctgaagagtgtgtccttacctccccgcgctggttttcagtttttttgtggaatagtttgttgcgttggtttgtactggccgtatttgtgaca

SEQ ID NO: 101755 - DNA, 1104 bp, Homo sapiens
ttggtgagagagcaagaagttgagagatgtgatgggaatgggaaacattggagtgtggtgagcaggggtgaggtgaagacagcgtagtatgttgaaggtgttcagaagccattagggccatgcacttatgtactgagaagtgagcagtgagctagatgccacaaaacgctgcagcagcaggtgagactgaggagcagggaggggggtcaaggataatttctcagcttctggcctatgaatttatagggtggtgggaccatcctctggatagggaacgccagagaagagcctggaagtatgtagtagggaggtcagaagtcctaagctcattttgcatgtgttaggtaggttttgaagtgcatttgaggcattcacgtggagatgccaggggagcaggtgaatgatggtgcccagatccaggcagagataaaggcaactacagccaggtgtgcatgaagtctctgtggagaagggatgggtggagggagaggaggagagcctgggccagagccctgaagccaccagcatggaggctcaccaagagtgcaggagagcaggaaagaggtaggtgggtcccgggacaggagagggtgcagggccacacgggttggcatctgggacagtgacaaggacttcagcctgctggattcatcaactgcctgagctttcctatgacagaggtgggcatgtggatgagagaaaccaaaggcttggcccttacagtcagctgaggggcaaccaggtgttcagagcttccagtgtcttgcaagctgaggtggtggctttgaacttgagttgtttcatattgaaagagatgaacagaaagaggagtgctaaaggtatattaatcttaaaagaacattaatgagtttttaaaaaggggagagcagtttgcccaggctggagtgcaatggtgtgataatggctcactgcaacctacacctcccagctaatcctcccatgttagcctcttgagtagctgggactacaggcggaagccaccacacccagctaattttgtttattttttgtagaggagaggtctcactatgttgcccaggctgttctcaaacttctgcgtgcaagcagtcttcctgcctcagc

SEQ ID NO: 101756 - DNA, 1128 bp, Homo sapiens
tccaaggcccccagagcgggggcggcgcgcaccccggccacatcccgcctgcccgcccggcccggccccgggagacgctcggcccggccgcccgggcccgccgccgccatcttaccgtgcggaacctgcctcccgcgctgcgcggtctgggcggctgcggctccgcagcctctcctgggctggggagaggtggcggccgccggggcgcccgagtagaaggaggcagaggtgggggccgcggcggaggcgggggcgggggcgggggcggggagcgggagggcaggcgcaccggaggccgcccctcagcacctctcgcgacagcaagagagcgcgagagcgcgagccgatgaccaatgaagcgcccccgcgagggggcggggcggacggcctcccggaagcgcggaacctcagcttccgtacttgcgcagaactcccctcgcggcgaccacgcactacgggttggcgccagagtcaaaaggcgtcggccctctggcaagatggctgctgcggaggcgttggagcgcggaaatctggaaccgggatggcgacgtctacactgagtcggaggcgaaggtcccagcttttttcctgtcgtttgcgtgaggccgcacggggtggggcgggggaaaggcgccgggtgtccgcggccgcccctcagacggggagggagtcccctcccgaccggcggccttccagggctagtgtccctgaggtccagggagagacggctgacccgagaccgggctgggcgagagctgtgctgtctgcgcgttgaagcgagttcccccgctttactcgagatgttgttgagcgcgtcctcactcgaggccaggtggggaatcagaagggccctgccctcagggcgcctcccatgggctacgccgaagggcgggacgcggccagggcgcgcgggacaaaggagaccccacttgcttgcggggcggagtcccggcggcggcgcggggcagggccggggttactcggtgactggagaccctcccggcaggagcgcgggttgaggccgcacttgggtatttgcgcgtttacttgcttattgcctgtccgctcaggaggaatgcgaagtctgtcattgcagggtcccatgtttccgttgctgggaagtacctt

SEQ ID NO: 101757 - DNA, 1111 bp, Homo sapiens
ttccaaaacccatctgcccaagggttttaaacatgcagttctgtgcgccacagtcccttggtccacgctgctgttgaatgaacgctcaggtgggtggcttccacattcctgccgctttgaacggtgcttctgtgaacagcgttgtctgtgtttggtgcatcctggtgagtttttctagaatataaatgtattaaaagtagaattgctgggttgtgaggagcacacatgttcagctttgtaaggagtaccagattgtttttgtagcacagtccgttctcctgataccagagtagaaaaagttgaagtgaacttattctttgctaagcattggcattctcagtctggtgggtgtcccacggcagcgttgtctttccgtacatgctcagtgtgggattctccggctcacagctcttccagcgctgccctctgcccttggaggagcatctaaacccctccctcagctgttatttttttcctgtagaaataaatcagaatgagttatgcagaaaaacccgatgaaatcacgaaagatgagtggatggaaaagctcaataacttgcatgtccagagagcagacatgaaccgcctcatcatgaactacctggtcacaggtaatggcttacagtgaggatgctgttgcatgaatgtgattctccctttttgaacacataaggagtgctgtagcactgaggtttgatgacgtagttatttgtgttcagacattatgaaaacacaatgctaacctggtaagtttggaagttatcatgtgaaagccttttctgaagatgagatttttccaggtctctgagacctaacacaaacccatttttcagcctttgacagttttacagttactcaaaataattgagactgttgtgaagtaagtatattgaaagcctaaatagttgatctcttctggccagtctgcaaaaatatgctggcctgtttctggaaagtatgcccaactcagaggatgggaatggggaagagcagaagcgtgcagagggaaataacagtcaggctgttcttgatgtcaactggaggaagggcagtgctgtatatggcaagaaaatagatgtttttaaaagacatgacatgaaaaatctccctc

SEQ ID NO: 101758 - DNA, 1519 bp, Homo sapiens
gtatagctgaccatggagggcccctgtgctgtggaggctgagccagtgtgacttgcctaacctggcaccagagctgcggctgctggcgtctggacctattatctgtcctctcaaaggagcccacaccaacacactgggccagcagccattctgacctctttggctaatgggttagagtttttggatgggataacaaggaatgaagtatactcttctcattttctatatgtattttgagagcataacttgtaaattataaagatattaataccgagttcctgagaaagtgtggttcacatcagaggttattaattgaggcaattggagtttctggagatacaaagtctttgccttaattccttgctaactttcctagcagtgaagatggtttttctattcagagggctttaaggaagcagcggagaagtttcgaatggaatctggaatcgaacctagtgtggatctggaaacacttgatgaacgaatcaagatccgggagatgatactgaaaggtcagattcaggaggccatcgccttgatcaacagcctccacccagagctcttggacacaaaccggtatctttacttccatttgcaggtatgtttcaggagagagtagtctggtttgtgaatacttgataagttaaagttatttgcaatgattgagaaataactaggctaatttgctttaataatgttatttcaatgcatgtgagggggagaggtttgagtttgctcttttatgtagttcagaagcggttttttgttttaaaaatgcaaatttgataactcagagatgcaagaaaagtcttccctctgtgatgtacttttgattgggacctggtaccacctgccctaagtccctggcctgggtgtgtgggggtcaagcttgtctgtctctgcctccagcaacagcatttgatcgagctgatccgccagcgggagacagaggcggcgctggagtttgcacagactcagctggcggagcagggcgaggagagccgagagtgcctcacagagatggagcgtaccctggcactgctggcctttgacagtcccgaggagtcgcccttcggagacctcctccacaccatgcagaggcagaaggtggggcctgccagagggaagctttcttccattccccatgtgctctgagggggcttcgtgacaacgccaagtgtgtggctttgctgtgtggactgagagacaggtggcttctgtgcctgggatgctaagtggttccttcatggcttttttttttttttttggaggtgaagtcttgttctgtcgcccaggctggagtgcagtgacgagatctctgctcactgcaacccccgcctcctgtgttcaagcgattctcctgcctctgcctcccaagtagctgggactacaggagtgtgccaccacgcccagctaagttttgtatttttagtggagatggggtttcaccatattggccaggctggtcttgaacccctgacctcaggtgatccagtctcccaaagtactgggattacag

SEQ ID NO: 101759 - DNA, 3891 bp, Homo sapiens
tccccaggcaaggactatgtatttcatgtcctgagagtgtctcgcagttaagagcttaatgtttgtttaaactgcctctttttaatagactctgctggtgctctgcgtgtatggtggtttttatcagatgtatttatattctaggtgtggagtgaagttaaccaagctgtgctagattatgaaaatcgcgagtcaacacccaaactggcaaaattactgaaactactactttgggctcagaacgagctggaccagaagaaagtaaaatatcccaaaatgacagacctcagcaagggtgtgattgaggagcccaagtagcgcctgcgcttgcgtggtggatccaacaccagccctgcgtcgtgggacttgcctcagatcagcctgcgactgcaagattcttactgcagtagagaactctttttctcccttgtacttttttttgacctggcatctttttatagggaaaaatggcctttgtaggcagtggaaaacttgcaaggaaagctgccgtctctttggcagtctgatgcagagcctgcactctggcactcgctgaagaatctggaaggttgcggtttgctcttccagtgttcgggggcctctggctgctgaaggattcggtctaccacggagggctgtgctgttaggctgcatcccactcaaaatacaggaaaagcacgaatcatgattctgctttctgttagcttaggcagacattgggccttcacctacaagtttttccttacccctgtggtttttgtgtttttttttttttctttttccataggaaagaatatataaatttgtaaatcctaattcaaagatggctcatgtgtgagggcattgagtttgatttgttttccctttggtctgggttgtgtggcttttgggggatgcgtgtgagggggctatgtgttttttaattttttaaatatatattttggtgctgtgtgtggtaagagacttgttcctagtggatcaatgaaccatctcttctgggcagttttgttgaaaataaaggtttctctttgatttcaagaatgaccaaaatggcctctaaaagatgttaatcatctcaaatgaccttttgtctttggggcgttcttccccctgtgatagcggcagtggctttttctggtacctgcagctggaaaggccacttggccctgtgctgagtgagcggccttcattagagcgaggcagcccttggccggtggggacgcagagccccagcaggtggtgcacgactgttggcggaaggaacgcgtgttcatcctcagtgatctgccctccagcatctcggcagcatctcatcctccatcgtcagctggctctgccgatgtcctgcttctgttcactcacagaactgtcccctgctccgtggtgggcaggagggaagtggtgcagggctgcgtgcattgcctgcgagtcgggacagttgatgggcacatggccttgtagctctgggcacagatgtgtttggattcattgcagcggaccaccgggcactgttgaccccactgagcagtgctaagtgttggtttagtggatgttcgtggaattgctgacccatccaagggcgtcctttggagccagtggagcctgccggcgcatctgaggggcagaatgctgctagcacttgaatctgggatctcgccttattctcaagtagcaaggcatctcgacaagcatggtctaggtctggtggccagcttgccagtacctgagccggtcgggtcatctgcctctgagggaccgtcctcaccgagctcctgcatcccttgagtgttgatcaggaggcgtccacagcattgttctcgcctctgaatgatgcttctttctgtgttggagcctggcgaagttgtgttttcaagccctctacttctctttccagtgggtaggagcttttggcagtgtttactttacctagatggcttatataatccagtaagagatgcaaagataaaattgctgcggttgttacagaagcatggcggcctccagactgacccattggttgccctttagattttgtaaggatgcggtgctggggaggtggtgcttccctaccccctagaaatgctgccttccaactaccactctcccagatgtgacccttgcgattatttcctctgaggtttgaggatgaagataagttggagggaaagagagtaactaataggggatgaaatatagcagaagctagaagaaagcggtgaggtgagagagatgcatctgcacgttttcttcaacagcaccaggtgattcagcatattcctaattacctttcactattcgtgtatataagatcgtttacttgcataatatatcatcaatttgacatattcttaaaactagagggtgtgagaagcacagcaataggaagtctctccacaaactaggggaacacaaatggggtcattcacgtgcctggactgtcactatgtggctgtcacgtgaagtgctggtgttgatttccatttcagccagtgggtagctgataagccagtgccagcatccagcatgagcagatgtcggggagactgggaagtctccagcgttactgctctccttcccttcatgataagccagtgccagcatccagcgtgagcagacgtcggggagactgggaagtctccgatgttactgcctgccttcctttcgtgtgaggggctgcacttgcttttcttgtgatctgttagtggacgaggtcttccaaggaagtgctttgcacactttctttgctcctttttacagtctttgtctttgcagcaagcaaatgaaattaagccactttgggataatgaacattcagtataattctactttgtctcattttggatctcactgttgtctttataaaaatggcacattttacaaagtagtttattcttattatactttctgctggagagtgccttgaaataaaatgtgagagtattctggtactctgtgttccagatgcatgaaattgggtgaggaataacccctagtctggaatctttgtgaagcatagggttattgcaaggcaaatgggaactaacacatcttgccatttgaatcagggtctccagtttctagaaaaggcagacactggttgggaccaaagtctccatggcacatgactgaagactggtggtcgtgtgtgtgcggagtccacggaagcctcggggaggtggagctgctccttccattccgtcaggacgtgatctgaaaacatgtagagaagatgagttgaggacagcttttctaaggcaatgtgatgtctttgctttcttatttctctttctctgcgttgttagttttgaagagtggaggagctaggggctccagaaagaatcttacacatgtgttgaagacattgatgtcatagggagcggggagctgcattcccttctgggctgttactgctaaatctcagtatgaacagaccaggcggaaagcttggtggccaagcagtctgtgtgcttccccgctgatggagaacgttgcgttgttcacaatagggcctcatgggtgtagccgcatggcagacccatggctggcgcagctgcctgttgccgtctgtcttcagtaactgctgctctgttaactgttctattctgatactacgcgtgttgttttttacaacaggtatgtttttgtttcagaaatatgtattgcttttctcatattttttgcaaattgtattgtcaacatgggtcatttaaagtcctgtatgaaccataacctgctgtggtacctttgtacatgtttgattctgtattctttattccagtgtggcatatgtgcccctctgtatcttttgagaagtgcggaataggttgcttctaccacctgttcttaatgtaacagtaaaagttttcacatttttctcagaactgttatctg

SEQ ID NO: 101760 - DNA, 1743 bp, Homo sapiens
cccagcttgttgtgctacgatgacttggcacctgaggcacattctgttttctagaaaccttcaaagtctggcacgtctcaatgtcagatgtcatcctgtgcccatgagcctactctgggggtctggggggcagcaatggcggctgcgtggtaacggtgggcaccacctgcggctggctttgccgtgtttgtgcacgctgtcttcgggcagagcagagacgccaggtgtcccaagacctgtggctcttgctgcggggcatcggacttctggagggagccccaggagctccgccaggcggcccccagcctccctcgagggagcgagggaacgggccctgcctctgagccgtgagcctatgagtgagcgctctgcggttaaaagttacaggcgctggccaggcaggcgcttcctgtgtgtggccgtctgtttgacgatgcccccctgcagggtagcatcagcgccctgtagacacggcccgtgggtttgggggacaagctcctgttgtcaccgtggctccgcggtgcctcccctcgcagagtccctccaggtcaggctcagagccctctggatgtggaggagctgcatggggtggtaaggtggtttccaaacttctaaagcggctgagaacacttggtccaaaagaaatcctgggaggaagctcagtttataaaacagggaagggcagctttcttgggggaagtatgtgtctgtgcacgcatgcggcaggtgtctgtgcacgcaggtgtgcatcttcatgcgtatgcgtgtatctgcatcagtgtgagcacaatgcagcactgccaagaagtgtgccggtgaacacgtgcgtgtgcaggcgcatgtgtgtgtgttggtgcgaggactctagagcacagctggaggccggtggtgagagtgtgcacatgtgcatgtgcgtgttcgcggggtgggagggctagcttggaagcaggggtgtttccctcagccgtgcgggtggcacgaccctgagcgagcctcacccaaaaggagtctgtttcctcagtggcaccaaaagccctgccctgctggtccctcgggtggggaggtgagctagagggacaggtggacgtcctctggaatcacagcccaaacctgagcagataggccgggaggagcctccctggatggaccctgagagaccctccctccacttgttgcaggggtttacttccctgccctgaccagcctgctgtcgcagaaggtgcgggagagtgagcgagccttcacctacagcatcgtgggcgccggctcccagtttgggtaagtcctggcctaagacggggcccaggagaggccaccaggtgagccccttgccgagtggcccctggtctgcgtgggggatgggccacatgggcttgcagggccaccatggtgaggtgggtcccgcaggcgccttttgggctctgtagcccgaggctgtgctctgcaggtaccagccccgggcaccgcgcttgctttgtgcatatttctgcctttctggagtggctggcaggtgatgaggctgggacttggggacatgggttggaggagtggccacatcatctcattttctttcatctgtgctaacgatgccagatgccgtccccaccatccgctggcccccaccctcgacaggagagtctgtgagcgcaggagcgtctgggccagggtgggcctatcagctggctggagggcggcttgtcctcagggtgggcctatcagctggctggagggcggcttgtcctc

SEQ ID NO: 101761 - DNA, 1065 bp, Homo sapiens
ctgccctgccgggtggtggtcaagagctgcacattcccaggagcagggctggccctgccggagagctttcctgggcagtggtgggcacgggggcgctgtccagcctgagtatcctcttccagatggccagatgccggccctggccccctctaaggccaaactcccccctgcagggctggatcttcaacgtggttccttggttggtggcgattccggccagtctattcagcgggtttctctctgatcatctcatcaatcagggtgagccccagggaggggaccggggctggaagccacaccctggttcacctcgctttcgaggggcaggatgctcccatcctggggctgcagcttcagcacacggagagctgggacagaggggcacttctttccaggctcggcctcctccttaaagggtggggttagactgtggtggagggtctggtctcacggtgactgtggagctcacccctgggggctggatgcagcccctgaccctccaggaaggcacctggaggggtcagaggttacaagcatccttgaacctttggaagagcttctgtctttgttccatgtgctccagacccacgctgggatgagccccgagcgggctgcgtgtttcttcccctagtgcagtgtccgctgcacagacacgtacaggcggatgcacacgcgtgcccacatgctctctccacacgtgtgcctattcttagaatgttcgtgtttttcctaattgcaaaaggaatacacactcgttgtggaaaagctagaaaatctggagcagcagaggaagtggggccgctcgcctgtttccgcctctgtaactgctgtgtggctgttctgtgtttctgcccaaacccacgccttgggaaccttccaaaggcgcacatgcggcctcgcggctgcaccccacatgcgtgtgtgcacacgtttttgcctgcagcacgggatagctgtcttgagccccaagcctcttcctcccctgctgcccctctgcagccattcgggatgggaccccctctggggtgtcagcacgaaagggctaacgggagccccttccttggc

SEQ ID NO: 101762 - DNA, 1431 bp, Homo sapiens
acccatgaggacctctagctcccaaccccacagcctctccaaggacccaggcgccagcagccccaggacacaggggactcagtgtgtgggacttggtcactccatgtcagacacacgagcagagaggaacacaaaccactgtggagcctgaagctccttaagaagagtccacaacagctggtgggagggtggggtgggcctgggtccagaccaggctcgctgctctctgggcctcagtttccccacctgccagcgggctcggccctgtcctcctcacaggctggtgtggccgtcagggtgggtggggttattgttagtaggcgcagcctcattcccaccacgatctgttccgcgtggttcccgccaaacctccctcggtcgccgtgttctccgcaagcctcctgcagcgcccgcctgccaatgtgaggctggcaccaggctgcagcctccccaatcccagcccactttgctgtgtctctggcgggctgtcctccttggtgggagctgtcctgcacactgtaggatgcttaaaggtatccctggcctccacccacccctagccagcagctcccagtcagacaacagccagaaatgtctccagactctgcccagcctccccaggtagccaccctcgagacacgacctcagagtctctgtgtctcctagaagcctgacagagacccccagggcagtgggtgggtggcgggctagagacccttgcctgtgtccgggaccctggcgccgctctcccctcctgtggatccctccgcactaacagtgttctcagtgggcagacgcctgggcaccccttgggccctgcccagcatggccatggcgcaggctctcgaacccgcatggctttcccaggcctggtgattctgctctccagggacggttggcaccttcctcgggggcgggccccacgcaccccagaacacacagacccacctttctggcgttctttctacctcccttttcgttgcctgaggagctggtggtttcatgagttaatgatacatcttgcaaggtgtacacatagagaaaaaaacctaaaaatgtggaaaagcacgccaaagccttatttaaataataactattaaactattcaaaaagaagactgttattttatttaacacctttgttttttaagaatgaacacgtgttaaagactttctgtaactaatttcatgaggaaacgagtgacacgttggaatcaggtcaaaggagaatcccaggaacggactcctaggccgggagtgttgaaatgagcatgccagcagagccaggctgggtttcggggttcctttgccgccaggggtcctgcgtgtccacagatgacagcgatgtaccctgctatcagctgtccacccagctttcccaagatgtggggcccccatggagtcagacagcccagctgtgctgtggaaagac

SEQ ID NO: 101763 - DNA, 1101 bp, Homo sapiens
gctcaggggtaggggacatgggggcatagacccctggccctggcagggcatcctgtgctgctcacttcattatcaccaaccaggatccccaaacctgagtcactggggagccgtggccgccatcagcatggtgggatggagggttggctttcagccctcccaggttccttgattctgaagcaaagatgactttgatgctcaggccccagccagcggaaggacaacaggcttctgccattccatggaccaatgtgggtccaaagggtctaccattctgcacagggccaacttcagggcagctgtccggggctgcagatgctccctcacaggccaggtggggctttcagctgtgacaaagtctggatgtccacccctggtgaagccactaggaggctgtgggggagccgagggtagtgtccaggagccattgagtccatctcaaggctctctctcctcttggatagtgtgtgcccgtgtgcatgtgtgtgcctgagcatatatagggtgccctcagagagtgcattgggtgatgatgactgatgtgggcagtcttttctttgatcaatggaagcaaaatcatttatggcccacgctgagcttccttctctggtttcctgttaaacacagcaaatgtgtgtctccaataaaaagctacacagcaacttaatctctgatcgattgcgaggaaaggaaaataaaaccctgctccctggggatgggcagcctctaggcagttgttcctgatatagaatgtgggcaataaatgcattaaatataaatggagtgacggagaagagcgataaaccctggttcctccacgctaattgaaaaccacgtcaagggttgatgaatgtagaggtcctctggggcagcgggaggccctgaatctgtttgtgctgggcgctcacccttcctggcaggcaggggctatgctctctgtctggggtagggggtggggttgggcaggtggggagggcatttgcagcaggtcccaggagacacccggcatctgcccgcccgagcttgctccacttcctgggagcttccctggacggtctatccgactgttgacctgtcaactccctaagccccagagcgtcc

SEQ ID NO: 101764 - DNA, 2905 bp, Homo sapiens
cacattcagtccatttttagcaaaagaggaggtttcaggttaaatgtttgggtgtcctgcccgctggttttctttattagtttgcatcttgatagatggccagatgagggtggatgtgcctgggatgcatctttttgttttgtttttatttcgagatagggtctctctctgttgcccaggctggagtgcagggcagataatagctcactgcagccgaaaactcatgggctcaagcgatcctctcgcctcagcctcccgaatagctgggattacagggtgcgccaccacactcggcctgggacacctctctagcagagtggtgcagcgtgtgctccttagatcgcacattttcatctttgtatgctgccttgtaaggagactgaaggggcttctagaccctgctactcagggaggccagtgtgggaaaagattcgggtgtaagtctcaagcttgtgtgtcacatacactctggaaaagatgattctcttacgggagtgggcagcaaacctggtcagaggagctttgccttgagccagtctagccgtgggggagtggggaggggcatgctcttccccttggcgtgggagtgagctggggagtgggaagggcctgaactggacaggcccacaccggtcctcctgcccttcattagccacatgacacagcaccttgttagccagttggaaggattttggtgtcctttgtgccactgagaagtttaaatgagataaaatacagaagaacagcttctgtctccctggcctccttgagagcctggtgcgtgccagctcctccctctgagtgcagagaatttcacattgctaagtgtctttccatgtggaatgatagtggcacatgagggaaagacagctgtgggaagtgaggcttcccagcagacaggtggcccatgtgaccgttgtggttgatgcttttctcctggtagagggggtggggagaatgccatgcccagtgtggccagtcccccacagagcaggccccagtgcagctcagagttgtgtgctggtgtggcttgggtaccattcagggtcccgcctccagatttgcaggtgctgctaaggggcagcctcggatctcacttttgggagggattcattggtgtggttactctgcgttcaacttttgttttttctttttacaggaacggcagagtcgaaacaaacaatgagggcgaaccagtttcttacatgttctaacgtttgactttgaaaacagtttaaaacacgtgtgcttggtcagctccagtgtgtcgtcccgtgcgggggttgagtgttgcatctttgcctttcttgtcgttgatttttgcccagatggatctgcatttatttgtactttttctatgtattataatcctgtagaagtcactaataaaggagtattttttttgtcagcttatcaatcagactgatctaatgtgaaatgtaagtatccttaaaaacaaagcatctattttggcagaaattgtgttcttaaattcagtcatttgatattctgtgagacttcatatttctcatccctttattgctttttagcaaacataagaaaccatgagtcattttgtcatttagagtattctgataaaatctcttgaaaatactgaaatcaaaaggttaatgattttttgttcattctgatttgtcattttattatctgttatcggtctaaagtgctaatttacccatttgatttttctgctagacagataacttttaatttttcaaatttggcagacactttttttttttttttgaaaatctttccttccagatctgttgcccactgaacagccacccgtccctcactgtcctggtgtccgattgggctggatggtgttggggcatgatgtgtggaggaactggaaggtgctttaggtctggttcagggtcgggcattctttgttgtttgcacatctttttaaattttacaccttttcttaagaattctaatgccgtcttaagtttttataccaataatgctgagctttaagtgtaggatctggtagtacagacagtgtgatggatgatgctgctggttgtaaatttcatcgtgtgtgtctaattttttttcctgttgaatgggtaaaaacaaaacaaaactttttttagaagatgaatttgctgtcatgttttgtggaatgagggaccgttgagctcactaccacctggagtttgagttgaagcatgaaaatggtgcccatgcctgacgctccagcgcctggatctgcacgtgcccttgtagaggatccttaccgtcctagagagcagacgctttctgaaaactacttgctccaaaagaccctctgagttaacgtttcagctgtatcattagacttgtatttagagcgtgtcacttcctctgaactgttactgcctgaatggagtcctggacgacattgggtttttcctctaggagaatacaagccttaataaacaatactatttagcaaacttggtgtcacctcattcttcaccctacttgatgagtttatgtgttggagctttttaagctgcagagccattcggggagtcaccgtagaaagccctgtgtttctcaaggtgtgggattctcgttccctcgctttggaagagggagctgttaatttccttaagactataaactacatggcaccgtcacccacccctcatcacatgaatgtgcagacgcagcggtgcgtgcagcacctgggcaccgctaccccctttctggacttggctcctcaccgtctctctccattcatcctccaatgcctcttattatttatgcaataagagtttaatacctgtttagtttgttttccttttgaggtaaaatttataagcagtgaaatgcacattgtgtacatctgcagaagttgacaagtatgtgataaagttatgcaatattagcc

SEQ ID NO: 101765 - DNA, 2504 bp, Homo sapiens
cgtggcactgactggtgtcctttctggcaacggtgggacaaatgtgaacatgccagtttcaaagccgacctcgtgggctgccattgccagcaagcctgcaaaaccacagcctaaaatgaaaacaaagagcgggcctgtcatggggggtgggctgccccctccacccataaagcataacatggacattggcacctgggataacaaggggcctgtgccgaaggccccagtcccccagcaggcaccctctccacaggctgccccacagccccagcaggtggctcagcctctcccagcacagcccccagctttggctcaaccgcagtatcagagccctcagcagccaccccagacccgctgggttgccccacgcaacagaaacgcggcgtttgggcagagcggaggggctggcagcgatagcaactctcctggaaacgtccagcctaattctgcccccagcgtcgaatcccaccccgtccttgaaaaactgaaggctgctcacagctacaacccgaaagagtttgagtggaatctgaaaagcgggcgtgtgttcatcatcaagagctactctgaggacgacatccaccgctccattaagtactccatctggtgtagcacagagcacggcaacaagcgcctggacagcgccttccgctgcatgagcagcaaggggcccgtctacctgctcttcagcgtcaatgggagtgggcatttttgtggggtggccgagatgaagtcccccgtggactacggcaccagtgccggggtctggtctcaggacaagtggaaggggaagtttgatgtccagtggatttttgttaaggatgtacccaataaccagctccggcacatcaggctggagaataacgacaacaaaccggtcacaaactcccgggacacccaggaggtgcccttagaaaaagccaagcaagtgctgaaaattatcagttcctacaagcacacaacctccatcttcgacgactttgctcactacgagaagcgccaggaggaggaggaggtggtgcgcaaggtgaggctgggtgttgcaggcaactgccatgcagatgtgtccttggtgccgtacttagaccaggtggcccggtggtgagcagatgcggcaggtccgccgagctgagtctcgtgacaggcagctcccagttggccgcaggtgggcgggcccaggtcctggcagcctcgtgggctttccctgcggagagtactgctagtaaccagtgatggtatttgggtagatgtcaccgaacgactttgatcactttccaattataattgaataattgggaccacagtgtacacattctgtttttctgttacaaagaatttgagggtaactttctcctctcctttttgaattgtgatactttctggaacagtgcttcccagcctccgtccatgaggaacacttaggtgatattcacgaagcactgcggtgggcacgtagggcatcgagaccccacctggccaagggcccttgcttcccagggcactgtccctcagtagttgggaatctctggtctttgatctggaggtcgttgctttatttttcttttaaaaacccagtatcctgcagtttttggaaacaaactcactccatctaggtcgtaaagaaaatggtggtggtggggtaggtttggaatccagacattttataatgacaaatatggatcctatatcaaaaattcattgactgggcctttttgagacagtcctgatttcctgggatacttgtagccaaactcctgagtctgtgctgtcatgtgatgtctgacgggattgagtgtgtttgctcttcagaagggctcagatgcccgtaaactggcaccagcaatgggaaaatgatgatgctgacatacttcataatgcttcctttattcgagagagttcatcctgagattctctcctgctttttaaaaaatatcccttcctgaaatgtcagttgataatagatgggttttcagtgtttttttcagttctctatgttaaaggaattattcacctgtgagcaccaagtgtcctaatgtattttgggcagaaaggcgtgtacatggcatatatagggatgtatagagtagagccgcctgcactgtctgcagtcttacattatgcaagtcctgaacaacttggggcttgtagaactttggaaaagtatcagtccctctcttttgtgagaaaagaagtggatgtcatttatttccagttactgaattctgaattagttactgaaattctgtgttttaggtcttttttttttttttaaatggagttttgctctgttgcccaggctggagtgcagtggcgcaatctcggctcactgcaacctccacctcctgggttcgagtgattgtcctgccttagccttccaggtagctgggattacagacaatagctcggattacagacttttaggtataaaatgaatactgaattgctaaagttgcagggataattgctaatgaagctttaggtccttagctggctaaactggaagc

SEQ ID NO: 101766 - DNA, 1028 bp, Homo sapiens
acccttgaaggattctgggagagctttggtccaggtatgggagagtgtcccaggaggaatgtcaaggcccagaggtgggcgcccagggcctgctgagtaatcagcgagcttggggtctgttctctggagcaaactgcctcacggccctgcacatcctggtttgccaatggaaatatctctgccttacaaagctgtttcagttcccatgatgccgtccgtgtctgtcataagcgttgtcgtcagcaggcaggggtttactcctctacctctggattcctttgcaggtaagagtagagggggctgctaccttgccagttctagagaggcatagcttcgtcatttagcctgaattcagagccttgccaatgatgcttcgtattttgagacggcaccctggtttgtgttcgttattaatttctctgtcttgatttggttctcacattggcgactacagctttctttctggaaggagtagccccatgctgtgcaggttttgtttttgctccacctgtgcttaagcaagaggcggttggcattctcagcatctcgtgttgtagaagtggtgtaacttgtcacgtttgcttttgcagagtaacagttacccctcaatgagcgacccctacctgtccagctattacccgccgtccattggatttccttactccctcaatgaggctccgtggtctactgcaggggaccctccgattccatacctcaccacctacggacagctcagtaacggagaccatcattttatgcacgatgctgtttttgggcagcctgggggcctggggaacaacatctatcagcacaggttcaattttttccctgaaaaccctgcgttctcagcatgggggacaagtgggtctcaaggtcagcagacccagagctccgcgtatgggagcagctacacctaccccccgagctccctgggtggcacggtggttgatgggcagccaggctttcacagcgacaccctcagcaaggcccccgggatgaacagcctggagcagggcatggttggcctg

SEQ ID NO: 101767 - DNA, 1061 bp, Homo sapiens
attacgattaagcctttatttaaaatttatcctaaattattgaaagtttcccgtcccccttctaattagttgtataaacatcagttctatactggttgtactccttttaaaattaaagcataatttctgctagaaatagatggaaatagactttgctaactttgccttccaagcttaaaagtaatcttttaaaatttgagggtaatattttgcaactttttgttctagtacaaaatggttcgttacatcagaaggatacagttcatgacaatgactttgagccctaccttactggacagtcaaatcaggtgagtttattttgttagcatatatttgtttttaagttggttttaattgttttgtacctttactgtcatttctgatttttaaattatcctaaacaacaaagcagcagactataaagtattaggaatgatagactgctcatgaagatgtgactcctgttaaccttgggcatcagtggggtgaaaatgattttccctgtggaggaggcggcatcccactggggctgggatgcaaacaggtctagttggctctagtgtttgtgggtcagtggtgtgtcttgcctttgacgcagtggaggtgtgtgtgtgtttctgaagcttcctggttattcttagctctggatgattggaattgtggtctggggaggcagctaagagctgggctgtggagcgactgtggagccagaggccgcctgggtttcagtcctttttttgagacagcgtctcactcttgccacccaggctggagcgcaatggcgtgatctcagcctgctgcagcctctgcctcccgggttcaagcattcctcctgcctcagcctcgggagtagctggaattgcaggcacccactaccacgtctagctaatttttgtatttttagtagagacggggtttcaccatgttggccaggctggtctcaaactcctgacctcaggtgatccacccgcctcggcctcccagagtgctgggattataggcgtgaggcaccgcgcccagcctggtttcaattttaactccaccactgactggcctgtgtc

SEQ ID NO: 101768 - DNA, 1049 bp, Homo sapiens
ccgccgccgccgccattggagtcgacgcctcctcagtgcgtccgcgtcccgggctcaccgccgctgccgcctcgccaggggcccgcgcgcccagcagccgccgccgccgcccggccggcgcccggggaattggcggcggggcccggggccgcgcgagctagggtgacaggcccggcctctaggggaggcccgagccggcgggcgccccggccccgcgtctagttgttcatgaagcatgtcggccaccagcgtggacacccaggtagcggggccgggttacaggggccgcggccggggccgaggcgcggggtctgggttgaggtcctggggctggaacgcagagcccggggtcgcggaggccgggcccaggcgggaccggggtctcggggccggggtcgcacgtgaccgcgcgtcggggccggcggagctcgcggcccgttggagaccagttctctggtgaataactttgtgtttccctcttcccccgggttgtgtgtaccccacgtcccggcctgcggcggtgcagagaacaaaaggacaagataataaaggtgagcggagtcccgggacggccggcgcgggctggagtggaggaggacggggaaggaacggtccaggaagctgcgtctggaaccggaaactttctctcttccgccagcttcagggagataaaacttgaggttgtgcgacgattctgggagatttgacaggtcgaagacaggggcttctcaagaagtgaataaatgattgctcagagtagtttgggcccgtctctccccaccgcatgatcatggatttgctttggggaaggggaggtaggagagccgggtggacatggccgcaggggttgagcgacttgcctttttccgcccagcaggggctgctctaggagaggggcagtccaaggttctgcaggctaagctccacatccccggtagttgcagcccgttttccaagtctgttagcatctcctgtgacattatggcttgggataaaccctcagagcgcactcatgtgaaaactgttaagtgacacttcacgtttacttg

SEQ ID NO: 101769 - DNA, 1021 bp, Homo sapiens
cagtgtctcgcttgtgtaagcccaacctggcccaccctgtttccccaaacgcctccaaagccggctttccttgaccactgaggaaaatcaaggctgagaggagccagcaggcgtcagttaatgcaggcaggcagagctatggtggccgccagggcacggtgcccgaaggaccaggccccaacctaagcgtcaagggaggtagtaagattgatgggcgctatcagcgggacctgggagccgggtaaaaacaagctgacgctgccacccgggaagggcctgcatgggttcaggagggccgggcacagccggctcagggccccctccgcaggagggctggctgcgcgtggtgctggggcgctcacctggcctaggacaggaaggtgcgcacgcggctgcggacgggggctctgcagatggggcacagctgcaggccgggggcacactcagcacagaccaggtggccgcacggcacaaagacgatggacacggcgcggtccaggcacaccttgcacgtcctctcctcctgcagccgccgcagctgcgcctccacatccctggctcctgggggctcaagaacccaccacgccctctgggcctcggctggactgacccctcctaggaggacaggcctgcgaaatgtccccacaccctggcccccaccctctatgggccatggaaggtcggggtccctcagccctcccctgccccagccctcacccagggggtcccgggcctgcacctggctcctgggcactttcagactggacctctctcctgggtgtgggcagctcagggtacccagaggcagggactgtggacagttaggatagacttgaggcctaactcccaaggagaaagctgggccggcccagatacaggtctgcagcctgtggggtccagttctggccgggagtggaggggctgcagagtatccccgctcccgacacttcttcccacccctcccacagcataacaggatccagaggcttcctggaggcgccaccagagagcctgtcccttg

SEQ ID NO: 101770 - DNA, 1205 bp, Homo sapiens
ccacagggttcagtctggtgggtagggctgcttcccttggggcctcccatgtgcagtgggtgtgggacccaggcatgcgcggtgcagggtctgattgcagtgagtcccagccagcccagtgtgaattgggggtcttgggtgtattgcagtgagccccagccagcccaggtgtgaattggggggtcttagatgtattgcagtgacccccagctgcccaggtgtgaattgggggtcttgggtgtattgcagtgacccccagctgcccaggtgtgaattgggggtcttgggtgtagagaagcgctaacacttagaagaaaagcataacacattttctgcgtggaatctgctggacctataaatgaatttttatccccaaagctgtcatattaagttgttttgatccttcttctagtacttctgtggctggctttggggacttgctggggaccctgtggtgatgtggcaggagggtctttttaaatgatcagaaagcacatctctctgctgccacaggaggcagcgtgcatgtcctgtgcgtggggacgttggcacgtcccccagagccccagccttgcctgtgttcagggccccacgccctcgggaggagcagggttcatgccagcatcttcggcctcttgtccgctttgttttcagggcccaggggaatcgctacgtggggtttgggaacacgccaccgcctcagaagaaagaagatgacttcctcaacaacgccatgtcctccctgtactcggtgaggacttggccctgcagagcatctcccatgggcagaccccgccctgagggcacgacgggccatagtgggcagtgtggcagtcctggaacatgtgctctttgccttgttctgatctaaggacccctcccttaccttcagcgacgttttctttcaaaaatgtggcttaaatttttcagatcccaaatgtattcaatcacttcctttttttttttttttttaagacggagtcttgctttgtcgcccaggctgcagactggagggcagtggtgcgacctcagctcactgcaacctctgcctcccaggttcaggtgattctcctgcctcagcctcctgagtagctgggattataggcacctactatcacgtcaggctaatttttgtatttttagtagagatgggttttcaccaggttggccaggttggtttcgaactcctgacttcaggtgatctg

SEQ ID NO: 101771 - DNA, 1050 bp, Homo sapiens
gtgtggcctcgactccactgacccaggatcaggagaggctgagctcctttctcagcagcttcttcctatggccccagcctccgtgccctcttccctccaggggggactcggtgcctgcctggggaggaaggagaggcgttgcaggtcagcatggggtggctgcagccggcgttggcctcaggcacaggctccacagggcctgttcccaccagcccggcccggcagggccgcatggtggcgcgtgagggaggaccctggagggggaccttcctgcaagaattggtgggggccgcggtctccgccttctagaggtggcggcctactgcccttcgggtgttgtgtgcaaagccccgtttcctgctccctgcgcttgtatcctgctgccttccctcctgctggtgaagctcgtgctgccctttgctggcctgtgctgccactgccgacccgtgtcccgtggtggagctgtcgtggggctcacgtgacttcccttcctacaggcgtccgagctgggccacagcctgaacgagaacgtcctcaagcctgcgcaggagaaggtaacgggcagctccgggtggttgtgcctggagcccttcactccaggggacgtgggtgtgtcaggggtgttagggggattgtttgtccagcagctgggactcagcgaggccaagcctcacaccccacctctccagcacaggcgtcctcctcggggcctgggctcctcttggaccccccagctggtcccttcccctggcctagggcctcccttgcagtgcccccagcccagcacccccagcccacctccgttcctctgcctcacccctacagctggccccagagcccagcacccccagcccacctccgttcctctgcctcacccccacagctggccgcggagctgtgcccagaggaggctctggtatgggaatgatgcctgccatcctagggggtcaagagccccgccagctccctgcctccttcggggcctgactgggacaagtggggaagacccacctggggcagcgtgggctgtccttaggtcacgttgctatt

SEQ ID NO: 101772 - DNA, 1029 bp, Homo sapiens
gccggcaggggccacgtttgcagacaccaggcctcacagtgacatggtttcttgatgctggaatccctttggggccactgtagaactttctggggctcagcctgatgggtatccacatgcccctgatatttcggatgccctcacccgggggattcctgcactcctgaagctttaagctttcatctctcccgcccccattaatgccgctgtcttcatccgtgcaggtgaaggagggaaagatttttgatgatgtctccagtggggtctctcagttggcgtccaaggtagggagcctgccagatacgcgggcacagtcgaagccagtctccatattccacggccctgggcgtgagagcagggtgtgccccgtgcagccctcagcccagcttggcagtggccgctgtcctctgagacgggaggagagctgcccagcctgacagcccgagggatatggaaacaacttggcccactgcggcccggtcagccactaactgtcacttctccctctgctcttatcttgctgctgctggccttttcctcggtaagtaagtgccagcgccgtctttgctgccatcagtcccactgctctgcgggccatttggggcgtgcattttgtcctgtttcctggcatgaggcgctctgcggacagacggggagggaagagcaggcctcgctcctcccccccaagcatgtggtgggagctcttgaggtctgtgcacgaggctgtcctcgctgccatgtcccgcacacacctggcaccgctgcagagtggccggggcgtctgtgtctgtacgtgtgtgcgaggcaccccttgtttctggattttgcctgggtcttctcagcgggacggcgcgtgccggcttgcgtgtgggggcctcctgaagctgcctgtgccgcgacagggcctgcctaacctctcttcccgtctccttccaggtccagggagtcggtagtaagggatggcgggacgtcaccacctttttttcggggaaagcagagggccccttggacaggtatgctgtgtcccct

SEQ ID NO: 101773 - DNA, 1045 bp, Homo sapiens
gcctgccccccgtgcctgctgacatggtcttcctggtggacgggtcctggagcattggccacagtcacttccagcaggtcaaggacttcctggccagtgtcatcgcaccctttgaaatcgggccggataaggtccaagtaggtgggtgctggcccggcccgcctcctgccccacccgggtgtggtccccacagctctgccagaggaggctgtgacctgtgggggtccccgtaccagccagggctctcaccttgtggggtgggacgcctgctccacatggggtgttctggggacccctccgtgtggaggccctggctctgcaagcgtcctctccctggggactggctactgtggccaggtgaccccacagaggcacgtgcagctctcaggtgtggccttgtgccaagctccctgggcatctcagcattggaaactcagcccgtggccatgcccctgctccccaggcctgactcagtacagcggggatgctcagactgagtgggacctgaactccctcagcaccaaggaacaggtgctggcagctgtgcgccgcctccgctacaagggggggaacacgttcacaggtacggcccaggcctgcccctccctctgtcctgagggcggacctccttctgccgccctcccagatcccgaaagcttgtgtgtaaatcgagctccaagtggtgtggacctgagccctgttcacacctttatagagggcagagtcacccccttgtttacctttgatgaaaacgagggcctgtgtccagcgcgtggctcctctgttccacattagcagctctggctgggtccacacccggcccagtctgggtgctcaccttgcaggtagggtctggctggggaacttggggcccttcaacaggtagaccctccctgctcccttgggctgctgcggggcctcctgataccccacaagggaaggagaggagcatctctgctgtccggttgctgccagccgagcaccaggaggggatgctggcagctgcctgtcactttattcctgctgctcccaaggccttgccctg

SEQ ID NO: 101774 - DNA, 1012 bp, Homo sapiens
ccccagggactgccatgagcccgtctgtaatagccttgttgagatgtaatttacacaccatacaacctgcccatttaaagtgtacaactccagtggctttggtatattcagagctgtcacccatggccacagttcatgttagatcattttcatccccccagaggaaccctgcacccctaagcacccgcccccccagccaccccaagccaccttctgtctctggatgtgcctgtcccagacgtttcctgcaggtggaatcacacagtgcagacttttgtgtctgggtgtttcccaaagcccttttcaccccccggaggccacattcctcccatgacctcaaggcagatggccttagacaaaactgtggggtggccttgtgtccccagagctggagccacaaaccttggcccaaggtgaagcctgggaagtgccactttgaatcctgtgcacctgccaggcggtggccgtgcccacccactctggtgtgagggtgccccgtgcgtgggtgtgatctctgtgtgggctccttcctaaagtgtccctgcatggccccccagcacctctgcctccgccccgggcgctgaccctggccgcagtgacgcccagaaccgtccacctcacctggcagccctcggccggggccacccactacctggtgcgatgttctcctgcttcccccaagggtgaagaggaggagcgagaggtgagctgggccggggggtggcgggggaggcagaggagtggggcagagcgagtgggggctggcctgggacgtcatgtctctgcaggtgcaggtcgggcggcccgaggtgctgctggatggcctggaacctggcagggactatgaggtctcggtgcagagcctgcgaggccctgagggcagcgaggcccggggcatccgtgccaggacccgtgagtgctccaaccccggctgcctgcccacaggcgggtgccccatcttgttcctcagccttccatggcatgggagacctcaggccccctcggtcccagc

SEQ ID NO: 101775 - DNA, 1050 bp, Homo sapiens
agacagttcacatcaagtgttttgggagcctgccctgggtcagtgctgagccaggtggggatgggcacccggacgggtgtgatggatgggggtatagggtgctcctgggtgtggctgcccctcctctgaggtgcccaggctcaggggctacacccccagcctgtgtctccacttccttcagagaaagctcccagcccaagccagctgtccatgacggagctgccaggggatgcagtccagctggcgtgggtggccgcagccccgtctggcgtgcttgtctaccagatcacgtggacgcccctgggagaggggaaggctcacgaggtgggcaggggtgggtttgtccttccgaggggccccccgtgggcccctagtcctgaagccaaagtctagggctcagagccatatgtgcgcccaccctgtctcccagggatgcctcactgcccggccccccaacctgaggaccccactgcacccggtgacccctggggctctcctctccctagatctctgtcccagggaacctcggcacggccgtcctgcctggcctagggaggcacacagagtacgacgtcaccatcttggcctactacagggacggggcccgcagtgaccctgtgtccctccgctataccccctgtaggtgcccctccacttcccctctgctgggtgtggggcagggatggcccaggggatccctgactcacccgctgcacaggcccaggaccctagactcccagaactgctggctccagagccctgatcactgggcctggtcgttggagtctgcagcacttccttgagctcacacgggtataggtgttcccccagtggccgagtgcacaaaccacctagtgtcccgcagggcagcccaggcagcagccctggttgggggtatggtgagggccctggcaggtggcgtggtgtgggtgtggtggggtgcggtgtgggcagtggcaggggtgtggtgtggttgtgccaggggggtgatgcgggctgtggtaggggtgtggcatgatgtggtggaggcattacgcagagcagggtagg

SEQ ID NO: 101776 - DNA, 1040 bp, Homo sapiens
aggaccagacctgctgcctgtgcccagggaggggccctgacaccctctgtccccgtcagaacagggccccaagccactgcattgctccgtcctcacatgccctccctttcctcgcaggggagcctggagctgttggtcagatgggcagccctgggcagcagggggctagcacccagggcctctgggagtgacaggtgagcccctgctgcctgcatctatctgccaaggctgagggcatccaggaaggaggagctcctgaggggccaacgggtggggcctcatgctgtccagggtggggtgctgggagcacaaggcccagcagaggcaggcgaggtggccctggggaaagtagggtcaactatggaccccgtaggggcaacaggaatgtggggtcacagggtgtggggtcacagggcgtggggtcacaggacgtggggttccggagatggattggcgtgctgggagtctgctgcacctcgtgggatgcagagttgcgtgctggggcggaggaggccctgaccagggttagcgcagcagggagagtggagctcaggtgtttgctcagtgggcacctggtccaagtgtgggaaagctcacaggagtcccaggaggggcctgtgaggccctgggtatgtcgatgagagaggcagggtgggggccatagtagcaccaggtaacctctgccttcctcaggaagcgctgggcaggcggaccctgtgtgcaaacttagctgaggggctggtcccagcagcaggtgtggggacagggtcccaggagcaggtggtgggtacagcacaactccggcctcaagtagcttcaggggccagagcgtggcgcagggtgtgtgacctggggcccatgaggggccggcacctttgagctaggggactcggcaggggctaggagggctgaggagcacaggcaggagacccaggggctcctggtaaggctggggcaagagggcagctgcctgagatgcccaagaatcaggtcagagcccagggctaagaacaagcagccttgcttctcctccacagacc

SEQ ID NO: 101777 - DNA, 1056 bp, Homo sapiens
ggggtggggatggggttgggctctgcgtcccactgagtctcattcctctgtccccgagccgagctctcctgggccagggtctcgtcaggaggtgcctgagagcagaatgaataattgaggttaggaacccggcatgccgagtgccccagaaatgccgctgtgtccccgcgggcagtgacgtgagtggggaggagactcaggcccacattgcccacacctgcctctgaactgctgctggtcacccccacccccgggtgcctgtgaccggggtcctgaggctggggcttttgtgccaggagtgggtgggacacagagacccccgtgccaaatcctgggcatccccagccccctggcccctcccacatcccccgtgtattcaggaccccatctgctgagctctgacctgcccccgctctgccatcagcccctgctgctcctcggccagagctcccaggacgcagggagaccctgggagagtgaggtcatcccggggccatggaagctggcaggagacactggtctcagaggagggatagagacgcagatttcagatgtaagaagcccgatccacattgcataagtggacccagctgccagatgtgtgggcagctgcagggagtggcccggggtgctgggcccagctgtggttgttcttttctgggtcaggagtgactgcggagtggctgggacgctcctgccgggggaccctcctgccgggggtggccgcttgcctgggggaagacccctttccctttctttttttttttgaggctcaaaaaaaaaatccaaataaagcaccatattcccaccacgccaaattaaccttgacaacaatgttggcgtatttgcgtccagtgctgtttttattaattaaggtaaaatttacatatggtgagatgcatgctcttcagtggagacccagcccctagaaggtccctccagcccttcctgtcggcgtccctccccatctgtggctctgacttaagcaccgtggattgacctctccggctcacgaccttcgaggagtcagaatcctgcagttggagcctttgatgt

SEQ ID NO: 101778 - DNA, 1029 bp, Homo sapiens
tgtgccaggtacggacgccctggaccctgcgaacaggtggggcgggcgaggggcccaagggacgggctccagagacacgcgcagggcaggaggggtctcacggaggggtctcgcactgaggcgcccagagctggtggtcccgctggacgccatccctctgcccgggatccacacggcccacgtgtgcccgccatgcccgcgccccacgccattgcagtctgccatcctctggccgtgacggtggctgcagcttccccatttgcgccgttgcctctggctgtctgcacttttgttcatgctccaaagaacatttcataatgccttcagtaccgacgtacacttctgaccattttgtatgtgtccttgtgccgtagtgaccaggcctttttttggtggatgtgttaccccgcacacttcaatctcaactttgtgcaccgtccattttctagggatagacgcccagggaatgaactctagttttctaacagattagctgagatattaacttactcacacggacaggttgatgccagagccgtaagaatgcgccagtgcgggtttgcgggggacttcgggtgtggggtcctgcggccgcgatggccgtggaaggttctggggatccctgctgccacggggacgagttcggacgccaggtggacctgtgcactcagtaaaacgcagtgattcaacctggacggtgtgtggcctcctcactcccactgtctctgggcggccggtctgagggccggggacttctggtcgatgctggggctgagtcgggtgcggtgctgtggaccgggtgtggggacggatggtccctctcctcagggcacgaacgagctggggtgttgtgaaacagtggggctgggggccacagtgagtgaggagcaggggcggctgggtcctagggctctggccagaggaggggccgctgtggggctgctgtggtccctgggctctctcttggggcgccgagctctccctcccctctgaggcctgcagccacccagaaagatgctggggcctggg

SEQ ID NO: 101779 - DNA, 1938 bp, Homo sapiens
ccggtgtgaggaggggcgggagtgatgacggggtgttgccagcgtggcaacaggcggggggttgtctcagccgagcccaggggaggcacaaagggcaggcctgttccctgaggacctgcgcaaagggcgggcctgtttggtgaggacctgcggccttgggtcccggtggggtttccgggcagctacaggcgggtgtggccggccgctgtgcgtggcctctgccttcacacctgacctgcccggcgggctttcctgttccccacctcaggggcgcccaaatacagagctattggttggcgtcttctccctgtaccttctgggatctgagggctctttccatggaagccagccccgaggtggagaccttcgcctgcagccgaggagcgggtggggcctgggaaccaaactggagccagagtggacgtccagccctctggtcttggcctccagagggagggcctggctcacggtggggccagggagccggctccaaagggtcttcaaaaagggggtccttgggggctccagctgcctcgccctggcctttctgtgggtgcgtgagagccagcagcaccccagccttggagaccgggggggcaggaccccaagtcctcccctctctcctgactgccctggccgggtgccggcactgcgagacccacctggtgagcaggcctcacagttcttagccagggccccacctcgcctgtgtcccaccagtgccccgacagacctggggcagggctgggccatgatgcagcgggccaggatagcctccaccgtcagcacagggccgccctccccgcctttccggaggaaaccactcccacctcagcccagctgtgcgccctccctagctctcctgccccctggagctgatggccccttctccactgaccgattccttagcggggcctcttggggtctcgggcctcgggtgcaccgtcccatgcccgtcctgttgtgggcaccgtggcccttggggcaggcggctctaatgcgggagcgagtccctagctccagacttaagaaccagaccccgggagcatctggcatttggcgtgacggcgtcgcaggcgggcctgggctccctggagagtggcctccctgggagtgagcagggctggggtcgtgggcgcaaatactcctgcagagcaagtgcaggggagtcctgggcccgtttctcctccacctgcgttttcagtgcacttggcttggctgggaggtcctgaggccctgaggccagcaggggaaccagtcctgagggagaggactttgaaagcagcatttgagggtcgtacgcccctggctggtgggggtcctggcgctcagggtgttcggggagccatgtctggcgtccattgtggggagctgctgccctggcctctctgcctacccccagcccggccagggcactcccaggccctgtcgccattgaggtgcctccgctgggctgtctcctcacccctccctgtgctggagcctgtcccaaaaaggtgccaactgggaggcctcggaagccactgtccaggctcccactgcctgtctgctctgttcccaaaggcagcgtgtgtggcctcgggccctgcggtggcatgaagcatcccttctggtgtgggcatcgctacgtgttttgggggcagcgtttcacggcggtgcccttgctgtctcccttgggctggctcgagcctggggtccatgtccctttgccgtcccgtcatggggcagggaatccatagcggggcccacaggcaggggtatgagtgcgtcccacccaacgcagcaccagccccggccaccgctccccgtgtccccagttccgtctcagctacctggactccaggaccctggagaagggagacctggcagtggagggaggctgtgctgtgtgtccccctgcaggtgtgaccccgcctgctctttcctcccccgccaggt

SEQ ID NO: 101780 - DNA, 1049 bp, Homo sapiens
ggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgtgagtggccggcggggcccccgtggcgacccccatggcgacccccatcggcgaccccatcggcgaccccggccaggctggctgcggcgggtttggctccctgcccctgggtctgggtccggggccggcgctccccggcgggagtgctgggccgagaccggagagcgattgtacagcgcgcgggcaggaaggattccggggtcggggccgctcaggtcggggtgggggctccaggcccgcaggacagagacgtgcggccgccccagccccctcctcagcctgggaggcccctccccgcggcctctgcgccgaacaaagggccggccggggagggacggcggcagcgctgggtctggactctccgggactctcggggacccgcggggctggggccgcccgaccaagcgagggcgggggggaggggtctggcctgtcctccgccatcctcccgagccgctctccctcagactagggtgagcttctgggttcctgagatgggggaggggccctcccatgacccccccaccccagcccgggctgagcgcagctgtctgtcctgccccctcggcgccgacgcccctccctggccccgcgaaccccctcagctcctgcgctcagctcctgcgctgtcccatctctgcagccgccggccgcccccgtgcacatcccgggctcagga

SEQ ID NO: 101781 - DNA, 1105 bp, Homo sapiens
attgttgcacatgtactgagggtgtttttaagtgaattgcttagtaggcttctaggaagagtcagatttatagcattttcaaccaaaataatggtgagtgcctaggcttcccgagttagctctttgggtggcccctgagcccctgtgagtgcacttgaccgggtgcggaggtcctgggcagcctgtccctgagccggcccctcccaggggtctgagatccatgaggtgtgtccctagggcttcagtcctggggcagaggcataaacagaaccagtcactatggaggtcgaggattcccatgtgggcccttcagcttgggctgcttggccacggaacagcccttggctccctggcccccggcccccatgcagcccctgggctggcccttggtggtctctgtccaagggagagcccctgggtgttcaggaggctgccccgggtgggctgctcagggcagctgccgaaggtggagcccagagcctgtctggaagggctgtctgtggctgtcctgagacctggccttggactcacaaggaagaccaggctgaggcccctccaggccagggtcctggggcaggcatctcagggagcagccagcccaggcctcctgccgtctccaacagggcatgtcccgggaggaccctgagtgccagattcccctggacgctcctgctgattctgtcggcagttgaaggcccgtctgaggccccgcaatgcgagggtcctgtgtcccacttcactgctccgaagggaactggctggctgtccgtccagtgagcggcccagaccccacctctgcgccattgtcaccagggccctgtcctggctgccctcacccatgtcaagctactgaggctgtgtcttgtttgttttctctgttacatttttgtttgctgttgtcacagtcagctggtttcggcgtgatgttgatcttttgatgtacatactccgttttaaactcatttccactctagttgagttctgcagcatgcagcggtatgaccctacgggggtcaggagagccctgcggcccccacccaccagctcagaacctgtcactaatacagctgcctgtgaccctgggacccgcaaccttccagctgct

SEQ ID NO: 101782 - DNA, 1904 bp, Homo sapiens
gtcaggaggaagcatttccattagaggggcagccggtggccagcctcacttggaaggtctttgaacctcgggggtgcagggaggtggcagtggtgcaggttgccttctcctgggttccttgaggtgccctcttgtacccggctcacacccttcccctccccgagtttcctgctcaggttcccgtctgagagcttgtatgtaggacgtcagataggacagcataaatgtttggatccagaaacgcagaacagtttcctattttgagacttgacacctaattagtcatcttactatttaagctgaaaaatagtgtcgtgttttgggtaacgttctgcaaatcgtttgctaatggcggctgagttgcttcacgccctttagggcaagagtgggacttgcctgtggacttctccgcggtcccacagggctctcgccacctggcagtggcctctgcatctgcaaagagctgcccgctggctgccgaagcttgtctcagggcagcttgtgtggcctcgcctcttcctggcttccccgtaacccttgctccgaactccgttcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccataggtgaccctagttcccaggcctctcctggcctcctgtggggatggttggcaagggatggcgctgagggtggggtgggcccatggggactcctgccgtctctcaagcagaactcaaggagaattttttagctgctgtataatttctcgccatcgtgggtgtaaacctagggttgggcttttttgctgaattagggcacggcagatgcccacttcacccatttttgataaaccagtatctggggtgtcagattcttggctgtctgcagggccgagttagccgaatgccacctgcctttgatacgtgagaacgttgtctgagaaccgtgacttctgtgcttgcttgtgtctggtcagcttgctacacggacatcccaaagattatttacgcctccaggacccactcgcaactcacacaggtcatcaacgagcttcggaacacctcctaccggtgggtcagacgagtttacacctgtctcggggtcctcaagagaaccagcttggcatggtgctgagtccacagccccatgctgtgctgtggtggagggtggtggtctttctagacgctcccccgaagtgtgcagagcgctggtgcccaggggtggggtgcggcctgggctgcctccaatgcccattacttgtgaggaagcagctttgcatctgtgtgctgaccttgggcgggcgtcctgagctcctcgcaggtgctgttgtagcagctgtgcagtaggtcagggctggcccccagtgcagctttgcacatgaagtaggaggaggccctgctgcttgtcagagcccagcagagtcttggtgttctgtcgggttcctgtggccggaccagtggcagggtgctgtggaagctgtcgaatctcctccctctgtccagtacccccgctcgtcttctagctccctcctacgcccgggccacgtttcagttatgctcacttcctctgaccgccgaggctcctgcgtgtctccatacagctcacgctgcagggccacgctgtgggtgttggagacagctcctcctcgacccacggtgctctctcccaccaggcctaaggtgtgtgtgctgggctcccgggagcagctgtgcatccatcctgaggtgaagaaacaagagagtaaccatctacaggtaggctcctgggctcc

SEQ ID NO: 101783 - DNA, 1114 bp, Homo sapiens
cctcccctgccttccctgctatccctgggagtatctggggttgggtcatcgctggtgtgtgtgagtgtgtgtgtgtgtgtatgtgcacgtgtgcatatgtgtgcgcttctggcctctgcagctgagtcctggccctcggggggcctggcacctcctggggacaggcacaaagcagccatgatggagtcgggagctgggggaggccccattgccccacgtggctgccctgtgactctggggtgcttgttagaagaggtatctggttctgtctgtgtttaagcaactccctaaggaattcttgtggttccagtttggggggcctgtactgtagaggcaagggaggggcaggacatcccccagactctgacttctgaagccttttctgcccggggcctctccgccagtacaggcagtgtcctttgccagggctgccatgctgcagaggggagtgggccactgtttagcccaggaaaacctggctctcccttagctggaagttctgggcctgttgtggttggcagggaagctgagtgacggtgctaatcacaggggcacctgcaggggtttgtgggagatgcctctgtgggttggggcgataggctgaggggctgttcttccctgccctgaggagggctgagtgtagccgccactcctgtcctgtcttgggctgtctcggagaggatgcgtagaaccctcgggatcctgctggcctccgtctggtccaccctgaacctcaggccttctgggggcagaggaggattccctcaggatcactcgggtgggggcctctcttgggcacctgagaccctcagtgggtgctttgtggcgcgttcacggttggtgggggacgcccagccctgcccgccgtgtaggagccgttctgtcctgggcatccccctgtggtctgggacttagtggaccctgagggtgtgtgtttacccctgcctcacacctgcagaaaaaagcctggagcaggagctggccagccccatcctggacattgaggacttggtcaagagcggaagcaagcacaggtgagacccctcagtgaggccacgaccactgtccttccatggcccagctctcctgtgacctgtggaggcccggatatatt

SEQ ID NO: 101784 - DNA, 1051 bp, Homo sapiens
gcacacacacccacggaacagcacacacactcccacggaacagcacacacacccacggaacggcacacactcccacggaacggcacactctcccacggaacagcacactctcccacggaacagcacacacactcccacggaacagcacacacacccacggaacggcacacactcccacggaacagcagactctcccacggaacagcacacacactcccacagacagcacacacacacccacggaacagcacactctcccacgcggggccgctgggtttcctgcagtttctcctcctccaggcctttccctggaccctggtccagtccgtcatttgagcacaggtgcctgttagaacgagaccttcttgttaggacgatgagtgtcccagccaccacctcttttggactccgggaggcctggaacgttctgaacgctccgtggggctccagtcttctccgcagccagggcagcagggtttgctgtctgtcctgcaggcagatgaggagtcagggctggggcctgtgtgggggctctcctgagcgcacagccgccgaggtggagcgtgttctgcctgagcgccgacctggtcgggggaatcccagttgcttccaggtggagccactgtcctcagcgtaatgctcaaggctctggcctggctcctcggccaccctgcaccctcagggtcccctcctgtagcttctgctgccccatcactgtcactctccaaagctttggggactctgcccagagccaccgcctcccagaagcccctgacaacctcttgacgaccccctagtgaccccatccctcccctctgacggcggcccctgctctgaggcggcttcttttcctcggtgctgttctcgtgctggccaggcctcctctccccacctggaggctcctgagggcggaggcctctcacctccaatgctggcgtcccctggagggctgaatttgtttccgagggaaggaaacttccacagttgttgccttcagttccaaagctgcagcctgatttccccctccaggctcgagcctgttttcttctcg

SEQ ID NO: 101785 - DNA, 1051 bp, Homo sapiens; identical to SEQ ID NO: 101784

SEQ ID NO: 101786 - DNA, 1051 bp, Homo sapiens; identical to SEQ ID NO: 101784

SEQ ID NO: 101787 - DNA, 1050 bp, Homo sapiens
gaaggtgctgagctactggtgcttcagtcccggccacagcatgcacgagctggtccgccagggcgtccgctccctcatccttaccagcggcacgctggccccggtgtcctcctttgctctggagatgcagatgtacgggccacccctgccagggcctgagcaccggtgacacctctgacatcagcggggtggaagtggtgggggtccccatgagccgggtgctgggggtctcgggcctcgagggctaaaggggtgctggtgcacttccccactgtctgctccctctggccacgctcagccctttcccagtctgcctggagaacccacacatcatcgacaagcaccagatctgggtgggggtcgtccccagaggccccgatggagcccagttgagctccgcgtttgacagacggtgagggcctgtccctgggccctgctggggtgggaggtgggggagcactgaggcctgaggtcctgagcagtggcctctccggctctaggttttccgaggagtgcttatcctccctggggaaggctctgggtgagtgccctgaatgccccagctgtgcccatcctggatcctggacccctgctcccaagagctggtagggaaccctgcagacatcctgcccctgccttgaccccggcccctgcacttccaggcaacatcgcccgcgtggtgccctatgggctcctgatcttcttcccttcctatcctgtcatggagaagagcctggagttctggcgggtgcgtctcccctgtgttctgggcggggtgggtgagggcagggctggagcatgaagcaggcagtggtcacagctcctgcttgccctcatcggatcggcggcgtgaccagggctgccgtgtccctgcctcttcctcccacaggcccgcgacttggccaggaagatggaggcgctgaagccgctgtttgtggagcccaggagcaaaggcagcttctccgaggtcggcacttggccggggctctgggcctgctgccccctcgtgcctcccctgcctctcacagcttccccaaggctgaccactgg

SEQ ID NO: 101788 - DNA, 1081 bp, Homo sapiens
ttccgtgttggtctggggtgtgtagagagatgggcactgctcatccggaagcccctccttgtgcgctgccatcctgggagcctcagccgcatccgctgtggggcagggggcttgagggaggaggagagagacgggccatgcaggacccctggcttgaggcagagccaatctaccctttgcccattcactgctctcagttccctgccagcctctcactgtgtgacctcagacgggcccagccccacagctttcttcccgcagcccctccctatgtccatccagccagccagtttctcaggcagcagccccacctcggcagtcactgtcccagggaacgctcaatgttccaaggaaggctctgcagccccagggaccagatgatgaggctggccctgatggagcctcgggcctgtgtcctgcaggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggtgccctggcttgcagaggccacccaccctgagggcagtgctgccgccgcgtgtggggtgggggccatctgggtccaaggtggtctctgttctctagagaaaaaggggcagatggggacagacgccccttcctctacaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggtaaatggggccccaggtgggaccctcagactcctgcgtggaaggcagtgtgggccagagtcctgggctgcttggggtgggcatcctcgggccctgcttggccccgcctctctgttcccctatgggagtgatgggggcctccacctccaccaccagcaccagcagcaccacctccacctc

SEQ ID NO: 101789 - DNA, 1333 bp, Homo sapiens
gttcccctagttcacccaggggggaacctagcctgttgggacgaccccagatcccttctgggcttggtactcactgggatatcctcatgcctgcacccagcctacggctctgagctcctgagtggggctttggcctgcccgccactgttccagcccccatccagcaggctggtgtctcctctgatgcccccagcacccaggcgtgtacctgcctgggttttcccgccctggtctgaggtgggtgaggcctggcctccctagccagccctgcccccccaccccagggaactttccagatgctctcgaccagctttgtggctctacatctcttcatcaggaagaacggcgccggatcccaagctgaccgtgtccacggctgcagcccagcagctggacccccaagagcacctgaaccagggcaggccccacctgtcgcccaggccacccccaacaggtagctgactcctgaaccgtgtgcagcctacgacttggtgggtccctcagtggcttcacgaggctaactcttgagtgtggccggggctgcccctgtggggagccatctcatggtggggactgctcccggttctgcaccccgcagttgtcctgagcagctctccaggagttcctggaggaagggcgggcagggcggtgggactctcagtcctccaccccagcgccactctgagccatgctactcccacaccaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacagcaagtggccctggcgtggggaacagccggtggggtggggggcaggggacaaaatgggggctgtgccgggtctgattgaagctccccgcagggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggtagggcacctgcctggctgctcctggcagcgccccaaccgcacgcagccctgggagtgagcagcaaagccccaggcccccctcagactcaagtctctgtctccaggcccctcacggtccgagaagaccgggaagacccagagcaa

SEQ ID NO: 101790 - DNA, 1073 bp, Homo sapiens
ggtacggggcaggggtctcccctcggaggaaaaggggaggggagggctgctttttgaagactgggcaggtggttgtgagcagaagccaccatgactgcagactgcctccatcactgatgcagggctcccacctctccatcatccccggctgtgtgggcccctgggacctgcctccgccactgcccaggaggcctcagtcctcagcgccccacctcggggctcagggtgtcccccagggaggggatggggggtggactccttggagccgtgtggacgtctagtttgtctcaggcactaccagccatgttcagcctcgggctgagcacagggtcctcactgctgtggtctctgtgggagacactgggaccctggtggagctctggctgtttccctggggtgaagggcatacgcccttctgagagtcccgggcccacaggcaggacagggccagacgtgggggctgctcctcacggccttacctcccccagacgtgcctctcaatccctgacatcaagacggccttcagcgactgcaccagcaagatcggcaggcgagattgcctgacccaggcctgctcggccctcacagggtgagtgggggctgcacctgcgggggctttggggaccgagaccccccgcctcacacccgctgtcttcacagcaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggc

SEQ ID NO: 101791 - DNA, 1050 bp, Homo sapiens
cacctccaccagatctccccgcaaccccagaatgcatcccagaagggtcttgcagttgggggctgccctcttgccccttcctcatgtgagcccctcactgtggccatgacacaggcctggctctgctggcccttggcagggtggggactgagccccaactcctggtgcttcctcccagtattatgcggagtgtcacggcgtcatctacgtcattgactccaccgacgaggagaggctggctgagtccaagcaggcgtttggtgagtgcggcctggctgctctgggagggatggatggtgagtgggggcaggtccagcttgggcagctctgtgcctggggcaggctcagtgtctggtcagaagtgctcctgcctagtgggtgacggggggggggggggcagagggagtggctgtcacagtgtccacgcctgtgggcccctgggcagtcagaggcaggatgctgggtgtgaggcgctgcctctcctgccctccccagagaaggtggtgaccagcgaggcgctgtgcggtgtccccgtcttggtgctggccaacaagcaggatgtggaggtgagccccacccctgcctcccgcagcagcttcccgagtccccagcctcccccacagcaaggggagcaggtgtgcacccagacaccccaggcccagtgactgcccagggggtacagagccattctcaaggcctgccctgcccccagcagcttcccaagcctggttcctctccagacctgctgctgccagccctggaggttctcccacctcagggcaggcgcccagaggcctcttcctgctatgcagggcacctctccccaggagggcggccgtgtctcaggagtgtgtggccaagctgtggggacacccaggtgaaactcagagctcaaagaagtgatgctggggccctggtgggagtcagctctgacccttacctgttcctgctacccttggaggtggcatctgtgccagccccacccccagggcagcccctcaagacccctctgaggtgccactgcccccgggagcactggccacgctgagt

SEQ ID NO: 101792 - DNA, 1053 bp, Homo sapiens
gttggcggcctctgtgtgggacctgtctgtaggccagagaagttcctgggggtgggggggcctcgctacctgcagaaccctggagggcgcctggccttgggcctcctctccactgtgggaagttcctgggggtgggggggcctggccttgggcctcctcctttccactgtgggaagtgcaggtgcacaggcttctctcctctgtgggaagtgcaggtgcacaagcttgtctggcactgggatggggttgtctggtactccctgctcagacaccctaaggatttcggagagttgggctgtgcctcctggcttctcatgctctcgggtgtgtgtgtcttaacacactgaccaccagcttgtcctacctggtcagcatccagttctaggtctctgggcactcatgcctggacaggagagctggcacagcctggaggcaaagtggcaaatgtgagctgttgtctgctccacgtggacgcggagtttgctgtgtttttttctgattgagatagaggtgcactcatctggtccagggctcagcacttgtacctgaggctgcaggggctgtgccctgtcttgcccaggagtgttgccagcgagcccaggactgaccagcccaggctgcagaggtctgagctcagtgactctggccctgtcctggcagggaaggctcgcttcgtagatggcgctggtcagtcttatccgcatggccacactccctccctgtgcgaggtgctggcacagagccccacaggtgcactccctcaacgggccaggctgtggtctaggttcctccagcccccaaaccctatcttttttttgagacagggtctctcattctcacccaggctggagtgcagtggtgtgatcagagctcactacagcctcaacctcccaggctcaagccatcctcccacctcagcctcccgagtagctaggactgcaggcgcacattaccataagcttttgtacagacggagtctcactgtgttgcccaggttggccgtgaagtgggctcaggtgatcctcctgcttctgcctcccaaagtgttgggat

SEQ ID NO: 101793 - DNA, 1072 bp, Homo sapiens
cgcctgcaggggctcctggggagcgcgccggtggctcgctgctcccgggtggggcgcggggctggcgctcgagggtgccgtggcccaggcggggctgcagcgagtgtgttccccgttccgcgcgcgtgaagcgtgggagcgaagcctcgggggagggcgggagcgcggctgagctcactgtgaacacccggctgggtagtcccgcgagcaggggaggggccggaaccgatgtgtatgcggagaggtcgcagtcattgctgtgagcaggacacagtggcggctgacctgggagaagttacagagggacggggtgggagagggacgaggagtcgggaatggcccccaggctctcgtcctgagcggtcggctggacgtggggcgccactgaccaccgtggagaagcccgggggaggggaggtgctttctggctgcacactgacctatgttggggtgcccagggcaggatgtacacgctgctgtcgggcttgtacaagtacatgtttcagaaggacgagtactgcatcctgatcctgggcctggacaatgctgggaagacggtgagtgcccacgcccttgcgcgcacctttcccacggcctggcggcgcccccttcggttttgtgctgtcagctgcacgttcactacccagacggaagccaaatttcacctgagacggcaggatagtcaccaccagcctcctgaagagcagagtgttgctctgtttctgtttctgtcttttaaagaacagacctgagtaaggatatttggaagccagtatagcccctccttgatgtgtttcgcctctgcctctctcctcagaccttcctggagcagtcgaaaacccgatttaacaagaactacaaggggatgagtctatccaaaatcaccaccaccgtgggcctaaacagtaagggtctcaatagcaggctgtgggtttggggccttgaggatgccgtgatattcacagtccagctggcccgtggccacagccctgtcgggcccctctcaagtctcatttgagtggcaccagcatggtttgccccatcccctgggagagctgggactgggtgtgtc

SEQ ID NO: 101794 - DNA, 1186 bp, Homo sapiens
actcgctgctgctgagggaggccgtggtggagggggacggcatcctgcccccactgcgcacagaggccacagagtccgactcagacagcgacggtacgggtgactccagctatgccagaggtatggcagcagctgcggagcccaggagccaggaaggtggggtcaccctgagaggctcctggccggtgagggcaccaaccatctaaccaaactattggagagtgtgtgactgcggcgagggtgccacctgtgcctgaggaggccgtgtgggtaggggtagatccgtggcggcctttatcttcaaggagtgtgggtgcaacagctacagtctcattgatgggaggccatggtcgtggctgtggccatgggagaggaggggcctggagttgccgaggaagtcacagaaaatgaccaactgatggggcctggagtgcaggaggggcagctcctctgcatggcttctcagacttgggacctgggtgcctgggatcctggcagacagaggttgtgtccagacagccagcatggaagtttcgggaatgggaactggtgggcagtgtccagctctccagaggggtgtgtgtatgcgtgtgcgtgtgtgtgtatatatgtgggaggtcacctgacccaagcatggcgggctgagtccaggaggggtctgcatgttggaggtgtacccagggatcagtgatggtggtttctgaagccccatgtccctggtgaaggaggactgaaccaaggactctgtgagggcaggtgaggcgctcacagcctcgcgaaggtggagaagggcaggggcaggagagggctgcggaggaggggccacggtgcagcaggccgtggggactgccatgcactctgcctggtgtcacatgcccacagcagcctcggtgacgagagcacggagcccaagaggtggggtgtcgtggctctgcccaggatctgagctcattggtcaaagcccgggtcaccatgcacaatcctctggcctggctgggccactgccctctgtccatctcttgcagtggtggggtcggacgccgtggactctgcacagtcctctgccctctgtccgtctcttgcagtggtggggtcagatgctgtggactctgggacctgcagctctgcctttgctggctgggaggtgcacacgcgaggtataggctccagactcctcaccaagatg

SEQ ID NO: 101795 - DNA, 1008 bp, Homo sapiens
caggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggctgccagcccgtgaggtccgtgaggtcctggccgctctgacagccgcggcctccccgggctccagagaaggcccgcgtctaaataaagcgccagcgcaggatgaaagcggccagcctcgcagcctgctcttcttgaaagctgggcgggttggggcggggggcttctctggaaggcttggagctgtcccctctggccttgggggactggctgcccccggggcgcccgggcctagccgaggcggtgctcctgccggccagactctcggtcagtgcgggcacggggtcccagccactcctagggggcagcgcagccggcagggtggccgcccccgggtgggacttggaccctggactccacgggagggctccgccacccagcctggtgttacataaggggtggtggaggtgggcagtcgagcgttaaagagtaacctgctgccgggaagcccgccaagcaatcgcggccccttccccggctctggcagctctgcgagcgcgcccgtggggaacgggccctccccggcggggcgcgcgggcgcgcgaggtgggcggaggcctcggagctgtgccgggccgggcctccctccctaggccagcgcgggagcgacccggagggggcgggcccggggcggggcctcgaagcgctggccggcggga

SEQ ID NO: 101796 - DNA, 1436 bp, Homo sapiens
ccggccggccggccatggagcgccccccgccccgcgccgccggccgggaccccagtgcgctgcgggccgaggcgccgtggctgcgcgcggagggtccggggccgcgcgccgcgcccgtgacggtgcccacgccgccgcaggtaccgggcgccggtgggcgggggcgccgaccaagtttctctcgctgcaaagatggcgtcagtgctgcccaaacttcgggcccccgggggcggggcagcggggagggcggccgcgtcggtccgcgcgtgtccgtgggtcccgccggggctgcgccgggcggccggggagcccttcccgccgcgccgggctgggggcggggccgggggcggggccgcgccgtccacaccggccgcagccggttttcgaggcgggcgccgagcggatccgcggcggaggttgagggacccccctcccccggccaccgcctccgctgagtctgccccctccccatccgcagggctcttccgtgggcggcggcttcgcgggcttggagttcgcgcggccgcaggagtcggagccgcgggcctcggacctgggggccccccggacgtggacgggggcggcggcggggccccggactccgtcggcgcacatccccgtcccagcgcagaggtgagcgggaggcccggtgcctcgggactcggtgtgcgcaggggcggtgggtggggtgcggagacaccggccccgacggaggccaggtcagggccccaggtttgtaattaccagccacccccaagctcttcagccctggaggagctgagcagaaatgatcgatgactgggagtccctacacctccctccaccgcagttcctcggggctagagctcagaacccggagcgggtggctgtgcgtctctgtgcagaagaggctgcgcggtcggcatggggcgactgtccaggaatccctggggctcctgaccgccacctcccaacccctgccaggccggacacctcggtctggctgccagggcaggggcgggccctggcctggctcgctggggcctggggagctgcccgtgcttccagcccagtctccccctggctgctgccggctgctggccactcccacctcccaggcctggcgtgaggcccacagctgctgttgcacaaccctggttaatgtgtgatggggggaggcctgggcctggcccgcccctctgccagggcttcagacccctgcccagccccagtatctgaaggaaccacagtggagccaagcccgcgatgtggagaactcaggcttcaggagaccctggccctgctcctggcggctccgggtggctttcagctctctctgcaacctgagctgggggaggagccaggcctcatgcccagggctgggagtggggagcctggtgtgcacgcgtgcccaggcctgcacgtggaccgaccaggggaggggcccagagctctgg

SEQ ID NO: 101797 - DNA, 1120 bp, Homo sapiens
aggaacataaaggaacataaagatttgaggaaccaggggaggctccagcagatggttccagctgcagtggagatggggaccgtccggaaaggggatgggctgttgggcagatggtgggacgcgtctctggcctgggagcgggctcccccgacacgccaccttccctgccagatggtgcttctgggtattccagaatctggaatgggggatgcctatccccctcctgagcccacctgctgctctgggtccctggagcccaccaagtccacaaccacctgctctgaatagaaagctgacattgaacctaacacgtccgacgaggacgggcaagggcaccgcggggcgctctttctgaaaagcagcacattcccgtaattccacgccgacacgtggagcgccgcgcacatgccaggcacacaccgccaaggacgccgtggcaggctttgtctttcgatctccctagaaagttgctgggtcggagccacgtggctccacttcccacggatggggacatgttttcccgcccctgaaagccccccgtccccacacattggcaatcccgtaggatctcggtcatctgaaccccgtcgggcagaagctggaggtccacccgccccagctgcccaccggctgggcatggagatgccttcacctggcagcagccggcagaggactcgagaaatgaccacagaaaggcacacaccggctcccagtcacagctctccgcagatatccccctccgacgcggctgttcggtcacccagttcccctcctgctcccacacacttgagagctctctcgcctgggcagctgcacccagctggagcccgggacccggacgccaaagctctggccgcagcactgaggtcaaagcaaacgccggctccagcgcacagaccagaggcacccgcagttctgtcccaaaccacttccagcaggggaggtgccttcgctgctgtcacttgcttcacagagctccttagctggcctcagggtaaagctgtcagcgcccaaggagctccaggcgaggccaagccgtcctggcactggctgcccccagggctgggcaagtccatccagggctgggcaagtccatccaggcctgggctggaagaagact

SEQ ID NO: 101798 - DNA, 1118 bp, Homo sapiens
cggggacggcttctgaccagctcgttactggagaaggtggccgtggagatggcggagcggctgggcccgggcgtcaggaggcgttttgcagagaacagttgcagcttgtctttgttttggttgtggtttaaagactgtttccctgtggtatttaaaggatgaatcgagaactttaacttgattctggatcgagactggaattgtgaacagttgccgactaaagggcatttggtggacatggtgctgcactttcaggtggtccaggccagcgtgccttggcgttctcatcaggagagcatttctgcagtccagaggtgttcacgctccgacttcctccaccaaaaccctctgttggaatcacttggctcctaggaaagagacacaccgcagagaagtcatgggtggagacctcgggcatttggggttggccagctgatcaaagcgttcaaacacctgcctccagcgagacccttggggcatcaccgggctcacaccgcatgccgggaagatcgtcagtgcttctggaactctctagaacccagcagctggtgcgcgttcctgtgggtgagactcctcctttcctgtgttcccagggcctgggtcccttgtgagggtcgctgatggcagaacagaagcccctccaccctccaccctcagagccacaggatgagctctggggaaccgccagacccagcccagggagccggcacagcctcccccagctcaggtaagacaccagggtggccagctttgtctggggcaactgggccaaacacttggggcatggtgtccctgacacccatgtgtgcgtggccacggcccagatgagcccgggcacctccgaggaggcactttggtggcacctgctctccatgtgccctcctctcccaccctcaactcagccaggtacagagaaaacccattttaggtcagccgagttattcgcttttgcaatagtaattgttccactcccacagcaacaggttgtatgaagttgaattggtttttatattttgagcaatttttttcccttaatgtaaagacattcaattcatgttgcagtgggttggaaacatcagttcctagagctcagtggtggtggccggtcccttccaggc

SEQ ID NO: 101799 - DNA, 1018 bp, Homo sapiens
ccagctggtaatttctgctgcgtcaacgcctggccccgaggcagcccgggggcgtcttggcgccccccgcccgcgccccccgccggcacagcccagccgcacccggagccgcccgcgccgagtttgccaagagtcggaactgcgggaggtgggcgcgggcgggtcccggcgccctgaggccggggggtcattgtctccccggacgccgggcgccggcctggtctccatcttaatcgccggccgaaccggggcgcaggggcctcggggcggggcggctcggggcgcggagggctcggggcgcgcggggcggacggggcgcgcggaggaagcggggtccgctgcgagccgcgtctttgtttctctgtaaatagacatgtcagtttcgcgggggagcgcgagccggtgtctgacaactcaatccctaaggcaaacggggaattctctgcgccagagggagggctcctgctagttggggttcccctggccccgctgacagattcactgtttgtaggtttaacgaagcacacacaatagggctggaccgaggagccagggtacagaccagatggggcgaagaacggatattttctgacagcgaagaaatataaacaaaagaaagtttgagattcgcagcgaatttcctctctcgctttccgtgctgcaatctcaacgatgcatttggagtggattacggtggcaagattgtgatcagcattgtttaaagaaatgctaattagaaacgtgtttagcgcgcggcctgggcgcagacacctgtgcgccgagaactcacgggcattttaattgtatcgattgtagaatctttcatattggctctattatcagagctaacttcccgtttgggtaacagactggatacatctctgctgctggcactcacgctgcctctgcaaggcactatttcactctacaagagtggaaaatagtttgttcatcaaaaggaaatgtatagaaggggtttttcacatgaataatgaagcaagcgacagtatttatcaga

SEQ ID NO: 101800 - DNA, 1050 bp, Homo sapiens
cttgaacccgggagacggaggttgcagtgagctgagatcgcaccattgcactccagcttgggaggcagagtgagactccatcaaaaaaaaaaggtggaaggtctgttagattgagctgctttctctgtagcaagggtttcctgcctctgacgatagtattctcactgggaagccagaattcgggtttgcctgccttgggccggcatttgtcgtgccctgaagcagcacaagtggcattggcttttcagctcaggtggtctgaggtgtggctgccctcgtctactgcccatgctgtcctcacagacctttcagagaagaggtgttagtctccagggtctcacccactcccacctgtgcttttgtcctgctagagacctctaccgtatttacttggaactaacttatttgacactttgtggcctcattttgtctctggcagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtgctgtggcttggctgtctgtcctggggtgaattggagttaaggccctcttggattagtgagaggccagggtactggccacgctcgggaggaattgccctgggtggtcacctaccctgctctgtgttccgactgataacggggttctctttgtatgtgcccagctccatgcactggactcagagccacctggcagtggagacagggcatgactcccttcccatacctctgtgcctggcccttcctaagtgctccctgaggagtgttcacacatgaaccgcctctgagcagccatctgctgggagtgtctctgttggaattaacacttgataatcatttttaagaccccatgaatctttcttgtcctggatcttaagttttcttttaaacatatttattttggctggatgcagtggctcatgcctgtaattccagcgccttaggaggacagggtggtaaggtggg

SEQ ID NO: 101801 - DNA, 1696 bp, Homo sapiens
gcctgccttggcctcacaaagtgctgggattacaggcgtgagccactgtgcccggccagggtcttcaccatttttttgttgttgttgttttgttttgtttgagatggagtctcgctctgtcacccaggctggagtgcagtggcacaatcttggctcacccgcaagctctgcctcctggattcacaccattctcctgcctcagcctcccgagtagctgggactacaggtgcccgccaccgtgcctggctaattttttgtattttttagtagagacagggtttcgctgtgttaactgtgttagccaggatggtctcgatctcctgacctcgtgatccgcccgccttggcctcccagagtgctgggattacaggcatgcgccactgcgcccggccggtcttcacctttttaataccatgcccagtcctagtaaagagctcggacaaacctggcatggtcatcctgggccattcctcatgaccacaaatggacatggtgattggtagctctcccagaaccatttagttgtggggcatgggatagttccctggagtcaagttcctagtaccagataaaaacaaatgtctgctggctgggcgcggtggctcacgcctgtaatcccagcactttgggaggctgaggtgggaggatcacctgaggttgggagtttgagacgagcctgaccaacatggtgaaaccccatctctactaaaaatacaaaattagccgggcagggtggcacacgcctgtaatcccagctacttgggaggctgaggcaggagaatcacttgaatctgaaaggcagaggttgcggtgagccgaggtcgtgccattgcactccagcctgggcgacgagcgaaactccatctcaaaaaaaaaaaaaaaccaaaacccaaaaatcagatgtctgctgtagatgctgttattcctaggacgagttaatgctttggtaagcggaaagttcttgtgtaactcatggcactgtgcatgaggatgttagtcacttcctgcagtagtgatggctcatcatgtcaactgcatgctttgcaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcgtaggtacctgccccaggcgcacccctgggggctgaagagaacgggcaccacacgtgccccggcatgtgggggggcgtcgtcatgcccagggacgagttgcagccgtggagttgagtggcctgtttggaaggatccagagagaggctctgagcccttggcccagcgactgtgccttgtttgttcaaaaagcttggtgtctacatgtgttttatttatttttaagtttttgtgtactttattattattttttttgagacagagtctcactctgtcgcccaggctggagtgtagtggcgtgatcttagctcgctgcaacctctgccccccgggttcaagcgattctcctgcctcagcctcccaagtagctgggattacaggcgcctcccaccgcgcccggctgatttttttttttgtgtgtgtgtgtgtgtgtgtgtgtgtgtttttagtagagatggggtttcaccatgttggccaggctggtcttgaactcctgaccttg

SEQ ID NO: 101802 - DNA, 1253 bp, Homo sapiens
catttgggaagaggaaagggaaacttgcacgcatgggccggtcagggcactgagaggcctttctgctctggcactgcctgccaggcgtgcacctcagggggcccgtccgctctagcaggcaaatggggcgtgttctctgtagtcagaggggctgtgagaagacaggaaagcgagcttagtgggtatcaggcaagggggtgaaattgggttgtgagatgagaaagcagcgtcattgcagggctggggggccgagactcggcagggtcgccgagagctcagtgagcgagcaatgcacaggcggctcctcgccgcaggggcctctgggggccgaggggctctgggcctgcaccccctctgtagacacctggcgagtgtccaccccttggcccagctcctttcctcagttttcctcgggcgtgctcccagtgctttgtttgcttggctgtgggtggtgacccgcccatgctgtctggttgatttaactggtgtgtcttccagctacaagaagactcaggaaactctttcacaggcaggacagaagacttcagctgccctgtccacagtgggctctgccatcagcaggaagcttggagacatgaggtgagacgcaaccctgactctgctgccctgagacctggccaggagtgaggtgaggtgttggaggtgctacaggaagcctgcctggagatcagggctcagatgcactggctcagggatgtggccatccatcatggccccgaccagtctgtgtgcagacccttgcctgggaggttcgtccatccccgttggctgcttttctgccgttgctgtgttcttcagggagggttggctgccagtgctgttgggtaacttgtggtgctcggggttggtgagggaggagtctgcaccttgaagcttcactgagtggcagcgactccagcccaggggtcagagtcaggtcagtgtgggacggcagtcctccaccatctctaggacaggggctcggcgtggtacttcctcaggctgtttcccaggtctcagaaagtgcagtcagacgccaggaggccctgaatgagccttctctcccagaggctggtgaaagcctcctggccatcagaggtccctcagcaagcagggctggggccaaggagtgagcagggggccggcgctttgtggctggcatgtttgctcttccttccctgttctaggctccctgactacagcatggtgatgaggggattgagccagaagcctgggtatgatgcttggctggg

SEQ ID NO: 101803 - DNA, 1043 bp, Homo sapiens
ctgtggagctggccaagcccagctgtcatgctgtggcacatttcacacctttgcgctgctggatggggctggttgtgctccaggtgctgtggcttctccaaacaggtgtgccttggggcataaggcgtggacagggcgtggacccaggggcctcttgggcacagccgtgaggctgagcagttgctagtcatgatcttgcgagagcctcctgttgagtcaggacttgaggagactggagacagtgctgctgtccccggtggtgtgcggactggaggagccgtcctggagggtcttcccctgctgggcctgactgagcacgagcagggggcctcccctggggctccccgaggagggctgtgagtgggtgctggcctcccttgcttacacttcgtttcctcttctctcctgctgccaccttccagggctcatccattttcacactcctttaggtaaggctgagcctggacacacctgtggaagacttttctctgaattggggcagggtggactccggcagggcccttgggcggctgtgctagtagagggcagtgaaagtgggatcaccccttccaggacagcagtgccagccaggtggttgctgcatctcagggaacaaagcagcagcgtgggatcgacgcagaggccccccggaaccccccggcccttctgtgtcccctcctcgtgcttcccttcaggctcacagaccgcctgctgccgggtctgtgaataactggcctggcgtccaggcctgagtttactcctgaaaaggagcttttttttttttttagacggagtcttgctctgtcgcccaggttggagtgccgtggcgcgatctcggctcactgcaagctccgcctcccgggttcacgccattctcctgcctcagcctctccgagtagctgggactacaggcgcccgccgccacgcccggctaattttttgtatttttagtagagacggggtttcaccgtggtctcgatctcccgacctcgtgatccgcccgcctcggcctcccaaagtgctgggattacaagcgtgagcca

SEQ ID NO: 101804 - DNA, 1045 bp, Homo sapiens
ccagctccctggttcaagcggttctcctgcctcaggctcctgagtagctgggattacaggcatgagccaccacgcctggctaatttttgtatttttagtagagacggggtttcaccatgttggccagcatggtctcgatctcctgacctcgtgatccacccgccttggcctcccaaagtgctgggattacaggcgtgagccactgcgccgggccctcaaaggagccttttcacgtgggagggctgtgccgactctcaccaccttcctgttcaacatctgtcctgtttccttgttttccttcagatggagttttgtcttgtttactacccgagagcccataggtgtgcctcccaaagggccctcctgcagaccagagcaagctcctctaggccaagccggggcgccgccagcacgtgcccttctgctggaaccgggaggtctagagccaggcccagaacaatctgtgatttcttgtgtttttacttgacttggtggtttctcttttgccaaaaggtccttacttgacttctgaaggctgtttgtaccaaatacttttcaaaagcccaagcctggtctcctcacagcttcctatggcagtgctctcccccctcccagtgctatgcgctgggcaacttggggtgccccccatgaggccaagggaggaccctggggtcgagtttccttcgggggcattgtgtggaggggcaggcagctcgctccaactgctgggagtgggggaatcccagctctgcccatccctgccaagttggggttgtgtgtggatcttggtgttaactcttgcttccttctctgcttctgccatgcttccaagcagcagctactccatccgccactcaataagtatgccagccatgaggtaatgtatgcctgctcgctgcggctccagagccgggtgtctctggtgggggttggggcagctcccgccggttacaccttgcccttcccatattcctggattaattgaggactccattcccttggcaacctctgatgactaagggccggtaaaaaccccctctaggct

SEQ ID NO: 101805 - DNA, 1022 bp, Homo sapiens
cactgactcaggacacagaacgcctccacactgcccttcctggtccccactgcccttcctggtccccactgcccttcctggtaccttcttggccatgctgaccttcctcccgccctacccccggcaacccctagtccactctccctttgtataattgtgtcatttcaagaatgtcacgtaaatggaacgatacagtgtgcagctttttggcattcactgtcttcatttggcatcgttctctggagacctgttggggctggtgcccgtccgtgatttgctccctgtccctgctgagcagtgttcgtgttacataagcttttgtagagcattgagcatgggcctgggatctgccttgtgttgtgtgctctgtctcaggtttttctgtcttcatcttttctctcctgtagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactga

SEQ ID NO: 101806 - DNA, 1017 bp, Homo sapiens
aacactccagttatctccaagtgggcagttagaatgagtgcttctaggccgggcacggtggctcacaccagtaatcccagcactttgggaggccgaggcgggcagatcttgagatcgagagatcgagaccatcctggccaacatggtgaaaccctgtctctactaaaaatacaaaaatagctgggtgtggtggcgggcacctgtaattccagctactagggaggctgaggcaggagaattgcttgaacccgggaggcagaggttgcagtgagctgagatagcaccactgcactccagcctgggcgacagagcgagactccctctcacaacaaacaaacaaacaaactgcagtgcttctaaggtgagactcatcgtgatgttctgattagaacgttctcgtgccacaaagtcctgagatgtgtccaagaagcaccgtcttctgtcagacacacctcctgccccgccataggccttcccactgtggcagcagaatctgtgctaggccttccttcgtgaaagaggacaagatcagggctcacgtgactggggccgctgtgactctgagcctctgcgttctgtcagatgagggtagtggtgcttcccctgcgtcctgctgggagaaaaaaggaggcagtaaatgaaaggtgtctcatcacctgcttcctaaatagaagggacaaagaggctgaaaaacagtaatagtcttgttttatgaaaatgccacccctaatctaggagctgggactgccatgccaggacccctcagataatgacatccctgaagaggattagcagctagtctgttatcagtcacaggcagttcaacccagaagatttaaggattagattacccaacaaccttgagtgtagattttgtctctcatcaccctttgcattaactttgggtgcatgtgtgttaatgaggaagtgtgttctgctttattcttggtacatcacagacatttaatagatacaggtcattagaaataaaaattgttttaacttgtatgagttttg

SEQ ID NO: 101807 - DNA, 1018 bp, Homo sapiens
cttatacctctttgcattttttatgcagaggttgctgtaaggattacaatatgcatgtttattttaattaattaatttattttgtttatttatatatttgtttttaaggaacagggtccctgtctcctgggctccagtgcagtggagtgatcatagctcactgcagcctcaaactcctgggctcaagcggtcctcccgcctcagcctcccaaaatgctgggactacaggtgtgagcccctgtgccggcccacagtacacagctgcagttcttcaggatctcttggggtggccgtattctgccgtctcacacttctccatgccatggcgtctgtctgtgcacgtggcaaactccacaaggcagtgttggattcttttgctttgaacggtcttatggaataaagtccatcagctctgcccttggtactttcatctatactttgtgatactttctttttattttttcttctagaatagcctaacatggcagaccagagacagcgctcactgtctacctctggggagtcattgtaccacgtccttgggttggacaagaacgcaacctcagatgacattaaaaagtcctatcggtaagtggacaagtgtggcccccacatccccccaggaagacacacatgccccgtgtggtttagtctgcattttaccaagaaccattgcacatactttatcctggccgactcagcgttgaactggtcacagctcggtaacacctttgtatgtgtaatgtgctccttatagcttaaagttatggtattcatgttctcttgccaacaaaaaatagcacttagtagaaactgacacactgtccacagttccatagggagtcagggtctgaacctgtttgaggcctcacaggagccgcagagcgctggcatggtcctgtggtctccttgttttagcacagtgatgacagagacccctcactctgttgtggccttctgattgagcttgaagaactgcactcttgggtacagtttcattgagtaacctgtaagagac

SEQ ID NO: 101808 - DNA, 1264 bp, Homo sapiens
gtgtcaacctgtcttgtcaaacaggagggcactgacactgtgccgcgagtgtttgtggtggcagctgggactgttgaggtgtgaacgtggaccctgaggtaaagcaggcgcatagagctgtccccgccgtgacctgcggtagccgtagatcccagggactgcgaggcggggcagggcggcaggcagttggggcggggctgagggccgagggctggcggtgacccaaggcgacggaggaaagccgtgtggggtggaggtcagcgagtagcctctcccggtggagagtttgtccaggtgcccgaaagtcgctccacaggaccagcgttgggtgcgcgccaggctgtggccctcgtgcagtgccctgtgtgcttgcttttcagaggccacagacacgccgatcgtcatacagccggcatccgccaccgagaccacccagctcacagccgactcccaccccagctaccacactgacgggttcaactaaatccaggaggagctgtggtcagaggaggagccggcgcctggccacgccaaccttagaatcatgaactgtagtcacagagatgggaaggcagcctcctgcctgccctggccttgctggggcccctcctgcctccacgcccacccagcgtcgacccttgacccacgaagtgcgtagcatgcagtatttaaagcagtgtagctacggtcttctgtttttttcccttttttaatagcatgtatggggttctgttccatgtctgtgttgtggacattccgcggcatgaccgcgtgaactgcacggtggagctgcctcagggctgtcggtcaggttggtccagtgaggggtgactgcagccggtcaggtgggcgaggagaaggggggctgcccctttcctacctgtgcttgaggggccggaggcaggtgctgcctggcagagctgtgttaccgtcttggcctcggggtctggtccacactctgtgctcccagccttgaggctgcagtaggactctgatctcacctgccagaagagaggcggggccgcgtcctcctggcgtcaccggcgtcactgtcattccttggtgtctgtgctgggcatggttggcttgggggtctgtggtttcctgggccttgtggcagggtttctcccgtgggagaatttggtgtggaaagcataggaggccccttccgaggttgacaccgtgtcctccgcggtgtttctcgcctggtcgtctcgtcgtgtggacgctgccgttctggttctcggaggtgtgtccttcgccg

SEQ ID NO: 101809 - DNA, 2986 bp, Homo sapiens
aggatacatctggacgtgcttaggaacagggtgctggttgagggcccccagctgacccctactgcagatccgcatgtggaccatgagccggctgccagcactaggtcctgggcagctttgtttgtcccacttttctttgtttcttctcactaaaatgatcacgaagacctttgacaagaggagagatatgcactgtgatattaaattagaaataatttatcaaaatcagacctctcctaaaagaataagaaattcattgtttggcccatcctgaaaggtgaggtggcgagacagtggggtgcctccgtgccgcttcgtgcagcagcaagttcagcctgagatgctggctgtactcagcctttgcaatttttgtagatgtagcttaggacgtgagttatttttccgcagactggccaagagccaggttctaagcttggacctaaggtagaaagctgcccatcgggggccctagctcagccccaccaggccctctgttgggcctgcacacagctctgtggctagaacactccaaggcccttcggtacccatcagagtgggccccttgccaggtggcttttcagttacagagtccagtggaccattttgtagaaccatgcagctccctgcggaaggtggggtagggtgggaaagaggagcaggtctggaggtttgtggaacccagtcccctgcagaatctgtaaaacctaataaatcatggttgtggccattctcacggtggtgattgtgattagacgacccccgggaagcccagacactcggggcctggagttcctccccctgcctgacctagaagcagaaccgttttcagcgctctgccctgttggctttaaggctttgtcttaatttaaggaaaaagatcctcccgggttttatttctctctttcttgagtggactgtttccctataattaaaagaggtggtgagtcctggggcagcttccgcgcctccctgtccacgtgctaacagatcaggacgcccccagcacccctgcctgcttttgctggtggcagtgacgggaccccgactcctcactctcgggccgcagacaatgctgtgagcaagtgtggccatgggcacagaatgtccctttggacgccgctgctgggggctgccaggggccctctggggtcgtgctttgaggcccgtccggttcacgagggggtccgggcagcactgactgcttccgacctgcaggaggcgtaggagcggccctgcgggccctttcacggcagctgctgctgtatagatttgtctccactcagtgacgtgggatttttttgtcttccttttggctttatttttaaactgctttagatattactgctcagtgtttgtgaactttcctagttctctatgttgttagtgcagccagcacccagtggggacctactagaaaaaggaactggcatgcacacgtgcccagcaggaaaagcttcgtcttcacgtcggctgctgccatccagaagaggccctggagcctcacgccgtcgaggctgctctcaggcgttctgttccgggcgaggcttgtgctgcaaggaagggcaccagcatgcaggctgccactggagggtccgggtgctgcgggcagagttcagcgcttgtccaccctcccttagctctgactcagtgcatcctactgtggggacatctcgtgaggggacacgaaatgactgatctcaccctttcccagtattcagagctgtgaacccctgtggcgcaggactggcctgtgtctgttattttggttgtaaatcattctcctgtggaattggcaaaagctacatttttactgtccttaccagcaacagtttgcgtcgtcacatgctgtgagtgtgggctgtggtgtgtccgtgtgtgtacatatgtgtatatgtatatatcacgcagcaggagtgtcattcatgctgctgtcccctggtgaagtgacaagtacaattaaaggtggctctgaaatggcctctggtttcttgggagtcgggcagggacctgcaggaggctttcccagcaggtgcacagaaggaagcgctgagcccactgtgtgcagagggtgtgtgcccagggcactgccacggcccccaccagcattggcctctgctctgcagggtggggtgcccatcctgggggctgtgtgtcatgctcacctgacccaggtgtgtgtcccggtgtgaaatcgaggaggggactggaagcccttccctgccttgaaacatgaaagctgattttctgagcagcagatacggtcagtggcaaagctgcatctgaagggcggcctgggaaggggccctgtgctggccccgggtccgccccagaggagtccacacagcaccacctccagaaggggctgggcccggggtcctgcaggcggcaccttttggtagagtttgtttccctggaaaatggggaaaatgtttcaagccaggtgaggggggaagttaacactgaaatatgtattgtttttaaaaatcaaatgcacacgcatggaagctgcttgtccatgcactggttttgtcactggcgtcctggaatccgaccgtgttggggtgcaggcgctgtcagactccggctgatcctggctcgagcacacacatctaagggccaggctggttccgcatggtgatctccgtcttgtatgtctgaatgttggcctaaaataaagattactgttgtaaaataaatgttttcactgcggaccccacgtatgtcttactcgctagtcccgcagatccctggttttggagagcagcagctgatctcagccctccacaccccttgcggctggaaccttgcttccctcctgcctggtccagatgtggataaatgccccctcctcttgattgtgttttcacctccgttttctaaataccaagactggagcaaagaggccaagcgtggtggctcatgcctataatcccagcactttgggaggccagtgtgggaggattgctttgagcccaggagttcaaga

SEQ ID NO: 101810 - DNA, 2712 bp, Homo sapiens
actgagccacattcgactgtgctgtggcccagagtaggatggctgaaggtgagggaagggcaaggggtgccctgaagtgactgaggcagcctccagcaccacgggcctcagacagccccacctgcaaggaggaagccttaggcagaaggtgctctgggcagcgcttaccccagcgcggcatcagcacctgtgggtggcgtgggaatgggagttctctggaccggcccagctcaggaagttagaacctgggaggaacaccagtgaataggaccagggcaggctacccctccccaccgtgagcggcccctccctgccgtgggctgctgtggccgagagcagccccgtggaggggcatgttggggaccacgtggcctgcagcgaggcgacgtgattccagggtggggcctggtggttccattcacagctgcgtgcctgggctcctccgtccctcgcctggccagcacagtgctggcttccccaggcctgtagccttgcctcttggccggctagggcagccagggtgcatgcccatgccaggcaagaccagtctgcgtccactctgctgttcagacagcccagccagtggcatggcccccaggagcccggactctgcgcccctgctcaggacagcctccgcctccccgaccctgggctgtctcctgcccacttcccaagtgagggatgtagccgcctcctgggagcagaatgaggagaggaagcacctgtggacacagacagatgggccggtcctgcctctgaggcagctcccaggagtggcctactattgaggagtatgacctccatgtggagtcttcccttttccctgagcttctggcagcccctgcctcagtactagaagctccaagagaaacccatggtaggaggaagctgacacccatggctgacctgtctgcccctgggagagagcttagggctgccaggacttctctgtgcacatccttgactgactctgcggagggtggggccgaaaccctgtttctgtgggcggggaggtggctgtgtcccctgtgccctgctgagccctgggcggggaggtggctgtgtcccctgtgccctgctgagccctgggcggggaggtggctgtgtcccctgtgccctgctgagccctgggcggggaggtggctgtgtcccctgtgctctgctgagccctgggtggtgagccctgggtggctgcaggtccctgcaggatcccccgtgagtgggggtagggcaaggcagttattttcagatggtgccagagggtggagtttcagatttgtttatgcctgtcggaagcactctggggctagggatggggtgcccagctcagcactgacgttcaggacacctggccaagaggcgcctcagatatccttgtcctgctgcggggggttcactctgtagccccaggcaggccggggtactgtagctttttccaggggatccaggaggggtgcaggcacacggcgcacagtggtcctccgcaggcctgcggtcctaggctggccgaatgtgccagcccacacacaggagggggcagttcacaccgagggctggcccgaggattgtcagggccacaccaggcaaagccagcgctattaatatcaggcatacacaagcccccagctgggtgatcctcttatgcctgtggccttggcctctgaggacggcagtgagtgctgttccctcagtacggtggaggcttcaagggcctcctagctgctgtgcctctgctgacatttggcaggcagcttctgccagccaagggtctcaccccagccacccggctctgcacccactgtgctgcccacaggagtggtcctgcccatggaagggccagttcaggtggccggagctcctgagctgccctaggggactgctgtgggtctgaggtggtgatgtcccccacggctgcctgcgcctgagcccccacgcatccacccctggggccactctgctgttcaggagcacccacccgtgtcctcgaccatgagcagccccccagcttaccctggcatcaggatctcagggtgccgggcccttggagcagaaggcaggtgagtctcgactggaggtctctgccgtgaggggcacccacttgtgctgtggtcctggccactcagacctgtgtttggtgcatgtctgtggatatcaggaatcaaacaggctggcaggtgctctcgggcaccgggcagagcccagggtcgaaggtgccattttgcttgaggctgttggtctgggcgcgtctctcttgtgttggttacggcttggaaccctccgggttggaattaaccttttgttgttgtggccagaagcactcctgtccatctgtgcacaggaagtgaggtttgctgtgcaactttctcctctgtttttatttatttttaatattctaaagttttttgtgtggagaccgtctcaccatgttgcccaggctggtcacgaactgctgacctcaagcagtcctcccactgcagcctccaaaggactgttcaaggcatgagccaccacacccggccaactttcctgtcaaggggtgctgcttgtgaaccgtggggtgaggctttgtccttggctctgagacagaccagctttggagaaggtagtggggctgggctcggtgcagactcagcctgacgccgtcacaggcctgcggtgaggcgggcttctggcagatcgtcctggcctgcttgtgaccgttccgctgcatgg

SEQ ID NO: 101811 - DNA, 3063 bp, Homo sapiens
caagctgcccccgcgccgggacgactggcctccaggatgcagagacaagggggcccggggctccaccggccggaaggtgggagtcagcaaggcgcctgaaaagtgagcatggtgcgtggggcctggcccccatgcagccgccacaccgccctctgttcaaggcagggccagctccgggacctctgtcctccagttctccatcccccacccccgcctcttcatccgtccagtggggcagccagccactctcccttccctgaaggtggcccttcccctgttaaggctgccacagggcacacctgggttggggctccccaaggtgtgcccagcagaagtgcaatagccaggagggttgcccctcctcatgggaatgtgtctggggtcttggtgccacaggggctgcagcgcagagtaggcagatggcctttggccccccggctccgcttcctcaggccctgccgggtcccttccctggctaccccaaggctcaggcatccctggtgacctgtggttctgggctggtgagggcacctgagcaacctggcacgggcagccaccatcctggcctcacctccacccaacactggaactccagcacccccagctacctcccaggacagacccctgtctgaccactgccatgctgacctgacaggctccggcctgcccttggccacccacttggtccccttgcttctgttttctacctctccaggcctgcccactacccccacccctgctcctcctttgtcagtgcgatccctgctgtgctcaggccctgccccccaggcctgtctgtaattctcccagcttggggcaagggaggggttttgcttcttgtacctacagggcagcagaagcttgatgcccttcaacacagctgccagccctgggggtgtggggcccctggagtgtgctctcctccagtgttcagccttctggcactgcaggcctaggttggagcagcctcgtggagtagggacggactagttcgggccctggggtcttgctggggcccataggcatgtggggcaggaagctgggcagagctggcctggctctgagtggccactgggggaaaggcagccttctgtctgccaatctgggtaggcccagtggccaagctctcatgggagccccctccccacttttttttttaacctgcccccattgtttctggttgtgtggtcatttgatatgggaactgaaggccagccaggggaggggcttggccaaagtcacagcaggttgatggcagctccagagctgtctttgcccctttgtggccctgaggacggctgggtctataggtagggcaggggtcaggcagggagtccagggtgcctggaagaggtggccacagcctgtggctccctccctggggtcctgccttccaaccacggcattgcagggaggatgaggctcagagggggtaggtttggagggaggccattttccagggtgggtgggagtgggctgagggctcggccccactgaccctggacgatgagaattttgatgtttgcccgtgtgcgtgtgtctcctgggtgtagtggatgccagtcttgttgctgtgacaagtaacaaccttttttttaaattgttttttatacaaacactcgcaatccgacatttggtgctaagggtttcctggtgcagacggtgggcctgggggctgggctggaccagggcgtgggtctctggggttggggtcccttgctgctcagggaggcagtactgactgggcactgcctctgcccccagcacccaccctcccccattccccagggagaaggggccccactgggcttggcctgcagtagtagggagacaagttccaggagcactttggggactggggttgcagaacacttcctgtctctggcttcatccttgggccagaaggctccaaccctcagcagcccttgccagatgtgccagggagtgggtgtggagacccggactccccccacccacgcacacctcggcctgatgagaggatggaggctggggcagagatgggcgtgacccagcgtcagagggtcgggggaggcattccttcctgtgtcccagagcttcactggtggagctggaggagccggaggtggagggtggggtctggcagctgctgctggggcagcctcatgaggggaggggaggggaggggaggggagcaggcactgggcgggggcctaggtgcactttgtccttgccaccaatggcgggaggagggtggacctgaacacctgcagggtgtggtgcctgccccagcctctcaggtacttggcccttggggagaagagaagagggtctggtttttgctgggggtgagtttccgggacactcccaaagcccacagataatccctggtgtgggaagaggagtcctggataccttgatgtttagcactttaaccccctttgtctttaaggtaggcgtgggggctactgccagaagtggctgttgggtctgaccccctcctttctgccctccctctgccacatgctggtccgcagagccctcctcccaaggggtggggccctgggtggagctcagcagggtctgcccactccctacgctggcccacataggcctccaggagccctcagtgagagggaccagcatagctgacccccagagtgtggtgggcgccggccctgcccgaggcccagtcggggccctttctgcagatctacctctggctcagcgcacgccccctgccctgagaacaggaaagggcccggaagggctgactcaccgggccgacgctcacacgaaaatgggatgcactttatttgctggtgcaaaggcaggtgagggtgcctcctgtgtgaccgttggccctcctgcctggtggcgctgaagggaaggagccagtgagcctgaccccgggaggggccgtccccgtgtgccgcgtttggcggggccccaggcggctcccccaggcccgggtctggggccccaggctttcccctgcctcgcggccgggcgtcccgtgctttgggtttcttggtttgggttttttaatgccagttctcagtacataagtgcattttgaaagag

SEQ ID NO: 101812 - DNA, 1021 bp, Homo sapiens
tccagcctcatgggctaccagtaccaccagcggcgctgcgggaagccgccctgcgaggtggacagcccctccttcccctgcacccactgtggcaagacgtaccgatccaaggctggccacgactaccacgtgcgctcggagcacacggcccccgtgagtggctctctgttctgtggcacagtgcttgttcctgtgtgccgtgtgtgttccgtgtgccttgggtgccaactgtatttgtccatgtaccgcccaacgcgtgtgtttcccacccctctctgtaagagacgtgtgtcctggtgggcgggagggtgaaacctccgtgttccctcgggttgcctgcgtcagccatgtccccagcacactgggaggcctgtgggtccaccggccttagggtggcctcgccgcgcgctgacctgactcttgctcccgcggctcactctagcctccatgccttcctgccctccagccccctgaggagcccacagacaagtcccctgaggctgaggacccgctgggtgtggagcggaccccaagcgggcgtgtccgccgcacgtcggcccaggtggcggtgttccacctgcaggagatagcggaggacgagctggcccgcgactggaccaagcggcgcatgaaggatgaccttgtgcccgagaccgcacgggtgagctgccccccccagggctgtggacagcgccgtggcctctgcgtggggcatgccttggcctgagacttgggacagccactgctgtgacctgggccacccgctgcccccgccatctgcggcgagtgtcgcctgctgccgaggcgagtgttcttagagcagctggggtgtcttctggcctcaggctcaccctggtgctgtcgaattcacagctcaactacactcgaccagggctccccacgctgaacccccagctgctagaggcatggaagaatgaagtgaaggagaaaggccacgtcaactgtcccaacgacgtgagcggaggcagccgggtggggggcgtggggagccatacagggc

SEQ ID NO: 101813 - DNA, 1023 bp, Homo sapiens
cggcacagggacgggagcttggtgcagtgccagattgggccaggggtcctcagtgcccaccttggctgttttccatctgtgtctggagagaagattccaagggtacctgcctgggtaggctggcattgcatcaagtcagcatgggaaggtatgagggccccagtgagaagctgtgcccccactgctgggcctgggcagcttgtgagccagcagccatcatcagagacataattggcccctggaggaatgttgccagcctccttcctcctgcgcaaggcacctctcccaggggcacaccccctcccagcactgggtaggagtgcatcaccttcggcatcatcttcgcagctgtggggctacgcacactgtggagctgcgtacactgtagagctgcgtgttgggaagggggtctggaagttggtgagggtctcaggacaggactagatcctatcaaactgatgatgactcctgggttatctggggagaccttggctggcagcccctcccctaagtcagaagcccccatcacttgcttttcccacgtgaacaaaaccacaggaaggcaggcccctcttccctgaccagagaggacctgccaagggcagggctccagggcagcctcaccacgtgttccaagtggggcccgtcaggcttcacagattgtctacttgctctgcagagatgacggatcctttctgcgttggaggccgtcggctcccggggtccagcaagagtggtcccgggaaggatggcagccgaaaggaggtccgacttccaatgctgcatgacccaccgaagatgggtaagaggagtcagggccagagtcaattccagatggttctgggcagcaagtggtaggagtggaccattgccctgggcgtcctgtctccaggtacccagctaggcccctagagttcccaaggaccttaccagggtaggggttgccttggacatagcccagggtcctgggttcttgtcctcagctggccgcagcccctgcccccggtgccctcgtgttgggac

SEQ ID NO: 101814 - DNA, 1032 bp, Homo sapiens
ccattctggccgcagccccggcgcccaccgcgccccggatctcgaccctgcgcgcaggccaaggagggggccgggcccggagcccccccgccccccgccgcgcccgagcccccgcgccccgcgccggcgccgtcttcctgcctcctccttctccagaaaaagtcgccattttggttcactgccttcgcccccccaccccgcgcccgcgatcggccctgcccggccaggccgaggcccgcgccccgcgcccgctcccggccccaggtgacaggtgggtggcgaggctggccccaggtgcgcgtccctggccgcgctcacccgcgcgccaggcctgggccggggtcccgggccgaacggcctacgcggcggacccgctgctggcgtctcctgcgcgcagcgcggcggagccccctctccccgcgagggctctgtgtccccgctgggctcgggagggccgaagccccttctcatccggggcgccagtcgcgtctctgcctcccaggctggccctggcctcaggccccactattctgaattcttctcccaggcttcagaaaaattggaagtggggcctcagcaggcacctgcaccccaggccaccggggtcatcaggtgctgggatgactcatgccggccctgtctcctttcaaaagttgcaaagtgaggacttccagagaactttgtccccggacactggcctcccccttggcaatgggcagtgactgtcctgacctctgacctcagctctctggccctcctggacacagcagccccttcccatcccctcggatccaagttaattagaagctatcaggagggggccacctgcccactcaaccctcaccctgcttcctgtcccacccccttccgtggcttttccacagggctgggcccagagtctcctctgctccccagctctcaggatggggttcccagcagcacaggccctcgggggccccagccttgggcagcagggcgttctctctggccagcatcctgggccttcactgctggtgcttccacgacttgttt

SEQ ID NO: 101815 - DNA, 1046 bp, Homo sapiens
gggctgtagacttgcaagatgaaaggtgtttccagttcttctctttttgtgctgggtgaggtcctcgaaacaggtcctgcacacttccttctgcctttggaggcttgggaacccctcattggggaggtgatttcccgcactagtgtggaggagatggggcagggagctagctctcaagtagaggaagcctctggttctgcccttgactgccctgaccaggcacccccacacacagccactgcccacttcagcttctgccggaccctcctggagcacacggtgtcagctgagagcatcccctgccacttgcctcggacacctggcaccagcctcacgtggcatgactcccgcagccagagggcggccagcagcaggccaatcaagctcctgcagcagcccggcacagacaccccccaggtacccacccactccacccacctccgtccctgccctccttctccaccactctcactctgcctgccacgcccctcccctgcagggccggctgtactctgaccactatggcctgtaccatacaagcccctcgctgggtggcctgacccggcccgtggtcctgtggagtcagcaggacgtctgcaagtggctcaagaagcactgtccccacaactacctcgtctacgtggaggccttctcccagcatgccatcaccggtacagtggcgctgagggtgctgtgggagtggggctaacctgcctcagagcgtctcttccccacactcagcctgcctttctcttgctgttgttttcgtctgtctagtttctcctgtgaatcaacctcccctctgttcttcatctccgcagaatctgtcttttctatctctctgcctttctttttttttttttttttttttttttttggtgagacagagatttactcctgttgcccaggctgagtgaaatggtgcgatcttggctcaccacatcctctgcctgccaggttcaagcaatcctcctgcctcagcctcccgagtacctgggattacaggcatgcaccaccacgcctggctaattttgtatttttagtag

SEQ ID NO: 101816 - DNA, 1021 bp, Homo sapiens
tgctaaaagcgtagggcagcagtgtgcgcacaggacgcacacagacaggtgtgcccataaccagtacacacaagctctacacaactggacagggtacagctctgctcggacagggcgcaccaggggcgagggcgggcagctgggctggttcagagggagggggccatgggttcagagggaggggaccatgggtcccactctcacagacaggtctccggactgcatcagagcactcgggaagcagcaatgccccaggctgtttttagcccccaggggccagttagggtcccagtgcaagctcgacctagcttcttccgcctctccacgaggaggcgctcccgcgcacgcgcctaccacgttcctgccccctagccgcggccggaagtcgtcgaaccaggacgtcgggacttccgcccagggaatcaaaagtgggcggggcgtgtgcggactgagcgctctgcttccggggcgcgggtgacgcgacgacggcgacactttgctacggagtgcatcggacgtcgaagcctagagtctctgcgtctttccctcttccgctgcctcattcctttccttcctagccttggtcgtcgccgccaccatgaacaagaagaagaaaccgttcctagggatgcccgcgcccctcggctacgtgccggggctgggccgggggtgaggcctggggcggcgcgcgaggggcggggacccggctacaggagcgcagtgctttggggcgtgtttgggggcgggggtctatggccgcgcagtctgaaagacgcttggtggatcggcttaatccctgcaggaagcaacgggctttggggtcaggacatacctgtgtgtgcaccctgcttgccgcctagatgtgacacattgactctcagcccagtgttttggtctgtaagatgggtaatgctgtatacggtctgcagtgaggagtagaggaatctgacgtgtagtggaaacacgcgaccaccttcctcaggtcgggctgacactccccccccccgcccgcccgcccgcc

SEQ ID NO: 101817 - DNA, 1110 bp, Homo sapiens
tgggaaggagggattttgaaagtggattcattagtacttggggacagacaggatggggaaagtgggagagggaggcaaaaattacatcatggtcccgtggcatctgggacagctgttatcagctgaaaccccccagagcagctgtaaggtgggcacggaagagctcagtgtgggccaagttgggtttaagggcctggttggatgtggagggggagatgatcgaagccttagggtggagagagattgccttggtaacatcatcagggtaggctgaaactttcaggtaagcagagaagatcagaagtgtttgagactgcagttcattgtcaccaggatctttggaggtttcccaaaggtgttagaaaaagaggtgttagtaagtgataaccaggagtggagaagagcacaggaacagagttattcagacacccggtgtcttgggggtctcctgcagcgccactggcttcaccacgcggtcagacattgggcccgcccgtgatgcaaatgaccctgtggatgatcgccatgcacccccaggcaagagaaccgttggggaccagatgaagaaaaatcaggctgctgacgatgacgacgaggatctaaatgacaccaattacgatgaggtgagatgtgtccggctttcgtggctcctccagccagtctctgggagcagctgacctaaccagtgtgtgttggtgtctgtaatgaatggcttggagtggctcatgcatttaaattttagctattcatggaacatctttactgagagtgagagggagcaggaaaaacacggagaaatgtgcactttttgtccctcagaagagatgttcttgcaggtgttaggaccactgccttggcattttctattgcccagtcttttttttttttgagacggaatttcgctcttgtcggaagagatgttcttgcaggtgttaggaccactgccttggcatttcctattggccagtcttttttttttgagatggaatttcgctcttgtcggaagagatgttcttgcaggtgttaggaccactgccttggcatttcctattggccagtctttttttttttttttttttgagacggactttcgctcttgttggccaggct

SEQ ID NO: 101818 - DNA, 1124 bp, Homo sapiens
tacaaaaaaattagccaggtgtggtggcgggcgcctgtagtcccagccactcgggaggctgaggcaggaggatggcgtgaacctgggaggtggagcttgcagtgagccgagattgcacaactgcactccagcctgggcgacagagcgagactccatctcaaaaaaaaaaaaaaaatagatctttttccatacagaagaaatttgttattatcacaaggtgttgtctgagtgaaatgaaggctgttttccttctccttctgactgctctctcagggttgtgggaggggcaccagggaccctctgagaactttgttttgcacctggtcatgtccagctgactcttagcttggcctgtctcacaggtgtctgactccgtgagtggacagaccgtcgttgaccccaaaggctacctgacggatttaaattccatgatcccgacacacggaggagacatcaagtgagtgctttgcagaatcgctgggctgggatggagactctagttgcctagggtattttggattttatatggacagtatgctgtcaaaatgggacatggcggttctaagaaatgtaaagtggagtagtttgttttttccatttgaaatgtatctgtatccattcattgcgtacactcaatgtgttacatatgatactgcaaagtccctgcctgtgctgggcaggaaagcagctggctgtgtcccacatgtcccatctggaccttcggttctcagcgtttgtctgcggggaggctacagaggcttggaatagtgcgcactgaggttttgagttggtttttgtaactcaggacatcaggactgatagttcttacattgtgactgtgaagtgggtgccctcatcccaggtctcgggtgcacccctgacagcatggcctgatgccgtgtgcactctccctctcatagtgatatcaagaaggcgcgactgctcctcaagtctgttcgggagacgaaccctcatcacccgccagcctggattgcatcagcccgcctggaagaagtcactgggaagctacaagtagctcggaaccttatcatgaaggggacggagatgtgccccaaggtgaggtatttcctgggaggcgtttcctgggaggctgcgtgattgtg

SEQ ID NO: 101819 - DNA, 1952 bp, Homo sapiens
gtaagatggccctgcacctgcccccgttattgctcgagtgctttagcagcctcttcactgtcctcactgtaccagagtgaacatgggcctgtgtgtttccaggtgagtctggattcttgcactggagtcggctctgtcatctcctccctgggaagggcttggaccagactaatcctgtagcagagcaaggcctggctcagttcctgcctgcctgcttttgattaagtgtgatcaggcgctggtccctgtgttctgacccctcttgacgctgctgtacttgcccttcaggccaaccccaacagtgaggagatctggctggcagccgtgaagctggagtccgagaatgatgagtacgagcgggcccggaggctgctggccaaggcgcggagcagtgcccccaccgcccgggtacgcagtggcaggcagggctgggccgtctggggtgcatggtgtgcacatgcgggccccacgcctggcttgggtggtgatgggagtgagatgacggcaggcaaacgagaccacagcacactcatctttgtgatgtgactaaaacattcatgtggccgggcgtggtggccgggcgcggtggctcacgcctgtaatctcagcactttgggaggccaaggcggacagatcacctgagggtgggagtttgagaccagcctgaccaacatggagaaaccccgtctctactaaaaatacaaaattagccgggcgtggtggtgcgtgcctgtaatcccagctgctcgggaggctgaggcaggagaatcgcttgaaccccgggggtggaggttgcggtgagctgagatcgcgccactgcactccagcctgggcagcaagagggaaactgtctcagcaacaacaacaacaacaaacatgttcatacggccgggtgtggtggctcacgcctgtaatcccagcactttgggaggccaaggcaggtagattgtgagatcaggagttcgacaccagcctgaccaactctgctaaaaatacaaaattagctgggtgtggtggcttgcacctgtagttccagctacttgggaggctgaggcaggagaatggtgtgaacccagcaggtggagcttgcagtgagccgagatcgtgccactgcactccagcctgggtgacagagcgagactctatctcaaaaaaaaacaaaacaaaacaaaaacatatatttatccccaccttttgtgtacacaaacaggctatgaaaagcttacaaaagtacacacagtactgcaggtaacagtgttgaggatgagtgtaccatgaagcacgtaccctggagctgatgccctgcgtgacagtgcatgtctgccccacaggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccagggggtacgtctctgcctgcaccctggggctgcagctgacccggcattcacaaaactgagccccctggtgcagggtcattgcccttcgcctctgaggagatgtggagggctgggggttacagctgatggagctgcagactcaggacccaaaccctggtcccctcgctgagttctgtgcttttccttatatgaagctgcacacactgctcagaagtgcagagtgtggcacacctgcagtaaaggctggtacgtacagacctgtgtgcacaggtccacagcaccaccgcacacctgtacacccacaaatgcagagtgtgaggggtgtttttccatggacatggcagccctgagggactcggtcacccactgcagatgagaagctgggcatggctgtgtcccagttcttcatagacaccacctgagctgctctcttacttgttggttgcag

SEQ ID NO: 101820 - DNA, 1016 bp, Homo sapiens
gcgggaggattgcttgagtccaggagtccattgcttgagaccagcctggccaacatggtgaaaccccgtctctactaaaatacaaaaatgagctgggcatggtggcgggcgcctgtaatcccagctactcgggaggctgaggcaggagaattgcttgagcccgggagtgggaggttgcagtgagctgagattgcgccattgcactccaccctgaatgacagagtgagactctgcagggtgtccagtctgtgccctcagggctgccatggttttgggtgggccagagtgctcatcctttgtggttctccttgcacaagttctgcgagccgtgtgtgggaggcccctgtcgtggtctgaggacgtcccgggttagaatctgtaggctgggcacctttccggaaccagaggctggagtgcaaatctttgttctttgtttctgaattataggtatcctgtggtctgaggccatcttcctcgaggcaaggccccagaggaggaccaagagcgtggatgccctgaagaagtgtgagcatgacccccatgtgctcctggccgtggccaagtgagtggggcccccacaggattgctgaacctcggggtcctaatgggctctttttccagagtctgtctgcctcttcctggtcattgtaaagatgcccggcagcagggtgggcttccccgatcctcggctgccgtcgctcctgctgtggtctggggcaggcgcctctcctggcagacacacctgagggtgccgtggtcagagactcactggggacgcatgtgattcacactggtgcgctggccgccgggtcacagactcactggggacgcgtgtgattcacactggtgcgctggccgccaggtcagagactcaccggggacgcatgtgattcacactggtgctctggtcgccgggtcagagactcactggggacgcatgtgattcacactggtgcgctggccgccgggtcagagactcactggggacacatgtgattcacactggtgtgctggcc

SEQ ID NO: 101821 - DNA, 1031 bp, Homo sapiens
ctgactagcttcccccactggtttctccacctgccaccccttctgcctgcaaaacaccctggcagcttagagggcacatccgggtccctgcaagaggcccacgatccaggcacaggcccctagcccctgccagggccacagcaatgggctgggggaggacagtcaccccgctggaagcaggcctctgcgggcaggcaggggcccgggccaccctgtgaaccacagcgggtgtcaggagccagggccggccgcactcacggtccgtctgcagggcagcggtcagcatctcgcggcacttgttgcgcacggcatcacaggtgacaggcaccggaggaaatgtggtgatcctcggagtcgacggtgccctgggcagctccggcctcttgcggctgcagagagccagggccagctgggttcagactcaaggctgcaggcaccccagcgagacactggtcctagaagcagcaggtgccacagcataatcccccaccaacccctgcttgttctactctgccagagtccaacagtggcctgtggccctgcctatcttgagtccagcccagatgtccatggggtgtgcccagcagccaggagggagagggccatgaggtccccagtgggtcagggtgtactctccaggtgggaacaggatcccagacccagcagtcagcatctgggcagcattaccagtcgatcagaatgaacctggcagttcctgccacctctggggtgcccacccactgggccgcaacacaaatactctgctgagggcagctgcagctgctgcctggtcagggagagggagagacccacagctgtctggggggagacaaggcggggccgcccaaggccaggttctgctgtcacagacgacacccctgggcacgtacagaatgggagaaggatgcccctcagggctggaccccaacatggggctgcccaacgaccaggctgcatccacctagccctcccctcatcccctctgtggaagttggcagaagcaggcagcttcctggaggaaaatcaacttg

SEQ ID NO: 101822 - DNA, 1054 bp, Homo sapiens
cagggcaccgtcgactccgaggatcaccacatttcctccggtgcctgtcacctgtgatgccgtgcgcaacaagtgccgcgagatgctgaccgctgccctgcagacggaccgtgagtgcggccggccctggctcctgacacccgctgtggttcacagggtggcccgggcccctgcctgcccgcagaggcctgcttccagcggggtgactgtcctcccccagcccattgctgtggccctggcaggggctaggggcctgtgcctggatcgtgggcctcttgcagggacccggatgtgccctctaagctgccagggtgttttgcaggcagaaggggtggcaggtggagaaaccagtgggggaagctagtcagggctccctcttgcagatgaccacgtggccatcggtgcggactgcgagcgcctgtcggctcagatcgaggaatatatcctttgggtaggggctgtgggcctgggtttctggtggagtcaggaggctgcctggcctggtgccctctggtggctgctggatgccactgcccagctgtccaggggtcacctgcctgggtggtcacctgcctgggtggtcaggctgtctcacctcaggagggcccccggaccagctgaagggctgattctgtctgcttgtggggcctaggtcccctggggctgtagcctgaagctgggtctcagtcaggaatgggcctggggcaggcttggccctgcagcccttcacctctccaccaggtgtgggtgggcagaccgacccctgtgtggctgggcagaacctttccagcccccaccccaacatggcccccagcggggcaggtggtaggtggagggcagcgacgttgtcctcaggtgggtccttaaaacacttgcacgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggtgagcccctgttggaggggc

SEQ ID NO: 101823 - DNA, 1071 bp, Homo sapiens
agggcctggcctggcccagcccagcctgaacggagggccctcgaggtgttgatgttggtgggagggccgtgctgcctgctgcctggcagtgactgcaggaccctcagtccctgccatggaggtggacactgagtgtgctggggagactgtggatcccatgagatggcagggaccctgttaagaggggagtgcggctgggtgcagtggctcacatctgtaatcccagcactttgggaggccgaggcaggcggataatgaggtcaggagttcgagaccagcctgaccaacatggtgaaaccccgtctctactaaaaatacaaaaattagctgggcgtggtggcgcatgcctgtaatcccagctactcaggaggctgaggcaggagaatcacttgaacccgggagacagaggttgcagtgagtccagatcgtgccactgctctccagcctgggcgacagagcgagactccgtctttaaaaaaaaaaaaaagaggggagtgtgtcgaggcggccgctgcacctggcagatgggactcgtgaggggctgcaaggacagcctttccttcccctcgaaggctgcatggggcctgggtcggtgcagagcctgcctctctcctgctcccagccactggtcagaacaggctctgcctgtggccggaggctcacccttgggccttccggaaggcagccgcgggcactggggacccctgctagttccccccaccattgggaccctcttgccctcagccaagtctgggccctcctggtccccagccaatgtgagctgcttcaggctcacacaagggcctctgccccgataaactctgtctccctcccccggaggctcagctttggaaggttggagtcacgaggcggcctcggatcaggtcacctgtgggagctcagtggctgcgaggcccgcactgcccatgttgaggggatgccgtctgcagcggagcatggaggtgaccctgggttcacccagccctgttcacaggtgcagacccgcagctctgatgagcccatgaccacctttgttgtctgcaacgagtgtggaaaccgctggaaggtggg

SEQ ID NO: 101824 - DNA, 1087 bp, Homo sapiens
ctggtggccacagcagagtcctgctctggggacgcctgcttcatttacaagcctcaagatggctctgtgtagggcctgagcttgctgcccaacgggaggatggcttcacagcagagccagcatgaggggtggggcctggcagggcttgcttgagccaaactgcaaaggctgtggtggctgtgaggacactgcgggggttggggggggggcgtctgtacctcaggggatgccccgctgtggtcacccagagaatcacccttcctggtctacagatggaagctgcaggttggtgactttgcaaatgcacttcctacagatgaactattaaaagacctgcaacattgaaaaaactcattttttccaccaaaaccttggccaggtaacctaccttaggcacctgcaaagaacaggaagtgatggctgtctcgcaacagagcctgggctgctcctcctgctctggggagtctaggccgtggggactgttctggggaggctcatgctgtctccatgacgtctgtggcaggagtccctgaggacgggagctgcctagctacagttttcttgccaaggcgaggtgttttgtgaatctgtgctgatgtaatgtgcaccttcacgtatttatgcatgtggcaagcgttacttcctgtgcacgtagccagccctgggtctgtctctggggtaatgaaaaaggaccctaataaacacctgctcactggctgggtattctttgtaaccagtgtttctggctcctgccacctggggatttgcttctggagtgacttttctgggattggcacgtgggtgggaggaggctatgggtttaggctgaattcttgtacctgtcctgtgctgctcaacaggctgggctctgccctcagtgaaacgtcccccaggaggctgcaaccctggggagagttgaagccagttaatggtgtgttggccgggctgttaccttttcttcagcacacacggtttctctctaaacaaccgatggctgcacctctcccctgccccctggaaagagaggtttcctgaggatacagtgggagggtgctgctcccacccaggttgcagggttttcttaccc

SEQ ID NO: 101825 - DNA, 1100 bp, Homo sapiens
ttgtgaagtgtaaatgaggccatgactggcaggtggtacctggaaaaaggtgcttgtttttactaaaaagctgtctgaactttcaaattaaggcagagttcaaaataagtgatagttacttagtggaaaatgaaacctatccaacatacagtttgaggttaccttctagagatgtggcattgagacaatgttggaacattatatacaggcttctgggtgaagaggtggctttgactgaggacggtatgcgattttccagctcttttcctaaatagacccttaagcatccaaacacatgattccgcttttaaccactgacccaaattttaagatgactgtggtaggctagggtgcagcctcagaactgagtggcttatccaggattaaagttgacctcattaggacttaattccatctaagtctaagtcagctggctgtggaccgtaatctaacaagggctccgaaacaattcaaaaaattcaaaaagggtgtgaaaatttaatgactggaccatcctattgatttgcaaaacctaatattcagctctaaaatcttgagtgtgaagattgagtgttccaccataaaaatagaagagaatttgtgttaagctatacccttcacactttttgttcacttgtaagaaactatgtgattattttcattcctgggaaaacctcccaccgctgtctccagttgtgtacgtgggtgtgtatgaaatccgccccaggccccttgtcaccccacagtatttctttacgatcctcattctactgttagaaatccagaggaatgtgaggaggaaagcaagtataaacttcatcataattataacaagttgttaaaaaggttgtgttcatttcagaaaatgtcttcatgaggtctggtggtctttttccctgacaatttgtatctggtgttttgtaaagcattaccattttatatgaagttaaagcagttactttgaaaaagttacatggggtaagtataaaattggaaaggatatttttgtagttttaagaagagtaagacttctccgcgtgaaaaagtgttttcttgtgaattagctgaagctaccctgtattttaatagttaggctcaga

SEQ ID NO: 101826 - DNA, 1102 bp, Homo sapiens
tacgagctctgatcactgcaacctctgcctcccgggttcaagtgattcttctccctcagcctcgccagtagctgggattacaggcatccaccagcatgcctggctaatttttgtattttttagtagagacggggtttcaccatgttggccaggctgttcttgaactcctgacctcaggtgatccaactgcctcggcctcccaaagtgctgggattacagtcatgacccaccgcacccggcctaaatttgaatttcaaataaacgtcaaataacttttagtattgttgtttaccttaatttccaattgaactgggattttttttccttctaaatctggcatctctgggtggggcaggggatgaggtgggtgttgacaaaagataatctattattttcagaattcagaatttcaaattggtatctgtttagaacttctattgttctgctcttacctttaacataaatcgctctttttaaacatttttaattatagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtaagtgtggaaggagagtctgaaaactcatctgtctcagggaaggaggcatctcctttgacagaaaatgtagtctgctaatggcctgcctgggtcgagaccgcagccttcccagtagttatctgacattgacacatcactgggtggtggatagagggatgagggaggaaggcctgcatgcatctcatgggccccggattctccagagggacctctcctgttctctgtcccctcttcctgtgctgccacagcctgtactgcgcacctgccctctggac

SEQ ID NO: 101827 - DNA, 1016 bp, Homo sapiens
tctaaacagtatatgtaactagcttttgccattttaaaagaaggcattaaagttcttattttagggattaaaatttttagaaacaccaagtgcagtttcaccacccccacatctcactcattgtgtagtattaatagatcttacataagatgataagaagatgacagagacagcagcgactggagattgtgtgaaatttggataaaacttttgatattcactttcatactattttgtttggtatttctagagttctagttatatagtataattctttttggaagtaattcttggacatttgtaattcttttcttccagctcctcacactgtaaactgtgttacattgctgtgggattttaacctgtggttagcatagatttactgtatagacttgttgcaatgtgatacttttagttgcaggaagcattttttacttccaggtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaaggtcagattcccttcataactgacatttctgcacactgtgtgccaaggtctgttctgggcagtgtacggatacttactcttttaacaatttcctgcatttcacaaatgaggaaacagaggcagggacaggtgagggagatgcagggtcacgcacatgccctagctggggccagaagctgactcaggtgggtgcttcagagcctgcacgtgaaacgcttttctccaccttccttctctgtctctctctttttccttcttctgtcccttccccctcacctccctcttccttccccttctccttccccccagctgttctgagttttaattctaattgttaatctattataattgttctgctgttagaattatatataaaatagagtcattctattctcatcattagt

SEQ ID NO: 101828 - DNA, 1083 bp, Homo sapiens
aaccaaaaagattcttgctgtttcttttgctcctctgatccagccctgccattcagagtcaggaaaatcaagacttgtccagttacgtaagtataccaatctttacttattttatcttttagatcttttctctctggttagattttaaaaggaaacaaaatttacaacaaaccttttgatattaaaaagcaccactcccatgctgaaactgtaaaattctacaagcaatttcaggcattataaaaattataatctatttttaacctatttcaggtaattttagccgtcttttaaatctacaaagagctgttgccggtcacaccattgaaagccgaggacgcacataaaagggagctcattttgccatgtgggagacttagcctatttgccgcctccactgggaggggcttacagaaagagccatcagccagagggctcctacagagtcatggggcttctgctccccagggcgccaagcgcctgctgcctcatgggtagacaaggttagagaacacattccagctaatctgctggggtgtggataggagactttccgtggaaccttacacagccgagcctttgtgtttcactatttcaggatgcaaactgagcaaggaactgataccagggccagcacgacagcaaaacctcctaatgttttaaaatttaaacggctcacacagaaatgagagttccaattgattttatttaaaataaaactatcaggatgctctctgatcatttagaaaatttggaaaatgcaaaaaataataggaagggaaaagttttgcatagtcttacaaaaaaaaaaaaaagttttgcaaaaagttttacattttggcaaatctcttccagaaaggttttttgatttattaggaatcacctatgaaatgattacactttgctttggtctctactaagtacaggttctaagaactagacacggttcttgaaatttgataatgagcaacaataggacatgcaaaacggttaattagggaaggtttggcagagggtgatgtctgtgcttggccttcaagggcaaaaaggagttccctaaagagagaagaaaggggagaaaag

SEQ ID NO: 101829 - DNA, 1146 bp, Homo sapiens
gatacgtacaatggtacagtccttctgaggaagggcatgtgaggtgttcgttgtgatacgtacaatggtacagtccttctgaggaagggcatgtgaggtgttcgttgtgatacgtacaatggtacagtccttctgaggaagggcatgtgaggtgttcgttgtgagacgtacaatggtacagtccttctgaggaagggcatgtgaggtgttcgttgtgagacgtacaatggtacagtccttctgaggaagggcatgtgaggtgttcgttgtgagacgtacaatggtacagtccttctgaggaagggcatgtgaggtgttcgttgtgagacgtacaatggtacagtccttctgaggaagggcatgtgaggtgttcgttgtctgtggtagacctgggtctgtgggaggctcaggattctggtccggactggagtagaacctggggagctattggctggcctctgttatttaaagccacagaatggatgtaaaaccaaggactagcagtcatactgagacggtgaaatggtggaaattggaaccttagggagcagcactgggctggatggaagaggaagagcctgcaagagaaaagagctgcggaggtcagagggagcggctgtgccttgggccaggggagcagtgagccacgttccttatcccaagcagactccttggagatctggagaggccggagctgagggccgggaccccgagggcctcggaaggagttgtttcagcctcttggggcaacagccagatcccagtggctctggaagtaatctgtctagatgtgagatgatgaaggaaggaaggatggctgtacttgaggagggagccgggtcacagatggggcaagaggcacgatcgtggtgttgagtgaagagaaaggactgaagacaaaggaagtgccggagcctgtcctggagaaaggagaagggacctcttgtctgtggagtcagaaaagcaggaaaggttgaagggagaaggtgctacttactcactaccaggggcctgggacacaagcctgtttgagggtttctgaagaacagtggagatgctgagattctgtgcaggcctttctgactttggtaataaacgttgtgcacaacacaagagctctccctatagtgcagactgttattattt

SEQ ID NO: 101830 - DNA, 2110 bp, Homo sapiens
agtttaatgtaattttccctttgagaaatgttgcctgcatgaaatcgtgagctttaattgtcaaatgttctttctccttggtgtgctttggagtttttgtttttcctgaaaaatgtttggatttgcatttccctactttaataaaaatggagcaaatgttcattgtgtaaataactatgaaaatattaacagataaaagaatattaggccgggcacagtggctcacgcctctaatcccagcgctttgggaggctgaggtgggcggatcacttgatgttaggagtttgagaccatcctggccaacgtggttgaaaccccgtctctactaaaaatacaaaaattagctgggcgtggtggcgcatgcctgtaatcccagctactggggaggttgaggcgggaggatcacttgaacccaggagacggaggttgcagtaagtcgagatcacacccttgcaccccagcctgggtgacagagtaagactctgtctccaaaaaaagaatgttggagacatattcactgtattactagtaggtgggtattaatatacacatgaacacagcaaataatagaataatgaaactgggctgtgtcaggaagacaaattgtgacccaggtgttgattccaccactgattaatatagccaagcaatattgcttcctttccctttcaaagttaagaattgatgcatttggaaatatcttttgaaaagtaccatatgattgtaaattagagcactaattgacatttgcttagcatgctctcatattcttgtaacatattcataaatttgccagttaattgaaatgatgctacgggtcttaggtgtgtaggcgttgtggtggtgtcactccgatgcatttgactgtgtctcactcttctgtgctgcagcaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttctagtggggaaacattattgagaagccctcccttattttaagtaagttgattaaatcttatgtgagttgccagttgtaatttttcaaaggaaaaattttgatggggtggaggaatgaattgccagataatctttctggaattccgagagaattccaaagagggtttttttttttttttttaggacatcttttgatacctttaaaagaaccactgtcaagtaatccttaaaagaatatcttggaaaaggaaacagattttttcctgtgtgtaagcaataagtgaagttacatttgccctaaccct

SEQ ID NO: 101831 - DNA, 1041 bp, Homo sapiens
ttttattgtaaagtatctctgctttatccattgctgaattcgataggatgttgaaatgctggtcaccaaaaaaggaaactgagcaaattcatttcaacaacatcaaaacttcagcttctcatagtaaaaagctgaatgttactaatatttttcatatctaaaaaaaaattcttagcaatgaaattgctgttaaaacacaaatttcaatcaaatacttttgtgtatagaaaatatgtatagtaggtagatagaaaagtataaaatgtttgttgaagtatcttattttagaatgaatggagaaatgccaaagatgaatccttcactgcattatgaaaatatttcacatgttctcttggactttatataaatctgtaatagattttagaattgaaaaattctttgtgaaggtcttctaaaagtgttccaatttatctcaaaatctccatatataggatcagcttaaaacataaagaaaaccttgaatttctcaaatgtttgagatgttcaagacagtctcttaatccgttaatgcttttggaaacaattgacaaaatagggcaggcagctcatctcatgtcctgaagttggaatttaaataattcctatttgcaaattagaatgacagtgttggaatttggaggcagtagttgagcatattctctagtatatagctacacctttaataaaatgaaggaatgtcttcaatcatattttagtgggctatttataaatagtcttgaagtcaatttagtttatttatttaaaagataatgcatcctgaaagggatcatttatgaataacaatctgaagtcttttcataaaaaaaattaataaactttagttgtacatttagccagtgttatttgaagtatgtaacttttaaaatattaagtgtcttgtatgattagaatatgtgaatgagtaacttattttgtatcaggaatgttttggtactgtgttttcactcaaaccactgacttaacagatactgctgtgtataacatgtactaaatattacagttattgtgcataacagattg

SEQ ID NO: 101832 - DNA, 1060 bp, Homo sapiens
ttggaggacaggacttcaatcagagattgcttcagtacttatataaacagatctatcaaacatatggcttcgtgccctctaggaaagaggaaatccacagattgagacaagctgtggaaatggtcaaattaaatctgactcttcatcaatctgctcagttgtcagtattactaacggtggaggagcaggacaggaaggaacctcacagtagtgacactgaactgccaaaagacaaactttcctcagcagatgaccatcgcgtgaacagtgggtttggacgtggcctttctgataagaaaagtggagaaagtcaggttttatttgaaacagaaatatcacggaaactctttgatacccttaatgaagacctctttcagaaaatactggtacccattcagcaagtattgaaagaaggccacctggaaaagactgagattgatgaggtggttttagttgggggctccactcgtattcctcggatccgtcaagtcattcaagagttctttggaaaagatcccaacacatctgtagaccctgacctagcagtagtaacgggagtggctatccaagcagggattgatggaggctcttggcctctccaagtcagtgctttagaaattcccaataagcatttacaaaaaaccaacttcaactgaattctgcagaaataatggttatttgtgaacttgtctgatgatctcttcccatttatcagattaccttttccacaaaagaaagtctctaaaatatcacagatttacctagagggcaacatttagatacaggaaaattttacatagtgttttgtcttaggattagacgtgaccagattgatcctgtttgattttggagagatcctattctaacaaatactctaaaatgataaaattgaggtacaactctcttaaaagagtatggataactatattttctggattctggaggttgataaccatatgcacttaacattatattctataaacattaagtagtgccagttatgagattcccagttcttactaaattgtattagcaggagctggtaattacttgtattatc

SEQ ID NO: 101833 - DNA, 1134 bp, Homo sapiens
cgcctcagcctccctagtagctgggactacgggcgcccgccaccacgcccggctcattttttatatttttagtagagacggggtttcaccgtgttagccaggagggtctcttgatctcctgacctcgtgatccgcccacctcggcataatgattaaatttttatcgctcatatattccaaagtagaatatgaatgttagaaaaggctgggagactttttgaaaattaagtgttaattaataaagagtagaatgacttattgcactgaaccttggattttatttctttatattgtaatctttcagaataattttaaagatagcatttagaagagcctatgtttactgttcccatttcatgcttctgttcggtttgtgactgctctcattattactcagtggtggagttcatgtcacagaagacacaaacatgctgtaagtgggaagagattacttgatcgcatcctctcatgaatttttcttcccttaaccaatcttacaggactgaagattttgagggtaataaatgaacccacagcagcagctatggcctatggtctccacaaggctgacgtcttccacgtcttggtgatagacttgggcggaggaactctagatgtgtctttactgaataaacaaggagggatgtttctaacccgagcaatgtctggtaagaaaaatgcagggagaggctgggcgcagtggctcacgcctgtaatcccagcactttgggaggccgaggcgggtggatcacgagatggggagatcgagaccatcctggctaacacggtgaaaccctgtctctactaaaaaaaaaaaaaaaaaaaaaattacagaaaaatgcagggagagttgaagaggtttgggcagtgctttctttaacatatccaatgtgtaatgcatcctttttttcccccagaattctttgacttcattttgatagttttctgtatatgtaattttataccatttgtatatatttacagcaaaaagttaaatctcaaaaaatgctgggcatcctataagtcgcataaatacattgccagttacccaattacggctcacatagccagtaggacttttcatggtgatggtgaagaaagggaacagagggaagaaaaatttctttaaaatga

SEQ ID NO: 101834 - DNA, 1026 bp, Homo sapiens
tcgcttgaacccaggaggcggaggttgtggtgagccgagatcatgccaccgcactccagcgtgggcaacagagcaagactccatctcaaaaaaaaaaaaagtaaaactaatatggattcattgtacagattttaatgtataacatttaacaagttctaatcttggtaaatgtactagatagatttcaaatgcattttttgattttgtaaagataagggtaagttctcatgaaatctagtatttatgtatatatgtatgtctgtatgcttttactcttttatttatttacttatttgcaaatcctattcacaggttttaaacaaaaatggaatggttgagttttctgtgacaagtaatgagaccatcacagtgtccccagaatatgttggctctcgactattgttgaagttaaaggaaatggcagaggcatatcttggaatgccagttgccaatgctgtcatttctgtaccagcagaatttgatctaaaacagagaaattcaacaattgaagctgctaaccttgcaggtaacagtacccttgactgagatgcatttttctcaaaattgtgttgggttgaaaaccttctgtagtaaggtttaccacttcccaaaccacacaaccatagtcaaaataaacaaactatatggtaggtgtattagggttctctagagggacaggactgatagtatatatgtgtatatgaaagggattttattaaggtgtattgactcacactatcacagggtgaagtcccacagtaggctggctgcaagctgaggagcaaggaagccagtctgagtcccaaaacctcaaaagtagggaagccaactgtgcagcttttagtctatggccgaaggcccgagagcccttggcaaaccactggtgtaggtacaagagtccaaaagctaaagaacttagagtccgatgttcaagggcaggaagcgtccagcacgggagaaagatggaggccagaagactcaggcagtctaatcctccgacattcttctgcctgcttttattccagg

SEQ ID NO: 101835 - DNA, 1032 bp, Homo sapiens
taaaaggaattaaaacgaaagaacacaaactcgaatcctggacctgattaggggcacgaccaaagaaagaaataactaacggttctcaccctccctttcattccctcccgcggaaagagaaaggctggaactccgcttcccagaatgcaaagcgcggggcggggctaaagagatagcctgttttccctcaagtaggatcgcgggaccacaggtttgattataaacgccagtctctcgccacggcgctcctccccctcagtctcactggtcctgccggccgttgcgtggaagggggactcagtcgtcactggcagcggttgaatggaggctctttgccccgcgccctcacggtagatgaagtccttgctttggtcagagcgatagcttctccgattgcctcagagcaagcggactacatttcccagggggctgcgggactgccgggaggagtgggggcggtgcctcacgtctggtacagtcatcacaagcctgttcggcgggactgtgatggccagagagatgacgatcttaggtgggttcccgggggtccttgttgctcttgcgggcgtagaggcgatctgaggatgccagagtgggcaggggtggttgactcacctcctggatctagctggagcagcggaaggggagtcagaaaggtgacttagagacggttttcggctgttcggagtggatgggggcggggacgcctctaggagggccccggcccctgcaggccaaggtaggatagacggcgaccagctgtgtccatcccagggacatcaggcttagggaggcgttcctttcaacagcacctaggtttttgaattgcctgttgaattggggcaagctatggaaggctgcgagaacgtgcacctccaggacccctttgtggaggaagggggaggagctacatccggatctgtcggctcagggatgctgaatttggaggctttttccatcacatcgggtttggaattacctatcccccacccacacacacacccaccccgcgtctccaaggtgatgaaatgc

SEQ ID NO: 101836 - DNA, 1050 bp, Homo sapiens
ctactggaagtcctagccagagaaattaggcaagaaatataataaaaaggcatccaaatcagaaagaaagaaaaacaaattttcactgttggcagataatatgacgctgtatgtagaaaaccttgacaattacacacacacagacacacacacacatacacaaaccattagaactaataaaccaattacgcaaagttgcaggatacaaaatcaacacacaaaaatcagttgagtatatgtacattaccagtgaacaattggaaacaaaaatgaagaagacagtccatttacaactgaatacaaaagaataaaattcttagtaataatctaaactgagaagtattataaaatatctagacactgaaatctataaaagattgctaaaacacgcacacacacacacacacacaaatagggggcatgatgccataagccaaccagcccacaatgtcaagtttatcatccagaacaccaatgcggcagtggccatttcgattcggagtgtcttcttctctgaggtgcccataatagtcattgactgggttcaaattgatgccaattcctcagttcttcatgatgagttcatggctcacaaacttagattaattcccctcattagtgaggacattgtggacaagctgctatcctcccgggactgcccatgtgaagagttctgctgagtgcttggtggagttcaccctcgatgtgcagtgcaatgatgaccagatttgacatgtcacatcttgagacctcatctccaacagcccccaggtcattccagtgaaacaagatgatgaccctaatgactacgtggagcaggatgacattctcatcatcaagttgagaaagggccaggagctgagactttgagcctatacaaaaaagtgttttagcaaggagcatgccaagttgaaccttactgcaggggtggcttttgaatacaatccagacaatgccatgaggcatgcagtgtaccccaaacccaaggagtggccaaagagtgagcacttggagctggatgaggatgagtcacaggtgccctgtgacccc

SEQ ID NO: 101837 - DNA, 1040 bp, Homo sapiens
atacttacgtgactttcttctttattttcctttcaagttcccactcaaataacacctagatgtaatagaatcctcactgtccaggagcacagtttcgttctcaccctcccttgttattattttctccttagatcttactacctgtatgacatattgtgtatttatttgtttgtctctggtcttcctctagaatgcaaatgttatgaaaacaggagatctactgattttgttcattcttttttccagtgcctacaatagttcctggtatgtagaaggtatacaataaatattggcggagtgaaggaacaaatgggatttgcttgattctgctgcagaagactaagaaaaagacataaatgaataaataactagtagaatgttaacacaatcagaaaaaggaccatttcttttcatttggatgtctcaaatctatttgttgtttttgttgttgttgtttttctggctgggcttgaaatgtaggcatgcagccaggaggctccatgctgactaatgagatagaggtacccatttagcccagcaatattcatacattgtatatgcattcatttttctctagtgactttttaatatattttggtgaagatattcccaagataatgaagatatgttgagtgggcattaaaagtgatgagtctttttttccattatcaaagacaaatacaggtgtgtgatgtatgcagagaattagaagtagggaaaaaaatgagggaatccaaaataatgaaaagaaattaaagctctccaataatcgaaagaaaggccaaactgaaaacataaatctccagactctgcaaggatttatactgatgtggggcatgtggaccaatggctttcaggatgtgattcattttgaaaaaagtgtcatttccattgccaagtagagttcatggtttagtgaaaatttcatcttcagtctgatcacatgagccaaattctggccctatatattctgatgtgaggaatgaagtatttctagtttatttgtgagattccaagcataatatccaggagggttagtc

SEQ ID NO: 101838 - DNA, 1019 bp, Homo sapiens
ccatgtccatactatgacaatcttattgtcaacactatataaataagcttttaaacaagtcatttttcttgatcgttgtggaaggtttggagccttagaggtatgtcagaaaaaatatgttggtattctcccttgggtagggggaaatgacctttttacaagagagtgaaatttaggtcagggaaaagaccaagggccagcattgctacttttgtgtgtgtgtgtgtgggttttgttttgtttttttggttggctggttgttttcgttgttgttaacaaaggaatgagaatatgtaatacttaaataaacatgaccacgaagaatgctgttctgatttactagagaatgttcccaatttgaatttagggtgattttaaagaacagtgagaaagggcatacatccacagattcactttgtttatgcatatgtagatacaaggatgcacatatacacattttcaaggactattttagatatctagacaatttcttctaataaagtcatttgtgaaagggtactacagcttattgacatcagtaaggtagcattcattacctgtttattctctgctgcatcttacagaagagtaaactggtgagagtatatattttatatatatatatatatatatatatataatatgtatatatatatatattgacttgttacatgaagatgttaaaatcggtttttaaaggtgatgtaaatagtgatttccttaatgaaaaatacatattttgtattgttctaatgcaacagaaaagccttttaatctctttggttcctgtatattccatgtataagtgtaaatataatcagacaggtttaaaagttgtgcatgtatgtatacagttgcaagtctggacaaatgtatagaataaaccttttatttaagttgtgattacctgctgcatgaaaagtgcatgggggaccctgtgcatctgtgcatttggcaaaatgtcttaacaaatcagatcagatgttcatcctaacatgacagtattccatttctggaca

SEQ ID NO: 101839 - DNA, 1029 bp, Homo sapiens
caggtgtagtaaaaactcctgtgagtcctactttccctgagcacttgggctgtgcagggtctagaccagaatctgggcttttgaatgggtgttccatgcccagtgagaaaggacccattaagtgggttatcactgatgcggagaagaatgagtatgaaaaagactctccaagattgaccaaaaccaacccaatactatattacatgcttcaaaaaggaggcaattctgttaccagtcgagaaacacaagacaaggacatttggagggaggcttcatctgctgaaagtgtctcacaggtcacagccaaagaagagttacttcctactgcagaaacgaaagcttctttctttaatttaagaagcccttacaatagccatatgggaaataatgcttctcgcccacacagcgcaaatggagaagtttatggacttctgggaagcgtgctaacgataaagaaagaatcagaataaaatgtacctgccatccagttttggatctttttaaaactaatgagtatgaacttgagatctgtataaataagagcatgatttgaaaaaaagcatggtataattgaaacttttttcattttgaaaagtattggttactggtgatgttgaaatatgcatactaatttttgcttaacattagatgtcatgaggaaactactgaactagcaattggttgtttaacacttctgtatgcatcagataacaactgtgagtagcctatgaatgaaattcttttataaatattaggcataaattaaaatgtaaaactccattcatagtggattaatgcattttgctgcctttattagggtactttattttgcttttcagaagtcagcctacataacacatttttaaagtctaaactgttaaacaactctttaaaggataattatccaataaaaaaaaacctagtgctgattcacagcttattatccaattcaaaaataaattagaaaaatatatgcttacatttttcacttttgctaaaaagaaaaaaaaaaggtgtttatttttaact

SEQ ID NO: 101840 - DNA, 1050 bp, Homo sapiens
aaaattgtcacatggcaatgatcagttataacaagcaaacaaataaaagtgcaagcatatatatatacaggcacacaaacacataaaaattcacaattctggccgggtgcagtggctcacacctgtaatcccagcactttgggaggccaaggcaggtggatcacgaggtcaggagttcaagacaagcctggccaagaaggtaaaaccccgtcgctattaaaaaaaacaaacatactggtttctcctcttattcttgatccaatgcaatatatttaacaaaacatactttataataagaagtgcatgaagatcttgacttcaaagatggggaacatttttaaaacagagtatatactatgtgggtaagtgcagagtgtctaagtgtactaaaaaccctaggagctttgatcaaaagccagctggttacatcagttctgttggtaatctttcttgctgatctgtgaccttgaccttgtgcttgtgtctgtatgtcaaatctattttagggatggggaaaccatagttgagtttagtaggattgatgctcccatctcaaaggatatccctgcatatatactataaacactcaagcaattccagaagaagaaagatccattttccattacatttcttattttgatagagattggaaaatattatgctcttgaaaactgatagaaagcaccagttactccaaagagctgttgagaaaggtgagaagcaaacactctctgttaattttgtatttacactcttttcttatacttatgtgctgccaaaataatttgttaatgattattttgtgttcattaagaaaaactattgtttctttgataacagtagaaggtagtgaatagacattagtactaatcataaataggtatgtactgtctgtcatgtaatagttttctggagctttaaaaattgtaggtaaaattaactttatttaacaattttccagtgtcagtattttcaagacagagtgaagtacagcatccagaaatgtattgtgtttttgaaatagaaattgtttggcagtttagctctttc

SEQ ID NO: 101841 - DNA, 1042 bp, Homo sapiens
atgaggataaataatgtattaaccaaccccgtgaggagaatcaaagacaactctatcctagtatttcattcgaggaagggtgagtatggcttaaagcacctgtgataaagcagggcttttaaaatgtaaaatacactttgtaggaatcaacggtcagtgacaagagctcccaggaggttttatacactgttttggccagtcaagaatttgtaaagaattgcatctctgcagcacccaccacagactggccccaggaacatttgtcttcctttgattgccctttgctaagcccctgtcaacaatgggttttcactatcttatcttggccttaacaaggtgacagacctggtcagtggaacctggcagcaggtttctaatgtttgaaaggtaactgatggattagccttgttttttgtgtccccaaaaagaccaatagtcagactaaaactcaacagattatagctcagtgcaaggcagaatttcatactgttggagttacgcaaggaactcttactgagcagcgactctgtggctaggctatgtgagcattaccacatttgttcagcccaggggctctatgaaacaggtattagtgcttttgcacgtttaataatgataaactttcaagagtagccaactttcctatgatcaaagagttggtaaatggtagagccggaataaattgaacccagagccatccgtctccaaaagaccaccttggaagatagttcatggtcactagaggtttttagaaataagctagatatccagagatagcaaatgggttataaaggggattaagcatcagacaggatgattgattaggcagatgacttttcaactgcctcccaacctttaaattatgattctgtcatgtttggagaattactttacatgccatgctattatgaaaacagtagccagtggcaaaattattagaggaaaatagatttcacctcataaaaattagctgcccttccaattggatacaagttctttaaatttgtgtaatctggtattatgaaggataagatgtttgtaa

SEQ ID NO: 101842 - DNA, 1029 bp, Homo sapiens
actcccatagcttctggttttgtttttctaatatgcttttaataataccattgcttgtaaggaaacccaccagataaaggccagcttcttggcatggccttgattcaaagtccttggtcccagttgcatttccagcctaatctccactcccattggactaccacacttcctgtgtcacactcagctcttccttgcctttgagtgctatttctggaccctagaatggctgccattctcttctgcctggctagcccttactcattttttaaccatcactgactaccacctgcatgtgtacatatgaactaaaaacctggttacagcctatctgtgttcctagagcactttttacatatttcagtcattgcatttagcacagtatatactctctctcctttggcacagagactaaggaagaaaatcaccggcactgtgcactctcgggtcttatttactcactaggtgttattactctgtccttttcctgtcctgttcaggaaaacatacctgaatccaagtgagtgaaagtgtggttatcacccaagttatcttgaatttatttagtctgtttttttaaaagggaataatttgcaacctcttagaccttattaaattctgtacttaacactaaatacttacactaaatactctttagaactaatcatgacataccttatatctgatgatgacaaaccagcatgttatagatggagacacactgattttagcatatattgtgatttaagcattacagctgtttgttccaccagactatttatttcttgaaagccaggactattttattcacctttttccttttgttgttctagagtaatgatttaaacatttgcctactttagctactaaattaaattttgagagcattgccagggaagaatcaaacaccctctactggcattaatactttctcttttggcccatgcactggtaatgctaaaacatcaaatgtcatgctgatgtttttataacaagaccgagattgctttaccttgttttacttgtgttact

SEQ ID NO: 101843 - DNA, 1001 bp, Homo sapiens
tcattgttagtttccagcattgcttccatccactcttaattccctttctcacagccagccatcttcgttcagagtcttatcatttctcatctggagctcttgtgctggcaggcctgtttactgacatccttgttcgagtcttttacaaccaccagatcttcctaaaactccagcttgcttgtgttacttgtctgatcaaaaataatgtagcaattgcaatagcataatgaacatagaaaagtaatagaccttccttaatcctaacttactgttactatgggaaacattaatacaattaacatttttttaatttggtatctttaaataattgacttttccttaagtcttttacttagtatcttaattgatataacttacgttgtttggggaggaagatccctactagactaagcctccatatcaactcagattttataaagtcgctatatgcgaagcctccatatcaactcaggtttttttttttttccttttccatgaaaggtttcaaatgaaggaatcaaaataattttaaaagtgttgatcaaactgtcaatacactttctcttcttacacagaccctggtcttttttcactgaaattaactgttgtgaacctgatagtctccttgattctctgctacatttgcccttcaaccatgtggcctgtggtttgcatatctgaaaattttctgattctaacgtcagagcttatgcattttatttagataactagaatttcttcattctggattagaggtatatgagtaattttcaaacctcgcttgcttcctttttgcatttatttatttaaaaaaatgttcatagtacagtctatgtaagcttctagcttgaagctttgtctcctgctgttgccgcccctctctgcacctcctccccacctgccatcttctagcctgtcctccaagctagtgcttctcaaaatatctgcagtaaaggccaataatttgtttgtctgtttctattttattttttttagtaact

SEQ ID NO: 101844 - DNA, 1056 bp, Homo sapiens
tattcttgagaattcagtgtgtagattacttctggagagaggaattggaaagcttgaaagaagaaatagtatttttgttgacaacacttaattcgatttatcaaaaaccagagaaaatggacagttaatacaaatcctacaatagcaatccctgatttcagataaaaagttaattaccgttttgaggaaaaatagaagcatgtttgattattgtgtgtttattatagtataggccagtgattacttttggaattattaaaattcctcttacaaaggaaagagcattattagtatttctgagaaatgataaagtaattggattaaattaacacaagtaggtgggcagagcaacaaaaaagacgatgagcaagtggttaattctacttggattaacactcctgttttctagtatagctacaacctaaatgaatttgtcatgtcttaagctcttggaccttatgctgcttatttctgggaaggagaaatccaagtgaactaggtaaaggcataatgattgattattgtgctcataatccgttgtgaatagttcagtttcatctagctaactgaaaaactctggtcaaagagagagagcagatacagcatgctgaaattcaccatgttttacctgaccacagtgtttcaaaaagggaatggcaactttgagccaaatttgctctttacctgtaggcctcatatggataatcctaactgctttttcttcactattctgataatgttcagaaaacctagtaatgaagttattttaatcacccacttaaatgcttagcttttcttgtaatttcatcaagaaaatctttaaaatgttattttttaaaagactgcataaaattactaataattatttggttgcaagtcacttttcgtatattcatttatattttacttataattggaatttaaaatcaatgacgcaattatttgtaaatactaaaatttttttattcagatataattaggtgttaatcactggttggcagtctgaaatctgcttttatatttgatgaaacagttgatattgaaccccatttctga

SEQ ID NO: 101845 - DNA, 1033 bp, Homo sapiens
tgggtttccttctttatttctgttttgtctttactctgttttcctttttatttcttaatatctcattcatctttttttttaattgccaggggatccatgtgatacaatggggtcaataattacttatcttcctgtagtttttgttattgctgttaagttaaaatgcccaaaacagttactatctgcattttacggaggaagaaattgagtccttaagaatttaaagacgttttgaaagtcattcagctagcagttgggtagacctaggatggtcagtcaaatcttgatttatttcacacttttttgtttatttttgtcaaagcagtctcagaaagaggggtttgtgtaccaggtgttaaggaatagttaataacctttggtgatggatcccgcagtaaaatccaagctaaccccacaaagggatctataataataagaactgggtcttgagacatgaaacgagaattggctggctgcatcacttttgttctagtaccttattttcttctcatggtcttcataaaagtcttaggatttgttgaatattctagtacttgaaatgtaatttccaggctgagaatttaaaaaaagaatagtacagttatgtacatgttcatgcagtggcattgttttacatgttacgtacatttggaattttatttaaaaagaagtagggagacttgctatttatttgcagacaaagagagccagatacctttagttgaccagaacactcacaggccagctctactttttactgatgagtagtattccaacaccattaatgtaggtggttgggtctgttggttcaactggaaacatatctcaaagtttatggaccccattcctctattctcttgagaaaggtaacaaataagatgagggggcactgtgtggaccagtggtgataatgtgccatgaaccaagtgcacgttggtctacacccctagaaaagagagcaagagagaagaaacctatgtgtagaccttttcatggaccacacactggccacgttcctgatgttggtgaaaca

SEQ ID NO: 101846 - DNA, 1043 bp, Homo sapiens
ttgaaattcaaattgatccctacactatcttgcaaatattacaaatgaagaattacaaaagttgtggtattttagcttatcaaaatgcacccgaaacataaaatatttttctttaagttcttaaatcagaagaataggaaagagttgaaaataaatgtgatacattttatcattatattagtattttgttgaaattaataccttgaatcatgctatggataaacatttagcctagaactctaaaagtagtataatgtgaatcagatttaaagaattgagaaggctggcaattcaaaaatagaggaagaaaacactctttggggttatgaaaaaaaggatcctcttagtattaagatttcttaaaaagctatacacagttttaagatagattgttcttgaagataatggggcaaataattacctgctaaacaaattatgagtcctgtgattctttttttggttgaaataatttcaagaactccagcatatgttgcagttttggctagaaaggtgattgtgacatacatccattcatccattctccctctctccttccctccttccctcccttccttctttccactttcaatacatagggctggggtagcaaaaaaaaataataatagtaaacagttttgtaaaacttgataatagaattatctgacagggttaatagttgtgtttgaaattcagagctagtatggttcactctccccagaaaataaaattttaatttcttacacctcagggaataaaaactctaaattaaaacccatcttgcctctttaactttgtgtcacttagcaaaaatatctttaaggatggaaagaagagaccccatgtgtcttaaattccaagtcactgtgtgactaagctcggagttccaataaatattaaactagaattctgctgggaatttgagtcatccgcttaagctactcctgggaccaagacaactctggttgacctgatgttgatgtttattcagagctttggtggaaaggagcctctcacccttggacttctaattaacaaagtcattc

SEQ ID NO: 101847 - DNA, 1004 bp, Homo sapiens
acatatggactgactatgtggcagcatatataaatatttcgtttgctaattgcagttagttatcagattgcacatgaacagacagaatgacatatgagaagttccaagaacattgtgtaacaggacatacaactgaaatatagttttctcacacttggtgagatttgagctcagcaaacacaacttattctgtattcattcattaagattaaaatatttaaaaaatcaccaaattgagaacatcgttatgttgtcatgttcgaggaccaatgccaaaaagaatgtgagaaactagagcttaagagccaccagctcacaagttgcttgacataatttggaatcagttgatagttcaatatctggtttccccaaaaattaagtacccaatacctctttttatcattttggagcttaactgatgagctagttagaaaggagagaaagcagaaaacagaataatttttaaaatcacaaaatctctaaaaactgaaatttcaagtcaactctttataattttcaaggcaaaactgacagaattagaaatgtttaccattggaagagaagcaaccataaaaaataacttaatgcgcttcctgttttatagatttatacatccatctcccatagataaagtgtctctccaagatcccaagtctagtttgtcaaggataggattcgaattcttacctcctagacttgtgctttctccagctttgcatgctctcttgattactattaaaccttttcggtttatctctagaatatgacttggaagccaaggtggttttgtgaaatgggtctgagtttttccattgatgatatttgagttcaaatcctggttcagtttcattgccttcatctagaaaaatgataattagaccttgttttcaaaaataattttaacattagaaacgaagtacgtacaatgcctcaaacctaagatgttctgaaaatggtagctgttattatcattgcatctttgaggcctgggtacttagtatgga

SEQ ID NO: 101848 - DNA, 1021 bp, Homo sapiens
ctgaggcgggccgcgtggagacgtgaggcggccgccgtggccctcacagtcggcgtttcgccgcctgcccgcggtgcccgcgcacgccggccgccatcgccttcgcgcctggctggcgggggcgctgtcctcccaggccgtccgcgccgctccctggagctcggcggagcgcggcagccagggccggcggaggcgcgaggagccgggcgccaccgccgccgccgccgccgccgccgcgggggccatgaccgtggagcagaacgtgctgcagcagagcgcggcgcagaaggtgaggcgagtccgccagccggcgggccccacttctccttccgacgggctgtcctctcccgctgcggccgggcgccccggcctcgccgccgccgccttcccgggcttcctccccggtcacccccggcccctgcccatcgcctcgggggcgtcgcgcccagagcccagctgcgtgtgggaagcagagtgtagtttgcgggcttcaatccacttccttctgccgattgttttcccgtagcagacggtgccaggtattgagagcgaccctcacattcctacagtgctctgtgtggcatcttaatgaaactttattctctccccttaaatgagaaagaatagctagttgtcatcctttctgaaccgattttgtctttcaaaggtagtagtgtaccaggcctgctattttgcaaaacggtctccaccaaaatcgaattacctgcctcgcggggcaggcgtgttgaccaggtggactctagaagtaggtggtttgcttggtttcttttccttttaaggtttccctttcttcttcttcttttctgtttttttttttttttttttttttttcaatatagaaactgtccctaagagaggaaacctttctggccatgttattccaggaatcttttgtcccctaagtttgaccttgttctttcgttcaccctttactcttgcatcagtcacacattcaaatggtcactcactaaagaaaacaattaaaaaactgtttgtgaaa

SEQ ID NO: 101849 - DNA, 1290 bp, Homo sapiens
tcttaacagtttctttgaagttgaagtattttaatattgattgtttaatttacttttatggttagtactttaaccattttctttttctttttcttttctttttttttttttttttttgtgacggaatttcactcttattgcccaggctggagtgcaatggcatgatctcactcactgcagcctccgcctccctgggttcaagcgattcttctgcctcagcctcctgagtagctgggattacaggcatgcaccaccacgctcagctaatttttgtatttttagtagagacagggtttcaccatgttggccagcctggtctcgaactcgcgacctcaggtgatccgcccgcctcggtctcccaaagtgctgggattacaggcgtgagccaccacgcccggctgctttaaccattttcttgaaacttagtttgtaaattttttctccctgtgttttgttctagaagttttgccattttaggtttacgatccatttggaattcatttctgtgtgtgttctgaggtgtcactaagtcaaggttcatttattgcatgtggaatctagtcccagcacctacttttgaaaaagctgtcctttcatcattgaattatattggtacctttatggaaaattaattgatcatgtatgagtgggtttatttttgaactcagttcctttctatccttatgtggtgccgttctttcttgattactgtggctttgaaatgtgccttgaagtgggtgaatgtaaattcttcaactttgttcttgttagaaatttgttttggctattctagaattttttgtatttccatatacaattctgaggtactttgaacagttggacaaagagccttctggggtttctgagtaggattgtgttggatgtatggattctttctgactgtttggacatctttacagtattttagcctttcaatccaagaacacatatatttctccatttatttaggttttgttttttaacggtttaaaggtctttgcatatcttttgttacagttgacttttttgatgctattgtaagtggtattttttatttttatttttattttttttgagacgcagtctcactttcactgcaaccgccgcctcccaggttcaagcgattctcctgcctcagcctccctagtagctgggactacaggtgtgtgccaccacacccggctaattttttgtatttttagtagagatggagtttcactgtgttatagccaggatagtcttgatctctggacagcatgatccaccagcctcggcctcccaaagtgctgg

SEQ ID NO: 101850 - DNA, 1779 bp, Homo sapiens
tagcatgaccaaaaactgtatttgctttaaagaattgtgacaaatataactgctaggaattatatagtattccagtttcagagttctacttagagcacgtttattttgttttattagtataagggagtttatttttggattataagctaattaggcaaacaagtacagaaactagagatgcataaagatttaattggacaagagagctataataggaatctgattattagcatcaacaagttaaatacatattttatttaaactgcagacatagtgatttaaggatatgatttgattcataaaagttttgtttacctacttgttttccagaatataggcactctaatttaaaaacagactgtgttccaaaagattttgcaagttgggtttttggaactgaaaatacatgttcccatagaaaccatgtttcctggtggtgtgttcttatttagaaatgtaactctgtgtgaacttagcttatagtgctgagtaacagtattttttgggagaaatacatttagagtttctactcatgatgtatttattttatctactaattaatagggatggggaatactcttttacattgtaattaaaaaaattttttttaagacagagatttgctcttgttgcgcaggttggagtacaatggtgcaatctcagctcactgcaacctccgccttctgggttcaagctattctcctgcctcagcctcccgattacagggattacaggcatgcgccaccacgcctggctaattttgtatttttggtagagatggggtttcaccatgttggtcaggatggtctcgaactcctgacctcaggtgatctgcctgcctcggcctcgcaaagtgttgggattacaggcgtgagccactgcaccctttttttttgagatggagtcgctgttgcccaggctggagtgcagtggcgtgatctcgactcactgcaacctccacctcccgggttcaagcaattctcctgcctcagcctcctgagtagctgggactacaggcgcctgccaccatgcctggctaatttttgtatttttagtagagactgggtttcaccatattggccaggctggtctcgaactcctgaccttgtgatccacccatcttggcctcccaaagtgctgggattacaggcgtgagccactgcacctggcccagatggggaatactcttaagggtcataaacatgatgcagatatggttgaaaggttgggtgacaggtaggaaaaaggactctgtggcaagggaggatggaaaccatcatttatctaggactaactatatccattgttctttgctagctatttctcataaagtatctcatttcttttttctggattgcatgaatgcttaatgttttagctctggaattctataaaaagtaggaagagacttaaaatttagaattcttggcatttttaagctttaatggaaagggtataccttcagatttatgtgcccatagaggtatatgagtaatttattttaatgctaaagtgctgttaatccaaaaagattgagaaaaacttcaatctgtgacagtaggatatgcagcatacctgaaccatttgttacccgccaaaaacttgaaaaccaggattagttgcctggtgagtaataaacaactcttcaagagaatgcaggttttggtcagtaggagttttactacttgtcacaaataaggagaatacttggagtattctttagggcattgttgcctctagggaaagtgacagggaggttttatggggtgatggagaggg

SEQ ID NO: 101851 - DNA, 1651 bp, Homo sapiens
aaactctcaggtttttaatttatattgaaattaccaatatttccttatatctgaagtgcatagtactgtattttgcacatagtagacacttaaggatgttattgtgcagtaaaaataacaggaaggaatctgaagacttgtaggtaatcttgacttctttgcttattaatttttgtggtgtttgcaagtaactgaatctctttggacgttgcatcttgcccctttggtttagcagtgggaagaggttgaacccacctccctgtacttaactagagaaaaaaaatccatacaaggagcatctcagagcccagaagaggagctctagatatggaagtggattggatgggaaccaccttggatttggaattgctggtcagggagaggaccatatttaggacatttccagttgaggatcagggcgtatcacaggtcagaagtttcataaatgggaaggtacaaaccttgaaaaacagactagggtcttaatcacaacagaaatggcaacaaaacccccacataattgcaggaaatgaaggttcagggtttcaaatacaggaaaaacacaactggaagatgccagtaacaaagggaaaaaaactttgcaaatgaggtggcttctctaacttaaacttaggatttttctcattgctcacctcttcccatttctctctacctaggtttagctaagaaaattctttcactttttttgttttcttttccacctggccttctccccgatcaccagttcttttcattgtttcattttcagtcaagatttatgaaaacatgaaccatactagagatacacctgatttttttctaggatatttgtctgaatttatagtaaaagataaaacagcaaaataacagtttcaaagaccttgctcttctccataatatactcagtattcttattgcactttatcaaaccaccataacaaaccacctcaaaacccagtggcataccaaaatattgtcactcacactcacagatttgctggttggctgggttgacttttttcacatgtgcctcattcttcttaggcaagtgggctaccaagtcatgttcttcttaagcaggttgcagaagttcaactgggctagcccagcgatgcaggtagtttcatgtctgcttgcatgctggctgctaacatgccattggtcaaatcccatcatccatgacaaaaggaaatacatcatgtgtgaggaagtaaaagtggcaaagagtatgaatacagggatgggagaattgggaggctagcataggcagtgtaatcttttctgggatttatattcgtgtttgtattttactttgtggttattaatttgtgtatatactattttgtattctgctttagcgtaatgtgattttgtaaggaaaacttctgtatagattatatatttttcacttaaatagttgtatgtgtaactgagactctgcttctaagttgatctgcatcaaaatcatttgaagtgcttattaaaatgccgatccctagaccttaacccagaccctctggaatcaatctctggggatgaggcctggacatcttcattattagcaaactcatggagtcatccttctgtacattaaagtttgagaactactttcttaatggaaggacatgcatttgtattagtctgttctcac

SEQ ID NO: 101852 - DNA, 1168 bp, Homo sapiens
ttctaaaataccctgtgaaaagaagcagttttatggattaataggaagatcatggaagaaaattgttacaattacaatgaaattaaaataataagtaaacctcctccattgcttaaaggaaaaagtcccagcttttcagttaaggattgttagtctctggtctcaaccaacttttccagcattaaggactactattcctctataccagggattggaggctcaaattcccagctggggtacaggtgtgcctatatgctgaaccctccgctattggagatgcctggagtggctggagccatttaatatggtcgttctagccacaagcagctttattcttttacacccatgtgaggtacaagatatgcgaggatgcaagggcaaggaaggtaatgtgaatgtgtgtggctggccaagttgggggcgggggcaaaatgaagagtgaatattctatctaaagagagctgctactactacttttattacactctggctttgtcacaatgattattgccatgcaggaatcgtgtaaccaggtcttctggtttttttttttcctcccagagcgtgagggaagtaatacctattattgtacacatacaatctcctaatctttatcttttgccagttatttcaaaaaattttgaatgacattgtaaaaaccaaagaaaaccattttcaattatgatttgtttcataaaaaacatgtctaagaacatggagtagatggtgattcttgttatttttgctctcaggacccctttacactcataaaaattattgagaacctcagagcttttgggtacataaaatttactattttagaaattaaaacggagaaaagcttaggctattagttcatattaaaatgtcagtctattatgtttgaataacatattttatgaaaaacacatttgctgaaacaaaatggttagaagattacgttgctttacattgttgcaagtcttgaatgtctgccatattagaggagaactagagtctccaatgtgcttctgaaggtttgcattctattgcaataagttgttttggttgaagtttgtgaagaaaatctggctttacccagataataatttagaaaagggaggagtattttaactgataatcagataataatggatattctttttaatgctatacccaaacttaacag

SEQ ID NO: 101853 - DNA, 1083 bp, Homo sapiens
tatattagtctcctattaggatctggtctaattattaaattaataaaattaaataaatttaaatattgtgattgaattatattaaatataatgttcgataactttagatataaaataaatgagtataaaataattttataagtaatttttattaaatataaaaacaaatattaaatttctaataatcgggtgaggttctaatattagtctaataattaagattgtcacaccacagtgacagtcggtgattcattgctcagtgaaaggcatttatttcagtagatgtggaatttgaaggtatcgttgacttgaaggagtctggaaaggcttcatggaggagtggagatttttgctaaatgggtttattgagatcaagcacttagaacagtgcctggcatgtagtgaacactcattgaatgttggctgttattattgctctgagcagcagcagctgggccttgctgaatgggaagtattatgagaagcagtcttgaatgaggaagatattcttggctgagtaatgacatgatttgctgtgaatatgtggcattcatgctgaaattgtgagcctatcctaggtcttctgcctttttgtgctggacttctttgagtctcttagatggcaccaacactctactttcttcaattatgatagagtgctaattcatccctaaactatattggctagtttaatttttggttactgttaaaatgaatatttattagtaaaaattttcttaatcttcagttaaggtgtttttgtttttgtttttttccttcaataggaacatcggaatttgccttttatgcgtgagctgaggtatctatttgcacttcttgttggtaccaaaaggaagtatgttgatccatcaagagcagttgaaattcttaaggatgctttcaaatcaaatgactcacagcaggtagttctgttgcactgacttgttcattaaccatttgtatttaatctgaacaatattaagcacctttcccaagaatatgagactatttgagatgcatgattctgctttattaaaaataacctggaaccatttaaaacatttgggagacttttaagagaaa

SEQ ID NO: 101854 - DNA, 1056 bp, Homo sapiens
gcgtttggaagaggaaggtctgagattctctcaccatcttccttgtgctttttgtttctgctttacatttaccttgtatggcaaatgtgaatgaacaaaaagggcactcacatcagagtttcttttatatgttgttgcatttttaaaaaaaattctaacaatgctccagtgccttttaggcttagtatctactcagctttgtttcttactcgctctgtcatggtaacactaacacaaatcaaaagaaagagaaataattttacagttgattccaaaccatcattttcgggcattcagcattccttctggttctaaatgtgttttacttttttttttcttctttagtatgcatagtatcttttccagtgattctgagtatacaattaaattttttaaaagattacttctgttctctgacttatctttccttctggatggctttttccttgtcttttttctggtttcttttttttttttctttcttttctagagattcatgttgattttggggtatcttttcacatttaaagatgaggcagcatagactttgtctggagccatgtatgtacataggtgggcttttcagtttgagttagagttgaaatggatacaactggcggttaaggccacaatataaatgcttttgcttcagattagcagtgtagactaacttttgaaattagtgattctttttctttagaggccttttaaagtagatgtgcatcaattaaggttgataagtttgattctcttctgttccctaaacacttgaatttgaagtctacaggagtaatttagtgaatctgtaaatgtaagcatcatgatttttttaaaagtgaatttatattttcattgtatcttcttcctaaatatttcaaatacatcatcttttgaagtacacaggagtcttttgagacaccctttggtatgtgatactgttagttttttctttttcttttccgtgtttgtttttttttgagacacagttttgttttgtcacctaggctagagtacagtggtatgacaatggctcactgcagcatcagcctcctgggc

SEQ ID NO: 101855 - DNA, 1023 bp, Homo sapiens
taattatagagctacctaataattgagagagaatactcagagagtatgtttggatttaattggtaatttagacattcaggagacctgtccagtcaatatggcctataatctatgtcaaattctcacttaaataatttatctcagaattttaaaatcttaggacattgttcagtctttttagacctttcaatcaaggtaccagccattagcagcatgctagttcctcgatataaagaagaaaaatcctgatattacagtggattttaaaacagatatatgctacttatatcaactgttattggaatttgtccacgatgcccagattccttttcttgtaaaattgctatgtgattgcataaggtcagatggaagaacttcccttctcaaggaagaaatcatttttataaaatattgttaacttatatgtctacctcaactagtttctttctttccagccatctctgtttctttatccatctctgtagctgcatctgtgtagccattcatccatgcattcatctgtcagggagttttggcactgtaatagtaagcaaaggacatacgtgcttccccaatcagttactgttaagaaattgctgatagttgtctagctgttaaactccatgaatgtggctagaggtctttatctgtgtcattcactattatatccctagtggtaatatggtaactgcatacataatacttattgagtgaatgaatgaaatgtcttggtgcttatcaaacaagtttctgaggtctttatactgaataggtgcttaataaatattaagtgatacgatgtctctgtgtttatctaaaaggagactttgttcttgtgtttttgagaacaaattgcttttgtctaaattttaatttttttttcttaaagatgcagttaaccctttcctgtttcaagtgcatactcatttttttcctcttcccccccacatacataaacaaacaaaaatatgcttttcctgttaagaggaagagatgtatttgaaatagtctttctctctacat

SEQ ID NO: 101856 - DNA, 1038 bp, Homo sapiens
taatattgtatctatctatctttctgtctttctttctgtctctctgtcttcctgtctttctgtcttcctgttttcctgtctttctttcttttgtttttttctgtctgtctttctgtctatctttctgtctttccttcttttttgttttgagacagagtcttgctctgtcgcccaggctggagtgcagtggtgcgatcttggctcactgcaaacaccatctcctgggttcaaatgattctcctgtctcagcttcccgagtagctgggattacagacacccaccatcgtggctggctaatttttgtattttagtagagacgagatttcaccatgttggccaggctggtcttgaactcctgacctcaggtgatcctcccgccttggcgtcccagagtggtaggccgggtacgctggcatctggccatattgcatctactttcatgatattcggaaatgctaatgattacctttttctgatagatacatgcacagaaacagagaaataacaagaattaagagggaagagatcaagagactgaaagattacctcacggtattacaacaaaggctagaaaggtattttaacttttatgaaattaggagataattatcagaaaccatgtatttggtgactagatttttaatttcaaatttgctttgagtgatttataattttaggagtagttaatattgtgtgaatagttttgagttttgcttgaaactaaaaatctatagtagactttaaaaaattattctagtgtttaaaattaaatatctcattgtcaacaggtaatgttcctactgctgaaaatagatacaaagttaaatgaatatagttttgaccttcctttttgcatgaaactaaagattactcttgagattttcattaaaatgaatggtatctgagtttttctccttaaaacaggatacaaactcagctgcctaccaagtcttctcagcagcttcgtaaaggaggaaattgtgtcaggtgtaagatggtatgtgccgggagcctagagagcaatctgtgtgtacaggg

SEQ ID NO: 101857 - DNA, 1065 bp, Homo sapiens
cctaagagtagattcacttagaagactgtatgtcctctgggagtttttttattatttcagtagattttatggttatggattaaaattttaatcacattttttttcagttcagaattatactttagcatgttttggtatgtacatatataagattcagcattttatgatccataaaaatagtactatcaaattagaatttgtttctgtaatgtaagctgataagccagggaaaataatatcaccatgcgtaagattttcttgttttttagaaataaatatgattaagctgttttaactctaaagctacaacttcatcttataataatttagttcttatgtattaaaaatctcatttggatgttagatcaatccacatatttctttaagattttttcttttgaattacaagccaatttaatactgtgggtttggcacgatctttgtcaagagtttcagcttgaaaggttaataagaaatactctatgctttgatacagcacaacagaacaacagggagccctatcttcagaactgccaagcacatcaccttcatcagttgctgccatttcatcgagatcagtaatacacaaaccatttactcagtcccggatacctccagatttgcccatgcatccggcaccaaggcacataacggaggaagaactttctgtgctggaaagttgtttacatcgctggaggacagaaatagaaaatgacaccagaggtaagaagtgtctcatagcatggttactgtcacctcagatggatatgtgtaatgttaatattgagaagggaaatcacgtctggattttatatttaaatattatagtcatttttcttttccagaaagggttttaagataaactagtttggctccccatttttataatctcaatatcaggttcacagggaccaaaagattttccctggattgcttagctgattaatgacatagcagatggcctgattttctagtttgctgctctaaatttatatcaaactggtattcacagttactccattggagaaatgtcatacaatatcaatgtttgtacatatcaattag

SEQ ID NO: 101858 - DNA, 1057 bp, Homo sapiens
gctctaacagatttatgagtatctatgatcccattactagtctgtaacagagtttttactggcatgcagcaaaataagaaaaataaggacagtgctctgggtggggtgtgtgcacttgtgtgcgtgtgcgtgtgtgtgtgtgtgtgtgtgtgtgtgtgtgtgtgtgtgtcaagttgccatctgtcctttcttggaaggaactctcttttattcttttctattctattttttcttttttttcagaataagttattctgaacttttctctttcctactttgctgctgttaaagtgtacttaaaaaaatggattatggtagattttattacatttttttccttaaatgtgaaaatataattccctattatcattccccaattttatgctgatttattgatttttgaaaaaaatgaactatgtgacatggttggaattatattgaacaatattgattgttggatattatatgaccaacttaactctttatagacaatatttgaaaaagaatggccctaatttagtaagaagtacataaggtatgatggtgactaacagcattagtagctgtcaagattttctttagtatttttcaaataagagggaatttttaaaaatatttgaactcattaacaaacattaatcaagcaaatagtgttgatgaagcactatattaggcgttgggtaattttctactcctcatggcaggttgtttttaaaagattacattcagaggagtggaagctaggaagcttttgacacctaagtagtggcattgagggagggaagaagtgaatgtacttaaaatactctttggagacaactgacagatgtgggtcattggctagaggtaagagagagggacgaatcgaatgattctctcagttcataatggtatgaataaccaaatagaatgtattttggaaaaaaggtaaagcagtgggcaaagaggttcccactcaggggaggaaagagaaatatgatgagttctcttttggccattttaagtttgaagagcttttttgagacggagtctcgctctgtcaccaggctggagtgca

SEQ ID NO: 101859 - DNA, 1041 bp, Homo sapiens
tgtaggattattttctactagaagtagaaataattgtcatgggagtgccataattttattttcactggtgattatagtcgatttttattcagttatgtgtgtgtacaagatatgtggtgaacatgttttactttgttcttaagtttacttgtgttatagcaatatgtaaggaagcttagctttcattttcattgaaactctcctttatagatttgaacaaaattcacttttattggctctgcacattttctagataaatcatatttgtgttgtttttaaagtatgcatttgtactgtgtcttttattaagaataactataattcattttctacagatttcaaatggtaatgttttttaagaaaagttttaggaaaattttcctattcctctaacatgtttgtaggaaaaacattagtccttatcttataagtagaaacacatttgctgttaatcattaaatgacaccttatatccttagatttgcaggaaagcatatccagaatccatcgaacaattgaattaatgtactctgacaaatctatgatacaagtaagtgaaattttgagctagtaatcattgtcaaaattatttacatatattttaatttacctttacattatcttaatctaatttttctttacatgttttgttttaaaattttggcaaatcttattgtaaaataataagggcttgcaatatgtacaatgtgacagttcatctgaatggggaaacttttataacaaatttataacaaaattcatgacaagttttccccattcagttgtattttcacaccgtatgtgttgtgtacccttactattttacagtaaaatctaccaaagtttttcaaaaggctatagcatctttaaaaagtcttatgggagaaaatctatggttgttaaaggatattaagatttgggaagaaacttaaggactccattacattttaacttctggtgtatatcatataatctattttgttaaccgtcaatttagaattctgaagatgtagacacatttgctatatgtaaaactgccca

SEQ ID NO: 101860 - DNA, 1077 bp, Homo sapiens
aaccctagagaaaattgttctgtatggcatttagggaatttatagctgtgggccactagtgatggggtttttaatagggttagaggatgaacaacaattgtattatatggtaaaagccgaacttgttctgctgttgttcctaacacagaaatagaaattactaaagtgtatggtagggtattagttgcgtgagccttccatacagaacaacacaatataaccagtacatgttacattgaatagagagtaattctttttgtttaaaaatatgagtaggtaggtacagtctggaaataatgtatcagaaatattaatagtgcttatctctgagtaatgcaaagagttttaaattttccacatttttcttgtttgttctagtaaacatttttattctttggtttgataaattgaagacaaaacctctttttttgtcttctttgacagtttttttatacggactttattttataatctgattcccttgtaattcttctaagaccacttccctgtgagtagcctgtgtttcatctacaccagattactcatcgtttctattgcatataggaaattttcctgtcattatggcatgttcatgaagtatccttcatcttaaaaatgttcttttatctttagtgttcatgaattttttcatattctttaagatcttcctcatatcccagagtctttgtgagtttctctgagagcacttctctagtagctattgtcttttccctcttaattccaaccttttcttactaccaaatgtattatgttcttctctattgtacttatattttggcttgccttccagtgtagagtctcatatatagcagggattttatgaatctttgatcagaccttacaatgtgctattccttctgcctggaatcttttctattcttttctccaagataatcctctacaaatccttcaagactcatctaagttagcacctcttctagaaagtgtttcttaacaggcagcattatctcaagtatgtgtattgggtccacagtgcttttataaaaccttgtgcgtaacttttattgaatttagcacattgtattataatagaat

SEQ ID NO: 101861 - DNA, 1035 bp, Homo sapiens
ttttcttttggctctctgaacatagccatggtcacgacatttcctccagtatagtggagagggacctgtcagggagtcaggagagacggggcccagtgatggctctgccatgggcatgatcagtgaccatgggcaagtcatctcatgcccaggctgtgatttcctcagctgtgattttaaagacacttttctcttaagtttctgtctttctgctagagaattctaatgaatcataatcatagattaaattgaccatttgatctggaacttaaaaagagaagtgtaaaatttagcagtatttctcctgtctctcacccattcctccatctgtaatctgattacatgggaatagttgagaatttaagacctaattgtcataatttcatgaaatgtgtttaacaataaaactactagatactgtagattagagtattatttaaaactactagatactgtagattagagtattattagaaggataagtaggatgttgcaaaactgtttgtgaatattttaagaacgtcctgtgcaaaaacgtcattaggctactctattgtagttttcaactacatctttttatagcggtaaattgagcatgtttggtgttatactgtgttatcagtgaatatggcattctgagagaagctatttcaagaatttgttactactaaaccttttagttcctgtagtcatttatcttttattagtgagcataagcagctctaatgcagattttgtggtagttccttttaatatttgaagattccccttgacaactaaaaagagtacgacatatcataattttacaacacgtaattttctgcttagtaagtgaattcagtgccagcaataacctgctaattgcaatgaggccttaaatatataataagacttcctttagccaaaatgttcaagagatatggtactctgttaattttgttttgatgaactaaataacaatacaaattattttttgtttgaacaattttgaaaatgtattaatatatcatcttattaaaatgtattaatttaaat

SEQ ID NO: 101862 - DNA, 1033 bp, Homo sapiens
gtatttaatcagcattatgctgttgaaattcttcaatagtaactgaaaaggtttataaaacatttatgttccctaagtgcaatttttttcccccaaagggaatctgttttgtaaggattaatattctaagtgataaccatttgcttcaaatttatattttcttttcctaagatagaattgttttggattggtttgctagtgagaaatcatcaccacaaactccgaacagatttctgaatttacctgtttatatttcactcttgtgtacagagacctagcacagttcgtctcttatatgctagaaagattaaaaatccttaattaaatgtcatggaccaagcacatctctgtagaatgtgtgtgatagtagtattaggttaaaattattcaaatataaacaatttaaagtagcacaacaaagtagtacaatgactcatagctgtcattttatagaacagccgttacatacctggtgttggcttagctgcatattatctctcatgatcatgatacctgttcatgctgatcatttcctgttgaaaagttgtggattttgataaattaaggataagttgtggattttgatatatgtgtgtgtgtgtgtgtatatatatatatatatatatatatatatatatatattttttttttttttttttttttgagacagagtcttactctgtaacccaggctggagtgcagtggtgcagtctcagctctctgcaacctccgcctcccaggttcaagcaattctcatgcctcagcttcccaagtagctgggattacaggcatgtgccaccatgcctggctaatctttgtatatttagtagggacggatttcgccatgttggctaggctgatctccagctactgacctcaagtgatacgcccatcttgacctcccaaactgctgggattataggtctaagctaccacgccatgccaaaaatagtgtttattttaaaaggggcagtaccagttgcagctattggttttgttttgttttattgttcagttaaactctttttctata

SEQ ID NO: 101863 - DNA, 1096 bp, Homo sapiens
atcaaattgcctacatgtagttatattgatttattctactattgatatttgcctaaaaaaagacattaaaaatgtaatctcatatttcaaaatgtatttctttgatctttgtgagggtcagtttttttcataaatattttggcaattggtatttatgttgactgtcattcatctttatacgtttattacactgagtttcttttagttaagtgaacattgatcttctaagacaattgattcatctgtaatttgcaaattatattttgtggtttataatttgtcttttaaatttattttttgtgtcttactatacataattttttagatcttataaaatacagcaactctttttatagatttggtcctgtgatcacttataaaattatgcaaaattttaattctgctgctttcatggttttataatactttttgttttgattacaggatagaagattttagttttctctgaatagtaaaatatccagatagtctaaacataaaatactgactaatgcctccttttcacgctgacttgacacatatactaaatcatacctatactaaatcccttatcagggatttatacttaatgatatactaaatccctacttataagtagctctaactgggtctctgtattccactgatctagttttctgtttttggacaatacactgaataccagtgatcttattgtagatcgtttgtaatacactttcacattttgttagaagaacacttagtaatttttgttcttttataaacaggaagtttggcaagcctcatttttcttctgatgatttttaaaatcaattgccacttcctttccaaatccttttagaattgtatttatgtattaatttaacatgaagcagataattttttttttagtattttgagtcttgcccaaaaggaacatgatacgccttttcacttttattgtcttctgttgtgttctttagtgaggttttataattttatttcataatagtcttatgtccttttgtttaatttattcctacataattttttttgcctttatgaatagggtcatttacttccattttttttttaaccaggttattgaaagggtagg

SEQ ID NO: 101864 - DNA, 1729 bp, Homo sapiens
ctctgtaggaagtttttgaagggaaaagtgaattgattacctttatatttctgtatcaaggaatacaatagtatatattcagttgccattaatggagatgagtttttcaaaaattaatatggattctgaatttctttatttttaaaactattttgagtgcttatacaattttataatttggggaagttaatctctagagaagaaaaaatggcccctgtgttgatgatcggcataagccaaacatgactgaaaaacacaataatgttttctccaccgctgttgcttttgtttctgttgttgccatatgcatagctttttctaaagagagattttcagttctagataggttgagattgttttctctaaataccgtttgttctaatactgtttgtgaacatatttatgttgtcttccttattaatacttacagatccttaatttaaaaaggaaacaaaaacctattcttttttttttcctgcattgcattaagaaattaaatgagcaagccgcagaactcttcgaatctggagaggatcgagaagtaaacaatggtttgattatcatgaatgagtttattgtcccatttttgccattattactggtggatgaaatggaagaaaaggatatactagctgtagaagatatgagaaatcgatggtgttcctaccttggtcaagaaatggaacgtaagtttaaacaatggtagtaggcacctgagatgtccggattaaatgcagttagaattagatgttatttattcttgccattttttatattaaatacaatattaagtattaatattttcacattcacatgattactctttttccatattgatgaactaagctgtgtgcattgcagttgccatttatgtttttgtctccccaaaatggcaattatcttacctattagagtaagttaatattagtaaatcatgttgacaatgatcgtgtaataatttctatctttagttagatttaattgtttgtatttgcagcacacctccaagaaaagctgacagattttttgccaaaactgcttgattgttctatggagattaaaagtttccatgagccaccgaagttaccttcatattccacgcatgaactctgtgagcgatttgcccgaatcatgttgtccctcagtcgaactcctgctgatggaagataaactgcacactttccctgaacacactgtataaactctttttagttcttaacccttgccttcctgtcacagggtttgcttgttgctgctatagtttttaacttttttttattttaataactgcaaaagacaaaatgactatacagactttagtcagactgcagacaataaagctgaaaatcgcatggcgctcagacattttaaccggaactgatgtataatcacaaatctaattgattttattatggcaaaactatgcttttgccaccttcctgttgcagtattactttgcttttatcttttctttctcaacagctttccattcagtctggatccttccatgactacagccatttaagtgttcagcactgtgtacgatacataatatttggtagcttgtaaatgaaataaagaataaagttttatttatggctacctatgtgtttgtaagcaggtatattgtatattagtgtattagtaatactagataaatgaattttgtctggggattaagattggatagttaatagattaatacaatcttttaattctgctctaatgc

SEQ ID NO: 101865 - DNA, 1032 bp, Homo sapiens
tccatgaatcacaggtcattgttttctaatcatacccatgtgagttctaaaccaatacatatttgcagttgtcttttcatcacatatacctggatgtttcgcagacactttcgacttggcacatctgaattcatcactttttcccaaatctgattgtctcatactcccttgatgaaatgatgtaataatcccaaaatgaattattctcaattctacttttacctcccattgattaccaagtgtcagcatgtcagattttttaatactccttagtactatggctgatgaggtccgtcatctcttagtttgactgttagatttgtccctgagtagcactgtctttgattttgcccctgaaattcatcttcacactgttgacagaataatcttttaaagtggtttgttttacatgtctgtcttccactgctggactgagctcttaacaggagattgtatctcttgtttttgtaatcctagcacctgttaaaataactagcaacttagaggtgcagtcttgcaggttttctgaccctccagtcaccctagacctgcactgatacagttttcgttagccatttaaatttaaataaaattgaacattctgttaattagtaatactagctatatttcaaatgctcatagccacatgttactgttgactactatattggacaacattttagaacatttcgattatcataggaagtttcattggacagagctgccccagcagacctttgctgatgtggatgtctttctgtattaacatccttttaacattcagacacctcccaaatgctaaccttaatagattggccttcagcatttatgtctctctatcttgatcctgcaattgatgactttactatgtctgctctgcagagagcaccactaccagcatgtgtccaatcaggaaagccgacactacatatttcaacagaggagatgtgagtacagaggcattagagagtaacccggggatcacaactgtaggatgcagctactagtcctaagggtaagaaaacaaatggg

SEQ ID NO: 101866 - DNA, 1013 bp, Homo sapiens
ggaggggaataaggtcatgctttttcatcttttttacatgacctgataagacaatgaaaccaaaacatgctttcttatagttatggtaaaactaaacccaatgctgcctcttatttcacatttgcatttataaatatatgttgaaatatttttactacaactgaatgtatgattgttgattatttactatagtttttaataattatgaggacaatttaagaataaataatggtttaaaattatgtagaacacatgatctatataaaggctataaaacgtatttatttcaaaatatgcaaaatcactaagcaattagtatgtagtattattttacacaataaagatataattaggaaatgctaagtgattatagatgtgaaatgattaatgattgtacaacttatcattttgttgcagttgagtttacaatcttaaaaaaacgtgtatgtggctggctttatgtttactcgtttgtgtgtttgcttgttgtctggtggtttaaaacattttttagtaatattttatttttgcccaacctgttgaccagatgagagttgtatgtagccatgcattttaagtgtatcttttttgaacaataagtttaaatatattttatttaggaaagaagatatcctatgtcatgtaatacatctggagtataaatgttagtgtggagtattagtaatcatgccattatcgtgccatttagtttagttttatattaactcatccaaatattgtaaattttagcaccattccgactatagacacagatgtatatatttaaggctgataataacttcctgtattctctagctagtgaacaagatcttactgttttatgagaaagttataatgttaccaattccttgaaaccagtaactaaactagttttataaaaattaaaataagcacggtctaactcatacacaattaacttaatagttaatttggttttaattataggctcgtaatactacattcatgcctcacaattatataattcatacatg

SEQ ID NO: 101867 - DNA, 1035 bp, Homo sapiens
ctggtgactaacagactagactggaaagtaggttgtacacttccggagagcagaagaggggagagggcaagaggaaagaaaacagggaagggaagccatgaaaaagagattgctacaatgaattacaacttttttgtattactaaatgcaagaatgaacattagatttttacatgccaggatcattcctaaaaggaggagaaatctctgattatttgtttttccatggtagttgtgatattctacacttacatatatcaaaagaaagagaaagaaagtaatttcaggttggcaaacctattgcatcctggtcataaagtgcctgaatttaacactgagtcattttcttgtccaaatacaaaaatcttgaaagaaaatataggtcaagttttttttttccttgttaaaaaccaatgatctctttcatcgtgaaccttttaaagtaataactcatataaatttacattttacattatttaatttggcttaaaataattattagttctagaatctgatttgtaaatcaaaattgtcataccaaggtacacacacacacacacacacacacacacacactcacaaacacactcgtatcatctgggattttttctcagttaattctgtagaaaattcctaaccagggctgggagtggtggctcatgcctgtaatcccagcactttgggaggacgaggtgggcagaccacaaggtcaggagttcgagaccagcctggccaacatggtgaaacccccgtctcaactaaaaatacaaaaattagacagtcatggtggcatgctcctgtaatcccagctactcacgaggctgaggcaggagaatcacttgaacccgggaagctgaggttgcagtgagccagatcgtgccattgcactccagcctgggcgacagagcaactttccatctgaaaaacaaaaacagaaaaaaagaaaattcccaaccagttcatcctagtccacaagaatctgatttttgtctcccttgtcctttaattactcttccttgtctcctaaaaaaaaaac

SEQ ID NO: 101868 - DNA, 1053 bp, Homo sapiens
gagttgtacagggtaattgctagaggatttgccaagtgcgtttgtcgactgctcctttctctgggaggggaaaaaaggcatgtgaaaaatgcgtggaccattaggaggcgtaatcattttgacactttaaaaaacggattttccatgtcggtgttttaaccaactgatcttgtttgtcaaactaagcacttgctgcgttttataaccaaataattcatttttaaaaatccgtaggtgggatcctaggaggcgcacttagtatagcctctggaagggtaattttttgttgttaggtgctctgaagcaggatctagtggccctttctgttgggatggctctctgcttcctgttgaaatgttaattccattgttggatgccacagctgtgagcattactcatgggatcaacattctattagcaagtctaatcttcgatctgagcctatagcactacctccacctttttgatatatatcatttagacttggcgggctgaaatgtccaaagtaagccttccggagaagatgaagggtcatagaaccagtttacaggtacattcccacctttctttcttttttttcttttttttgtctaggccgaacctgaagatgaagttgagaacacagtgtgttctctgggaaaaaaaaaaaaaatagttttagaccacatctaaagcagaaaagtggaagaacataaattatgtggaggaacttttttttttttttaaatggagtttcgctcttgttgcacaggctggagtgcaatggcgtgatcttggctcaccacaacctccgccccccgcgtttaagcgattctcctgcctcagcctcctgagtagctgggattacaggcaccccccaccatgcccggctaacttttttatttttagtagaaaccatgttggtcaggctggtctcaaactcccgacctcaggtgatccgcctccctcagcctcccagagtcctgggattacaagcgtgagccaccatgcctggcaggaactagttgttgttgttttaacgggaatatttagataattggatttaattttttt

SEQ ID NO: 101869 - DNA, 1459 bp, Homo sapiens
agattaaaaactgactcagacatgactagtggaataatcactgtaaggaccatctttattagatgagaagggagagagtgatgaactgaagagagctctatcatacacacaggcctagtggcaaagaagttgaaaactttcagtcatgcaaaaaggacttgctgaacactagctgtctgccaggagccacaagaccatgcagggactgcaacaatgaatataggtaatggccctgtcctctgatctagtgcagtgagctaagttggtaatcgatggagaccccacaacagacagggtaaggagccaatgtagggaggcttgccttggaggggaggcatttttcctctgatggtggtataatcgcaggaatgaaaagattaagagggggcatatcgggcagccatcttgctcttgccgcgtgctggtgctggaggaccctccctgcttcagatttaccaacagcatgaatcaagaaaagttagccaaacttcaggctcaggtccggatagggggcaagggtacagctcgcagaaagaaggtggtacataaaacagccatggctgatgacaaaaagcttcagagttctctaaaaaaactggctgtgaataatatagttggtattgaagagatgaacatgattaaagatgatgggacagttattcacttcaacaatcccaaagtccaagcttccctttctgctaacacctttgcaattactggtcatgcagaagccaaaccaatcacagaaatgatacctggaatattaagtcagcttggtgctgacagtttaacaagccttaggaagttagctgaacagttcccacggcaagtcttggacagtaaagcagcaaaaccagaagacactgatgaggaggatgatgatgttcccgatcttgtagaaaattttgatgaggcatcaaagaatgaagctggcatggtttttggaagctggcatggactagattgaacaaatcagctatgtggttccaaagttttacagacacagagaacatcacctgttactagttcactaatataaatattttgtatattaataatgctgttcagcatttttctgtcatttgattttgcattttgccttcctctcaggatatttttttggtcaaaatatgaagtattggtgcagtttgagggtgttctgggttttgattcctggtttttttgtttttggtttggggtatttttggtgtatgtttgcttatgtatgtgtgtgggtatgtgtgtatacagtggagagcaaattggaaaacagttctatttatcctcctccctccccagtagaaataaaaaaaatctttacatttgttacttttcttttccccctataaaacacagaattaatggaaagtgagtatcttggatttcagatctgaagagatttttaccattagtggtttgattttaatctgcttggttaactatcatatttttcatacac

SEQ ID NO: 101870 - DNA, 1026 bp, Homo sapiens
tctcttcagcttgttgagatgctttcataattggcctcctgttgagtgaactttaccctgtcctccaggcacatcctgttacttactgcagcatgttctaacctttatcaagcatgccgatactgtcattgttttctcttgccagaatgtacatttcataggtcaggcactgtttacattgtattcccagtatatggcacagggcatgttcattgcataaatggggaaagttatgctagacaggaattcatgtttgtaggcttgggaaggacctagaagagaaagagcatttgaagatcaagaataggtacctcatggaagaggtgagcagggctgggctctgtgtcctgcacaggtcagctttgtgtcagctttgccaggtgttcaggagtggagtttatatcaccactcacatttagttctcctacttgcagccagttctctccccttcccttatttccacctttcatctgtcatagaagtcatcatcagatgagagttgatgctttgtgtcattaaataaaggaaataattgaggctgggaactttggattcagtttatttggtggctagcaagtagttgatgtgaagataattattaaattaaattaattattaaaataagataattattaaaataatgcagaaaacaattaaaaattatccaaccagaatgaccttatgggtttatcttactgtctttcatctaacttctgtttcttaagaaaacaaacctagtaatctagaataataattgttcaattgggtttggatttaggttggttctttttatttttctttttcttttttaaacagagtcttgctctgtcgcccaggctggagtgcagtggcgcgatctcggttcactgcaacctccgcctcccaggtttaagcaattctcctgcctcagcctcccaagcagctaggattacaggcgctcaccaccatgcccaggcgattttgtgtgtgtgtgtgcgtgtgtgtgtgtgtgtgtgtgtgtatttttagtagagttggggtttcacc

SEQ ID NO: 101871 - DNA, 1047 bp, Homo sapiens
gtttcccatttcaaaaagaacctttccttgaccacatatcatacactgtctattttctcccctcatcgagaacaaatttctcaaactagtagtcatttctgtctttgctcacatctctcaagcactgtggtcagataatatcctgttgcagctccccaaaaccttcactaaatctgatttggcctaggacaccgatgatgttctaattgccaaatctagtggatacatttcagtgtcattttttttacataataaattgtgagttcttcctagtggaaggcactgctaaatgccttttaaatataaaagatgacaagacatagggttatgtatcatagtagaagtattaggcttatcagatgacagtgaattgcctactagctactatttattgaagagtgaacaccaggatgtgctgcagctgttctaagaggtttacatgtgttatttaatttctccaatgaagtaggcattattatttttaatcttcattttagagaggaaaacatctagtcacggagaggctagaaattgcctgtggccaagcatttagtgagataaatttgaatctgaacccagatctaactttagaactcctactgtttaagaaatgtctgcatttgttgggagctggactcagagaactcctgctaatgcctttgagatgtggatacaggggaggagaagaaatgattgtcagggaaggcttcttgttggttgattgatcaatgggctagaattagaacatacttagttaggtctgaaatagataatttagttcaacacccctaatttacatttgagccctagggaagcaacttgtccaaaatcatacagagcttttttgtgtaataaatttggcaacagtcagataacctagtctgacatttatttttctgtttttccaaaaaaagaaaaagtttcacccaaacccctgaaccatgtgccacctaaaatgctactagaaatgtagcatagaagaagagtataaattccaaacatttctctaccatggtgattggaataggatttctaataatgcaccca

SEQ ID NO: 101872 - DNA, 1026 bp, Homo sapiens
tgcaacctctgcctccgggtttcaagcgattcttctgcctctagctgggactacaggtgcctgccaccacacccggctagtttctgtatttttagtagagacggggtttcgccatgtgggccaggctggtcttgatgtcctgaccttgtgatctgcctgtctcagcctcccaaagtgctgggattacaggcgtgagccacggcacccggccttagcagtatttaaagccttagttggtagagttaattagtgttaacatatttaaagtgtttttcccttctagaaactgggatactcactatttagatgactttcaaatattgctaatctcaaagcaacttcctgggaagaagaaaggcaaaggttggagttagggtctggcagagggggaaaggaaatggtgcaaatagcatggtggtcacctttttgtatagagtttagagtatctcagtgacttgctaacctagacatctatagtatttgtaattaaatgcacaaaattacacttgtctttatcaatcttcttcttcattttctcgaacctctaaatctacttataaatcttttaacatactagttcctgatttgtctaacttattttcttccttttttttttttttgagaaggactcttgctctgtcaccaggctggagtgcaatggtgcaatcttggctcactgcagcccctgcctcccaggttccagtgattctcctgcctcagcctcctgggtagctgggattacaggcacatgccaccacgccaagctaatttttgtgtttttagtagagatggggtttcatcctggccaggctggtctcaaactcttgatttcaggtgatccgcctgccttggcctccgaaagtgctgggattataggcatgagccaccgcgcccggcctctaacttatttcttaaagttgctgtagtgaatcattttttgactattattgagtgtgtgttttgacacagcgtcttgctctgttgcccaggctggagggcagaggcgcagtcatggctcgttgcagc

SEQ ID NO: 101873 - DNA, 1016 bp, Homo sapiens
ggccttagtaggaggtgacatcaagggctaaaaaaatactctttgatgaactcatgtcactttgatgctcagatataagtcagactgtgcagaagagaagctttaaagatccaagtgatttagaaactggagataagaaaagcaagcagaaaactgggaaatgttatttcagtcactgccaatatgggatgtggttccgtctgtttatttacataatatgatctagtgctgtgcacttattaactagactgcaaatacttgcagcttaataatgtgccgcatattttatcacatcctgaattataaatttgaataaaattgtaagaagatctgatatttgatttaccttttaaaccgtgtttcaacctgcaagtagtttgcaagttaaattgttaatctacttgctgcataaataaaattgggcagtattaggaaagatgcccagggccgctgtctgagaccaagtgtctgtcttttgtcttatgtaatttgtgtctgttgcgtacttcagcacttgaaaaactattcctctgtgaaaagaggcccttcagtgttgctaggaaacccaggaactgttttatatgatctcaagattttaattcatttctagtgcaacacagtgaagaggaattgaaggctttaaccattttttgaaagaaaaacaaaaaacaaaaaaatctaaaagtcattaaaaaatcgttttaaaatatcataagcagcatactcatttaaaaaaatctcagaataaagcagaaatggacagttgtcttccttaaaatcctaattctcaaaagtagttgctgttaacaatttgacatatatcttttcagattattttgttacacatatatgactattttaaggcagttttttaaaattactttttatgtatcaaacgagaaagaaagataatataaaaactaagttgtattttattttgatcactttgtatagtgtaagtactgagaacatgaatttgggggatttcaacttttacaaatgtaggtgtctaattg

SEQ ID NO: 101874 - DNA, 1060 bp, Homo sapiens
gacatgactgaccgtattagtccattctcacaccgctatagagaaatacctaaaactgggtaatttataaagaaaagaggtttgattggctctgcaggctgtacagaaagcatggctggggaggcctcaggaaacttacaatcatggcagaaggcgaaggggaggcaggcacgtcccacgtggccagagcagagaagggggaggtgctgcacacttttaaacaaccagatctcctgagaactcactcactatcagcaagggggaaatccacccccatgatccagtcacctcccaccaggcctctcttccaacactggggattacagttcaacatgagatttgggcggggtcacaaatccaacctgtatcactcacctttcagagattctagccaaattcagttttaaacatctgcttgcatatagaaaccttctaccagtagaaacttacataatgtcaggaagttcacagcgttccttaagggaattgtatcaaataagatgatactacttgtgtcattctacttttacaaaggcacaaattaaaaactgggcatctcttgagtttggactccattcctcgggacccaaaccccgtcctgtatccctcgcatcaatgtgctgcttctgaatggctgcggggcactgtgtgggctgtcagcgtatagcaaatgcttagtcccttgtacatttctttctctagatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtggtaagtttgatatgtccttgctcgcttagcagctgtctgtgcaactatctgatgtgtccatcaccttgccagtcacatggatgggctgcagggagctaggaaggaagccccccaacttctcaggctttatggtctgggtgaggaaggcaattgctctggtggaaattgaggacacatgtaatggagggaaa

SEQ ID NO: 101875 - DNA, 1042 bp, Homo sapiens
tcgggcctgactcattttatctactcagcctcgttgccctgttccctgtcactcttacctcccccttctctcccttctctctctctggaggtgctggcacctagagtacaggctcctgtctgaggtcctgcagttccccgttcctgtgacagtgcagtgcctgtcccgctttagagcccaggactctgatcctgtgcgtaagataggggaagcctaggaaccatatggagagcgtgggtcttccgtgcttctgctgagtgaagcttgtgaccaggtgcatgtagagaccaagaagcactgtgccctgagccattagcgtgtctgttaatgagaagaagactccaagtcgtccatgctgagtgagaggcacggctttgccgtctacaggagttgtaagataaatgtgaaactgggacttgactctgagtgaccgtttctgggttaaaaacctagcttctaacctaaaacacagtcacatcagaccaaaagaaagaagggttaggaagagattgatgcagaagaggatgcatacatggaatttaaactacatatgttaacagagcccctattttaatatatttcagctagtagacagaatggttaaaaactaggaattggaggactgagctggaaaaatttgcattcttattccttatgtgatctctttagtcagcagttactgtaaacagcgtgcttgggcagtgttttgtatactttaattgtatatacttaagccttaaaacaacatagtaaggtgagaattattatacatatggcaaggaggaaacagaggcccagagattttcatgcccagagtaacaagtgcagttgggatttgaacccaggtccctctgactctcacagctgctctgttatcatttgcactgtcctctgctgcctcccgtgtttcataaacctgtttcctcatgtgtaaagtaggaacagctatacctagcatctcagggtcattacaagaattcagcaaaatactgtattcacacgcattctgtaagcttataaatgatattgaaatgataatcat

SEQ ID NO: 101876 - DNA, 1410 bp, Homo sapiens
caggggatcatggttactttcaccttgatacatgtgaactggaagcatgattgaattctggaaacatctgtgtggctcaatgccagtttgcttgcatccagccttggtctgtcttgcttttaactggattgtttaatttggagaggactatgtttactaacacctgataacaatacatactataaaaatgagtttgttttctttttcctccttccatagaaatgacttcatctgttatatctgtaaaaaatgcctcttctgagtactctgggacatacagctgtacagtcagaaacagagtgggctctgatcagtgcctgttgcgtctaaacgttgtccctcgtaagttatcttctttctgttggtggttttgtttctgttatctttataccacctcctttagttcagtcagcaagtgtgtattaaggacaaagggacactgactttgatcagaacactgtggtttgattattagcttttctagaaaaatacattttattaaaaaaacttcataattgcaatgatatattaagaaggtaagagttgtcaaatcaacccttgtaccatatttagctgttataagtatgagtagcttagaacattcttatatgttaaccaagatagctttgaatattaaaatctttcagacaggttttatcattttaatgcttggaatagattatacagttcagaagacagttctttttatgaatttttcccccggatcaaaaagactaaataatttgtcttaaagttaacacgtgatgaaatcaatctaaaaatgtatagcctaccttcagtatctatacatgtatatatgtatatattttttactattaattcttcttattttagcttcaaataaagctggactaattgcaggagccattataggaactttgcttgctctagcgctcattggtcttatcatcttttgctgtcgtaaaaagcgcagagaagaaaaatatgaaaaggaagttcatcacgatatcaggtaattaagtgagacaggagttgactgatgtataccaaatatatgtcatttctctaaagcattcgttctcttattaaccacccaaagcatctttcttaggagaatgggtaaaagctctggccgccttctcaatacatttgaaagcatttacttctaactgcaagtgcagagctccaaccaccattcgttgtgccccgctccccaaccttctcgtaccccattttaagaaccactgccaaatgattatctcaagactgcctgcttcttgagaagaatccctgcctgcagtggtagggatgaagtagatattgaggtttgaaaaaaaaactgacctgattgtatcaagtaatctggaagtttgtagaacaattggtagtataatttttattttccttaaatattctaaatcagtaggt

SEQ ID NO: 101877 - DNA, 2009 bp, Homo sapiens
ccatatgtctcatctgtgctctccgtgttcctttcctttttttgatatatgaaaacctattctggtctaaattgtgttactagcctcaaaatacatcaaaaaataagttaatcaggaactgtacggaatatatttttaaaaatttttgtttggttatatcgaaatagttacaggcactaaagttagtaaagaaaagtttaccatctgaaaaagctggattttctttaagaggttgattataaagttttctaaatttatcagtacctaagtaagatgtagcgctttgaatatgaaatcataggtgaagacatgggtgaacttacttgcataccaagttgatacttgaataaccatctgaaagtggtacttgatcatttttaccattatttttaggatgtgtatttcatttatttatggcccaccagtctcccccaaattagtacagaaatatccatgacaaaattacttacgtatgtttgtacttggttttacagctcctttgaaaactctgtgtttggaatatctctaaaaacatagaaaacactacagtggtttagaaattactaattttacttctaagtcattcataaaccttgtctatgaaatgacttcttaaatatttagttgatagactgctacaggtaatagggacttagcaagctcttttatatgctaaaggagcatctatcagattaagttagaacatttgctgtcagccacatattgagatgacactaggtgcaatagcagggatagattttgttggtgagtagtctcatgccttgagatctgtggtggtcttcaaaatggtggccagccagatcaaggatgtagtatctcatagttcccaggtgatatttttcttattagaaaaatattataactcatttgttgtttgacacttatagattgaaatttcctaatttattctaaattttaagtggttctttggttccagtgctttatgttgttgttgtttttggatggtgttacatattatatgttctagaaacatgtaatcctaaatttaccctcttgaatataatccctggatgatattttttatcataaatgcagaataatcaaatacattttaagcaagttaagtgtcctccatcaattctgtattccagacttgggaggatgtacagttgctgttgtgtgatcaaacatgtctctgtgtagttccagcaaatcaagctgagctttgaaaaagtttgtcttagttttgtgaaggtgatttattcttaaaaaaaaaaaagaaagaaaaagaaaaaaagataagaaggaggagtaaagggactactcctccttgccaaatgtgctaaatatcattttaggagaagaaagtgggtttattgtatttcccttaagattgtgagggagtgtggatacagtagaatgagccaacagtttctttataataaatacggtctgcaataaattatttcactagctctaaaacctttccctagattttagtagggagttggtttctgttaatatctttgggtgctgtggtggtaaatgctatattatgaacggtggcatgtatttacagttagagtattgtgtgtacactttttaatggtaaacttaagctgaatgtgtaatggatttgtgtatagttttacatatttggaagcattttaaaaacaggttttaaccttatgtaaaattacttttatactcgtgttaacattttcatctgtgccttttggtaatttaatttctattatgaatttctggtgcctatgagctagctatcacctacctgaaaggtgcttagaggtgaaggtactgtttctaaaaacacatcactgtgatacctttctatcctcacattttcaagcttgcctcttttctgttctttgtggatataacttaagcaattgtgttattcataaaggtttagaaatttcaatattcccaacactctatgtttctgattttataacagtagccatttttgaaagtcagatgtttggcctgttttatatgaataaagt

SEQ ID NO: 101878 - DNA, 1713 bp, Homo sapiens
tctcctgacctcgtgatctgcctgcctcggcctcccaaagtgctgggattacaggcgtgaaccactgcacccggcccagtactgcatcttaacagcaaagccattttattctactttataactgagagacttgataccatccatctctttaggttacagaggataatttgaagagaaatgttactgtagaatatatagttctgtactttttttttttttttttaagagatagggtttcactattgctcaggctggtctcaaactgctgggctcaggagatcctcctgccttggcctcccaaattgctgggattacaggtgtgagccgcagcatccagccagttctgtactttgaatatggagtagtttacagctatttttttttcttactggtaatcttaactaatatgattcccttgttagagagcctctcactcccccacccccaaaaatgtctactattcatgacagtaaccaattattctggacaaattgcttctttttaatttgagctatctgccatggactttctaaaatggaaacacagcctgagtgtatcttagggagagtttgattgaaaaaatccaaatcactatccatatagatcatggatataaagagatacctgatttttattaaaaagatactttttcaaatttaagagttaatcttggaaatttggaacaagtaaaggggcaagtaaaccttttgatgaaatataaaaggaactcattgcatgaagttgactatcaaattctgtgatgtgtggcttcttaaaaatattctcagtgtcttttgtgtgcgtgcagcatgtacatttgatgttatgtgaatgttgagttttttcttctaattttcacttcagcagtgtttagggctttcagatgccttattccagtgtgaacagaaaaagttcatattttatgtggttaatgctttgatgtgtcacataaagagtagtttgtagaaaatgttggcacaattttaacttcttagtggcttgtgacattatatattatatatatatatgtacatatatctttataacattcctgtgtttagtagtgtaaatgttctgggcaagttttaatattttgaatgcctttggatattccagcaataaaggcatcatgttctgcaataggatttcttactcatttacctattttaacactaaaatagaccacaactgagcacaaattccttttataaatgttatagaagcagggaagaataataaacacatttgtgaattgtggttcagtttatttatctttagggaaggctgatcatttatcttatagcagataaccccagcctcttattcattatggttaacttttataatttatcttattttataatttaagaatatagtacatatcagttgggtttggttttggtcatcgagactaaaagctccatcaaaacagaactttgtgttttctgctaacttatttaatgacacaagttttaagagaaccacaattcattgattcacttattcttttccctaattgtgaattttagtgataaatacacctgtactactgaggaaaatattctgacacttcacgtgtgcaaagtatagaactgacagtgtcagtttcagattttgtatgtacgatttctggcttatatatccaatggtgcagattttgaaatttgtaagaacaaaatttgttaagaaaaacaacttgctctagttttgtga

SEQ ID NO: 101879 - DNA, 1063 bp, Homo sapiens
ttacaaatttcaaaatctgcaccattggatatataagccagaaatcgtacatacaaaatctgaaactgacactgtcagttctatactttgcacacgtgaagtgtcagaatattttcctcagtagtacaggtgtatttatcactaaaattcacaattagggaaaagaataagtgaatcaatgaattgtggttctcttaaaacttgtgtcattaaataagttagcagaaaacacaaagttctgttttgatggagcttttagtctcgatgaccaaaaccaaacccaactgatatgtactatattcttaaattataaaataagataaattataaaagttaaccataatgaataagaggctggggttatctgctataagataaatgatcagccttccctaaagataaataaactgaaccacaattcacaaatgtgtttattattcttccctgcttctataacatttataaaaggaatttgtgctcagttgtggtctattttagtgttaaaataggtaaatgagtaagaaatcctattgcagaacatgatgcctttattgctggaatatccaaaggcattcaaaatattaaaacttgcccagaacatttacactactaaacacaggaatgttataaagatatatgtacatatatatatataatatataatgtcacaagccactaagaagttaaaattgtgccaacattttctacaaactactctttatgtgacacatcaaagcattaaccacataaaatatgaactttttctgttcacactggaataaggcatctgaaagccctaaacactgctgaagtgaaaattagaagaaaaaactcaacattcacataacatcaaatgtacatgctgcacgcacacaaaagacactgagaatatttttaagaagccacacatcacagaatttgatagtcaacttcatgcaatgagttccttttatatttcatcaaaaggtttacttgcccctttacttgttccaaatttccaagattaactcttaaatttgaaaaagtatctttttaataaaaatcaggtatctctttatatcca

SEQ ID NO: 101880 - DNA, 1080 bp, Homo sapiens
ccaaacgctggactaggtgctttacatggattatctcatgtatgttcttgaggtctatacagtttgttcttcatttgttcagtggctgagccaggataacctctaactccagagtccaaactcttaaccattacatttacttcttctaacagaatccttccatttatcttaaatcatgagtaagcacaaatctttcccacctgagttgattgcatacacatacacacacaaacacacaaacccaggaataagcatgtcctatgtatgcaagcctcgaaagcactaacttgtggctataatggatccctttctaacatagcaacaaaaggaaggaaggaggttaagatccattctgtgtgaggttactacacccgtaggcagccttgtagatccattacaagctaattttaacagagatgggaccagatcataatgaggtctttctggtaaactgtcctcaaagaaagggtccaaaaaggaatcccatgtgatcattaggatagtgctgaattttaaaaatctctttaagatatttctctcttcttcctcagcctttgagcaaactcaaagagaggattatacatttatttcttagttaacatttgggtatttaatcattaaaatatgtctgttcactgataccagggggagcaaagtggatttcgagtgtgtgtcagcatggccaaatcatctgatggctattttggatgagatggtagcgtatttcaagtattgctctgatactaaaatggatgatgtacaacagttatacatatatgttggagaaaatctgaaaaacaaccaccccaagttaatctcttaaaatttggtatatctttcctatgactactatagacatttaaaggtttttattttaacatttaaaacagcctatggacgtttctgttttttgcagaactttaactgctatgtaaatttcttcacttaactgtaccacaaatcttttgcccataacattacaagaagtttaaaccaaatctatatatacatacattcataaagctctcctggtctactatatagcacatctttatcatgtcccgaacacagcagatagta

SEQ ID NO: 101881 - DNA, 1037 bp, Homo sapiens
gcaaataaaaaatagtttgaggcatgacaacgcgtgtttctgttgtgtgcataaaaggggaaaagaacgggtatttcccttcaatgtatttaactaaatagcaaaaacattaaacagaacgtaagaattttaaaatttcctttgaaaaatcaactattaaccatacttttcctaaaagaccacatatcagaatatgcatatgaaaagttaaaaatttgttagtggtagttattgaaaatataataaaacatcttttaactatcagtgtcactatacatagggttttttaacaaagaatttggctcgtactaattttgacatgacatctgacttacatgtctaatgccattgcataaagtagatgtgttcttacagctgctctaatctctgtgccttgtgctttttttaaaaaacatttaagtctttactagaggcctaaaataaagtcaaataatacaatacttcagattcttcagtagtccatatttatacaactgtaattccatcagtcttgtaagggtacttgaactacaaaaagaaaaaaagagatatctctataagagttttgatttttctccaaaggtaaatttttaaaaactaagatcagcaatactttttccatcaccttcatctttaaatttgcagtcttaaattatttgacttaccagaaaaatcacaacttgctaataaatcattgaatggccatggctattccacaaattattgttatttttaggaagataaattctgttgaaatacaaaactgcacaaatcataaaggtatagctcaatagtatgaaaatgtcagtttttaaagtttgcaacttcagaaaactcatttttaaaccttagagacttttctagctttaatattgtactctttaagccatacacaattttaacatctctctaaaccatatctactcttttcctgaaatctagtgactgcctattcaaacatgagcatgtttgtttattagtgtcacaagggagatgcgttttatcaattttttttaaccaaagttattgaaagaaaa

SEQ ID NO: 101882 - DNA, 1050 bp, Homo sapiens
gtcattgctatactatctagctgtagaaaaatgagaaggatctttatgtattgatatgtttctgaaatgtattattatgaaatgtaaaaagcaggatacaatccagtatacatatatatttttaaagtgtgtatagatgtggatagaatatctctaaaggtatatttaaaaaaatgtttggtgtcagttgcccttgagaagggttaagataaagaagataaagggtgagataaaaaaagagggactttccacagtttacccttttgtactttttgaattttctatcatgaatgcaatgctatacacaatataatttttttaaaaaaatcctatacttagaaatgcagatttgagatcagcaaaatcagaaatttaagaagatgtggcattctaagcagagaggtctaaaactgctgataagaacactttgaataatgtgaacctgacgtgcccacctgatttatgggataatctaaaactattattcccaaatactaaactggctacatcagaatcacctggggagctttgtcaaaatacctggcctctagttctgagattttattattgttcattagaccagtgctagggcatgaatgttttgtgtttatctttttttttttttaacttttattttaggtttagggatacacatgaaggtttgttccataggtaaacatgtgtcacagggatttgttgtacatattatttcatcacccaggtgtgaagcccagtactcaatagttatcttttctgctccttttccttctcccaccctcccctctcaaatagactccaatgtctattgtttccttctttgtgttcataagttcttatcattacctcccacttataagtgagaacatgcggtagttgattttctgtttctgcattagtttgctaaggataatggcctccagctccaatgttttgtatttaaaagcctccaagtgactcctggcttagccagctgtggaaaccactggactaaaacaagcatgtccttacaagcttccattcgttccatgttttggtcttttttggttgaag

SEQ ID NO: 101883 - DNA, 1021 bp, Homo sapiens
accaaaaaatgtcatgtggtctgacatagaggcaaaaatgaaaaagctaaaaaatcagcacgattatgttatcacacaatcaaatagtttacgttcaatataatgatcctaaaccatcaggggaaagtttttatgtccaaggatgtttaacaagttacataattatataaacattttggacctatgtatttaaaatgcttaaaataagtctcagtacctgaacataaaaactttagttatacggacattctacttcagtagacatttcattacttgatgatgcctggtaggaaaaaactgctactttgctttcatcttattaatcttagaaaaccttttcattcagtaggcttctaatttatatgtaaatttgccaaaaattggctctgatgtgatttttttcacagctaatagaaatcacctgcgagtgtcaggtgttcattcaataacagaaccccaaaaagaaagacgtattaatcgtttagtagaggtggttgatataagttaacagaagaaaaagacattgagaaatattttttcaccaaaactggaaacatagatattttgaaaattaaagctgatctagcaagtatacaattgatcaaatatctgagaatctttaaaaataataactcattggtatactagagactaagattgtaaaaaaaaattgagatgcactgagaacattcttcatagtcttcacttactctgatagaataaaatgctgcaagagtacaaagagtgccatatagttagaaaggttatcacttcgtgatacagaatagaaaataaatcttgcctatgatgagaagttctgagaacagatgccagcttatctactcaacatattttacaactttttttttttttggtgatttctgccatcctttttttcccccaatagagtgttaaatactattgattgtttctaaataactaaattagccttgatgttttatcagtgatcattgaaaaatggaaagtttaaaagttgtccaggtgtctactaattctccta

SEQ ID NO: 101884 - DNA, 1084 bp, Homo sapiens
tagaataggtggagtgttctttctcttacaaaatgtttgtaagttgaaattgtttttctgcaatataaataagatacttgtagagagcaatttggcaatattatcaagatctataaaaatattcataccttttgaacagtaagtctcccaagaatctattctagaagtataattagaaatgcagacgaacatgtatgaatatggatgtctcttacactttgtaattgcaaaaatggaaagaactaaactgtcaacattaagtaaatgatagaatatttttatgcaacttttaaaattttgtttttgaagagtagttaatggataagtagtatgtagagtgaaaaaaaatagtacaaaacatgtaaggtatgcagattttgttgaagcatagtctctgtttaagcatctatatttatatataatttgtaagcttagagcctgtatcaccttaattgtagataagaaaaacacatacatctaagatatatctttttatccttaactgcttttggtcccagagcacatgggatctttcaaattaccctatacaatattagaatctatagcataagaccatgtttttaaaaggactaagcagtattttacatactagaaaataatttttctcactttgcctttgttatattgttaatggtgacgctaagataggtacgtatatacagggttgagtattaaggaaataacttgctctttggagtctagtggcctggatttgaaccctagatccatcacttagtagctgtgtaatgttgggaagttactcaaactctctctgcctccttttttctttatgctgaggaaaaaagtatctaactcacaggatgatcatgagaattaagagttaatacatgcaaagcatttaggaaattgtccattgcataataaattttttaaaatgcttattattgttaatattattatgtagaaacacttattcctattacctgttgagaactttttcattttttaaatagaaattaaaaccaactaataatttaacttttacaaaaactttaaatagcacattagtctttatatcattgtattttacagcgtaattact

SEQ ID NO: 101885 - DNA, 1078 bp, Homo sapiens
tttagccaacaggagcaacgtgctatctttatggaatttcttcatgaagctaagtgataagatttttaagtagtattttataataaggcctttatggcataaagataagtagattgttctctacttcagatataagccaaagaaatacaagataaaattggaaggaggaaggggagagctgtaaaggaggtatatcttacagagcttcatcttcccagtttttatattttgtttttctgagaaaacatgttttatctttgcagggaaaaaaatgaagaatgaaattgctgccgttgtcttctttttcacaaggctagttcgaaaacatgataagttgaaaaaagaggcagttgagaggtttgctgagaaattgaccctaatacttcaagaaaaatataaaaatcactggtatccagaaaaaccatcgaaaggacaggcctacaggtaaaggattagattggattaagcagaggctgatcaacccctgaggtgggttcaaggccggatgattgaagggtgtgcagaccatgcctacaggtgtttcatctgcaaaatatagaactctggggtgtttgtatattttctccttactcattttaaaacaagtatttgttggcggagtggtggagtcccactgcctggacacaggaggccaatgctatggggtcaaaggagttagtcttttgtggttatagcctggctcctaacagtgcatttctgtttatcacaaatacttagggattttcacaattctagaggacccctaataacacattaatgggcatggtaggagttgaaagaagtgaatcttgcatctaaaagtaaattacatgttatatgttctttgaaaaaaaaaaaagtatggaaaaagggaactaagattatcagacacctgatatgtcgttaatacaagaataatctcatttatatatttgtggtagaagtcagtgtaactattttctagatgaatgtgactcacctgtgatccacgactagtaaataatggctctgggatttgcttttctgggagttttttttttttgtggtattgtttttgctctgtcacccagtctagagt

SEQ ID NO: 101886 - DNA, 1751 bp, Homo sapiens
ttgctggagagtcgcgcctccgggaagccgggtcctcgaacccagggccgcccgccggggacagcggacccgcggggcaggcgcaccctggcgaggatgttgtcggggaggctgggcattgggcgccagggcccttccccttgaacttggggaaaaccgggattgcagaagttgggcgcagctcaaggcggttctttcaagagcgggtggagatgtttgatccctcctcacctacctctctcaaaaccccagcgggagagcctagcagcaggtttcgatggcttcagaaagtccaactcttagccccttggaaaattatttcccctcttcatggctttgtggcgccgctgaggtcgggccggggctcctcaccccacgggccagtcttctcgcgccctccaccttgggaacgtctatcaggagaaaaatgtgttcctagaaacgtttgcgattagcttttcgttacaagggagggaaaagtacaaaagttataaactcctgcgaggccgagcttgattctggattccctttgggttttatccacgcagccgtgagcagaggagccttgtggaacaaagtagaacttgaggagcagccgccgcggtgacgaggtcccaggatgacgtcaccgtgcgatatttaaaatgggagccttttgctctgagtgtgggtggaggacgcctacttactcaagacgcctgaggtcttcttggccctgcttgcctctggtggttcttgccctgactgtaactctccctctttcaccttttggtactcctagaatactggtgggagtgggcttatttttcagctgttcgagctatcatttcttcaaacggggaaaacaaaagtccaaatgagtcatcttgtgttacaaccaaaagcaaccactaagtggttctttccttcttttctatttttttatatgaagcagagcaaacagaaacaaatccagaactcagatatgtggcacatagttggcaaatgtaatgaatgaggagaaagatctagttaaaagattcagtacatttctttagtgtggttccttgtttgctttgctggagtggaggctaatgtagttccatcagcaaaactttcttcccaacccgtatattaaattgccttgggttttcttttccatcgtatcgtggtggaatataaacgtagctttacaaagtggaaatggcttacatttttcaggaggaggctgcacagcagtcgtggtgggctggggttatgtatacgtgtacactcgtgtgtggacccatgcccggtgcctgctagctggctgtagaaggtgaatttctcattctagggttctgggaggaagatttgtgtgccttcccctccatcaggctatctgcggctgccagcacacctctcagataactgtgtagaatttatttcacagtgaggttccttgtttgaatttgcacttggaataaaggagtcatattctgaagagagactgaaagagcagtttgagaaaagaaagctaacaatcagctttatttttttggaaatgtgggaacacaaactactgctaggttagttgtttttatgctaaacatagcagaggctgtatgtttttaatacgtaattggctcccaaaaaggtgatgttgcttactaaaggcagcatcttaataactccaggttacagcagccagatgaatgagctcactgagtagagacaacatacatcaaaacaatcttaggacaagggtttgcccttaaggattaatcaatgat

SEQ ID NO: 101887 - DNA, 1003 bp, Homo sapiens
tgtatatttatttacattatcatgtgtgaatatgttcacccatatttcaggtcactgcattttattctcttaatacaatgttttcacaacggttaccttgctttccaaagataaatatattttggattagaaatctgagttgttttaatttctaatacctcttgtaaaagaagaattaataactttttaaagcagtattcaggtaaatacaatacattattttgttttctaacaaaagcagttcttagttcaggaagaaaagactaatctggcttctatgtcaatttgtctccatagaaatgaaagcctcctcttgcttctttcattattagcttcacaccagtgactgtgatgcattagaatttggacagagtaagtcaagcctcacttccaattcaaatataatgtctatcttcaaattgagtgtgctgtgaaattgttctgtctttgaaaaaaaaaagtaagattattttgtgtgccactttgggtaaagtttcaagaatacttaaactgtccaaattgtattatcaccatcattgaacttagtgctcaaagaaagcattgtgaggtatttttctaaactttagactctatagagaaatataggattgttctacagaagaaaagcaaaactcctaattaaaaaaaaataaacctatgtattaagagaatgttctcgtaagttgcctatgatgcttccaaagagtttttatctaacagattgtgccaaacagctagataaattttaataatgtattacagtaaaggctataaccaatgcagaattaaaatgggctctaaattctgtttttaactcatgtttagaatgtacttatgaggtagatccttgcttgaaagtatctgctgaaaagcccagtaacgtggcagcttcatgcataaagatataaatgacatttgccttaaatttggcagcctaccctggcttgggtcagattttgttgttgaacacaagaaagtatttaagcaaagaaacacttcagtt

SEQ ID NO: 101888 - DNA, 1051 bp, Homo sapiens
ttcattggacctactactattttttggtgaaacttttatttcattggagggtggtgatgtactgggagtgataaaaaatatgtttctggccaggcacagtggctcacacctataatcccagcactttgggaggccaaggtgggaggatcactggagcccaggagttcaagaccagcctagacaacacagggagaccccatctctacaaaaaataaaaaaattaggtgtggtggcacacgcctatgattccagctcctagggaggctgaggtgggaggaatcacttgagcccaggaggttgaggcaacagtgagccattgatcgcaccactgcactgccacctgggtgacaaagtgagaccctgtctcaaaaaagaataaaaataaaattttcttaccatgggttgtggtcagggtttgaaaacttctactccacacttacgagcgttaatggttgaatactggagtactgctgaatgttgtgttggcagttaagtgctgatttttaaaaataggatattgtgttggtgatgtaagcagcatgttttcctaggttgttgtggtaatagtgaatacattttcatgtttcagtgaattcgatgactcttggtgaggtagagcaactgaatgcaaagctcctacagcaaatccagggtaagaatcactgtcagtacttttttgtgtgtgacaaattttgacatagaaaatcatctatgataggacaccactggctttatctacatttaaatttggaaatgagatattcaaacctgttagagtttccagagcaaaaagaataagaaagaaacaactttcaactgcagaggaaatacatttttccttttttttttttttttgcgacagaatcttgcttcatcaccctagctgcagtgcagtggtgatcctcccgagtagctgggacttactgtcattacacccagctaattttctattttttatagggagggggtttcatcatgttgcccaggctgatctcgagctcctgggctcaaacagtcctcctgcctcagcctcccaaagagctggcattac

SEQ ID NO: 101889 - DNA, 1046 bp, Homo sapiens
attggcttgctttcttttccatagaggaaaaaaaaccttttttttttaagctagcttagctttgtttagctttttttcctttcttcattttattaaaataagggtttcactatgttgcttaggctgaccttgagcaattctcccacctcagtctcccaggaagctgagattacaggtgtgtatcaccttacacctagctaaaacttttttataagattggaccaattcctgttacacaggttgagcattcaaaatcaaaaatctaaaactttttgaacacctacatgatgctcaaaggagatgctcattggagcatttcagatttcagatttttgttatttggaatgctcaaccagtaagtataatacaaatattccaaaatctgaaatttgaaacagttctggtctcaagtatttcagataagagacattcagtctgtaccaaacaaagttttcagtgtaagttgaccttgctagttgatgagtaagtatgtatctggctgctctctgtgtagagcctcttggattactttcagttagttctttctagaaccattctagaaggagacccaaagtcagctccttagcaatctttccaacaagaaaaatctgtaatcttggttaagtcgtagatgaattagtgtctatgtttaatcttactgttccttgattctccgtgtctttaccatatactgtttgtggtcagtagtcagggaccaatttgaatctcaatatgaaattcttgatttggtttggaagttagaactggttgtttattactcgaagggaacataaactgttcctctatgtcctgcttctgacactaacttttttccacttaagtaaggggccccaccacttgtgatcaggaagctgtaaagagctaattcaatctggcattagcctctttctcatttcccatcctgtaatggcaaacatcatgtattaactaaaagttgcactttgaagtataaagcctaatgggaattctgaactttagcttggtgatctttaatatacttatcttagtctattttgagctgctat

SEQ ID NO: 101890 - DNA, 1019 bp, Homo sapiens
actgtcattttctattttaaatgtgatagaactgaaccttggcgacctaagaaatacagtttgaagtcacacagctcataactgttggtcctggactttaaagcctggcagtctggttctagtatatgtgatcttaataccattgatctactgtcaatagttattttatagcaatagggctgatgttctaatcctaattggttatccttgctattctctcagccagctttttctaaccagtgtttgctggcaaatcatcattaatggagttcatgccatgatcgaatttttccacagaaccctaaattttcgtaattgcttttctagctttttaaaataagccttttaactggttctcagtcattatatagagaatatacaaatattaccttaggtaccatctcttaacatttcagctctgataatatctcagcatgtaagcatggaataagtcctttgtttttgaaatcatagttcccttcagtgtaaaagacaattctcaatttgaattagaactatttcgtttaatattctatgtatattcaaggttttatatattaaaatcccaatttaatctttgtaagaaaaattagagtcaaataatttcttctctatctggtgtcatttctcagctctcacaaatacgcattttcattttcactacagtgatcagctagtgtattacaacttttttgtttaagatttttgtaggccggcacagtagctcatgcctgtaatcccaacattttgggaggccaaggcaggcggatcacctgaggttgggagttcggtaccagcctgaccaacatggagaaaccccgtctctactaaaaatacaaaattaaccaggcatggtggcacatgcctgtaatctcagctactcaggaggctgaggcaagagaatcgcttgaacccaggaggtggaggttgcagtgagctgagattgtgccatcgcactccatcctgggcatcaagagcaaaactctgtctcaaaaaaaaaaaaattattttagaaaaga

SEQ ID NO: 101891 - DNA, 1077 bp, Homo sapiens
agtatttgagtgagatgagcccgaactcttttctcaccagtatgatcttattatctggaaaaatactttaaaatttttagattaacctcttttcagtgatcacacacactgttggtaatttttaaaacctgaaaaggtttttaaaatttttttaataatgtccctaagatatatgaagaaaaattctccaaatccaaaaagaaaccccaaaaaaaagccctattggaaggatttatttgggttggtgcagttagtgttgtcatattacaattgatttttggtttagatatttatgagtcatactaaaaaaaaccttaatattcctgcaaaaaaaatttggcctgtaatttgagttttgagttgtaacatatcagtagagagactttattaaacctctagattttggacagtttcaaaatagttctttccttttttctgtattatatatttgaaatttttcatgatctttattttctgtttactaagtatggggtatgaaatgttcttattgtttaaaaaaatatagtgggggattatataccttgaaattcctgttaggacttgttattcagaaattattatggtcaccaaacagtatgtgatggaagattatggatttcttgtggattacatagaatatctataacttcagctttaataaatgtagtgattatagctaatttcaaaagatgacataacaggaacagtggtgtgttcctacaatctcagctactccagaggttaaggtgagaggattgcttgagcctaggagttcaagtccagtttgggcaacatagcaagaccccatctctaaaaaattaaataaaaataaaaggatatcttaaaaataagtttcttttacagtacttaaatcatgctggggtgaaaatccaaatttatgttctttggaaatagagttggcttgtatattgttgatacattgtagaattttaattttagatgagtaaagacattagaaattatctagtccaaaccctgtattttacatttaaggaaacagccaaaaagttggactgcccagggttgctgtagtggtgatggcaagctgttgttatg

SEQ ID NO: 101892 - DNA, 1285 bp, Homo sapiens
aggccataggtgacactatgtccgtgtcttttttgtcctatagttgattgggttagtggcacctgaaggaaagagatttgccggcattctagtcctcctccttcgtcccccaacctcgaataatcagagggcttagcagcgaggccttttcagctaccaggttctgtcaacctagttaacgctgtgagaaacaggaaaaacgacctgcacgggacactgctttgctaacttcattgggggaacctcagatgcgcctcgcgaactcggagttgcgaagcttcgcatcgaacggagatcggcggcagcaaaatgcacgtgggtaccgaatacccggggagggcgtcccgccgtgtccggggcaactacaccgaaggccgagcggcggcttcacggtaccggccgggcaccgccggaggggcccaagccggagctgggagagccgcggcatcctggagcccggcgggcgggagagcctcgtcccatcgctccgggattcctcccagagggaagaaagcgtccgagggccacggcggccggtccgcccagcctcagcgtctcggggagccgggtcctggcccggccttcggcgttgggggcgcgcggccgcccccagggagtcgcggacccaagtccgtctttccgtcggtctgtccgtcggggcgcctggcgcgcagcagcgcgaggggccacggggctcggaactcgaaggaggcggaacgatgggactgggggtcggggctcaggtgggatgggagcagggctgcggggtctttaccgtccggctccgcgggccaccaccgccgttccgtgcggctcgggttcctccactattgtttccggccgcagcagaggcggccgccgcgcgcctggccccgccctctcccgccggctccatcccgtaaaggctgcggggagggtggcgcggccgcgggcacacctgcgcgctcgccgggctgctgtgggtccgcccctccgctcctgcaccgacgccgcaccttcgcctcgagttctcctgtgatcccgtgtttcctggccggagtttcttaccgttctctggaacgtagctcctcacacacccctcctcgaggtgcgtagatagacgaatccgttccacctctcccttcagcctagtgcaaactactgccccggggcgggggccgcaggcggcgggggtaggaaagccgcgggtggatggcagaacgggagaggtgcgtgggtggcactttgacttcaggagaaagaagcagaatactgtcactgaacttatagttaagtgccagttgaa

SEQ ID NO: 101893 - DNA, 1099 bp, Homo sapiens
tcgttagatacttcaactggcacttaactataagttcagtgacagtattctgcttctttctcctgaagtcaaagtgccacccacgcacctctcccgttctgccatccacccgcggctttcctacccccgccgcctgcggcccccgccccggggcagtagtttgcactaggctgaagggagaggtggaacggattcgtctatctacgcacctcgaggaggggtgtgtgaggagctacgttccagagaacggtaagaaactccggccaggaaacacgggatcacaggagaactcgaggcgaaggtgcggcgtcggtgcaggagcggaggggcggacccacagcagcccggcgagcgcgcaggtgtgcccgcggccgcgccaccctccccgcagcctttacgggatggagccggcgggagagggcggggccaggcgcgcggcggccgcctctgctgcggccggaaacaatagtggaggaacccgagccgcacggaacggcggtggtggcccgcggagccggacggtaaagaccccgcagccctgctcccatcccacctgagccccgacccccagtcccatcgttccgcctccttcgagttccgagccccgtggcccctcgcgctgctgcgcgccaggcgccccgacggacagaccgacggaaagacggacttgggtccgcgactccctgggggcggccgcgcgcccccaacgccgaaggccgggccaggacccggctccccgagacgctgaggctgggcggaccggccgccgtggccctcggacgctttcttccctctgggaggaatcccggagcgatgggacgaggctctcccgcccgccgggctccaggatgccgcggctctcccagctccggcttgggcccctccggcggtgcccggccggtaccgtgaagccgccgctcggccttcggtgtagttgccccggacacggcgggacgccctccccgggtattcggtacccacgtgcattttgctgccgccgatctccgttcgatgcgaagcttcgcaactccgagttcgcgaggcgcatctgaggttcccccaatgaagttagcaaagcagtgtcccgtgcaggtcgttt

SEQ ID NO: 101894 - DNA, 1616 bp, Homo sapiens
aggaaataattgtacattttttttcaagtattttgaagatacaattgggcaaaaaatgatacggccatggctgtaagatgtatatccaaggtaggttatatttgtaagtatgtgagaaccataaacatatttcagtatagatggaaagaaaacagtatgaagcggacaattcaggaaaagtaatcgaattgtattatgagatcttttgcaaaggtaaaaggcaatgctgcccaggaggcacctgtggaacttggcttctgacagaaggagagaattcttctcattgttacaagaaataaaaaagcagtatcagaagggtgtatattaggtccagttaagatctgcataaaaaaacaaggtatttttatttgatggcagtaattttctctgtgactagaaggcaagactgaaggtgtgctggtaggatggcgtcttaagaagcaattacttggctttgcagacgccgccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacaggtcctggcatcttgtccatggcaaatgctggacccaacacaaatggatcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccaggtcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaaacaaaaaaaaagaagcaattacttagaaaatgttgctgaaaagagagcatacaaagtagactaagagaaggacttgttgggcaattttaagaccccataattagtgagatttgagtctccaatacgttttgttagattttcttcatcagaaggctgtagcccacataaagatttttttttaaaaaggaatataattcaccaataaggttttgatttaacctcagaattctctgtgatttccccccataaattactattgtgaattctgttttaaagtaatatttaattatcacatacaaagctgaccttaacattatttgctaaaatataatttctagaattaccttcatatcacatatgtgatggttaattttacatgtcaacttggctggatcacagtgtgtagatatgcgatca

SEQ ID NO: 101895 - DNA, 1057 bp, Homo sapiens
gaaaacagtagcctagatgaacatgttacaaacttttgatatgcttggatcccctgcccacaccccctgcctgcagctttactgaggtatgattgacaaataaaaattgtatatatttaaagtatataatgtggtgttttgatacacatataccttgtgaaatgagtaccacaaacaagctaacatatccatcactttacctagtaaccagtttgtgtggtgagaacacttgaaatctctcccagaaaatttcaattatgcaacatattattaggtctagttatgacgctgtgtgatatgcttgccttttgatatgcctgttaccaggaacggttttagatctgtgaataatgtcatttaaatataacctgtatgactacatagatataaactaagtcaatgtatttaaaaggtagtaagtgaaacctatacatggtagataaaaaaggaaacagactagtaggtcagagagtaaataaaattggtttccattctgcactttgtgctctgtgaggtggtgaaatttcctccttgcctctgtgttctgcccaggtgccagaattggcagctctcctacagaatgttcacttacatattaaaaagcatcagttatcacccctttcataatgcctttgggtgcttcttggctgagaaaaattattaaaataatgagggtttcttactcctggagaagctaaactgttaatggtttctttctacttaggctattaaaaaaaagatggttttctgtccaataacacagccaaggctgtggttatttctcactcttaaattgctttctctttctactttatcaacagagcagtctttcttggcagctctttcagatactggccttcactaattaaattacaagcaaataaaaggaaagaaaagggaaggagaaagcagctttgaagacagtcatgatgtctttcttctccctcctcaggtcgtgtttgttgctccccaatagtagctcaaaatactagagtattcattctgtttctattgtataacccttgtcctggcatatactataaaggggtaataccag

SEQ ID NO: 101896 - DNA, 1067 bp, Homo sapiens
aggtaggacaggttttggggtgttgaattcagatttagccatgtctgtttgatgagtctgagtgacacagaatagaaatagggacatagagatatctatttagactaaatctgtaatatgttctattctaaatggaattatactccaaaagaaaataaactgatttaaaatagcttgttacagcacttcaggtgttttttcttacactaatgattttgttttacggctgaaaagtaaaatggccaacttgagaagcctaggtataatatgccttagattatatttttgaatggaattattgttctttacctgataatttatattggttacttggcctttaaatctttcttcttacctaactttctattctactatttaaggggaaagataaagggtcattataagagggctgtggaatgatttaaaatggtgggtgaagggtaaaactgaaagtgtttattaggaaagtaaagctattcatgtttttacaggtaactgaagatcaaagtaaagcaacagaggaatgtacatctacctaataactttctaaaatttaaatatgtataataaaataaatgttttaaatataatgtttgtgtgtgcttatacagattaaccctttctccccaagattgatagtgatctttactttttcttttctctaaagtatgaaacacttcatgttgcttaagtaaaaactgtacaaaaacaggtcactcccttcctgctccatggatgcaacactttagcatgttttctctattttttcctacagatctaggcagatacatacaaatataaatgtaatttctaaaaaacataaataggaccatactatacttgcttgcgttttttgccgaacagtggcacagtaaacatccttgtgcaaaaatggcaaatgtttgtagataagtaatattaactgagtatttatcatgtgctgggtcttgtgcgaagcccatcacgtgtggaaccttttctataatcctcatagtgacctgttgagaagatgtttctattttttaaatgaggaaacagcatagagcttgaaagtggtaaagtgggaa

SEQ ID NO: 101897 - DNA, 1052 bp, Homo sapiens
tgaattctcagcttcgttacatgggttattgtaaggttgtagatgatcggttttaggcaattggatcagcttgatagcatgatgtgttgcgtgactcttaaagaccttaaaacctatatcaatgctaattaagaaaatggttcatttgatttaattttcaaagttttagcctctttacttgagatcattatgtcaggggtcattagaaactgaattgaaccatatataatgttcttgattagggatgttagcagcaaagagaaggaagagatttctttttcaagctcttacaaattatttgatgttgcagttttgtttatttatttttaaatcaatcagaataggtgacttcattgatgtgagtgagggccctcttattccaagaacaagtatttgtttccagtatgaagtatcagcagttcacaatcttcaacccacccagccaagtctcatacgaagattccagggcgtgtctttacctgttcacttaagagtaagtaaagcttaaagttctaggtcttccaatttgggtatagatataattccggacttgattttataccagtttgaagaatataaacttttaatttttcttaagttatgtgacactaatattttataaactcaggtttatgattaaaaacaaagttgcccagggtgtaaatatacaattacaaaagaaacattagttgaaaaaattaaattgacatagcatttaaaaatttcaagttagcataggtgagggtacattgacagagggggtattagagtgcgtattggtaagacttcctggaatgccttttaagcttaaatttggcatgctcttccctctaattttaatgatccatcatgacccgaagcctgacattttccacattgctcccaccccttgctaatctttttatttaaatttttgattttgagataattgggttataagacatagagagatcccatgtacctttacttggtttcctcaatggtagcatcttgcagtactaaaatacagtatcaccaccagggtatggacagcgatacaatgaagatacagg

SEQ ID NO: 101898 - DNA, 1050 bp, Homo sapiens
tgagcaacatggcaagaccctatctttaccaaaaaaagttagcccggcatggtggctcacacctgtagtcccagctacttgggtggctgaggcaggagggtcgcttgagcccgaagtttgagactgcagtgagctataattatgccactgcattccagggtgggtgataagagtaagaccctgcctcaaaaaaaaaaaaaaaaaaaagaacaaagaaataaaaatggaaagaaagaacacattgagaagtggaggtgagcattggtattaagaaaatgaggaccaaaaaatgtccactgggttgacaccaagcaggtctgtgactttgttgagaacagtttggcagagtcatggggctgtggccagattaaagggaggttccaagtgtaacctactctcagaaagtatggctgaagaggaagagaaagggaggtatctttaaacacctttttacatattttgagttaaaaaaatgtttttttctttgctgcttttcaggtacaaagtagatttcatagaagagaaggcatctcagaaccctgagagaatagtcaagctacacaggtaagtaaaagtctaaaaactggctgctatgttagagtaaggcttagctttattgttatctgaatgaagcatatgaccaaaaaagatgaatttgtgtcttattttgttcttattaccttatttttggttgcttcgttcattgttttgttatggtggtaaatggaagctttaaattatcttcaggaacacttgtggtttctataatcctcattttattgtttgctatttttatttaattttgagttgaaaaccactgtttaagaatgtaatttttaggtgttttgaaactgggcaagatagtcattgtgatgaattgaacatcgtaattcatatgaatactgactaactagtaattacttaagatacatgtaagttaagccagaatgtgctttctcaagcatggatgagaaaggtccactgcttatgatgacgttctcccatggggagcaagtcccaagacaatgcattctgcagaaatgacttcat

SEQ ID NO: 101899 - DNA, 1044 bp, Homo sapiens
agatttcccattcctctaactgtcaaggactggtagcggcttctgggacttttgtaacttagttgagtgtgtggtaggaggaaggggataattctggaggaagcttgataggacaaaagagttggttcattgaaggtgggtcagtgattgagtccttctgctgcaggagtaagggtgggacctttttgtggctttgactctcaggggacaggagcatctcttggaggtgggtcaggagggataagtattcaagggaattggcacccttattagtgcctgggggactgtagcagtcagtgggtgtttttgcataaaccagtgttccctaactttgccacataattgtgcatacacctgtggtgcacctacacatattacttgtttagcaccctgaggtaaacagacaaagctctcaatagtaaatggtaaagtcatggtttgaacctgggctgtgcagtttcatctgtgcctttagctatactgacagaattgggtagatttgagagatactgggcagtcaaattgacaacttgataatgaattgaataaaggagatatggtaggagaaaggaatcaaggaaatctcccaggtttttcacatggacacctgggtggttggtggtatcgtactaagacaggaaattcaggaggaagaacaagtttgggcggggaaagaggtggtaatttgtgcagtttgcaaatttcagggtaaggtgcttgtggaacatcctagaggatgtccaaatgggtcttggatatacagtttggtggtcagaagaggtaggtagattagaagcagagatataggacatacaactacataagttgtagctcaaggggctgacctagggaggatgcttagcgtgaaaagagggtgtaggatagaattctcaaagggtagagaaagacaggagtggccagagatgtaaaataacaagcagtaaggaatgccactgatacccatggaaagagcactttgaggctggatgtggtggttcatcgctataatcccagcattttgggagactgaggcaggaggattgc

SEQ ID NO: 101900 - DNA, 1402 bp, Homo sapiens
acaggtatggtgcaggtttctccttgtgactgatcaggtcattgctctgataccatatcaggcatgtccatgaatcaaaatgtgctggtaagatgaaagcccagttcctgctgctctgctataaatatgagtaatctgaacgatgtgttagggtgttaggtagaggataagagtcactaataattcataaaagttgagtttttctccatatttataaatgatacaaagttacataattaatatatttattttactttagcacaagtttgttaacaagttaactttatcgtgggttaaaaataaatactttcaggtaataaaactatctgtcggggttgataaccattatggtgtttgaaatcttgcacagaaacattgctaagaacctgaggttcatgcttcattcttttttgatttttgcttggtcgaggtaacgtcatggcctgatggcaactgttgctacattgtgtgaacagagatatatgagaaatattttctaagtcagaagttcacttaaaatttaatattgtcaaaactttagtgaatctcagtgtgtttatatatattttatatatgtatattttttttctaggcatattggcgttcctgtgctatgatgatgggctgtgtgatagagagggcattcaaagatgaatatatggtcaatttggtcagagctccagaagttcctggtagtgtatacatatatgtctttttgtgatccttaaatattttggtacctatttttgatgacgtatagagtttagtactaatataaattaccattatacatatgtgtcatttatcatgggtaacaaaatctttcttactatgatgaaacatgaagtagtctttgcaggttaataattaacatcatagaattactggaaagtgtttgtcttgaatatgaatttcatggaattccactatctcagcgtttatttatttatttgagacggagtttcactctgtcacccaggctggagtgcagtggcgtgatcttggctcactgcaagctccgcctctggggttcacaccattctcccgcctcaccctcccgattagctgggtctacaggcgcgcgccaccacgcctggctaatttttctgtatttttagtagagacggggtttcaccatgttagctaggatggtctcgatctcctgacctcgtgatctgcctgcctcggcctcccaaagtgctgggattacaggcgtgagccaccgtgcccggcccttagcgtttattttttactttaagcatatatttccaaattggatgtatagaggaggaggaaatctgagtataagtagactactgtaaagagctgtgcttaggtggtaatatttcaccagacaggaccattactttggaaagtgacagcactttggtgaaatgacagg

SEQ ID NO: 101901 - DNA, 1028 bp, Homo sapiens
gacgttcttgtcattcatgcttgcagtcattcagtaaactgttattgaacacctgctatattccaggcctggtgctagactctggatatactgatgagtgagcaaaagtagacatgatccctgactttacggggtttatgtagtggttgataatttagaccttgtagtttgactacttttgtgagtagctgtgtaattgcagaacatctaattggcattaacagttggcattgcattctgggatgatgaaacagaccagagctgattggcttatccgggagttaatattaattattaaaaaatggtaactactgtatttaacttgaagcatctatgtcatggaaataagagatggtttgggagcaagacccaaaaccaatctagaactgatttttgtaggtgtgtattaatatatttcccttttactttgagttgtgtgtgtatctatccaaatgtatccatgatgctgctctctgaatattcaagtgtaacttttttcattaataattagcaaattaatttcaaactagatgtagcctgaacaaattttgtaaatggtttgggtaattttgttaataaccaataagaccttgagtatattgggtattattttatttatttatttatttttgagacagagtctcgctctgtcacccaggctcgaatgcagtggcgtgatctcggctcactgcaacctctgccatcttggttcaagcgattctcctgtttcagcctcccaaataactgggattacaggcacgtgcccccacacctggctaatttttgtagggtttttttttttaattgattatagacgtaatatactttttttctctaaaaaggacagtctgcagaatcttgcctttccattgttatatttctaaatatagcacttaaacatgtaacttttcactctggattttgttagataatcagtctgttttaaatttctagatttaagcgagtggtattgcaggaagtccattctggctctggtggatggacagccttgggacatgtataagcct

SEQ ID NO: 101902 - DNA, 6830 bp, Homo sapiens
cagcacgagtcttgattgcttttttttttctcgagttcgaggcggagcccgcgaaccccatctcctcagagcgccaccccctcagcttcgcccgttgggcagaattttccaaatatctccacccctaggctgaaaagccagaaagaagttttgagccaacgaggggaagaaaggagttggggcaaaacaggaggcgtttccctacccgcatacatccccgtccccgagacacccaatccccccacccccagcctgcccgcgcctcccgcccccagctcctcgccctggggacagctggcagccccgcgcggaccagacacaaagccgatcaatcccggaggcgtgggggcggagggacgacccgccggggctttcccgggcgctgctctcctcctgctgccccctcgctaggacccggcggacgcctcgtctggttttcacgccctctagcccctacccccacacccccaaaacagaacagacccccatccctgggctggaggacccgcctcttggcagccagctgagaaggcgccccggggagggggaaactgacatcccatctagagccgtccctcctcttcctcccctcccgactctctgctcctttcccgccccagaagttcaagggcccccggcctcctgcgctcctgccgccgggaccctcgacctcctcagagcagccggctgccgccccgggaagatggcgaggaggagccgccaccgcctcctcctgctgctgctgcgctacctggtggtcgccctgggctgtaagttgctcgggttcctctacccttcctgcctggaccagcctgcccccaccctccagccccccacggggcgctggctgacagtgtctgggcggctctgggccgaggtcgccgcggggcgtctgaccttgcgcccaggcgagcgggaaacccagggtgcccgcgagcggacgctgggagcaagggagcgcgaggtcgtgggtttcttgtgaattgcgtctgattttgtcagttctagatacagaaaattaagggttcccactagcaggttctcatctgtttgcaaagttggggtaagttttcagacagagggacgtgattcgaatgcaaaactcactacccactggtaagatgctaagaccccaagaaagatggcatcactgggaggcgggcgccggccacactttgagtccccggggagggggcagcgtccgcgtggtctgggctctgtagcgtcccagctgagccggcgatatgcagcgcacttgtggggcggaggtggagggaattcgtggctgctgagccagaattacttttatcctctccacctgcacatctacattcacttagagaagtctggtctggggactctagccagctgctctgtcctcaggggacatccaacgggacgattgttagaaagattcagaagccacatgatccagtagctggggagacgtcccaaagccaatttcaccggatgattttaaacaggattttcacggattctggactcatgagatttgaaatcctgggaacgttgccgttattttgttttcttcgcgttaactttttaggaaaatggaggaaattacaatagactaagcaatgcagttctacttttgctttttcttttttctctcaccttttttgttttgcttttttcccttccttccttcctcccttcctttctctttcttctttctttctctctctctttctttctgtctctctttctttcttttgtaaaatgagttattgttgctattcacgttctggtaaagtaacacttataatacttaacctgcgggacgagtgtctaataccacaatacaatgatattttctcacgccctcgctgcccaagtgatcatcgcacagctcaagtgatgtgagccacgtccctttgtggaggaggaaggtgcacattgtctcaggcaagggacatgtactgaccaatattatataaagtcaaaccagaaagccaaagtttcacaatgaaacccttgtgcaattctgaaatatcaattggtatcatatggaacacacagaagaaaaaaaatgcactcatgctaaaaggcaacagagaggtaggctggagaaatcgttaacagaacaactgagaaagttatgtattctgctgaaattctaaatttcaaatagaaaagagtgtgccttttagtgtagaattgtcactaattaaaaacagaaaatcgttctgctgtgctattcctattgaatcaccaacatagaaacaatacaccccaagtctgaaattgtagtggagaaacaaccaagaggcgaacaaaagcataaatgaatggggctgagtgacctcttcaagctttaggtaaatataacacattgtctctgctaaacttgattcctataggggatgtatttggaagtgttgtggggacttttctatattgttcctgggatactaaaagatctggcattgcaagagtgttttctttgtatgtgggtgtttttttttttatgtttaaaacaattttagaacagtttggatttaaataaaaattccaacgctagtatagagagttctcatatactccacacccagtttcccacattgttaatatcttacattagtatggtacactttattcaaatttccttcattcttacctaatgccttttctattccaggatgccatccaggctaccatattacatttagttgtcctgattccttaggttcttcttggttgtaacagtttcttaggcttcccttgctttctcttactataatgggtttgaggagttctggtcaagtatctggtagaatgactgcgaattgctgtttctctgatatttttctcataactagactggggttataggttttttggaggaagatcagaaagtggtaaggggcctaggtaaagtgacattttcatcacattatctccagggaacataccgtacacatgacttattgctgttgatgtgaacctaggtcacctgtaatcatactcctaatgtagtgcataccagttttctccacagattacctacccttttttcttcatttccatactagatttttttggaaggaagtcactacatgcaacccacacttcttcaggaaggagagttatgctccatctccttgaaggcggagtatcttcataaattatttggagctcttctgcatgggagatgggtctctcccttcccttcatttatttatttaatcatttatttttctatcagtatgggctcataaatatttgttttatactttgggttataatccaatactattttatttattaaagacttagtggatttcttatgctgttattacatattcatctttttaatattcttcccagatgtaactgtgccattcttttggccactcctatcatttataatatcatgcttactcccttctttcctttttatcctgctgtttatcagcattctttatatctttcttagtagtctggaggattgcttttttgttgttgttcttgttatttaaacgatgatgtcagtatccctgttgatatatggatatttttgtgtgtgtttagttgaattacatttttctttcccactccattaggaaaggaatttcttgatgtttgctcaccactatatgtccagtgctgagcaaagttcctggttaatagtaggtataaatatatgcctgttgattctatggtgccttagtccattcaggctgctgtaacaaaataccataaacggagtagcttataaacaacgtttatttctcacagctctggaggctgagaagttcacaatcaagataccagcaaattcagtgtcaggcaagggcccacttcctggttcatagatggagccttctcagggtgacctcccatggcggaagaagcaaggcagctctgaggtctctttgtaagcgcactgttgtcatgaccagatcacggtccaaagccttcaactcctaataccatcacattggtgattagatttcaacatatgaatgtggggggacataaaccacagcagatggaatggggatgaggtagggtaggtaaaagaagtgtatagattgaactgattgcaatataaatcatgaagctctaacttcatgttaagtaggtggagtgttagatttctctgaggcatcatttaagctgatatgtcaaaaaataataggaatgagtattccgtgtttggtggggtgttgtcatgccttttggggtctctcagagccaaggagctgatcatgaatcagttcctgattccacctaaccagtagcagctggtcctcagatctggactggaacctgatccaggcgcttagcctgagtctaatctctcatcaactgataaagattgtggtaggggagagaggtctgaatcttttgtaaaatcacaaggttctgcctttttgccagaactgacccaaaacagcactccagggaaccggtactaggaaaattctgccctctgtatctattgttaagaagcaactgccataatcaatttgctggagagaagtggttccgtgctggcacagtctcaattatctgatgaacagaaacgctaaaatgggcttgtaggtggatttaacaaccatttcaagactatgaaagaaattatattagaaagaatgaagtcaaaaacaaaaacttcagcctgagcacagtgagttccctatgactgaaaacactcatttatcctcccacatgagcagtttaatgagaggagcccacaggagcttacggatgttcaccacccatggtttccattgcattggtttcctcctgtgggccttcctcatagagaagatgtattggaatatagaggtaagagctgctagctttattgaagtcagaccaccaggaagctataaaggccattcttaaaataatattttttcatcccatagcaatatagtagtaacactgctgagtcaatactccagtatacccctcttgctagactgatgttttgaggaagatggtggtgaagatggaaaaggggaatcagaacctgggtcaggtgcctcctttggcaaaagcagcaaaataaaacttaaaaccagggattgttttcttggacggtgttactgttaacaaggctagaactcagaaaaaataacccaactgtattacttttctatttctgtgaaacacatgaccaaaaacaaaacaatacaaattgattgtcttaaacttctagaggtcagaagtctgaaacaggtctcactggcctaaaatcaaggtatcagcatgaagcattccttctggaggttctagggcagaatctgtttccatggcttttccagcttctggaggcgccccactcacggccctgtcctgccaggctgccacctgtccccactcacggccctgcgacaccaggctgccacctctcttgttctctctcttctgcttccttcttccactcatcaggacccttgtcattaccttgggcttacctgagtaactctggataatttatccatttcaaagtcagctggttagcaactttcatccatctacaactgcaattcctatttaccatgtaaagtaagatatttataggttctggggagtaggatgtggacatctttgtggggctattattctgtttctcacagcagccaaaatgaggttatgcacagcgacagtgttttcagtgctgtagccaagaatattctagattccatgaagccaccataacttttacctttaaagtataactcatagtgatataaagctggttggttttttggttttgtttgtttgtttgtttgtttgttttatttgagatggaatcttgctctgtcacccaagctggaatgcagtggcgcaatctcagctcaccacaacctccacctcctggtttcaagcaattctcctgcctcagcctcctgagtagctgggattataggctcccaccaccacgcccacctaacttttgtatttttagtagagactgggtttcgtcatgttggccaggctggtcttgatctcctgacctcagatgatctgcctgccttggcttcccaaagtgctgggattacaggcgtgagccaccgcgcctggcctaaagctatattttttattagttgtatttcaaattgcatagtatggtggtaaagaacatgcactccaatgcagcactctgtgctcttaccagctgtgtgatcttatacaggttaacacctgtattatgtcagtttactcatcagtgttggtgataatcccaataagagtgcttacctcatagaggtttagggagaattacatgtataacacacttagtaaactgaagaagccattgaagccttttgacattgaatatcagtttgatttgcattttaaagagaatgcattggatggagtatggtgaatggaaggattggggtggggggagtcaaactggggagaccagttagaagttattggagtagtccaggcaattgcttgtgtaagtacttattttatatagtttattgataaatatactcacataattacacatacacatataaccactgacaattgctttttacagttgtcacctaatgatgcgatgtgttctgagaaatgtgtcgttaggtgattttgttattgtgtgatcatagagtgtacttacagaaacctagatggtagagcctgctgcacaccaaggctatatggtgtagcctattgctcctaggctacaaacctatacagcatgttactgtactggatactgtaggcaacggtaaacagttgtaagtatttgtgtacctaaacatatctaaacatggaaaaggtacagtaaaaacagcacaaaagataaatggtacacctgtgtagaaacatatcat

SEQ ID NO: 101903 - DNA, 1687 bp, Homo sapiens
ccttcctgactcctttgcttctcagatagaccatccttaagtttcctgcaaatggtttcaggaaattagaaaagaaatagttccagtatatataagcatactcttataatttctttagaaataaagatcacaatttattatgcttactgctgtataccttccagaaaatcaaatcatattatatatagtgttgtgcaccttgctccaaaaagttatttatgttagtaattaaggtacaacctaaagctcagtctacaagcaggacagaagataacatcttatagaggcctttaaaattgttgcaccaaaatgcagtgggagctattttctaactagaaccaccaaaaataatggaacaaaatgattagtaaaacaaagggaaataaacttccaaaccagtaaccaaatatggaaagggaaaaattccaagcaagatccagttaaaaagtccaaaggagaacgtgtgtgcacccagagaggacagagacactagcaccagctaagattcacagacaagtgcaaaggggtgctatttttaaaggagaccaaagaggaaataatgaccacaaataaaaagggaacatgtcaaacttctgggcaagtgctaaatttgaaaagagagaatggtgtttatgttttttaaaaaatgcactagagggctgggcgctgtgactcacgcctgtaatcccagcactttgggaggccaagacgggtggatcacctgaggtcaggagtttgaaaccagcctagccaacgtggtgaaaccctgtatctactaaaagtacaaaaagtagctgggcatggtggcatgcacctgtagtcccagctactcaggaggctgaggcatgagaatcacttgaacgtgggaggcggaggttgcaatgagctgagattgtgccactgcactccagcctgggcaacacagcaagattctgtctcaaaaaaaaaaattcactagatgcattttcaaataggaatggattttgatcagaagcagaactgacacaatggaataaacaataactcaagtatgcatttgtccaataactgaaacatgcagccatctatgtcataaaacattaaaattgtacctaagcatattggagacatgagattattgtactgtccatatagtgcttttggatccagaacaagtcaggttcttttgtgccgtgtgtttgtgtgtgtgtgtgtgtgtgtgtgtgtaaacgagtgaacatctatgccattttatctagatacagtacttcttcccaacctccattcatctctgttgttgttgctattgttcctcatatggccaaatgcaatttctccctgaaggtctaactccaaaattccttgcgccttctcttaattctttccaactcatcaattcctcaaagctgatgtctactgtatattatactctggtgcttttggtatattctttattctcttatggcacttactgagctgtactgttacaatttttccatgtatatctctctgtattgtgagcttgctggaggcagagacaacacatctttaggtcgttggtacctagagtactgcctggcacatttaatacttgattaagtagaattacataagctggaatttaatgtttatttgttttgtagcttcataaaattatataactttttagcaataaaaacctcaagacatatgtaaaattaatagtctc

SEQ ID NO: 101904 - DNA, 1243 bp, Homo sapiens
tgagacaatagagactgttttagtctatttctgttgctgtaacagaacacctgagactgggtaatttataaacaaaagaggtttacttggctcccagttctggagcctgggaagttcaacattgggcagctacctctggcaaggccctcatgctacattaaagcatagtgaatggcatcacatgtggaaacacctgcaggagcagcaagcaagtatgtgcaaaagagacaaaacacaagtgatggcctcattttttaacaacctgctcttgcagttactaatctagtcccatgagaacaagaactcatttgcttctgtgagaattaacccagtcctatgagaatgggactaatatcttcgtgagggtggcagagtcttcatgacccaaacacctcttaaaggtcctaccacctctcaacaccattatactgggaactcaatttcctatacatgaattctgaggaacacatttaaaccattgtagagcctgataaagtgatcttcatttccaaatcaaagatgattttcctaggtgttcttgtccagtatttttataggttggtgcaaaagtaactgcagttttagccgttacttttaatgattttgtgggatcttgacacttgctcattagcacttaaaaaattacccctggatccaggtgagtcattgtctctgccaagaatctcattcagcattaggcaaatgccaaaatcagatacatgtaagaatctcagctccattgtgctactgccacccaggacagctatctaaagatgctggcatgttcaaaaaacactgaatcagtgatcttcaaacttttttatattacatatcctacttcatttcttaaaagaggatatgtcctgacgtgtgttttaataaattgtaatatgtatttctgtatcaacatattaatcataaaacatataatacatagaataaatatcaaatgaatgagacaatggagaattaataatacactaacggggcagaaatgaagtggttatagccctatattatagtgttctataaagcctctataagtaaaataatgtgagattggtacatgaatagacagacaagccaatggaagagtatataaagtccggaaattatgccaacttcatttagaaatcacgtgtatgtgtgtatgtgtgtgtaaaatggtagcatttgaaaccatggagaatgcttaatcaatattgttacaactgggaaccatttgagggaaaaatggatcaga

SEQ ID NO: 101905 - DNA, 5546 bp, Homo sapiens
aatgttaaaatactcatcagatgaatgcatgccacattcatagactgatggcaagaaaaagtgaatataaaaaaagagttgattaaattcctaaaaatttaaaatgtttgtcttgcatttgtttagtggagactggttccatcaaggtcctcttgtccacccccaggctccttctaaacaagtaaagagaatacctgcagatatcttacatttgacacatcaactcaagcacatttcaaaattggccgtagtttctaaaatattcatttaatgttaaagttcttgtcattaataacttagtatcaagcttcctgtgagttcttcatatgatttaatttctcatagttcctttagccttgaagaccccaaatctataaggattctctagagaagatgccggttatgggaaaagaatggaagaagtagaggcatttagcagccacaatagaatagcctggggcctgtgtcagcagcatatgcacactgtcattgtagccatttgtgtcagaagctatttctgtgctggacaacactttctccaaatacactatgaatttatgagcaagggaatgtagatgttaatggaggaagaagtttcacttcacctcccactcctttgcgtcttaattttagagtggaagcaagattgcatcacagccctccatgggatatatattcagagtcctaataatttgaacaatcacatattatttgcttgtacaattatatatatgttcaactatttatatttggccacaagttaccaaaatttgctgagtaatgatgagaccaatcaagaccagcctttttcattatgtgggctagaatgtttaaggagatttatttctaattattagaaaatgaaaggacaaaacattttgggagtgggctattgcaacacttcttttatagagcagttatcccacttatatgaatattgaatacaaatgtttcttttcagagaacaatggacttagatctattttttttttcttttttgggatgggatctctctctgtcacccaggctagcgtgcagtggtgcaataatagcctgtgctaatttatttatttttttgtagagatgagttctcactatgttgtccaggttggtcttgaactcctgggctcaagtgatgcttctgcctccaactcccaaagtgctgggattacaggcgtaagccactgcaaccaacctgactttcatcttttacctaaaagagtattagtcacatcttctcttacaaggtgactcatggcaggttcaaaaggacagggttggtggacagaatcaccttcactttttaaactcattaattttatgaattatatttgtaatatgtatttgccagtggtacattattgaattcataagttaaatatccatgtgaaatgtctctactagatgttcaaaggacctccttatatctaaccacaaacgtcaaattttgttcacaaagaagcaaaaagtataatataaataaaatggaactagagttccaatgggctagattgagtcagttctgcccttagtaatcatatggttttagaaaagctaccttattgtatgagtcttttttccctcatttgttaaatgaaagggtttgatttaatgattatttgtattgtttataattgaacattttatgtttttaaatgggaaaatgtaccatattttagcctgttataataaaattatgttatatgtagctaagaacatgttttaaaattctaaactgcctcctttagaattctcattggttagaacagagcctgttttggaaggaagcaagaaaataggctccaaaaatgctggatattcataaagttgactgtatagcatgttataaactttttgtttgatgcagtaggcaacaggaagttgttgaaggttttgaagagtggaataatatatcaaaaaataatattggagataaacaataattttgccccttacatatagactagacttgggaagaaagggtaactgtaaggcaggccttaggtaatgagatccaggattaaactggaggctgtcaaaatcgtttaggaaaagtagaatccagaagacattgaaaatagaaattgataaaatgcagtgattgattaaatataggggacatcaaagaaatcaaaacagtaactccaaggttgtaaacttgtagaaccagagaaatcatggtatttaattgagaaggaattatttatatatatatatttcaggaagcaataaaatagccaactaaatgtgtctctaaagaccattggagagtggatgatcatgatctgtacctatcccctgtatttaagtggtaaaatggaaagagaaatgtataaccactctgggaaaaacatggagaagattagtaggaggcaaaaaactgaactctggaaaacatacttgtgaaagaatataaaagagcagagacaatgacaaaacaagtgcccagagtaataatggacaaccaacagaaccagtgtcatggaagctggggaggaattttgcaatgtcaattgttatctagaggtcaggaagaatgaagggaaaagatcagggtgaattgttgggtaacctgaggggattaaaaagtaaagaaaaaacaaaattagcatttgaatggaactttacaattgacaaaacactttcagaggaattattttacttaattctcatgttaacattactgtgagacccacaggactatttttattcacagtgtcataaatgagaaacacgggagcttagagtacttttaggacttattccaaggcaggacttagagttacttactcaaaatcccacattctttgctatctggaagacaaggataaaaagaacatgctggaaagtaccaaccaatagtatattttcagtgtccctgtctctcaccacatataaatgccttccatattcacaactcaaatcaaattcaaagcaatattaacctgaagggtaagccataagcctgtaataaatatttcatgttctgaaaatattatttaactaaatgggagaaatatccaaaaatgaacacattccatattggaaggggtttattatccaatttagtcatcctaacaacatcacagcagatcatttaaaatgaaaatagaaaacatcctcataattttctagcctttttttttttttgctgtaagttcatattaaaagaataacattaatattgtcttaagcaaagataagtattattatacgtcatgcatttcctaaatttcaattatgtgttatttttaaaattgctatgtgtgtctgatgataggacacaaggctgtgtttttccttccttttaaaataaataaataactcttttagctgatttctttggtgccattttgtaatttcttttgtctttcactacttcccaactttagtttccataggaacaggatcaatcggaaagcatttgggattctttcaaaatgttgagtccaagatttctaattagggttcaggcacttatagtttaattaatatgagactttttctgtgttttatttttgaaggtggaaaaaactgggttatgatttcataatatgtttgccttttcaaagatttttattagagatttggatcaaagagctttaagatcatttaaaaatgtgttaatacatgcctgaaaaaattaaatatattatgcatactattcttgacagataagaagacttaaaacaataattatcccagttaaatgcatcaaaattagttgaattatccttagctgaaaattgattctttgaaatataacataaacctagtgtcttctcctatacctcttttatagtttgttgttgttgtttttctgagatggaatctcactctgtcacccagagtgcagtggtgcggatctcggctcactgcaacctctgcgtcctgggttcaagcaactctcctgcctcagccttctgagtagctgggactacaggccacccccgaccatgctcagctaatttttttgtatttttagtagagacggggtttcactatgttggccaggctggtctcaaactcctgacctcaagtgatccgcccacctcagcctcccaaagcctgggattacaggcctgagccactgcacccagcccctcttatagttttattgtgagaacaagtatggtcaatggaaaataatgtagatgatagattttacttttaaaaaattaccattatggtcacattacgttagctgtataagacaaaaacatcctcagtttataaaaaaagcattcaactttctattaacagagagtgtgctcaaggaattaaatcaggaattatcaacaggaaggggattacttcccccagggggtactgtgaaattttatgggacctattccattgtcacaatgatgagtggttgctatatatttgctgagcagggaccaggcctcttaaacagcttgctgtgtgccagacagtcctgcaaaataaagaattttcctgagtccctcatttttcataactctccaaagtcctgctgcatgttcatataagtgaaaacttcataattatctgagcttatactgtaacttacactgttttacctataaacacaaatattcttttggacagtcttatcatataactaaatatacaaatttgtattctaatgctcacaataaccatatatatatatatatatatatattttttttttttttttttttttttttttttgagacagagtctcaccctgttgcccaggctggagtgtgatggcacagtctcagctcactgcaacctccacctcctgggttcaagtgattctcctgcctcagcctcctgagtagctgggattatagaaacttgccaccacgcccagctaatttttgtacttttagtagagacaggagtttcaccatgttggccagcctggaacccctgaccttaggtgatccgcccacctcggcctcccagaatgctgggattacaggcgtgagccactgcgtctggccaataaccctattcttatattcctgtactatttggaatggtttctgattttacttaaatcccatttaacattataagtgtacaccaggcatggtggctaatgcctgtaataccagcactttgggaggtggagacagaggatctcttgaggccaagagtttgagactagctggactgggcaacatggcaagattccatctctatgagagtaaacatttaagaaaatttgctaggcatggtggtgcatgcctatagtcctagctacttggaaggctgaagcaggaggatcccttgagcccagaggttcagtgttacagtgagctataatcatgccaccgcacaccagcctgggtgacagagcaagacattatctctaaaaaaagaaaaataaataaaaataagtgtagacttcattgtgtcttctagtgtactcacgtataagcatttatgaattaaaatatgtatttttttatttctctttaacattaaagggacattacattatttcccaaattttacatatatataaattttatgtatataaattatatgtttgtatatgtaatgtttattat

SEQ ID NO: 101906 - DNA, 1713 bp, Homo sapiens
atttagcatgcacactttctatcaaacttcatttcttaaaatatgagagctgtgtgaattttatttttcaactttcctgctggaagatgactcataaaatcttggcccttacattacatacaagtgttattaattaaattctattaccacaagtgcttacagaagaaatttgaaaaccaagggaaacttcccagccattgttgcttcatgcttcctttgattagtcctcaggaagccaaaaaacaagaaccatttattttgaagtgcagaacatggaaacaatggtttggcattgcttaactgtcatattcacaattgtcaggcaagattcctaagaattagctaccctgatttcttgggtcctgtaaatccaggaaccacaatttcccttttcttttggtaaaaacagttctctgacttttttagttcaaaactagtcctacacatccaactgtgagctaacaccaacacgcacttttttaggatcagtgaactagaccaataaaataaataatttagtgaatatctgcacacattaaaatcagtgggacctttggagctgcttcctagaatggtcaggaaatgagtttttgtgctattggataaaggtcaatttttttttttttaaattttgacacagggtcttgctctgccacccaggctggagtgcagtggcgtgatcatagttcactgcagccttgatctcccggggctccagcgatcactgcacctcagcaatcctgagtagctgggactgtgggcacataccaccatgcctggctaatttttgtgttttttgtagagacagggtctctttacgttgcccaggctggtctcgaaactctgggctcaagggacctacctacctcggcctcccaaagtgctgggattataagcatgagccaccatgcgcagccaaggtcaaatttttgaaactctttcaaattgagtattggaaagaagaacaaaggtatttgtgtccagatatggtaggcaaaagtctaattgtcgtaatataactcaagtgaaatggctgtttgatgtttgtcatagcatgaagagaactggatttatgacagaatctaccaaaagttttgaaattatttagagtcagccttagcacataatcttagcacttagtcttaataaggtggtatcagaactgactttacccccattgggataaagaactaaattgtattctaccactattattttcagcagcttggctttttgagtaagtatcatctaaaattaaataaaagacaacattagagtctagcaaggtaagaaaagagtagtctattagagaaatgcaacttaagtcttagtcttcattatagatggaaacagaatcattctgtctttaggaagtcataacccagtatttgaaacccagtgctgtgaattactagccacgtcaccttggataagctacagcctcagtttaagtaaaatgaagctagtaatgccttccctagctggttgtaaagatgaaataaaatcatgtacataattgcttagcctacctcttggcacacagtagattctctataaatacttgcttctcatccctctcccctcacttcacattgctttttatccaatgtggtgacgcagatagaacatttcacaaatgattctacaataatcgcgtatgaggatgttctatgaaaaatgaattgttagggttatacttttcccccatcttct

SEQ ID NO: 101907 - DNA, 2157 bp, Homo sapiens
aaactttagtacactctgagattataagatttaggaactgggtttcaggaatcattgagaaagaaaatcattttctctttctcaattacagttttctacttgttaaaatttcctttaagaaacatttcttaaattgtcaaaaattactataaaatttctgtgaaaaataacagctgttagcttcaggaattttgttaattcccttgtacattttttatgtgtatattaatatttgaacagaaaaacgatgtatcacagatgttaaaaaagaggattagttgaattggcaaaattatgtaggcaaaaaattataaagggaattagctttaataaattaattatcggtagtatttcttagtagctgaatatttatttccttttttttttctttttgtgtgtataaatttaaggggcacaagtgcaattttgttacatgggtatattgtgtagtggtgaagtctgggcttttagtgtagccgtcatccaaacatacattgtacctatttttgtgattttaagtatcttctccttctagctacctttcttcctctaattctatttacttcagggtttaccaacaaattaagtaaaaatatttaaaatgtatggtcacttatgtggaacttatttgaacagaaagctctgaatctttaaattaaaaaaatttataagatttctaccttgttttagcctttctagtcttagagttcctttttacaaaacttgtacctaataactctttttataaaaacaaaatgttggattttatatcagcatatcactagcagatgttaggtatagcccctgttggctgcattcttgaagtgatttttattttttcttcacttttccagaacaaattaaataggaaaataaacaaaagaaaatggtcatgtaggcctgctggttgaggtcaacaattgtcttaaagttagcctcagaacatctttaacagttatgaacatgttccaaaagcactggcagaagttcataaaataaggtgaagagatgattattttcataactgctaacaactccaagtcaaataattcccagtcaaatgaaaccttttgtgtttcttttcctcccaactttaaaaacaaaagtttttgtattctctattactcatctaagatagtctggtttgactaagaatatatactttatattatgacaattttaaaattactataaaggtgttatttaaattaacacttttaattgaaaacatgactaggaaaaactggagaagtgttacataagttgttttttttttttctttttctttttttttttttttttgagacgagtctctctgtgtcacccaggctggagtgcagtggcgtgatcttggcttactgcaacctctacctcctgggttcaagtgattctcctgcctcagcctcccaagtagctgggactacaggcatgtgccaccacacctggctaatttttgtatttttagtagagacggggtttcaccatgttggccaggctggtctcaaactcctgacctcaagtgatctgcccaccttggcctctcaaagtggtaggattacagacgtgagccactgcacccggcctgaagttttttgtttgttttaaatgtatagtatcacattatcatgtataaaagcaaattataaaaagtatggatatcagttatatcataagtttcataaaaataaaaatttatggccatgtggttttgatagttactgaaagacaattattatactgatatggtttagatctgtgtcccacccaaatctcatgttcagttgtaattcctaatgctggaagtcgggctggtggggggtgatgggatcatgggagcagtttctcatgaatggcttaacacaatccccttggaactgttgtcatgatagtgagcgagctctcctgagatctggttgtttaaaagtgtgtagcccttcctcccttcctcccttctttccctccttccctccctccctccctccttccttccttctttccttccttccttccttccttccctccttccttccttccttcccctccttcctctctctctctctttctctctctctcctctctctctttctttttctgagacagagtttccctctgtcaccaaggctagagtgcaatggcgccatcttggctcactgcaac

SEQ ID NO: 101908 - DNA, 4023 bp, Homo sapiens
ctctaagactagaaaggctaaaacaaggtagaaatcttataaatttttttaatttaaagattcagagctttctgttcaaataagttccacataagtgaccatacattttaaatatttttacttaatttgttggtaaaccctgaagtaaatagaattagaggaagaaaggtagctagaaggagaagatacttaaaatcacaaaaataggtacaatgtatgtttggatgacggctacactaaaagcccagacttcaccactacacaatatacccatgtaacaaaattgcacttgtgccccttaaatttatacacacaaaaagaaaaaaaaaaggaaataaatattcagctactaagaaatactaccgataattaatttattaaagctaattccctttataattttttgcctacataattttgccaattcaactaatcctcttttttaacatctgtgatacatcgtttttctgttcaaatattaatatacacataaaaaatgtacaagggaattaacaaaattcctgaagctaacagctgttatttttcacagaaattttatagtaatttttgacaatttaagaaatgtttcttaaaggaaattttaacaagtagaaaactgtaattgagaaagagaaaatgattttctttctcaatgattcctgaaacccagttcctaaatcttataatctcagagtgtactaaagtttgcctgaaatgaaggaaggccagaacctactgaagaaaataaacattctcagtaggcagtgtgatgtttgaaaagttcaaaggtatgatgatacagagggaacaaagattatctttccctattttgccccgaggttttcctcgactggttttcagggaatttgagtcttcattgttttctctaaaaagtgtaataaaatatttcagaaatcacaagaattgtcagtcataagtagagtttctccgagggcattaattcacacagtgttaaaggagacaaacagactttttcaaagtatactttgaaagtttcacagaacaatggtttggcattggaatcactggcaaaaatgttcagagattttgtcatcaaaaataggagtaggccaggcgcggtggcactttggcaggccgaggcaggtggatcacttgaggtcaggagtttgagaacagccatggtgaaaccctgtctctactaaaaatacaaaaattagccgggtgtggtgacgcatgcctgtaatcccagctactcaggaggctgaggcatgagaatcatttgaactcaggaggtggaggttgcagtgagccgagattgcaccattgcactccagcctgggcaatagagcgagactcagtctcaaaaatttaaaaaataaaaaataaataaaagtaggagtaaagcaacaaggtaggtcccgtcttccctacctcactgaagaggattctggcttggtctcctgtctcattccttcctctgctctctgaagattcagactctatctttggagtctataacatgtgggaagcagaagagaagctaggaaataaaggaatgcaggagaagaaagggatatgggggaagagaaaagaaagaacagctgctatgtgatcaaagtgtgtggaaaaggatatttaaaaagattgcatggacccctttcatggttcttgaaatatacaagcaaaagagttcttttgaaatgactccctggtggacttgacacctctctaagattgagccacatgggtcactgctttctacagacatatttacagctgtcaatagaaaggatcagttcagtcctgtactcttcacatagacaccacgtttgccagtttccctattgaatatgtttgccatttagagctattgaacctgcatatcactggttttcctgttatactagaaatctagtaatttgtgtcccacagacttttgcaaattaaaaaaatatatattttgagtcactgtgttgcccagtctggagtgcagtggtgcgatcatagctcactgcagcttcaaacgcctgtgctcaagtgatcctcctgcctcagcctcccaagtagctgggactacaggcaggtgctaccacacccagataatttttaaaaattttttgtagagatgggggatgttactatgttgcccaggctggtcttaaactcctggcctcaagtgatcctccttccttggcctctcaaagtagttctgcaaattttaacttcacaattagatttgctgtccaggcttttaagggaaaaaagaaattctccagaatagcgtgtgctccttaagagtgataaaatctagcacaatggaagactaatttacatgttgatatatagagatgaataaatcaaagaagagttgtcatgtcatatgaaagatttctctctcctttccaggagtataatcaattctctttcatagttacacaattctgattttatacaaacttttcaaaatcctagaattcatggttctttgccattctttatagtctattggtttattcctgttcctggttgttcaaactggtctaagtctagagcaatggttctcaaccaggagtgatttctttacacccatctctcaggggacatttactatttagggacatttttagttgtcatcacttgggggcatggtgataccggcatctagtgggtagaagccagggatactgcaaaacatcctacagtgcacaggacagccccctacaacaaagaatgattgagtgccagatatcactagtgtcaagatgaagaaaccctcacctagacctcccctctggggttacgttggtgtcctactttcctagatcagcctcttagcttccaccttccttttgtgcttcagagccagtcttttgccttcattctaaccaccaatttctcaaactctcctgtcttcattagaccaatgaaactttccacctggaatctttgttaatctgcaatccttgctagtgttcagcttgcggggatcacggtgtgggcctagtatagcacagtaattaactatgtgggcttcaggtactgactgagtccaaagccaaatgccaccgcttacttcttctatgatcatggccatgtttcttactctctttgtgcctcagttttcccaccctcaaaaatgtgagtacaaatggtaccctgccacagagaattgtaagagtcaaatgagttaatacttgtaaagcgccaagtgcttaataaatgttagctattattatcctttctcaagggtccatcaaggtccttgtcctctaagttacttccttctctgtactctaagtctggaaagcaggtgtaatttactcatgatggtttctcttaaatgtttgcctaaattgtgaatgttttccattaatctaatggctaggacttttgatgtggaaaggcagaacataccctatttttctctctcaggtttggctgtccatatctcttccctgagcactttgtggcataaaggtgagagatgggaaagagatggaaggaaaaatacttcagaacattttcatggatgactcacaattcttagtctgcagatggaagctgatgaatgaagggatgagaggatgggtgcatcatgggcagcacctaagtttctggtgtgagtggccacatggaatgtgatgctttacatagagatgggatttgtaaaaataagacaaagtttgggggcaagctgatcagttttgcctatgagtttgtggtaattgtgggaaatggaaatacagatgtccagcagaaagctgggcttacaaatttaatttcaagagacagattggagctggagatgtggagttatgactttttagcaaataaatgctagttgggtcaatgagagtacaaaatactccataaaaaggaggtagtttagtcagaaaagcagtttctggatggatggatggatggatggatgacgatcgatggatggatggatggatgggcagaacaaggaggaggaagaagaactcacaaagcagacagaatgaagcaccaggatcagaacagaaggatgaagactaggag

SEQ ID NO: 101909 - DNA, 1240 bp, Homo sapiens
acagtagtggtagccaccacagtcagttacttcagtctatagaccggctctcaaaaatcattgaaatgttttggggaaaaaaataaagatgttctgcttgaatttttcatcataatttcatatacagcttatatacatttattatatatatatacaaatttcatcaaaagtatgtaaaatgactcatttctatatgacatgggtattgtcaaggataaattcataaagctatttatacttttaaataagcctaaagagaattagcttttatttgtggggcaataccgtgtgacactagattgcatattaagctgaattaaggatgtaagttatttttcaatgatcgggctggcaggagtgtgttgtctggggtggggtccaaatagatgcatggattctactttggaaaatgcttaaaggccaaagctacaatctagaaaataaacatgtatagtttcatttgctttttcctattttgatcctttaaaactatgtgttatgaattgggtaaacttgtcaccaaactttaggacagttttcttgactattgcatcccattcagacatttgaaaatgaacttttgtataattttaattatcctatctgttttaatctttcagatcataaggcctatgggttttctgccccaaaagaccaacaagtagtcacagcagtagagtaccaaggtacagtatcttactgattttcacaggctgtattgtttaaataactcacgagagtgactcgtgtgatgttattttctatttgttgggattctctgccttaccttctactaattcctctgcctgaaatgctgcttcatgctgactccacctcaagaacatttactccacctcctcagtggaaattttcgatattcaataaaagaccggatgtgcaaagaaggtctcctataacttaaattatctgcacaaagcaaatctaatttgtgaaactgggagatggagagcttggaaagtttctagccagctagatatgatacatagaaatgaacacttcaaactccactctgtgtatttaaggtgatgttaatatagcttactttggggtaccatgttcttatctattttagcttcttaaaaatgtttataaggaggagttaatttaagagcataaagtttctgttttgcaagataaaatagttctggagattgttatatgcacaacaatatacttaatactactgaactatacagttaaaaatggtcaagatggtgaa

SEQ ID NO: 101910 - DNA, 6544 bp, Homo sapiens
ggctgggagtggtggctcatgcctgtaatctcaaactcctgaggccaggagtttgagataagcctggaaaacatgaagaccctgtttctacaaaaaaacaaacaaattagacagacatgtggtgcacacctgttgtcccagctactcaggaggctgaggcaggtggatggatcacttgagtgcaggagtttgaggctgcagtgagccatgaccatgccagtgcactccagcctggacaacaaagagagagaatgtctcaaaaaaaaaaaaaaaaaaaaaaaagttcatcattttaaaaaatgagtaatttaataacaaattacttaaaaaattattaggttaactaagttctcttaagttctaacattttatatgcttaagctatagaacactctggtatgagttagttttaaacggagagaggtgggaagaggaaattaacgattgagggaatttgggactatggagcacctccaggatggataaacagggctgggtgagatgccagaatggaagctggaaaggccacaagggtgagcacagagtgcgagaggggtaaatggaccaggatgtccctgagggaccaaggaagtgaagttcagttccacttctcactttcttggaggttcttaatgctgggtccaactgggtgcagtggatgtatatcctctcccatcatatctgagttaggacatcaaaattatattctttaaccttacattattttttaaaaaatgtatcaaggtgaatttcacataacctgagatttgtagtttttaagtgaacaattcagtggcatttgacacattcacagttttgtgcaaccaccacctctacctagttccaaaatgttttcatcactccaaaacaaaaccctgtacccatctgcattactttttaatgcatgttttatttttaatatagaaaatccttccataatgtattgcaagcaaatgttaatctcactccaaaataagtgttttctattttcttgtttcatctcacctctttttaattaagaatttcattttaattctattgtatatgtgtctccatcattccagttttggctcttcataaggcataaatacatttctgtttcttctacattttagtcttaggactagatgcagtaacttaattttgccgtaagtctataatattttatgatttgtgtatatgtgtatgtgtgtttcaccctatttgttcatttgttatgccttgtttctctgaggtcaagaaattatgaattaattccttctttccagcgctgctgtgctgtatcacttcccatgatagtgccaagagcagaaggagactgaaatcagggcagctctgccaggcttgtaaattacatgagcagccctctgcaaagggagtctaaacctgaaagctataaattagagtttaatagcaagcatttcttcacagaagtaatttctgctaagtcagagctattttggtagtatcaattctctttttgtgttatgtatgattttgatgatttttaacttgagccctgagaatgaaatcaaaggataattagcagtacagaatccaggaaaattaaaattcataatgattctatctatgcgattcctaaatgtgattattttgccacatgttgttgctaatgctttttataaacaaagaattctcttttcttgatctaaaggaaatagatattttggcaatgaaataatccccttaatagaaaagacttggcatattttcctgtttttaatatgccttaggttgagaaaatataatttatatctatattttttgctatctcctacagagataacattttatttcaaattggagtgatttataggtaaatttgtgatggtataaagtatatatttctacgtcaaggcaagcttgcaactataactaagagaaattcttcaagggtgaaaacaataatgaccatttacagagcacatactatatgtaaggtggtgccatgtgcatcacacatgtaaatatagtgtctctttaatcttagtgacaactttgtaagatgagtactgttctttttatcattttacagatgtggatataatgttcaaaaaaagtaattctcccaatatcacatacggagtatatggtagaggtctaactctgaagcctctgctataagctaccatgttatagcgcaataaccctaaagcctgatacagaaaattatgctggcataagtactgaattttggctgaagagagagaagagaattcatgagagttaggttgtaagttcatttacttccttatcctcagatattgaccccatgattccagtatttttattctctgcatttgtttcttatggctgccattacaaaatactacaaaccaggtgacttaaaacaatagaaatttattctctcatggttctggaggctagaagttcaaaatcaaggcattagtacccaagggcctaggcactggctctttccttgcttgggatcttctttctcaaagaaccatataatgaattctctccctcttttaaacctttggtcaaatatcaccttctaaataaggtgaactctggctactgtttttcaaaaattgtagccctgtccctagcacttgcaaaccccctgtactctgctctgctctcttttgtcttcataaccctcatcaactgctaacgtactaagtaattcactttattatgtttcttgtttatctgacttcccctgttaaattgtaagatcccaaagggcaaggatctttgtttcgttcactgatacagctcaagaacaatgcatggcagacagtaagtactcaacctattttggatgaattggataaaccatttctcgacattttacatggccagcgagagagaggctggagtgaagtcactggacttaggaaaattattgctatattttctagtataagtttcatagaggtttttccacagcgcaataaggacagaaattaggaagaattcaccaggaggggtgtgtgtgtgtgtgtgtgtgtgtgtgtatgtgtgtgtacacgcgcccacacgcacgcacacacacatgcgtatctaaatatgtaaaacaatgcaattatttaagtgtaaaattactcttaagacacagaagacatgaggaataggctaaaaatgagtgtgggtgtgtgtttaattgttggaaactcacaaaataccggaaggaaacctatctacaactcaagactccggaaggtcaccacccattctccttaatcaacagaaaagaactgtgtttcctcagacaggtcccttagcacacgtttgtctttgtagcataattgtaaacatgtctgtaaaatgatgtctctttgtaatgtaaaacctgctttaaaaactttagacattcttgaaaacaacttttggttcttttcttccttgcctttcttttctctgccctactttctattttccattaccttttattccatttttgtatgtccagcaatatgtgtggaatgaaaaaaattagaaactaaatattctgcattcttttttaacattcatttgcttaacattaaaatcaaaggtatgaaaaggattttaaaataatttctggtcaaagatactgtgcttttttaggtcaaaccatatgccttgtggggaaaaaagtatttcagaaacatggaattgacattctagagagcctggttaaaaaaatacttttaaaaatatttataactggaggtttccatttggcaacttgaggcagttcccagactggcactgggttttttgtttttttttttttctctcagacatctcgtttggacagtgaaaagaagggggttcctttggaggctccaagtattaatgacacaattgcagtaaatttcttgtaataaaagaacttagctacattgaggcagttacacttgatgctaagatttaatactttaataattatctggactgaggcaaggttatataggcagttgtttgggggtaaaaatcaatgatttattaggagaccatattggataggtattaatgtatttgtagagaaggttgacaaagaagggatctgagtgagaatatagcatgttgtggaaacttttctgagtttcccagcatgtccctggctggattcagtgcctttcttgggtactaagcatgaatcaccatctgcatagctggtattcagcaacactgggctgaaacgccattatcttagttgcctcttctaccagatggtagactccttcaagactgacactgggaataataagacacatagttaatcatagctgccatttgttaagtccttactatgtccaagcctgtgtgctttgcatatcttattgcatttgaagactcacaacaactctgtgaaatactagcccatttacagatgaaaactcaaacttgataaccagggaaataagcacagtgtcatacagttactatgtggaagagctagaaggcttccaattcatgggacctgttgatgtaatttatgaatgaatgaatgaataaaactataaaggagtaatttaaagttgtttacaattttgttacctagttaagtaaaatataaattcatggggacaattagaaaacaagtatttttattgttgttcctagaggctattttagcctgcaaaaccccaaagaagactgtttcctccagattagagtggaagaaactgggtcggagtgtctcctttgtctactatcaacagactcttcaaggtaagcagctgtaggcttgaagaggtgtgagcaagagaatgccaagtacaaccaggatcctttaattggcaaatgagatcggacatgactgattactgaaaatgtgtttttgtaagtgtgagatgaaagcaaccatgtctgagacataaaacacaatagccacaaaagcagagaacagagggaggtgaagcccactgaatccctggactcttctctctcaactcaggcataaagtatgcaaaatgcaattgctcttattggctcagtagattaaactccgttccttccttcctttctcttctttctttctttctctttatttctttctttctcttccttccttccttccttccctttcttgcctttctttcttttttcaagattttgttctcttgcccagtctggagcacagtggtatgatcatggctcactgcagcctccacctccagggctcaagttatcctcccatctcagtccccaagtaggtgggactacaggtgcacaccagtatgctcagctaatttaattttatttatttatttatttttttgtagagatgaggtgaggtctccctatgttgcccaggctggtcttgaactcctgggctcaacccatcctcctgcctcggtctccaaaagtactggaattacaggtgtgagccacttgcctggctatagataaactcctgagggaaaggaattaaaaaatggtgtggtttggaaatggaaggttgcttctcagtcataatgctgtcaccctatttccttaactccatttgaaaggtaggccaccactgagaagctcagggagttaagacttatgggtgggttatgacagcaaccattatcaagtgctttcttttcttttttttcttttgttatacatttctttctactacctactcttgccattgaatatgtgatgaacttataatttaaaatattgataatgatggatgaactgttataatgtccatttgcttcaaaataaaccagtggttaatgatacagatgaaacaagataaaccatgcattgattactattatagctggtcaatgatacattgaggtacaattcacttcactttctaatgttgtgtatgcttgaatctttccattataaatatttctaaagctggaaatacaattttacaagttaaaataaacatgttatgattttaaaatactatgtatttctttaatgttaaagaattaagtgaaaatgtttgaagtttatagaaaatttaaaatatctgctcaagttcttatctgtcaagataagactactagctgtaaggtgttaatagcacagctgtcttcacttgaattttttgtagttgccatttctggcatatgcagaaatgcaaaactattattttatgcaacactatttatttgagccattgtacctgcctaatttttacatttttttaaagagatgagatctggccatgttccaaggctggcctcaatcttctgtcctcaagcaatcttcccactcagccttccaattggctgggactacaggtgcaagccaccacaccgggtgcaaaacactattttaattctgaatatgttactatcaaaaaataaaataatgtttttaaccatcttttcttgtgccgcagtgttacgtgagccaccacacataaagttactgttccagtcaattaaaccagactccctggttttctgaagacatgaatatttttacaagggaactagaaagggaatgaggcaagcatttgagctcaattctttaaaatataacatggggctgggcacagtggctcatgtctgtaatcccagcactttgggaagccaaggcatgcggatca

SEQ ID NO: 101911 - DNA, 1037 bp, Homo sapiens
tgaatttttttttttttttgagactgagtttctctctgtcgcccaggttggagtgcagtgacacaatctcggctcactgcagcctccgcctcctgggttcaagcaattctcctgcctcagactccccagtagctgggattacaggcgcccgccaccacacccagctaattttttgtatttttagtagagacagggtttcaccatgttggccaggctggtcttgaactcctgacttagtgatctaccggcctcggcctcccaaagtgctgggattacaggcgtgagccatcatgcctggccttttgaacattttaaaaactgtcctttccaaaagaaaaattttaaataacagcatctatatacaacttttaggctttaaacttgagtttattaaaagggaaataaatgctttggttactaaatgaactgattagaggaaggtattacacagaaagctacttggattattactaacatcaatgtcttctttttctaaaaggtgattttaaaaatcgagctgagatgatagatttcaatatccggatcaaaaatgtgacaagaagtgatgcggggaaatatcgttgtgaagttagtgccccatctgagcaaggccaaaacctggaagaggatacagtcactctggaagtattaggtgatgtgcatgtatgtgtgtgactacgtctcccactccttctccaccacccagccctgggggcaagcaagcactggtccataaacatgccagcatcaactgggagcctcaaccagtcaagttacagagaccataagcatcaccttcctggcaatctcctggccatttctccccctctcctcattggctgctgaaattttagtaatgcgttatcacaaagtatctctttgttaaaggtggaggcaattcctaatgatcctacaatatacataggagtatctttcctgagagtttatttttcaatagttttcagcatatacacagtttctccaaccatttaaagtagtatcacatgagatggtggagaagcaataacacacaaaaa

SEQ ID NO: 101912 - DNA, 5017 bp, Homo sapiens
tggggaggttgaggtggaaggatcaatgggttgagctcgggaggttgaggctacagtaaaccatgatcacgccactgtactccagcctgggttatagagtgagattctgtctcaaaaaaaaaaaatctatctgcacacacacacacacacacacacactctctctctcgctctctctcacacacacacattctctctctctctccctctctctccctctctctcattaggcttcttttaaatataagtggtaataaaccaattgaagaaaacagtagagatcgtttatctaataaagaatagctgttgtataagctaaagtaatgcttattattataacagataagcccttaactctcagtgagttgcttaatagtaagttcctttctcacttaagtaaagcctaaatagttgggacagtggtggaggagccatattactttatttcatgaaatcattagagactcaacctaatcttctgacatcttcaatatatgacgttccaaggtcaccattgttgttgacacctacttggtagttgcagggggtggaggatacgaatgaacatgtgggaggtttttaattagtctggcccagaaatgggatatatcactttttcccacattccattggccagaactcatgtatatgaccccatctggcaacaagagtgctgggaaacatggtcgactgtgtgcccatgaagaaagaagatgggtttgttggacaagtaagcagtctctatcacagggtccagtaatcacacctctttacctggctattaaaaccattgattgtagagacaaagtcaacagctttgaagaaaataaacaaccttgattagcttataaataatcaatatcatttgacttccattgttcagtggctccagcagttccatcatgtgaagtaccctcttctgctctgagtggaactgtggtagagctacgatgtcaagacaaagaagggaatccagctcctgaatacacatggtttaaggatggcatccgtttgctagaaaatcccagacttggctcccaaagcaccaacagctcatacacaatgaatacaaaaactggaactctggtaaggtcatttcaagatttgacttgataactgtcttgcatttggataaaaaaattattagaacttaagatgacgtttaatagagagctgataccattgcttgctaagtggagagaggcaggggcaccaggaaagatggcagcacttgtaccacgaagtgatggaaagagctactacaggacatgggaacagaaaacagagactgagggagctgactgtgcaaggaccagtaaaagagcaaaggggcaaaggctcctgaaacaaaggagcaaaggctgtgtgtttatcttttcagaatttaaaaagattctagaattgataatcctataaatgataccaattaagattttcgtagaccctaagctacttcctggtagtaactctggctctttaaaggaaatgtttattatttgctgctgcagtgaactcacttgtgacttaggaaagtgcattaacccttttaccagggaggccttcatttatataggtggtgtttcctaggaattagaaatacctagactactgagtactaccatgtgctataaactttaaaaattgcgcggccgggcgcagtggctcacgcctgtaatcccagcactttgggaggccgaggtgggcggatcacgaggtcaggagatcaagaccatcctggctaacacggtgaaaccccgtctctactaaaaatacaaaagacttagccgggcgtggtggcgggcgcctgtagtcccagctactcgggaggctgaggcaggagaatggcgtgaacccgggaggcggagcttgcagtgagcagagatcgcgccactgcgctccagcctgggtgacagagccaggctccgtctcaaaaaaaaaaaaaaaaaaaaaaaaaaaaaaaaatgcatgctgccttcttaagtaacagtgccccaaagcccactaagcctgattcatgatgatgaatcaggcagttatctacagctgtcttctggcctggaaaattactaagtgcagtctcaatttacaacatcaggaaaatgcatgaaaacttgcttggggataccctgaccatgtgaaaatagtaactgtagtcaatcatggtaggattcctatatcattaaatatttccatgactgtagatcaacaacagttgactctgtgactttagtatctattactttagagtccagatattctgtttcctccagtaaaatattcttattgaaagactttctaggaatactgatgacaatctataagcaagctctgtgaagctaattacatttaaaaataaaaagtattttactttttcatctttgattataggaatagaagtggaagtttaaaaaagggtcattaagcttgaagctttttaaaaaaaattcagtcaatgtaatattctatgtcagtttaaaattgtctgccttccagcaacgcagaatcactatgacagcgattatcaaaaaaaaaaacttaaaggcgtggtgataataacaattttaataatttttaaaaatgtttttgagacagagtcttgctctattgccccggctggagtgcattgacgcagtcttggctcactgcaacctctgcctcctaggttcaagtaattctcctgcctcagcctccagagtagctgggactacaggcacctgccaccatgcctagcaaatttttgtatttttagtagagacggggtttctccatgttggccaggctggtcttgaactcctgacctcaagtgatcgctcgcctgggcctccaaaagtgctgggattacagctgtgagccaccgtacccagccaattttaatgaattttgaaaggaggatataatgcttcattcctttcatctacaagtgcacagtaacatttacaaacagatcttctgataaacaagaaagcaaattgctaaagtggctgaataataaagcctattggatgcagttacttcttaagctctggcctctcagcagtcagcaggcgcagtcagcaggtctgagtgattttacactgagcaactgggcagaaaaacctgctgtcacactttgctatatttacttttcaaatttattttttctcagggcagttggtaaaagccccaaggcaagtctgaaaggatacagattcactttcctcagctaacctcaacccttgaaatagcttgtgatgtcaaaggaatgcacctggattgaactaagataggttcttatgtgagaaatgaacaacaaagactccagtgtatggaagccaatgacttccttttaattaccagctataatatgctggaagatcattttgggttttagtctaacatattatttatatgtaaccttggccatgagttcatggtgaatattctaaaagcattctggctttgaggagagtgacagatgattccatagagtggaaaaaaagaaaaacaggaaaactttctctccctccatctaggaggatctaagacaatgacccttcaaggtgaccaggattacactccctttcttccctccctccagccctttcttctttccttccttcctttctccctctctccctccctctcttccttcctttctccctccctccctccctctcttctttcttttctcctcttcttcctttttgtctgccttcattccttccaaatatcctccaaggggataaaaactactgataaaaataacgaagtctattatatcaatcttagcttttggttgctttgacagggatgggaaggagcaagggctggcttttcttttcaaatttaaaaaaattctagagttgatagaatcgacaatcctataaaccgataccaattaagattttcctaggccctaagctacttcctggtagtaactggctctttaaaggaagtgtttattgttggctgctgcagtgaactcgcttgtgacttaggaaagtgcattaacccttttaccagggaggcctgcccttcatttataaatgatgtttcctaggaattagaaatacctacactacttaatactaccatgtgttatgaactttaaaaaacactcattgccttcctaacagtactgctttcatggttaaaaaaaaaaaaaggaacttctctgtatgtattttatctttgttcttctcgtcaaattaagcaaaagtctagcttaaactccttgaagtcatggcagatttttaaattcatagtaaagacagaaagtcccaaatttttaaaaaggaaagacaaacttaatgctaaaatttgagggacagggttatttaaaaagtctacttatagatctatggcttaaaaaaatatatttttgcatccacaaatagcaatttaatactgtttccaaactggacactggagaatattcctgtgaagcccgcaattctgttggatatcgcaggtgtcctgggaaacgaatgcaagtaggtaagcatgaaatattgggaggaacaaatggtttgcaattcgactgtgaagtacagcagttgggggtacaaggagcaaggagcaggaaatgtctgagtgacttgaagaataaacaggagagaatgactaaaattaacttgatatgatgtgttgcaaagaagcaaagatgctgtttttaagccatctcccaaataagccaaaaatacttagtattgtatttaacaactttttttagttttttaaataatcgtttttaaaatacattcttctaagtagtctttctctcaaataaaagctaagtatcttgtagtctaaattgttgaaggtccagaagtttgaatttctgatatttttaaaattcaggaatgtatatcattgatattattcaccaaattaattcaggtgttgacatttatagtcaacgtagcacttatttaagtaatcagaaagtatccctttcaatgctgctttgaaattatcatttaaaaaaattcatcacaacatgtttaaaaattaaggcattgttttctttgtttccttta

SEQ ID NO: 101913 - DNA, 2683 bp, Homo sapiens
cccacctcagcctcctgagtagctgggattacaggcatgagtcaacatgcctggcaccatgtgttttctttgacgttgagtttttctttatttgtgaaattgacacagttgatgatgtaggagaattttaagtaagacgtggggtagggagtggcagtagaatacttgaactcattgaacttcaaagattgcttccagtcttttaatcctgtgaattattacacatctccaaatgaatgcaaaagaatacattttattttttaatctgagaagtttttaaaatttagtatttttccaaagcttaagttctgttaatatttttaatcaattttgaaccatgtcttagaagtgagttagttgaacaggcttcacaatcgttaaagtatgctttatgatatagctgcaaaggggatctttttttgaaccttttcaatttaatgactgcatctgtccgtgtaatccacatatatttatgcgtaatttattttacattccagatgatctcaacataagtggcatcatagcagccgtagtagttgtggccttagtgatttccgtttgtggccttggtgtatgctatgctcagaggaaaggctacttttcaagtaagtgaatttcacccttctttggcagataactttctatggctatggagtttatttatgagatactgtttctcctaggaagttgtttttttgtttgtttgtttgtttttcagacagagtcttgctctgttgcccaggctggagtgcagtggtggcaaaatctccactcaatacaacctccacctcccaggttcaagtgattctcatgtctcagcctcccaaatagctgggattgcaagtgtgcaccaacacacccagctcatctttgtatttttagtacagatggggtttcgctatgttggccaggctggtctcgaactcctggcctcaagtgatctgcctgccttggccttccaaagtgctgggattacaggtgtgagctattgtgcccggccctctcctagcaagttttaacaaactctggagaatattgttcatttattttctgctatagaaaatgttcaggatgacatgcaggtggcttatgaaacaccttggcaaacctagggagaaaaggcagaactgcctagttgcacattccagggagcaccacagaatatgcaagaggcatccttggagtggtgcagtgcagcgagacagagatattcaatgtgaacggatatttatagtatctttgcatgtttttaagatttttttttgtttgtttttttgagacggagtctcactgtgtcgcccaggctggagtgcagtagcgcaatttcggctcactgcaagctccacctcccaggttcacaccattctcctgcctcagcctcccgagtagctgggactacaggctcccgccaccacgcccggctaatttttgtatttttagtagagacggggtttcatcgtgttagccgggatggtctcaatctcctgacctcctgatccacccaccttggcctcccaaagtgctgggataacaggtgtgagccaccgcgcccagacaagatatttttaagttaggaattgtatatctcaagatataagttgatttcaaattctttaagaaatttcattgaaataaataagtgaaatatttcatcagtgtagaacagtgaaatgttgaatgttaaatttaggacaactgtatttagaagagaattgttcagctgggtgtggtggctcatgcctgtcatcctaccactttgggagtctgaggcgggaggattacttgaggtcaggagttcgagaccagcctggccaacatggtgaaaccccgtctctactaaaaatacaaaaattagccaggagtggtgacatgcacctgtagtcccagctactgaggaggctgaagcagaaggatcacttgaacctgggaggtggaggttgcagtgagccaagatcatgccactccactccagcctgggtgacagagcaagactccatctcaaaaaaacaacaaaaaaagagaattgttcagtcaaaaatagaaacctattgtatttatgagagctacttctgtacacagttttgaattcttcaaatttagacctcttgtaacttcacacctccatttgataatgcaataggtttgatgtaaatgggtgggatttaaaaatgttttattctcttaatgcatttcttcactccctctttaatattattggagagctcagaagctgcagcattctatcagggccactggcaatagtgtgtaaaataaaattcttaattgaattataaatttatagcatatacaagttctagacccattgttttacagcgaacattaatttcggaatttagatttttaaaacaattttttttttttgagacagggtctcactctgtcacccatgcctggtgcagtggtgtgatcaaggctcactgcagccttgactttccgggctcaagcagtcctcccacctcagccttctcaagtagctgggactacaggcacataccaccacacctggctaattttcttttattttttgtggagacaggttcttgctctgttgttcaggctggtattgaactcctgggatcaaggaatcttcccatcccaacctcccaaaatgctaggattacaggtgtgagccaccactcttggcctttaaaaatatatttta

SEQ ID NO: 101914 - DNA, 4858 bp, Homo sapiens
gtggctcacacttgcattcccaacactttgggaggccgaggcaggaggatcacttgagtccaggacttcacgaccagcctgggaaacatagggagaccctttctttacaaaaaataaaaaataagccaggcatcgttgcacacacctttagttccagctactcaggaggctaaagtaggaggatcgcttgagcgcagaaggtcgaggctgcagtgagttgtaatctcaccactgcactccaagctggataacagagcaagacactgaccaaacaaacaaacaaaaagagcggctctgtcaattaatacttgttcagtgcttcaatttagcccactttaatgtaactttatgaattgaatccagctgtggccccctgctggtcatcagtgaaagtacagacaaataagataactcttccaaaactcttgtcatctttatctatagcctaaaataatactggtctgagtttttttaatgaggagttagtaaaaaaattttcctaaaatattgaattaattaaaagttgacttgaatattaggagttcgttacctaagaatgttactctgatttttcatctagcagaaaaatctatccaagagaagcatattcttgaatatatgtttaggacagaggttggcagactactatctgtggaccaaatctgccctccccgcctatttttctatggcctatgaacaaaaatggctttacagatgaacatttacaatctatttgatgatagggcccgctgactttgaaccccaattaagagaaatgttatcttccccaaaagcattccatttctctaactagtaggcctgtttttcaagacttttattattattgttattattattattatatttttattttatccataaaaatgtttggaaatttgtttgctctcttgttacttaagtacctatatagtatcctcttggccccaaagcctaaaatggttgctgtatggctctttaccaaaaaagtttgccaactcttaatttagaaggtataaacgtcagcaagtgaagattaaaattaataaaaataaattaaacccaaactcatttttatatgaatctgtatcataccataataacccttgcattaatgatatatactttttcttttgtagaagaaacctccttccagtaagtatactttcctacaatgcatgtctttctcctatgtcaactaattttctattaatcatctgtttaaagtcaaaagagagaagttgggttatttgtgtaggtttactctcacaagaagttactcaagtttatcaagaaatacatctgtattaggctgttcttgcattgctgtaagaaaatacccgagactgggtagtttattgtaaaaagaggtttaattggctcacggttctgcaagctgtacaatcctggcaccaacactgcttggcttttggggaggcctcaggaagctttttactcatggctgaaggcaaagcgggagcaggcacgtcacatggcaaaagcaggagcaaggttggggaggtgccacatacttttaaacaaccagatttcaagaaaactcagtcactattctgaggacagcatcaagggggcggtactaaaccattcatgagaaatccgcccccatgatttaatcggctccaacaaaccccacctccaacattggggattacaattcaacataagatttgggcaaggcaaatatccagactctatcaacatcccacttcacacttcatacctacttgtaaatggtagtacagagagaatgatgattacccagcctacttgtaaatggtagtacagagagaatgatgattacccagacaagaaatatggtcactaatttgatttcataggcatttgtataaactaacttaaaaaaaatttactgtattttgctaaattgaaaattttcaaataaaattttagttaacagtcatttttttatattaattgaataccaattttgtgcctaacactgttctaaggaatggggatacagcagtgaacaaaacaggccaaaaaccccacaaaactctgccttatggagcttacattctagtagagaaaggcagaaaataaacaggtaatactatatagtatatcagatagggccattatggagaaaaataaaacaaataagagaatatacaatacaaagggtaggagtagagattctaatttcaaatagggtggtcagaaaggatctcactaagtgatttttgagaaaggcctgaagagggtgaggaagcaagttgtgcaaataaccatgagaagagcgttcaggcagaggggagagagcaaattgaaagatcctgaggccaggcaagcctagaatatctgagggatgtcagcgggaccagggtggctggaacagaatgagagaaacagaggagatgagcgtacaaaagtagcggtgggggcagattgtaaggagtcccttttaggcagtcgtgaggagtctggctttggtctgagtaagatagaaagtcactggagggctttaagcagaggagtggtgtcattttaatttttcaaaactcacactggcttctctgttaagaataaactatgagatgacaaaaggtggaagcagggagatcagttagcaaactaccacactaagtgaggcaagagaaaatggtggctggtgccaaagcagtgttggagatgctgagaagtgacagtgttttggatataatgttttaataacttgctgatctgttggatgtgggctgtgagagaagcagagaaatcgaagatggcttcaaggttatgagaaggatggaattaccatttacggaagtgtggaagattttaagaggagagagtttgggagtggtgatgggaataagtggagaggttggagtgtttggaattttaatatttgatatgcttatttgattccaagtagaggttatcagtaactgaatattcaaaatctagagtttggggaaataactggaaatggaattgtaggagtcattggtacatgaaatatgggtgagctccccaacgccctgtagtttgtgtgtacttgttttatgactgtccttcttgtatgtacagatctggcagacctaactttggctctatgggcgtagagagaagatggatgacaaactatctgaggctatggcagctgggagtggagaagatatactgaagccatggcttcagacagtttgtcatctcctaattcctttgaagaatcatctgccattgacttcctgttcccagatttctggctcaatcctggtctctcagtctcgtaagatcctaatacaagtctaggttgaagttcagattatcaagaattagcagtaataaagccagtgagttcagaagggcagggtagctggaaagtgttgctacttcccacccctaacctccaggtgattgtgaggacttctgcttttattgagtgacacgaaaagtaattggaaggttttgagcagaggggagacatcatcttacgtaagtgggaagggtgacatagctgcagtgagggaggttattcttctatcagtatctctagcaaatcaagtagtaatctggtggggaataacttcattcctagacatatgccctcacattcattaaatctgtggccttcaaaatatgttcaataacgaaatggatgactggaacactagtcaccatgtaaaactttttccacggaaaaataaataaattttgagattataatagtcaagctttcaaaatattaaatgttaatatattaaattaaaagttagtaagtctctggtttgtgtattccacaaaaatctttagtatactagccacaagctacatttacgtgcacaaggcttcacactgatgttttgttgcatgactttctctgtgaatattgtctgtaaatataagaaattcagtaagaattgtctttttttctacctaagatatatgttcatgttcttgctgagaaaatgtatggaagtaaaattaactaaaagagcatatatgttccagattggaagtgataatgtagtaaatattgtcttttatattccacaaacaggaagagtaattcttcatctaaagccacgacaatgagtgaaaatgtgagtatctttaaagcatatttatagaatgaatatgtttggggaatagggcagggaaatgaagtaattatatggactttgtgaattttcacttttaatacactttgcaccagtgtctatcactggtgtttaaaaggagctaagtagatgttagcttctgtaccctgtctaggatggcatgataaagatacctggcatttccaatagcagaagtgatctttaatcatatcattatttgtttcatggtattttctataattagtctgccttcttagtatcactaggtctggcattatcagctccctttgacagatgagtaaattaaaacacaggttcttacagggtaacagtggtggagctgggacccaggctcttttcttccctgtagcttgaccaagcagagtggttccagcagagctgtggttctaggactcacctttggttatgtgaagcacttggaacattttagggctatgcaatgtcttagtcatttgggctgctataacaaaaataccatacactgggtaatttacaaacaacaaatttattttcagttttggaggccaggaagtccacaatcaaggcaccagtagactcaatgtctagtgagagcctgttcctcatagatggagacttcctgctgtgtcctcacatagtagcaggggcaaaacaagcaccctctggcctctttggtacgggcactagctccattcatgaaggtcctgccctcatcacctaatcacctcctaaaggccccacctcttaatagtatt

SEQ ID NO: 101915 - DNA, 4232 bp, Homo sapiens
aatgcttacccacttttctgtaaaaatttgattttcaaaaactgttccagaaactattacagaattcaccttattttgtggtttactacactgaaagcttactgatgtttaattaggggacaagaaactttgttcccaccatttttgtgcctacaatttatggaaagtctttgtttctgcaatttacagaaagtactcttggagtgtggaatcgaatactcccatccctccaaacagtatgaagcacattgtggctaaactgaatgaacaaaagccatttattttttctttgccttcctctcagttgcccttatcaactaacagctagagtccccttcagttctcttgtgccctaccacagggtttctcaacctcagcactactgatattttgggccacatcattctttggtgtaaggtgctgtcctgtacatcataggatgtgtagccacaggcctggcctccaacaccagatgccggggcatcctcctaacaggatttgtctgcctctgccttccagtcctacctctttactctctaggcaaagcttcagagtaccttgtctgctaggagttagttagttaattccccataaaacaagtttaattaaatatatactggttttggccaggtgcagtggctcacgcctgtaatcccagcactttggaaggccgcggcgggcggatcacgaggtcaggagttctagaccagtctggccaatatggtgaaaccccatctctactaaaatacaaaaattagctgggcatggtggcatgtgcctgcagttccagctgcttgggagacaggagaatcacttgaacccgggaggcggaggttgcagtgagctgagatcacgccactgcagtccagcctgggtaacagagcaagattccatctcaaaaaataaaataaataaataaataaatactggtttttacctgtagaattcttacaataaatatagcttgatattcataagatttatgtttctttaaatatgaattcatatatttaaacctgttttttctttcttttcctaggatttcaagcacacaaaatcctttataatttaaagactccactttagagatacaccaaagccaccgttgttacacaagttattaaactattataaaactctgctttgtccgacatttgcaaagaggtacacgaggaaatggaattggtatttcattttaattttcatgactactaactcacctgaacttgctattttaaacaaatagttctgtcgacacctaaaatataatctggcttcttgtgtctggactaagttaaaagaattaaaatactttgtaatgtcctgggctttgggaaatgttaaccacgtcctaacttctagagaacgttactaaaatataacatactgattgtgaagtcaatccacaggtcatgaaaatataaatcagactctgcacgagagtctgatttagggggtccaacaaatactctgacagatgcaaaaggaacctctggtctcatttctgccagaatcctcttttctcccctaatatcatccttattctgatgctcgttcatcactaacacacccacagaaaggaggaagcgggatgggtcttatgcccaaggatttgcactttgtgtttacttccattcctgggaactaaaagcaacatcaaaagaaatgcctaatggctggagcccacaggtgtgcaccacaggatttgcctggtgtgtgtcactgatttcttcattaaacgtaatttagatggtcaaacacaaacccaagtggcttatttcacccctactgctgcttgccactgcttccttcttgtaagatttctttgaagaggatcagtgactttgacatcagaactcaccactggagcctacacaagtttgcagatacctttccctgcaggagtggtgacttcacatctttctgtctctaaaaattgtgcagtgacattccgggccaagtcccttagtcaggggttgacaattctgcttttggacaaggagggatgtggagggaagaagtaatagtctaccaggaaaatgagacgaaaaagctcagtatgactccctgcatctggtacccctcttgaaacacagtgggcacatgagcaatggctcaaacgaaaagtggatctaatgtgggtttctcaaccgatgaaccacaaaagcttccagctactattacaatgtgaaaattccaatgatccgtttaccagagcaattagactatgttaaaaattcatatcatttgtaacttcttttaattactgaattgatattaaaaacaaaatatggctagggcatgtcctattcttctgggcaaatgtggatgaaaaggtcacttgctacctttgacaactatgaacatgatggttaatcttctttctttttttttttttttttttgagacggagtctcactctgtcgcccaggctggagtacagtggcacaatcttggctcactgcaacctccgcctcccctccgcctcccagattcaagcacttctcctgcctcagcctcccaagtagctgagattataggcgtgtaccaccacacctggctaatttttgtattttagtagagaagggtttcaccatgttggccaggctggtctcaaacctctgacctcaaatgatccacccccatcagcctcccaaagtgctgggattataggcatgagccactgcactgggcaggttaatcttctttcaaaagagtctgctctttctacccaattggcgaagcaaatccccaggattcaccgaacaaatggattaagcacccactgagtgcctagcatgtgcctggacaccaggccaccgggaagatgctccccctttgacttgtctatgacatgctatgtctctcaccagatcccttcctggaggtcgggcttctgtaacatggctctgcccccaaaataaaattttcaccacgagtcagggatcggcaaacattttctgtaaagagccagaaagtagatattttaagtcataaggtccctgttaacaactacttgactctgccattgtagcacaaaggcagccacagacaaaacaagcaagtagtcatgtctgtgttccaataagactttatttacaaaaacagcaggcacagacaagatttggcccacaggcatagattcccaactcatggtggtgaagtacagaaaaaaacacctgtctacaagcttttgtaagaaatcaggctaaatgttacctatgttttggttggaagatttctttggtttgaggaatgctttcctcttgcattggcatgccaagaggatagatgactctgaaagacgcctcttcagacatacctgtcatcacacaagatcaacttcttcagtttaaatgacacaaatccatattgtggaaggaaaatatgtagtgccttagcttcactaatagttgtaaaacttctttttaagacatcaaaggctagaggattcattttatgcagtgcgaacatctaataacactctctgtgtcaaatatatattgtacattaccttaaactattgtaatagctaggtaaaaatccttgtataaaagaatgttttcccccacacaaagggcagagtattgagcactaatttcctattaaaagtatatatatgtatctgtgggtcactggtgtccagacttgtatttgcatttgtgtttacttgaggaacttgaacactaacaactggtaaaatcccattgtaattcttacagcattttgactttattttcctgcagtgaattgtgttgtgtaaagattagggctttaaaatcttattagcaagctttgttttgttttaattattgttgctgttgtaactagatttaatttatttttagttggaggtttgacctaagtctggaccaattgattgcttttcaatacaactttgcaaagaacttcctttttccacaggtggctttgttcgattaaagtctacactaataaaaatagctgaacttgttaaactttttagccccatataacagtgcagggaaagagtcatccacctattgttattcataaaacccaggaaactacaccctcttaccttctgtagctacaaggctagctgctggttagctgcttaagattagaatgtcatcatctctggatggctgccaacttctcaaatgctgagaaaaatgctctgaaaataaaaagcaacaactatttattgaacactttatatatgtcagaggtggggatggatgggggtgagg

SEQ ID NO: 101916 - DNA, 1026 bp, Homo sapiens
gctttttaagctcaagcaaatgtttggtaatgcagacatgaatacatttcccaccttcaaatttgaaggtacgtcttataaatcacagattcattcttgtgggggataagtgaagaatatttacacttacctggatttttagagaactgaatgacagtgttgacatgtgaatttattaggaccatgacgtgtgcctgagaagctgccggctaaatgtttgctgttagaataagagcagtataggagatcacataacatagtgattaaatggtggggatctgaaatcgaactgcccaatcttgaatccttataatcactttcagctgtgtaatcttgagtaattaactggtgcatgtctcctcatctgacatttggggagaattatagtatcttctgcatatgtagttaaatgacataatatatgcaaagtcaattaatggaatgcatggctcatagaaagtgttgcataaatgtttagctatatttctatgtaaatgtttacaaacagtgtttactaaaaaaatcagaaaattgatgagttaaatcttgagcattctacataatccattttattgcaatttggctaagcttgacccttttttccccctcttcttagatcccaaatttgaagtcatcgaaaaaccccaggcctgaagaaataaagtaaaattaatctggtaatttgtcacggattagttgtacaactagttagaagtttcagaataaacatgcatttcataactgtcaaatgttcttttaattctgagtccaaataaattatttggtgatgttgagtgtgttcttgatgaattgagttctgtgtgttagagttgtttttagatcctttcatttggttataataaagcagatggagaccttggatgaactggacacaacttgcacataaccctgcttgttgtggagggatgttacccttcctttagaacatgaagaaatggtttataaattcttggtcatagctttctcagaaatctgagtgtaattttttatatgtcttggaacatc

SEQ ID NO: 101917 - DNA, 1050 bp, Homo sapiens
ccttagctgtcatcaggtccaaacccaaatcttaggaacagtgaggcgcaccaattcatagttccattttctttcatatagttgtctactgtgtgtaaagcacttggctattaaccgtgatgggccacagggcatttttacaatattcttaaagtccgataggagtagaaagcttctaagcaaataaatacaatataaggtaaaatgagttaggtgctaaggtagggaaacgctgggtgcttggggagttcataggaaagaatactcctttccagctagaggcattttagaggcttcttggaaggcagtgtttgggtactcatccctcttgagaatctcatggacaactgtggatcatcttcccagtttaaagaaaaaaacgtgaagaatttactcacatcattttccttatagcatgaaacagttctcaaacccacaggaggccttcagtagacctgtacacccaggggtttactctaggttttaaagatcagtgtatgaaggttggacagataaatgagggtaagaggagagtatcttttaggaggaaagaatggtgtgaactaaggcatgaaaatgccttagtttgtgctagaaagcacaaaatatatttggtgaatggtataattctatttccctggagtatagggtatatgaagagtataaggatggtatggggttagaatgagggattatggaaggccttgattgtagactgagcaagtaagatatgtggtaggcatttgtgagaaattacagctttttgaacatgactgtggggatggaagattactctgaattaggaggataattttaaccagggtattggaaggattgaaatgagaagagagcaaagacagacatgttagcaaaatgtaacctaagcattagttgatgagaaccttgactttatagcagtggtaatgtaaaagtgacagagtcaagacattgaaacactgatgcctggttttggtgagctgctggagaggaagaagagggaacaataaaagaaaactgacttttgaggcgaggtaactaacaaaggtgtta

SEQ ID NO: 101918 - DNA, 1121 bp, Homo sapiens
ctttgatttagttgttacagtattcttaaatggctggaatccatttgtaacaggcagagcagtttctccctctgtgggcctgtgaagtacacattttcaggttgtcatgcccggctgaggtatgggaaaccttgtacattagtttgggggccagtgtacttttcctgttaggagcggacagtgttgcaacagtctacctctactgttttctctgatccatgactaagttcaagggggaagaaatacctcacctcacattttgtgctctaaccctgatgaagcttcaggcctgagtttctaactgttccattatcccagagccttttggttaagacctaaaaaacttgcaatggggaataaggaggagaagggaactgtggtcaggtatagactgagatctgatatgatgtaattctgtagcaattagtagaatttgattctcatgatatatttagaggtgatttataataagtatattaacgtttctgctgcttgttttctgtaacagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagtaagtgaataaataactacagtgtaaatataaatattcaaagtatgtaagtttcaaggtggtaataaaaatgacttggtatttgaaagtattagaccttcactgagctcatctctgacatagaggttcattaggtgccctcaaaaaagaagataaggatcttgatttttttaagtcagaaactgtatctttatatgagttacaagggaaaatcctactaaatttattgctgtttaaaatacattcttactgtcatgtcatgtattataaaccacatcaatttatagaaatacatagggtcttggaaatcatttagcagctaagtttgaaaaaagtaactcccttagacattgattagccgaagatcataaaactaattggggaaaaatatattatcaaagtatattttagcctcaatttagtggcctttctgtgacattgt

SEQ ID NO: 101919 - DNA, 2039 bp, Homo sapiens
tgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgaggtacaaggaagcacaacgccccaatccgctttgttttacacagtctcactttccctgcacctttatacacttcgataaccctaacgaacaggacgctgactcggaggggagcttgaactaggggaaaggccactcaaagagcgcatgcgtacagagcaaggtttcaaggaggggaaaaagaacgggtcaaattaggcgaagaaaagatggcggaggctgtgccaggggacccggaagcacttaccctccacttcctcctcctgtttggcttctgtctcacctagacccgtccggtcgcagactgtctccgagacgcttcctgtccggtgagcgtcgaccgactgaaacggcggcccataatgcattgcgatggcgggtaggcgtgtgggggcggagccagggccggaagtagagcggaggtggtggcggcggaggctttggcagctcgggactgagtgcaaggtgactgggagggtagctagatcagcgtggccttttgggactccagttctgggttttttcacgaggcctgggctgcctctcacctttactaggaggagagagcagctctgtgtcctggggaccttcacggcctggcccggggtcacagctgacctctacgtttgtagaccttggagtttgccgtagacccagaaataagatcgataccctctctgagggcaaatcggggcggcgcggggggcagggaggcccgggggtctcgggcccgcagcctggctggggcaacccaaggtcaggcgcgcgggagagattttcggccaggcctacccgccccgggcgcacgggagcgtctaggctacttaggcagaacgtgtaccattaagagggaaaaaattagtcataatattgaaagtttgcatcccacctaaaaacgatggtgctaacacttcattaggcgactttatggattgttcataggaatatgcactgaagaggcagcgaacctactaacctttggccggtcagtcatcactataaatagaaccatgctcccacccagaacaaggcctctgctcagactagtgttttcttactgttgccttccccagtctttctgatcatgtcagacgctatcatatgctctcgtggcacccgatggtactggaatagagaatttatgtcaggtggtatttcacagctatttgtgtaatgactatcttctgcgttttagtggacaatatgcattcactaatcagtgaaaaaaaatgaaagggattaaaggagaaggaacaagttttgatatgggattatgtgttcgttttttggatgagttcgtaggacttataagggagatgagaactgttgaatgctgtggatagatttggggctcaggatgaatactaaaattagaaatgcgattggggaatcataggcacttacatggtggataattgaaacaatgaaagtggattttacccgtgttgcagaaggagtaacatctatgcagtcagacttagagcaaattaactgtgagaatacgtgcagcttaatctttcttagatacagttttatcatctgtaaagcagggataagaacactttaactctttgagagtattgctgtaagggtacaaggaaaggatatatatggaagtactttgcacagtatctagggctaagcaaatgtcgggtgaacctattgctgaatgttaagcatgtccttagtttgccagaagggaaagtggcattgaattgcacaatttttttttttgcatatatgtgttaagttagattttgctgtgtaactttgaccagatactttttttttgagacagagtctcgctctgtcgcccaggctggattgcagtggcacgatctctgctcactccaagctccactttccaggtttacgcccttctgcctcagcctccggagtag

SEQ ID NO: 101920 - DNA, 1006 bp, Homo sapiens
gggttgccccagccaggctgcgggcccgagacccccgggcctccctgccccccgcgccgccccgatttgccctcagagagggtatcgatcttatttctgggtctacggcaaactccaaggtctacaaacgtagaggtcagctgtgaccccgggccaggccgtgaaggtccccaggacacagagctgctctctcctcctagtaaaggtgagaggcagcccaggcctcgtgaaaaaacccagaactggagtcccaaaaggccacgctgatctagctaccctcccagtcaccttgcactcagtcccgagctgccaaagcctccgccgccaccacctccgctctacttccggccctggctccgcccccacacgcctacccgccatcgcaatgcattatgggccgccgtttcagtcggtcgacgctcaccggacaggaagcgtctcggagacagtctgcgaccggacgggtctaggtgagacagaagccaaacaggaggaggaagtggagggtaagtgcttccgggtcccctggcacagcctccgccatcttttcttcgcctaatttgacccgttctttttcccctccttgaaaccttgctctgtacgcatgcgctctttgagtggcctttcccctagttcaagctcccctccgagtcagcgtcctgttcgttagggttatcgaagtgtataaaggtgcagggaaagtgagactgtgtaaaacaaagcggattggggcgttgtgcttccttgtacctcgtgagcctccgttgccttgggcggtcgttttgcgcaccctgccgggagttgtagtcctggacccgaaggtgcctgggaggcgggaggggggttggggcttctcagcgccgattccgcgggaagggccctgggacctcacacttctagtcgcgggagctgcaggtcttacccggagagacgctgcacgtggagccctcgccgctgccgttctcagccggctctggagtgcgggcgggggcgacagggccgattc

SEQ ID NO: 101921 - DNA, 1092 bp, Homo sapiens
atgtcaggttaataaacaccagttttttaaaaaattagtttataaatgtcatttgtggattttctttattttatttttcaaacagggtctcttgtcgcccatactggagtgcagtggtgcgatcatggctcactgcagcctcagcctcctgggctcaggtgatcctcccacctcagcctccgaagtattaatagctgggactacaggcgcgtgccaccacgccctgctcatttttgtatttttagtagagacaggatttcgccaagttacccaggctgatttcaaactcctgggctcaagcaatctgcctgccttggcctcccaaagtcctgggattagagacatgagccaccacacccagctgattttcttctatatgtaaagactacttccccctcttctgcttggcgtttgctttttatttggattgggtctctacttcttgtgtgtcatttcgtttatgtggatagttttaaaatatcttaaaaagtcactcttgcaggactgatcctttgaaatactccagccatgactaaaagagaagcagaggagctgatagaaattgagattgatggaacagagaaagcagagtgcacagaagaaaggttggtgtttctgaatttatcattttttttcaaaatatcaatatacctaattaaaaccaggaaacaagtcatagttcttttggactgtctttttttaactgttctcagtattttagggaataatgtattgttttatttcctctgacttaatgtggttgtagctgagagggaaagacagttttaaactaatggtagtaaaagggtaaatgaaatcaaaagcaattgctttcaatagttttctcctttggggcatttgattctttattcttttcctcagcactggttgctttaatttcagaaatagtttaattcaacctgaactcatttaacaaatatttatgagtaactgttgtaaacaactaattgacaagaatatgtgaataaataagatactaatctgcccttataaaggccacgttgtatttgaggagacatacaggtatatgagtacttacgggaccagtactaagcataaaatgtagtgaaa

SEQ ID NO: 101922 - DNA, 1041 bp, Homo sapiens
aagggaaagtcttttatttaacttattctatttttatatctttctttttttttatgtggggaagggaaattgactagtagagatggcatacagattttgaggagacaatgtgtcttcctttctgggtctaaaattcttcaaaataacttgaaaatgtaatgcaaatgcaaacataatgtatgtgcaatgtttatatgtgtacacatacacacatatgtatgtacatacataatgaggcatatttacaaggatgctttaaatttcaagcttagcatttctctatgaaattcagtgttcattttggcaacactagttggtgatgagcctgccacagtatctatgtagaaatgacttttcaaagaccagaaatgtgttttggtttgggattgtgtttttagcatattgttgctttgaaatccagggtaaaaaatgtaactgttagcacttacatctttaacatttagcattgtagaacaaacctacgcgccagctgaatgtgtaagccaggccatagacatcaatgaaccaataggcaatttaaagaaactgctagaaccaagactacagtgttctttggatgctcatgaaatttgtctgcaagatatccaggtaatttttatttttgtaaatttctattgcaacattttagtctgcataggaatattttttgttagccttttctttatagctatagactttatctctgtaagaagatttgacctgtattactgtaaaatttaagtgtttagaaataaaaaggtttttaagcaaagttttctccatttaaagttatattttaaatatttagtactaaaacaaatgaaacatttgttttttactttcacaaatataaaacgagaagtttaaataaattagaatcaaagcttaaatataagtagtaacagtaggaagcccattgacttttgaagctgaagtgtatttctagccagcttttaacttctcaaacgtatcatttaactaaatgatttctacatttctgttttacctttattttctctaacagtaagttttggataagaa

SEQ ID NO: 101923 - DNA, 2499 bp, Homo sapiens
ttggtaatttttatttttatttatctatttattttattgtggtaagaactggtacttctttttttctaatgatgtttataggtagggtttgtgtgtgtgtcttattttttataaaattattttaaacttgtagaaaagttgcaagactagtaaaagaattcttgaatatccttcacccagattccccaaatgttaacttttactacatttgctttattcgatgtagtttttctctaccatttgggaacatataaactaaattattttttggtgacttctgcgttttcatttagatttacaatttttttttatccactgttcaggaattgaaccaaagttaaacatccttgaaattgttaaacctgcggacactgttgaggttgttattgatccagatgcccaccatgctgaatcagaagcacatcttgttgaagaagctcaagtgataactcttgatggcacaaaacacatcacaaccatttcagatgaaacttcagaacaagtgacaagatgggctgctgcactggaaggctataggaaagaacaagaacgccttgggataccctatggtaataaaatgcataattctatattgggtagaataataggaattaagcttgacatagaagacactagggtaagttataatctattttacatgtagagttattaggatgaatgttgattttctgtatctctcttttaattgtaacgcacatttaagctcatgtggtggacaaattctgtcctgcgtgcaggaaatacaaagaagtctaaaaaatttctgctcttagggtgttgagagtgtagttgaagagagagaagatagatgaaaagagatgattgccataaaaggtaacatgtttttaaactgccagtaactcttgtagaagtatgctattggaatctcaaagagatcatagttgccctgagggaaagctgaaaagagtttattataaataagataccattgggcagagaaagacatttaagacaggaaatgttatgtgcaaagcttagacctgggggtatgcatgagtagtgagaaaatggagtggttaaggagttactctgtagcattacagaactgtttttgattgatgaaaatgataattgaaaaatgaatatggtggcaatatatggcataagttggaacaggtagagactaagtgaagggaaaacaggagcatattattatagttgtgactggatgataatgtctacattagcccagactccagatgatttctttgggagtagcaaggaaaaagtggatgaaaacagtgataggactgagcagattgacagattttatgagggtagagagggaagatacaagtattgatctaacttctcaagcttcatcttggtgactaaaacagtaataatcttgataaaaattggttccatcatcattacatatttagtgaacactaccgtacaccaggcaccatgttaaatgctgggcttaattaagatggtgcactatgaagagcatgctttcaaaagcccagttggggaagtagagaagtctggtataggaaatgtttttttcaagagaaggtggatagcacttgattttgatgtggaagtttatattcagctggaggttagccagaaaatggtttcagttatataagatttgggctggagacaaagatgttatatgagactcattcccactgaatttatatttgaagctataaaagtctacgtagtccctgatggaaagcgagaaatggaaaagaacacacaactaaaggcatatacacttgaccctgtaaacatttagggttggagaaaagggagacaagaaataactgaagagacagaaagaaagtaataacttatatgtatagtgtcactgaaattgaggggagagtttggatggtcaagactctcagatgctgctgagaaagtcaaagaatgctgactgatatctattaaatttgatgatcagaggattattcttaaatttagacagaagtaactagagttggcgagacaaaacagaattataagaaatagatatcttagaaatgggggcagatgaggaagaatgctggggtaacaaataaataatactgatcttccaagagttggcggggacctgagtgtatttgtaaatgaaacagtattgtcgggtttttgtcctttttttattttttatttttagagacaaggttgtacctggggagcagggctgatgacagaaaggctgtattgtagaaccactgttttccctaggacattttttttctttctttaaaccaaacctaaaagatacacagtaaatgagagagcttacccatggaactgaaagagagctatggaaccagacagctaatgtagaatttcagtctgtccctccgctgcccagtactgtagccactaatcacacgtcagcacttgaagtgtctctggtcaaaattaagatgggttgtaaatgtaaaaatacccattaaaagaaaaagtataaaatcttttctaattttttat

SEQ ID NO: 101924 - DNA, 1022 bp, Homo sapiens
ggtgctttctctggccaggtgcagtggctcactcctgtaaccccagcactttgggagtctggggtgggcagatcacttgagatgaggagttgaaagtgctttctctgctggtgaataagaaatgagctctggagagaggcatttcttaattgtttataattttattcttgtgaggattctcccagatgttttttttaagtatctatgatactaaaagacttagtacattcattgtatttgcagcatttatttccaatttccattcttactagataagtaagttgaatgtcctggttgaagctttgtccttggtttcacagatttccttccctgcagaggttttgaaatgaataaggtagattctgaattgtgaaacatgtgagtcatgtttattgaaacactttcttataagaaatctcaagaacacaacaaagatagtgcatagatggtagtttcatttttcccaaatccacgttttttccagtctttcccaggtcagctgtttgttgtggctgtctctttctggttctcttattgcttctcaaactttaaagcttattcataggcttttcccagaacagaagtcaaaggtgtcttgtgtatctttccatttccatgcagttgaatgagtcttcctcagaaaagctctgctctggaaccattgctttgtcttttaaagcaacaaagtcccacagcctagatgagtgtctcacggaatttcttggtgatccagccatggttcttcactctgccggggtagggaaatcccatctgctttggaaatctagtgctcagttcagaattgggagatgggcaggatgatgtgtaagggtatttctaacagactttctagaattcacaagtcttacttctcagaatagggttttttgagctcagtgtagttagtactctggtcccttctgtagagagaagtctgcagcctatctgcgaaaggcactgattctgggacagaactgttaataacccagcctctattatccatcctcagtgatctctcaaga

SEQ ID NO: 101925 - DNA, 1051 bp, Homo sapiens
gaggagaatgctcagaactaggagtctggataaaacagtgaggttgtcagttgactgaaaaagtaactgttttgtgcactgtgctttttaaaaacatgtttctttaatcctcacaataacctcatgaggcagtaagtataggtgtctaatttaaacttgaagaagttaatgttgaaagaggtcggtaattttaccaaagtcatatagtcagtaagagctaagaactaaatccagatctgtctgaagccagtcccatataattcttaagtcctcagtcttcagaccctcaaagctcccatctgataggattctgacctctttttacttccccaaccttttccagctctgcgtgtctggaactggatcctggcaaggcacccttagcggagtcttcttgggagcccaggcctcagtacccagaatgattgctggagggtatagtttcaatttcaagagagaggcatgcaatttgtgatgggcacaaagtaggctgaagtaatagagactgggatgtgcaattcttgtgagaggtaaagaataacatctaagtagggaataacaacagataagtaatgaatggttctgtaaagccttatctcaggacctttatagtatttttattttgggaactatatttttaaatgtgaaattatttagtttaattgagacatttaggactgctacaattgtgttgaaaatttgctgtctttaagtagaagcattataaagcttaagcagctttagtcaaaagtggatgttataacaaataatgggaaggaggcctttttggtggagatacgtacctaaataatttaattttggtgtatattttatctttgatctgatcttgaagatttccatatttttacatggctttatgtggatttcaatacaaatgtttacatttagaaaaccatagttctctgcagaactttactgaacactaaaagacattggagcttttccctgtgttatttctcttaaggtatcttttccttttaaagtgactatcaaatatttttaaggtttttatgccagtaagtttcagttc

SEQ ID NO: 101926 - DNA, 1045 bp, Homo sapiens
tcagtgcaatctgctacacctactaccattaaagttataaatagtagtgcgaaagcagccaaagtacaaagagcgccgaggatttcaggagaagatagaagctcacctgggaacagaacaggtatttttgtattttcttgtatttataaaatatatctatctaattaggtatattttgttgtattttactgtatgaaaaatgtgaatttggactatccctctggcagtttttagacagcatttctagaaaaacaaaaattgtttttgccatggctgagatttaaaccacgggaccagtttgttgtctttgccttgggctaatctataacactatagctaatgctttgttcctcttaccaatttaggaaacaatggccaaatccaactatggcagtttttgctagaacttcttactgataaggacgctcgagactgcatttcttgggttggtgatgaaggtgaatttaagctaaatcagcctgaactggttgcacagaaatggggacagcgtaaaaataagcctacgatgaactatgagaaactcagtcgtgcattaaggtaagcctttattacttttttttctgttatcaaaaatagaaactttctaaaaaatagtttcttattctagatgtaataagcattgttatgtaatgatattaaaaacttgtttatgtttttttctttacatattaaaaaacctttttaaaaagatcttaataatttcgaggtacagttttttttttacaaaattactctaagattgtttgtttttatctgatttgaaagctataatactctgtcccaaaaaaaaatgtttaatttttgaggtttttattatttgcatagatgaattgagtgttagtttttaatgagtaagcagaaactgtcctctgtttttacaattacaagcagaatattgacccattttctacacaatctgcctaaatctggatatccaatctttacattgatacaaactctccgtaagtagtataaggttttttgacagaaattactatcagaaattatgcctactacagtgatg

SEQ ID NO: 101927 - DNA, 4236 bp, Homo sapiens
tgatatgagggtataagcactgttaacctcactttatagatgaggaataaaagctttgagaaaatatgactcctgtggtctcaaaaatgttaggttttgaatcttggctttctgactccaaagctcttgttcttaggctcttctactgctctcaaggttttttgttttgtttaataattatttttaaatcaatgttttattctaattgttgaaaatatgttttgaaagtttaatgtatagagttttggagtagtgagcattgaaattttagtaaataatgttgggatgtttcatttgatagtagcattaaatattctacatagcttcaatattaattgctattgtggcggatgcagtactctactaggcttctgcttatggaatagtctgtaaattattgtaagaagtctcattttttctgaagtctctaatttttttttctctttttgaagatattattacgatggggacatgatttgtaaagttcaaggcaagagatttgtgtacaagtttgtctgtgacttgaagactcttattggatacagtgcagcggagttgaaccgtttggtcacagaatgtgaacagaagaaacttgcaaagatgcagctccatggaattgcccagccagtcacagcagtagctctggctactgcttctctgcaaacggaaaaggataattgagccccaggacattctgagactccaaagtctttcttaaaatgtttagagcaagtatagctcttacctttattactgaatttgaatcttcttttatttctaggctgtacagtctgatgcatgatttttttataaatatttcatactcttgtgaatttggatctttttactttgagcatatattttagaatatgtgtatgttaaaggatctccacaatgtctgcagtgtgaaggcaggttcattgtggaatagtttaacagtcaggaaggctaaactggtcagtattaatgtgtagccctaccaaaaatagccagtagtatctgaaaatgaaaaataaatgaagtatctctaggaaacagtctggcttaactatttttgaaaatataactgtttcccctctctgctgctttagatgttgctttacatagaaccagaaaatggaatttctcagctaaagcatgtgtgcctgtttcatctaatcaagcagagctaaaatgttcataccgaataaatttatattaataaattactaaactaagagtatcaggttatttatatatttgcaagcaaaggacagtaagaagttgactggcaaaagagcagtgctgaaggaggagatccaggtttaaatctggcttattaactcaagccaattttaaggattttctgtatagattactcatgtcagaccaagaatttaaattattttgagagaggcatttaattctaataaaccagctgttataaaaattataaaatgatctctgtttttcctgtcagagatttaaaaaactgaaaaggtatacctcaacccaaaaataaaggtttgttttggtttgttatggcttccttttttaaaaaattaccctgtagtgccagtttattatgcaaagcagcttatattcctttgtttctgataaaatgaagactttaaatcagtcagtagtactttacctttcaaggcattagtaaattacttgcaaatagttttaaaaggaaaatacgacctttgttataggcagtcttctctttaagacaatacttttccacttgttttccttttccatattatatatgtgtattcatatagctgtatacatattcagttgatcattttataaacatatgaaggcataaagatatacagaagaaaaattattaaacaactcattttaagattcaaattaactaattcctgcatatatgacattccttacataagcgaacactaaacaaaaatggctagaaatgtctttttctttcttttctctctttgttgtttaaggtattaagcacgaattattacatgagactggcagatagctattaatcctcttacagatttgagaaagttgattctcaaatatttatgcaccttctccttcattgttttctttaaatctgtcctcttaaaaagcttcttaagagctcagttaatgcttttgacttaactaggagaaaaaggcatgataatacaggcaagatggcattgttagcaattctggtagtggtttggaatgaatcctaagaggcagggatcttaaggacaaggaagagaagagagagagggagggatctttgatctctttctctggtaatcttaatgcataattttactaatacatgttctcaattcattcatattattaagctcttcctgcagttgatatctgagcagagtaagatttgtatttccatttttacttttttgaaagagaatatatggacagattattagtacaatttgggcactgtggttttaagaatatctgagtaaaataacaatatgaaataataaacagaagctctaacgtcaggtaacaaatagacagcaagaaaggttttgcaccatcctcttacggcctagagagttgacaagttgcttgtagttttaaaaaaataataaagtatacccttctggtatatcatcaagagcttaagaatcttggctttcatatttaaaatgcttttggggagacatatattaaaattttagccaagatgatagacatgtctcaattatatatgtgtgtgtatgtttttaaagctaaaaacattacttttagatccctagaatgaaaatttttttctcatctatgcaattcccatatggtttttttttaaatcatattttattcattttctccctttagcaattttcattttatttctcataatttgaacagagacagttctcatacatgatcagatgctttttttttcttcttaccatcatttatgcatgacataggtaatgtgactaatttctccagttgattcaagaaactcattactttgcctcaaattatatgtaaaatatttgttttacttaggttacagttatcagaaaggtagtttttttcttctattaaaatataacattgtgaaagaaaataaaatttatgctattctttgctttgtttttataaatgaatttttcatagaatttacagtatattcaaaggaagaaagataaaattattggtcatcatttgtaccttagaagtacaagaatttaagtaaaagaaatgttcatttttgttttaaaatttgttttccatgtgaagtttttattgagccaactttcatacatatcttgctagcctaaagtctaaatatttgtgttggcatcagaaaaacaaatgaggcagaattgctatgtgtggttgatcttcagataaattgactgatcacagttatttttgtatcagtctatgttattaggaaaaattgtttagttgttttctcccctgattaatggtgatattcaagtatgatacaaaaagaattgtaccaccaaatatttttgtgaggtctgctgttttccatattcattttatgctactgcctttaagaaagaactagtgtatccttgaaatagcacaaaaatgttttaaaattcataattgcaaaacaaatctgtgactaacttaatgtcttcagatctaaagggtgtaaaaatattgatacttcaatatttcacttgctgccaggaaaaacaaaattctcaatcttttgtaaatgggaggaggacttttgcatacatttttactctttaaataacgacaacgacacttatactgtcataataacaattatgtatttctttgtggttttaattttttttgtaattttacataaaacagttattttctatttttacgcagataaatatttgtgcataaaatgtaaaaatagtaaaatgagaaaaataaaactattatacagtatgtttctgtgttgcttaaaagttttttttcctgaaaacaaaatcttaaatccccaggatattttgttggatagtaatctgacagtccacttatgatacgttgtacataggattccgatgcatttttaaacttaaaagctgtcaatttgggaagaacatatttcactgaactaaaattagtaggttcatctctttgaggaaattaatgaaattccatctacaaagccaagttgttttagaatagtaacagatgaagctgtcagaaggcaagctgatgattgctaaattgtaaacctttcataaagcctttttttttaacaaacaaaaa

SEQ ID NO: 101928 - DNA, 1757 bp, Homo sapiens
tgagtgtcacccaagatacagtatactttgctgaatctccctccatgatactcttgtggttttatctattttaccaaaacacttccacgtaaaacaggcttccgttgactctgtttgtcctttatggacccaacaggggaggaaaaaataccattgcactgggtttatccacttactgtggagttggggaaccagaaacaaccactggacacgttgcaagcgcgtcaaggtttccaccgccacctggtggctagatggagcacagcatctgtgtaactggtgggcaaaggcgttctgctccaagatgtcaaagtgggggagaaaattatgggtgttctgcaatcttggcaaaagaagagtactgtactccttatctttttactgcttctccatgttcacccttaaaagattgatttttattttttactcagctctcctcttgtttttcaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagcaccattgtgctggtgtgaatgattccatagtaacaatcttgaccatttactgacgtacagaccagtgagaagtcttcgcatgttgg

SEQ ID NO: 101929 - DNA, 1008 bp, Homo sapiens
taatttatttgtaattggaacaaagccccaaagtagcagttttgttctaccaggtaattaatgctcatttttaaagccttttattattatttctgaagtaatgagtgcacatggaaaaagacacataataggctaaacaataagcccgtaagccaagccaacatattccaggaacaaatccttgccaacctctcaaccaggatttaacttctgcttttcccccattttcaaaaattatagcatgtatttaaaggcagcagaagccttactttcaggtttcccttaccctttcatttctttttgttcaaaataggtagtaattgaagttttaaatatagggtatcatttttctttaagagtcatttatcaattttcttctaacttcaggcctagaaagaagttttgggtaggctttgtcttacagtgttattatttatgagtaaaactaattggttgtcctgcatactttaattatgatgtaatacaggttctgggttgacaaatatcaagacggaggagatctctgaagtgaagatggatgcagaattccgacatgactcaggatatgaagttcatcatcaaaaattggtacgtaaaataatttacctctttccactactgtttgtcttgccaaatgacctattaactctggttcatcctgtgctagaaatcaaattaaggaaaagataaaaatacaatgcttgcctataggattaccatgaaaacatgaagaaaataaataggctaggctgagcgcagtggctcaagcctgtaatcccagcactttgggaggccaaggcgggtggatcacgaggtcagaaattcgagaccagcctggccaatatggtgaaaccccatctctactaaaaatacaaaaaagattagctgggtgtggtggcaaacacctgtagtcccagctgctggggaggctgacgcaggagacttgcttgaacccaggaggtggaggttgcagtgagctgagatcgtgcctaggcgacagagcgagac

SEQ ID NO: 101930 - DNA, 1880 bp, Homo sapiens
tgactttattcttttgcatataaatatccagtgtcccagcaccatttgttgaaaaagactattcttgccaggtgcagtggctcatgcctgtaattccagcattttgggaggccaaggtgggcagatgacttgagcccagaagttcaagaccagaatgggaaacatggcaagaccacatttctacaaaaaaattatccaggcatgataacatctatttgtagtcccagctactcaggaggctgtggtgggaggatctcctgagcctggggtggctgaggctgcagtgagccttgatcacgccacctgggcaatagagcaagaccctgtctcaaaaaaaggaagaaaaagactattatttcccccattgaatggtcttggcactattacacaaaatcaattgtccatagataatatgggtttatttcttaattcttagttcttttctttgatctgtgtgcctgtgcttactgtagtaccacactgttttgattattgtagctttgtagtaaattttgaaatcagcaagtgtgagtccgttatctttgttcttctttttcaatattactttgagtatccggagtctcttgcattacaacatgaattttaagatcttcctcaccccctgcccccactaccatttctgcaaaaaaaaaaaaaaaaaaaaaagtgcggattgcattggatctgtagatcattttggggaatatttatatataatgttaatgaggttttaaacaacacttttatctactagaactgatatttgcctcgaaatgattccaccttgagccccattcaggaacgttagtattttagaagtagcaagagaactgatttagcatgctatcatcttttactccaaattttggtgagattccagagaaattatttgtgagcttttccttaagccatgatgactgacatgtcagtagtttttgtctgtttttatgccattcttttatttttgtgcatgtgtgggcacctcaaccaaatggatggagcctgaggcatggtctcccacgccaaagtctgccgtttcttttgatgatccaatgcagttccaaagctattttctcaactcaccagctcgtttgtatggccctgtaatttgaaacaaaatctaaaaagaaatccaaattaaaatgattgggaagtgaagtcagaccacagtggtggctgtggaactacttcctggcatggaacactagagcagatgtgtcctgctttttttgtagagtcttgggaacaaccaatgattttagactggaacaagggctggttattctgtttttcacaagcatctgccttcaaggttcattttttaaaagaggaggggaaaaaaatcagtgatgtttgccaccctgagtatggagatgaatccaaattgagattaattttgaaatatgtttcccgaattttgagattaattttgaaatatgtttccacaaacactaactgggaatgacatgagtttgtttcatgtgagacggagtttggaagacatgttaatttgcttgttggtgttcaactcagaaacaaattttgcatgtattttctgagtaagtgccattattagttaacagttttcctgccgtatgcactatgggctgctttagaaagtaaatcatagaaggttagttataatatctcatcaaaaatagtggatccatctattaaccggttccaagttatgagacgtgtccaaaggaatgttgacttggtgtgcacctaaacactatttgtgaagaggctttggacttcgagcatgaaacggggtcagagggtcaaggccagggcgttacttaatttcagctcctgttgatggattcattgacttcagatagtgcgtttaaaaaagcctgtttaatgtgtttgtcttt

SEQ ID NO: 101931 - DNA, 1041 bp, Homo sapiens
tcaaggagccaagccctctggcattgtgcacacccactggaagtgggctgttcttgcatttcacacaaaggcagcatatgggctagtgaagatactcggaaattcagtgatagcatccccagtttacagttgaagaaattgaactttgaacctaagagagtttgccaacttgcccagcccagatagtaaagtgatgaaagtggggtggaagccaagacctgccagaagtccaaaatctgtgttctttctgctgcctattttcctctctgaagtggaattttcccctacttaacctcaatgtgaaagcactgggtatccacctccaataccatactctaacttggagtaaattatttgtttatatctctactaaccctccatcctgtgaactcttccagatatatgttggtcatccttgcctcctcaagatccagcaaggaccctggtactttttagatattagtaattataaatataaggttgaagccagtccccaggataaaaaggcagatgctccttaacttggactgatgaagtgggctcctccgtaaccctaaagacctgaccaaaactccttccttgacatctagcgtaagcaccacacaaaacaaatttctttcctaggccacagcatcctctaaagctgtgattgatcaagctaactaaatggatgtggttggccaagataacaaagcataaatcagggttctgaggacctttattaataaaattttacaacatggtccttctttgtaccatgaccctctgctatttggtcatctacttgatttaattgtgctgtcctgtttgaccgccaaccacagtctgaagctattcccatgacaaataagtgtgaattttcaagtgtcctgttgtgttataaaaggcccgtgttttattttataatttcatatttttttcattcaattttaattattatgtgcaagttcccaggctcagtcatttattaatgtttttattttttaaaaagttattttcaggcagattatgaagatttcttgcaaagaatggcctcaggca

SEQ ID NO: 101932 - DNA, 1034 bp, Homo sapiens
catatatttatccaaagttattagtcaaatcagccttcagagagcctatgaaatactgattttcaatgagaaagtaggtttgatgagggttggagagtgcaagaaagtgaagtaagctataaaacgtagaattagtcaatgttggaatgactatgcagtctttaggatactttttagcactagaagaaaatggaataggatgtcttttttagaagacttgaaattgctgcttcatcctacttattcagtccccatggacatatgtgtttatgatggcagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcgggtaggtctcgctgcagccgagttcacacttcaggtcacagcacagacagtaagggtggggcactgggaactggaagccatacaaaaagaatgaggagaaatgccttgagcactgttattcagaggttcaacccctgtccattccatcttgaaggtcaaagggtcacagggcagctacctccacaaggtcatctctacacagcaggtactcacacttccccacagagcagccagacaggactcccagggactcacattgcaagccctgacttgatttaatattcctgaggtggtgacaattgatggcatagttcaagttcgaacacaaaagctggaaggatgtcttccagtcccttcaggctgctgtaacagaataccatagactgggtaccttatcagcaacagaagtttatttctcacagttgcagaggctgagaagtccaagatcaagacatcagcatacttggttgtctggtgaaagtttgcttcctggttcatagaacttaaattttgtttatcttttatttattttatttttgtttttgtttgtattttgctgtatcctcatatggtggaatgggcaagagagctctctgg

SEQ ID NO: 101933 - DNA, 1393 bp, Homo sapiens
aagaaaaagaagtttaaaattcggctctcagttttgcaggtggggaagtccaagaacatggtgctggcatctgttgaggacttccttgctgtatcatatatggtggaaggaagaagggcaagaggagggcaaaactgagttttataacaacccacttctcacaataacaaacccactccccccataatgatactaatttactcatgaggacagagactgaatcacctcttacaggacttacccctcaacattgttgcactggggattaagtttccaacacatgctttttaggggttacattcaaaccatagcagttggttactaaattagtgctacttgtaaaaaaatacatgtttgctgcattcagaatattacatgttttcttggagtttttggaaggacttagcgtaatccttgctgttcatgacttaggttggcaagctcaaagggccttaattccccatcagttctttaaagggggataggtcttaggatattagacagcagaagtcttctttttcttcccccattatgtactgctttttggcattgtattcatgacacacacacacataaaatgtcatattttctttaaagtcaaaatatacagtttaaaatggtttcagttgctttcataagagagtaaaacttaggtgttcagtttaatattggaagaccttgttcagttaatgtgtgccttccatgaatagttggtatttgttcacatcaaatcaaatgactgtcagttctcggggtaaaaaaagaccaaccttgactcaaaaagctatattcctgcaataaatatgaacatttatgtttaatatactgctgtgattaattatttatatcctagtgggaggtcaaatattcttcagataggaaggggtatgtaataaattttttaaatatctaaaatgacaaaaatagaggaaaaacataatcatccatcctattaagtctgtattcaaaggatgaactgatgattttaaattcaaatgtttccttaatttataggtcatgagagaatgggaagaggcagaacgtcaagcaaagaacttgcctaaagctgataagaaggcagttatccaggtaaaacctgaacccatttcctaccaaacatcacatgccagcagtctttttaatgagtgtctgcaggtttacctttatctgccagcacctcacgtgtgattgttcatagtcccatgaacttcagctgttcttaatcattgtctagtaattgagttgtttaaatcctgccttatatttgctcccaattatttcaagttataattcattgccataaaactcacattgtaacttgcaatctactttttattaataatacatcttttcagtcaccacaatcttctgctgcttctccctccagcaaaaa

SEQ ID NO: 101934 - DNA, 1026 bp, Homo sapiens
ggaacttgaaatgcaagtatttttaacttaatcattaagttaaagtcagtaagaacgtggtatttagcatttattcattttaacttaatgattaagttaaaaatacttgcatattggtttgcttgaagctatggagaaaaacatttaccttttttccaaaaaggtcttaatattcaaaattattgtttcaatcttacaaattaacaatttacttatttttgatactttcggccttttttatgtgggctacacctaacattttttgaaaaatacatactgcttttcctgtaggttgcactttgtgatcctgtgtgtaattcattttcagtggttctattttatttattttttgttagtttgtattttcttttgtttctttttctcaatttttaaaattttaaaacttgtccttttcttttttttctttattattgcactcttctaccaaaacattttcagtggctttgaataaaagtatcagaactttcccgtggttagcattagctctgagatttgaacaggatgtattaagcagaggaggagggaaggccactaacatgtatgagctccactgtgtgtcaccctctctgccggatgacttacatgtggtatggtatctcattttcccagctctcctatcatgtcctgcggcatgttatcaccacttgataaaaaaattgaaacatggagtgcttaagtttcctgccccaggtcacagctgatctgaaaaagaaatgggattcaaatccaaatgtgcttaattgcaaatccccacatgactctttccttccttccttccttcccccgttgctgccaatgtaagaaggaacaccactccctcatttgctacagagaagacaggggcagctgtgtaaaggcaccaggaatatgccctgcctccttccttccacttgaaagcaacatctggatagacactcaactgcttttattttttgaaaaatgattattaatcaggattgaagtggagggaaaaaatcaaaacgaatgtttctttttaaaatgaaa

SEQ ID NO: 101935 - DNA, 1050 bp, Homo sapiens
cagtacccctgacccctacccactaaatgccattaacacaactccagctgtgataactaaaaatgtctctagacattgctaaatgtgcccagggggtcacattctggttgagaatcctgttctagagtagtagtttccccacatctgactcagagatagaactctcctggtgtaaacacgtgtactttccacaaatttgggggcatgttgaaatgttagaatgtcagcatcatccaattctcgacagatgtttgaaattgaatttgttagactattgtccaagctctcaatatttgcaaggtaaagtggaagttgctgttgctgtcctgactatagtattgaaggtctcgtagttttcctgctctaatgtaagctactgtggcagcagaagagaaaccagcaaatcccttagtttgaagtcattggttcacctatgcaccacccctttctcctctctgtttcatcttagtttcctagaatcccaggatatgctggaggacaaccatctgtagagatgtcctatagtcttgctacacaggttatttgtactttaggattatgtttgatggccttatagtttgtgcagaggtgtaggcctgaccccatgcaggattgagggagggaaaaagattgatttctaggcacatcagaatggtccagatgacatgaaacagactggtacacttacagagaatatgaaaagaattggaacttaacaagtcaggccccaagttccatccccaggttccaagtttgttgccgcagaagctcataattttcaaatcgtagaaaactcacaccacgcagcctttcaatggaatatgccaccttaaccccagggtcgttgtaaagacaggagccataagacagaagtctgaatgcctaggccatttaatctttggccaaatttgaactattgttcttaatcacactattcttgttcttttcactgtgcagtagcaaatgttagttcccattagcacattctgcaataccattggaactaaaactgccaaattagattaggcaacctgggattacactttgctc

SEQ ID NO: 101936 - DNA, 1047 bp, Homo sapiens
cagaataatgtatgaagaaggcaaaggctgaagatcagttagatgggtggacaagaataagtagagagtataagcctcagcaaacagccagagccgagagccacatgctgtcctatgaatgagtgaaataaatggagtttttgtgaaaaaatgcatcgaagggaattggggatatttggcacaaaaggagcaagaaatcctcttctgttaagaaacctgttgttactcggatatactatcagagacaaaatatccagcattctcaaatgttaacttcttacgaaaatagatcttatgtttatatgttcattttggttttgttggagggaccaaacctaagtgagtgattttgtttgttaggttgtttttttgtcagtggactcgtgcatttcagccatcattcccatgtttctctttttgtttttagttatgttctcttattttttccatagtgtcccaaagtttactcaagactacccaggaacctcttgcccgagatcctgttaaacgtacgttgtcattcacctgagggaagggaagaggggaggaggatgctgcttggttcacataactccagcatcatcaccttctttgcatggttttgtgtttcttgaacacctgtcttagtaaaatgtttcttcccattaccttgcttgtaattacatctgattttgccagacagcttgagatgttgggctaagagcatcattgactaagtttcttctatttctgaccaatttcctttttatttagtctggttttattgaatattatatggacaacatcattgtattgtatttgccattactattttatttcctaaaagctatcagtgtaactgagagcaggcttagcctctcactgcttttgcagaactgaagaacaagggctaggtgcagtggaaggaaagtgactttacttagcaaagctagcaatggggaaatggtccaggctcctgcctcaaagcaaccatctcaaattttggattaaaaaacaaaggcttaaaaaggggagcttggaatgcagggcatgaaggaggggtgagga

SEQ ID NO: 101937 - DNA, 1759 bp, Homo sapiens
tattgttcttggtatattacagataccaacaagtatgaggcaatcctgagacatctacctactgagcttttctttccttaaattcacacctcaagaccaaggaaaccgaaaaactcttacagtctccctacatgtgttcacttgtgcccctatttcctgtcattaacatggtagtgtagccaactcctgctagcctgtaaaagctaattattacagtatagaggaattttgtaagccatagccattagtagcttgaaataccaatggtgggagtatttataccatggcagttggcatacactgtaactcaagagtgttctatttgtttgtttttctagacagtgccagtttcccagcatactcctgtctctcattcagtaagacaaagcacttccccttattttccaatacaggacatgatatcccgagttttgagcttcttgttaatagcctgttgcacgctaaccacgcagctcagtgaagagcaagtttattcccataacaaacaggaaacaaaggttgaggaaaaaccacagtggtacccttttgtgagtgttccctaacaccgtcacgggagtcctgattagtctaaatactttacaagtaaatctccttcaggtggcattttataaacaatctttcatcatggagagatgagaattgggtcaggtataattagaatgacagatgtattggctagcctgagagaattaacgcaattcagtaaaaaggctagccaactgcggatatcttctagttacttccgtgacaaattagcaccatcctcttgtactgaagcagtgctttcattagcatgcacagctgtttgcatcatctttgtttgtatttcaatccatatttggagcttaagtgagatttgtcataagacttcagttcaagcttgcttgcctaattttacatgcttctatttagtaaaatatgattactaggtcataaatatttgataatttattgccttattagagtaattttctaaacatgttttttgacgactgcttgccactacgtacaagcacttgaaaaatgttcttttctattaaaagtacatggttccagaattgggaaaatcacgttcttaaaaaataaccagttttctattgtgttggcttttaaaattttttcatcagtagaatcaaatgcaaatattgtctgcttatttttcaacagaatacaagtttgattttaataacttaggctcatgaaatgtcaccacgtagtaatacttagaattacagcaataacttaggctaaaaaaataaagttgttatgaactacattgagctcagacagatatatgtattatgtaaacatttatataaaatgtatataaattgtatattgtattatataattatatattgtaatatatagtatataatatataatttataaatataatacataaattatatttataaattataaagtttttatataatatattataatctaatatattataattatatttataaattataacgtttatttgaaatattgaagttttgtatacttagtggattttaatatttatgtcgttttcattttattccactgttacattaaggaagtaacttattacaaaaataaattatatttgtcttacatttgccctttttactctacttaaaattggagaaaaagagttcaagatagggaatttctgtcagaaaggagaaatagttgtattatgtgaagtttaagtagatattcttgtagagtatggagaaaataatgc

SEQ ID NO: 101938 - DNA, 1081 bp, Homo sapiens
gtgctagcattacaggtgtgagccactgcaccagctgggtgcacctttttgtttgtttgttttgttttgttttgttttgttttgttttgttttgttgacatggagtctcagtcacccaggctgggattcagtggcacgatcttggctcactgcaacctccgtctcccaggttcaagcaattctcaattctcctgcctcagcttcccaagtagctgggactacaggtgtgtgcaaccacacctggctaatttttgtatttttggtagagatgggtttcaccacgttggccagactggtctcgaacttctgacctcaggtgattcacccaccttggcctcccaaagtgctgggttactggtttgagccaccacacccaaccgggcacacgtttttagccaagccataggtctgattaagtacagtcagattccttgagcaggttacaaagctgtggatttgaatggagatctttagttcccttgcagaacaatgagtttccaaaagcagagtggcttacagcctaaccagctgcttctctcagcctttaaccattttgccctcctgaaaattcatctttggtttccaaccacctcttccaatatgcctgactttttgtgattctgttagtagaagagtaaaaagtcaaggggaggcaagaatgaatgaatctcatataaaaatgatgctcaagagaatcccttaattttcaagacagcagcccaaattgtaaacattgagacttttacagtgttaaaaaaaaaaaagtgtttacaggccaggcatggtatctcacacctgttatcccagcactttgggaagctgaggcaggatgatcgcctgaccccaggagtttgcaagcagcctgggccccatagggagaccaaaaaaaaaaattgttgttttggctgtagtgtcacaggcttatagtcccagctactcaggaggctgaggtgggagggtcgctggagcccaggtgaggtcaagcctgcagtgagccgtgatcacaccaccacactccagccttggtgacagtgagaccctgtccaaaaaaaaaaaagattaaggcagaggaaatgttaaa

SEQ ID NO: 101939 - DNA, 1051 bp, Homo sapiens
cttacaaggtatcctataattcactaacgggatttttacttatgattaatatttaactctccacaaagcttggggtaaactgtgaacttaacttgctgtgaacccgaacatgaactcacatacttcagttggaggcctcagtagtagcatgctgtacaaaaatgaaactaaagctccagggagtatttgggaacagggcaaaagggtaatggctcctccttatagagcaagcctcaggcctttacctttgtgttttgaagatggagaggatgcacttctactctcgcccgggttgtagcatgcttgctaatgatgtcaagagaactagtgtcagcactgaccatagatgtgacaggtaacagcctgttattttgtgccccatgtcatggcagccattgattccgaggtgtttgatacacactttgatagaggcagagtgaagcaggacatggacaagcatctttccgtgtagtttaatggtctcaatctagaaagcccactcagataattaggttgcttaaaatgtgatgagactagggaatagagccatatagaagtgtgtgtgagagagaattcagtggtttagtatattcacaaagatacacatttgacaccagcctgggcaacatagtgagaacctggctttaccaattaaaaaaaaatagaatagcagaagtaatcagtgaaaggcattttaatacaattatatctagatttattaaaaataaaattttagtccaatttaattaaaggccagaaactagatttttaaagaatattagtctttctcatattttccccaaatcagttgctttaaaaaaaaaaaagtgtgcagatgcctcaggcacaataactgtactcaactcaagaatttgcaattaagaaaaaaaaaaatcaaacctcaaagaagaaatccagcaactcagaggttcaggttcatttaaacatgcatacatttacatgggcacactttttttgttttgttttgtttttaagatggagtttttgtttgtcgcccaggctggagtgcaatggcgcgatctcggctcac

SEQ ID NO: 101940 - DNA, 1039 bp, Homo sapiens
ttcacctcccgccatgattctgaggcctccccagccatgtggaactgtaagtcccattaaacctctttttctccccaatcttgggtatgtctttatcagcagcatgaaaacagactgatacacttccttaacagaaccaattattttttcccaaaaaagagggggagaagcccagaagcatgcagcttctctcttctttctaaggaataggtcttcacaaagtgcccccaaaagaaaaggaccaggcttttctcttactttgtgactttcctaggttgctttgtagccattttggacacagaccacctatagctgtgtagtagttctcatgtgtatggacacagtggaaggagatgccaggcacatagttcttgctgcattgacaccttttcagggcatcttcttttaccatcttctgtagaaactgcaacagcccggccaactaccagccccagcccacccctagctttgctgctttcattttctctgtaacacttgtcaccttgtaatgtgctagtgtaacatcgttgttttagttttcttatatctttccttccctgtagaatgtaaataccaggaaggcagggaattttgtctgctttattctctgcagcatccctagactccagagcagaccctggaactcaaatatttgttagacagccaaaggtcatatacttccaactctccacccaaaatatatatggatcacccatccttagtagcagctaaacctttggacatgaggaatttgctcgttcacagttttctggcctagcatctgattaaccaaactttttcacatatcaagaatttaaaatgactccaaaactttttatgaccttaggtgcttctccttaattctagttggttcataaagctgtcagaacaataatctgcttttgataatatatgacttttcttgcctccaagatagcctttaaaaaagcaatttagccttttactgtaattatattccaaatttaagtcttgccagaatatcattttccccctttaaacatactttttatgatgccaa

SEQ ID NO: 101941 - DNA, 1142 bp, Homo sapiens
tgagtgaatggcttttcatacacaattttagacattgttcctgattggtctctctagtcaataatagatttatcaaatctaatcgataatagatttctttttcttttctttttttctttttctttttctttttttttttgagaagtcttgctctgtcgcccaggctggagtgcagtggcatgatcttggctcactgcaggctctgcctcccaggttcacgccattctcctgcctcagcctcccaagtaactgggactataggcgcccgccaccatgcccagctattttttgtgttttagtagagatggggtttcactgtgttagccaggatggtctcgatctcctgtcctcaagatccgcccgcctcagcctcccagagtgctgggattacaggcctgagccaccgtgcctggccgatagtagatttcttttattgattagagagactaatcagcaacaatgttttaaaattctcacatagatctctgaatgggaaagcagtcttgaattatgcttgcagggagagagaggggaaggaaggaggaggaatggtataattagacttcataaggctagattttgtttctacttaaataatggtatcacagtgggacatattatccatgcagaaagtgagtgggcatctggtctattatctgtggtctttcaggaatggcagctctttagtttaaaaaacaacaaagtgcagcactgtttatttaatggaaatagaaaagcagtgcctgtgtattagtggctcagatttttttgttctttgttttcagctgtctgctgtatgcctctccagcggggtcttacagaatctcaagtctaccatgatcaaagctgaacccattagctccatttcttaattcctcctgtatcctctgttaccattagtaactattctccaactcaaagcatcagattcctcctcttactcactcccttcatccccagtcaccagttctgtgctgttattttatccaagttctcagtaggcttcacgagcaccgccttcacatcccaactgtcgctcctccacctatctgtcctccatgcttctgctagctcatgtttgttgcaatacaactaaccttgccactcttctgcttcaggcttttctactaggctctgcatct

SEQ ID NO: 101942 - DNA, 2294 bp, Homo sapiens
ctggggatctacctggaatgcgcacaatttctggatacacgaattaagccagaaggcattaattctctggtatctgttcaccagtggagactgctacatcttatttcccaattagtttccattccagttgttcgtataaacctctattatataacatcgtggtcttattaaataaataataaacaagaataaaaagagtaccaaagtgtaacccatgctaaaaaaaatcctgttgtaaattcactcaaaaagcaaataatcttttcctttgtgaaattggttcctaatatattgggtctgcatgttgattattttatgtggagttttcttacaatgaaacacatctactctaccactcactgttttctccttacactttgtagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggaggtaaggtggcctttgtgttcagcctcagagatgctgaaacatcttgtatggagtatttgtatcctgtaaattaatctttctgtttatcactgaaaaggtctctgcccactcccatcagagtctgctgttatgcaaaaatctgaactatgaatttttatggcatcctgttgaattaataatatcagtcacccatcacagagttaattttaactatttaatattaaacttgggatcaaaatcccactgataactatcataggttactggtagttctaacagggagttgaaataataatggcgttctgttttggtcattaatttaaaaatatttttaaatgctctctgggattgtcagtcattagtttaaggtgaattttcgttaaaggtttggtttgagattttgggcgttctctgtgtggatgtgtaagggtttttttttggccttttatcatttcttttccttcatagtggaagtcaaaggcattaataaatgcttgttaattttttttaactacctttgatttgttgattgtaaagaaacctattttcgcctctttttcttagggagcttagtcccgttacttcttacctgattctcattcttaactgaaggcaaacatctatattcaaatcataaaattataaaatgagaatctttgggttggaaatgccatctggttcaggcattgattttatgctgtctcatcccccgaagggtgatgattgtatcacttatcttattccttcagtattctcttagatgttccctagagctacagatttccaaacagcacattcaataggagttgtaagtttataatcggcaaactacaggatgcttgtttttttttcttttaatttctggtgtaatctgctactagggcccccatagagtttattgtctatatcagctagaacactgggaccacagtcataaactgaaggatccaggcaaactgggtcatatggttacccccaccaattacagtcttcagtgatgatgtcactatccaggttgatattcagttgaaatgctagccagctccttcctagttaccttcatttacatcccatttcagtacctgaacacagtcatgctttagactctgaaattccttagaaatagtaccataaggtttatagctttgatattcctctctgatcatgatcttccctcataatcacctccccagttcaggcttttagtccattatcctctttttccctgcctgcctttctaatcaggatggaatcaatggataaccattcttacctattccattgaacatccttgacttggctgaaacccttcacattttctaaacatatttttgtcaattctccatagctaggaaaaattaatttctttctttagttgcttctgggatttctaaagtatcaagtcatgtaaccttaccacttaattccatttcttattcatgctgtaacatcagctgggatcttaatgttactagatgcacctaattatctctgtcttgatgacctatcatcttccccatagcagttgatccagcccaacttcattctccttggttcccagcgtaactctctctcatgctctacagatgacccctccaccgtcatccattgtgaatttctgcaacatggtacctgacatttggtaggtgcccagtacgtgtttgttgaataaaccattgaattttctcctgtacttcagcaactcttgtaccttctt

SEQ ID NO: 101943 - DNA, 1893 bp, Homo sapiens
agaaattcaattatttcagctctctgtggagtgataagtcctgccaaattgatttacaataatgaaactaagccttgtttacaaatctaagtggtgatttctaagtccacagaggcgtggtaacagagagagagattctgatttatctgggggtctatccgtgtttgaacagattgtgtgatttttgaaacatgattcaaaagggatgttgataaattctaaaatacatttttattgaagagcttgatgaatcatgtatacttactttatttgttattctattagatattgtcttcctcatccctaggtggtgttgctagtacagtgacagaattcaaatccttctttttcctctgctctaacagagctttgtgaactcatagcaatattgtaatgcctggtaaaaggtggtgccagtttcaagtactatatcctaattacttcatggctaactcttgttattgttaacaatattgttaactcttttgttaaatgcagtgacatcttttttctttctcattctctgtgtactttttgccctaaatagttctgcatcttttaagatacaagtttgctttttcttggaggtttttatttggaaaatgcctgaaatatatagaccaacatttgttcctccaatggttaaattacattgtctcccaaagtgaggcattttaagtctggactatacccaggagaatctaaaagaggcagttaataagctcttgaagagcacagtggggtggttgtgtatttattgagtctcacacttaggagagaaataggctggaccaaatgagcctgggcatcaaaagcatgtgggtggtcgttggtgatatgtgcagtgatgagtgtgtgtgctgagggtcctagaccaggctggcagggaaatgaactgaaggcagtgaagcctcccctgataactgcagagagtgctgcagcatccaggacctcaggatcatgatgaacaagctgtagtggatggaagggagaggaactatgggaaggatgagtttctggccagaaagtggtttactggagtgctgtgtctgagtattacatgatctgaggaccatgaggtccagctttgggagtatggagagtttgagtggagtagagttatagtcccatggtcttctgattcacagacattcatgagcgataagtatctattgagaaagtggaagcatgatttttatgacctcctcttgttgtggggaaatcgatcaacggggcctatattggttgggttctacaaccaaatagaatgtgttcagcaggagtcatgttttgggctcctcacaatgttcagtgttagttctgttcctttctcttgcttccacataggaaagactttgacccaatgaggaattagtcattgtcctttgggtacacttccggaatttgataatcagttgggcacttgattctagtacatttgctaaaagtaattaataccctgcaattggaagcatgcagcaagcgactgggaatgctaagtgaaaggtcagaattgaaagagtggaggaggctgttgacccttaggcatggatgatatgtctgagtgagaaagcaagaagagtagaagacagagccttactttataatcagaattatgaaaagaggagccaatgagagggaaagaatgattggcttgagatagattggtggaaactggagaagattgaatttaaagaagaaaagtgggccaagttcagtggcccatgcctagaatcccagcaaattgggaggctgaagctaggagagttgcttgaggccaggagtttgagatcagcttgggcaacgtggcgagacccctgtctctacaaaaaataattaaaaaaaaaattagccaggcatgttggcatgtgccggtagtcccggctacttgga

SEQ ID NO: 101944 - DNA, 1022 bp, Homo sapiens
tggctcaaaaatattttttttctggtaacaaaaatattttctttctgtttttaagacttgtagcatttttaagtttgatatgtacgtctctgtagttcagagcacttggtaaacagcctcttgcttttgaggcaatttatgaatgcttcattgtttttagctggttattttgttcattgtcaggaacactgttttcccatgggaaagcatctccagttttatgatgtcagtggcaagtcattcagtttacaagaattaccttcatattcagtcttagaaaagcatagaccacaaacggccagttatatcacagttctcatcttttaaatgttgtcttagatttttgcaaagtaatcttaactcaccttagaatagtgttaagacataaatagaactaaaatgtagtagttaagtggttatatttcccatctactaaggtatttatatttcttttcttttagaaaataaaaatgtttaaaaaattaggaataattatctttaggatgactttgtaagactgtgcttttttactggcagcaaatacctgccagatttcaggtatttggcaggtaaattgaatcttaaaagatttcaattttaagagtgtccatattaacagatcctgaataggaccctgtgtatcatttattaagtcatttcttggaggcttcactcaggaaaagggagttaacccttggatggcaatgtttaatgtggccacatttccttctggctgaatgccagggagtggctgcgcttagcaaccaggctttgtttcataaatgggttatttgatgcaggtgaggatgccgtgagttgtttgtcttgttttaattcagggagacaggcatatgtagtgaaagcatggaattgtttgcagatgggcttcagtaagaataggaaggtttctggttcaatttgtatctccaagctaattgctctgatttccatatacacatctggtgttggttcggggggaaaaaattttacttgagaaacatggcttttgtgagttgatattt

SEQ ID NO: 101945 - DNA, 1023 bp, Homo sapiens
accacttgcagtttcagtcatcacattttatttttcttttttaatagcttctctatttttgctcaccacaaatacatgcacacacacacacaggggcaaagccttggaaaattgcaattttccattttaatttgagagacagcccggtcacattaacagaacccttgacggaataggttgaattcccttctctgtccctataaccccatggccttggacatatccttacctggtgccctttcctccctcttatggtccacttttgtgattctgattttaatttcagttctctgttagtgatgaaatgagcaactgcagatgttccgcttacactggaaatacttttttggcatttaaaagaaaaccctacagatgaattattcccctgaaaggggttcactcagattttctagattatgattctagaaaatagttctttacatttgacaatggagaatttaaatgttttaatatgaaaatgtaaagcactcttgtggggtatagttgaattatgcccaggttaagggaatccagtatttatgtcaggaaaccatggatgtgatagaaatagtatcgctacaaagctgggcacagtggctcatgcctgtaatcccaacattttgggaggccgaggcaggaggatcacttgaggccaggagttcgagaccagcctggccaacatggtgaaaccctgtctctactaaaaatacaaaaattatctgggcgtggtggcacaggcctgtagtcccagctacttgggaggctgaggcaggagaatagcttgaacctaggaggcggagaggttgcagtgagccgagatcatgccactgcactctagtctgggtggtggagtgtgacagtgtatccaaaaaaaaatactgagattatgcaagaatctgactcgaagaagtttgaactgattaaaaagtaccaaatacttcattatatgaggccagctatttagactagtcagcgggtggttcaaatgcagaaaacagatggctttcattagccagaaacctt

SEQ ID NO: 101946 - DNA, 1046 bp, Homo sapiens
gcaatttaggaatccagggatgtgataaaatttgtgcatctgcttgtcattagccatctcacgtttatatcgctaagtgaaaatttaacttagtttggaacaaaccaccatgatttagttcacctgtatagtttaaaagacctaagacctgaaatttttttttttttttgaaacggagtctcactctgtcacccaggctggaatacatggtgtgatctcagctcactgcaacctctgcctcccgggttcaagcaattctctgcttcagcctcctgagtagctgggattacaggcagctgccaccacgcatggctaatttttgtatttttagtagagacggggtttcaccatcttggccaggctggtcttgaactcctaacctcatgatccacctgcctcggcttcccaaagtgctgggattacaggcgtgagccatggtgcctgtccaagacctggaattttacactgcattgggaccttataaaattcttgacttgtacccttttggcattttctgaatgctcatgatttgcttctgaaatattttaggcctttggaaacactccttcattctaatcctctcttttcttgctctcaattcttcatgtcatgtaattattttgcctagagccaaatctgatgtgttattataatcatcatttctgcaggagcttggtaacactcctgcttttgttccctttaaggcttcttttggttttgtttattttgtttcactcagaatgatctggttaagttttgcttgatcatccatttcaaatctcttagtacatttttcaaattcagttccaagcatgttaaatgtgtcacaatggaagtggcccacggtcaaatacattttgggaaaccttggttttaaaaaagttaaactgacttcattattacggttttttttttcaaaagcctccagtatccatcttgaatgatccatttcccatatgtgttttatgacagaattctccccactcccaggtaataactgttgacattttctgaaaactgtttttgagaacactgaattagatatg

SEQ ID NO: 101947 - DNA, 1053 bp, Homo sapiens
tcatcagggtgtttatagtaaatgtaaaacgttaagtaacatttgagttaatctgtgcttgtacaaacctcagaagcttaaataatgaaccaatgacatataatttagaaagttttcattagactctttgcgttggtatttgcaatatcagatttgcatgtcatcattattagccttcctctattttgagtgttgactaggtgccaggcgtcatgttgagaaatttatgtgcttatttaattctcacactgactccatgagatagatactccattttacagatgaggaccccacatcataaccttttggccagaattacagttagtgttagaatttaaacctatgcagtctcattccaaatcctctgtctttactcctccagaatgctccattaaatgaattgtttcttataatccggttgttttaacgttggaaaagaacttgagaacatttagcccaaccaccctatgaagtttggcagtacttcttgccattctttcaatagataatttatttgagtttaagggagagtctatgaattaacactagtaccaaaactcccatgagaaaataatgtagacagcttttgttaaaaaagcagaatttttaaaggtgttcattcagttatcttcttgcctaacaagttcctgtgttgtgatagactttgaatttgttaaatatgaattggcttcctgattctagctgttttgccagaggcctgatttagagaagggattaaaccactggtcaaccttggatggaatttgggccagcagttccttctccacagcccctgacacttggctttgtgccaagaaaatcctacaaaaggaaattgatttactctacccaagacagagttccggaggctttggttgtccattgttagcttagaagttggcgcagtgtgcgtgtgatccacgcctaaatagcacagccttgctgtgcgtggtagaagttgggttagtgttgacatgctgttgactcaccctcccgaggatggaagctctggcctgggtcaagttgtggtcactgcagttaacagtttgttga

SEQ ID NO: 101948 - DNA, 1066 bp, Homo sapiens
aagagcttgaagccaatactactatataccattaacttgacaggaattgaaaatctaattgaggtcattatgattagccttgtatcttgctagtattttctcaatcttattttgaatgttttgtgtcaagtgttaaatcctcttataccacagaatccagaaaatttaaatgcaacagaagtaaaacgaatataaaaattctatggttgttgtggaggggcgttcttggctaacccatagggtgtttgaatgtaaaggcagcttacagaactgctgctagttgaattgtggagggtttcacttttaagagtacatttgagacaaaattgcaattttggaatcacttattcctgcttgttcagtgaaataggagaggggggaattcctgagggaagctgggagatttccaggtgatgatagagtagccatgtgagtatttggctgaaacagagtagaagccacctctgtctgttggacagaggtggccttaacactgagtatcaatcagcatggccattagagctgtccaggacaaacataatgaatgttgtggtggcagagagggtatacttaaatgaacaaaattggaggctgactttccttgtttcttggtagttcctttcttcgtatttgctatttggatatttcacttcacttttgtgagctagactcaaaggttaaatttatatcattgtgaattttctgggtcatattgtagggacacagatgggaagcatcccttcagtttattgagagtatttcttatgcgcatgtgtttttaattgtatttattgatttaataaatagccgatgagatgagaaaaaaatattagtgtcttgttgttgcagagaaaaagacattggatgcattcttagaatttattatcacatgcgaagttatttagatttacaaagcaatctgacatgttgacttcattgctcgtttgctcatttctatcagaggttgaacacaaagccaagcctaagcccgtgattcttctgtgtgcagatgagggggaaggtttaatgcagaatgtttagctgaatatttggattgtgcattccc

SEQ ID NO: 101949 - DNA, 1029 bp, Homo sapiens
gtcacttcttttgttttttggtgatttttttttttttttttttttttttttttgagactgagttttactgtgtcacccaggctggagtgcagtggcgtgtcttggcttactgcaacctctgcctcccgggttcaagcaattctcatgcctcagcctcctgaatagctgggtttacaggcatgtgccaccacgcctggctaatttttgtttttgttttttttttttttagtagagacagggtttcactacattggccagggtggtctcgaactcctgacttcaagtgatccacccacctaggcctcccaaagtgctgggataacaggtgtgagccactgcacctggccaattttttggtgattttgataggaatttttttttttgcctgatgctttttttgagagaatctaataatttgtctcttatttaataatttggctttcattagcttccagaaagccacatactgtcttcattgaaaaatgtaaggcatcctagatgatacagactgataaattacttttcagccataaaagatacttatgagaataagagatctgttgcataaagaaaagtcatttgtgttaagtgaagaaatgcattattactcttgctgctttgctaaatttcaaacattgaataactaatatattttgaccccctggagatattttacaggaagaaaaatgagaggtttaatcctactgttgagatagacttaacgtgttttagacctgcccctcatcccaagttactacaaactcatttgtttagtttttccttgtctgtgtgctcgttatttcacagtaaaattagtgaggcaacataaattttatttttaagagaaagtaaagaaaatggctttatccattaaaggtttattcatcttaaaaaaggacttgttatatctactcctactattggatgaattttcaaaagcatattgatactgtgtttggttttgtttgttttcgggacaagtcctcactctgtcacccaggctgaagtgcagtggtgtgatctgtagcc

SEQ ID NO: 101950 - DNA, 1052 bp, Homo sapiens
acacagaatagtaaagctcaggtttgatggtgatctgtaaggagtcacggttcttgctaatcgatgagaaaccatgataactggcagactgcagaagcttttctcttgtcaccggaaccagcagaggctcctgaacgacatttgcaaggctattagtactgcggagaagttactagatggaataatactggtcctgactgaggaaatgaaaaggaacatgcaagttcacgaggttaaatgaggaatggctgattcaaaaaaattaaaaagaaataacgtgatcaacaatattggtttgaaggaatgggagaggttgtctttatgttaagtcttgttgctagaggatctctattttatgttactgttttttgcatactagagtcttctacagatatttgtatgaatgttgtcagtcattctggaaataagcatagctattacttgcatttcacgtggccactaaactatcagtgagaagtgcattaaattcagtagaaatgtacattgtttctgcaaattgtattaccttgagaatcttacaaagcatctttcattaatacatttcttttaaaatctctatcaattacaaatgtaaagataaacctgtacagatgcattttaaatttaaagcttccagaatgtaaggtttagttcgactgcatacctcattacctccccttccctcctccctccccttactcccaggaagtttgcagggtaaataaaacatgcacatgataataaaacaaagtggaatgtactaaaataccaaaaggaaaatacagattaggtatactgagtaaatatgttacagagaaaacttcctgtatttaaaaagtaaggaacaatgggatgagatcatagataatcctggagcatttcctggtagtaaatttccagccaggtttatatcccaggtctggggattggaggttaagtttctgcatatacaatatttgtttacattcctctctgcctctaccagacagacagacagacacacacacacacacacacacacaccctctgtctctttctctctctttctctct

SEQ ID NO: 101951 - DNA, 1022 bp, Homo sapiens
caagctcacggggacgagcaggagcgctctcgacttttctagagcctcagcgtcctaggactcacctttccctgatcctgcaccgtccctctcctggccccagactctccctcccactgttcacgaagcccaggtgggccgtcggccggggagcggagggggcgcgtggggtgcaggcggcgccaagggcgcgtgcacctgtgggcgcggggcgcgagggcccctcccggcgcgagcgggcgcagttccccggcggcgccgctaggggtctctctcgggtgccgagcggggtgggccggatcagctgactcgcctggctctgagccccgccgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtgggtgccgcgcctcggaaggcggggggaggctgcacggtggggacgcgataccccccaagaccttaacccaagtctttaatgcagagaagccgggggtccgtcaatgggacccctctcctctccgcccccgcttgcggacgtccagcgcatccccgctttcggcccagccctgccccagggagtcgcgctccggcccgctgagagggagcgggcgaggcgctggtctccctggttccgcgccagcccggggcgagaagggtagggggcgaccctgagcccagaccccgacttagtccctgccttggaagcgggggtcgggggaggcgagagacattcagacaggggggaagggggaaggagcacgtggggaaaaccgaaaacgcagcgtccctaaagccagtccttcgctcttgaatcgttgccctttcctttctcttgggccctggggaggaggaggaggagtcg

SEQ ID NO: 101952 - DNA, 1440 bp, Homo sapiens
ttttcttttatctacctctgcctctgttgactgctgagagtggttttctcaaagcatattcactaccatgttcaaagaatctctgatagctacatgttatacattctacattgcattcagagcccaccatggtgatataaccgcactcctcattgtcttttcccattctccctttcatgtacttttgcttgagatgaagggctctcccgcttcagtgcttttgatcaacctgaattgtccctcaccttctctttctgccacttcagcatcatattttcaagaaactttctctaaacaaccagttcttaacactttgacccatgataccacattttagagcacttaccctttcatacatatgtggtcctgacctaataaaactaagatttttgcagccacaatttatgtcccctcccaaagtatctagcccagtggcttcaacacagtagaaatgcaaatatttgctaactccttgatgttctcttccccttctttttcagcaggaccaccaccctacggtcacgaccacgagatggaatactgtgcagacttgcctcctccatactcccccaccccacagggtccagcacagcgttctccaccccctccttatcctggaaacgcaaggaaataatctatctcccagaacagaacatgtgccaatgggcgatcttgcctggaataaaatgcctctactcagaaacaggcaggaaagaattgctccaaggaatactttttggggtcagataatgtgtcaggtggaatatccctgctaggagatataggatttctactctgctcaaagctgaccccatctggagtattaatgtttggttctatggaaccacattttaagagatctgctgatccacctaagcacattcagggaagagtaatgtaattgacaaaatatctgataatcatgttgtttaagggctaggtgaagaaagtttcagtattgatcctggaaaaaaagaagatctaagtaggatgggagaatgatttggcccacacaaggaagcaactttattctatatagctttaaaagtcagaactagaattgttcattctttcattcatcaataaatgtattttgagtgcctaagagtttactatgtgcctagcactgtttgaggtcctgatggaagttacaggacgggtactctggttttagtacaagaaagagcaatgactagattgctttgtgaagctcttggtagagacacgctccagaagggataacaaaatcaaatagtagatgggttcattgggcctcagaagttctgctcgtattttaggtgggtgtgaagtgaatttctatatgtccaggagtgaatacaacagaaagagttggatcttatttatttaattagggagttaaaacaagaccaaaaagactcaacagccgcttgaagccaagaactcttcaatgccagctac

SEQ ID NO: 101953 - DNA, 1004 bp, Homo sapiens
agcagaatggtttttaaaattattactttggagagcatatctagagaattgtgctttgtatcaaaacatgaattttaagaactggaatctgaatgatgaattggtcaacggtgctagaagaggatttttataactttttcatatctattgaaatacagactatttgctttatcaattcagggaacttatgggttttaaaaaaaaaaagaaaagaaaaacacacacacattatccttaagaacatttgtaagaaaacacttgtcctataatcatggagctctactagaaagtctaaagaatgcttacaagtcttttgagtaaacttacttgtttttccttttaggggcactgcaattgcgggcattgtttttggaatagtatttatcatgggggtcattgctgggattgccatatgcatctgcatgtgcatgaagaaccacagggcgacccgcgtgggcatcctcaggacgactcacatcaacaccgtctcctcctatcctggtgagcaaaactgttgactctcgaaggctcagatttgctagttatcctctgctcctcacagagagaaggaaacattctagatggtcaatgaaaccaccttcaatttcatagagtatttctaggtacatgtagattgaagttctagctgaatcaagattgcttagatccaagtaatacaacccaattctttttttttgaaggtattcatatttttaatgtctgtttcattgactacaattgccagtcagccagaattaagacaaataagcaattcacacccactgtgtctacctgctagtgagtactgacaagtaatttataaagtataatgtatgtctcaataaactggcatctgatccaatagatatatatgtcttgagaaaaagcattcaagaaaattttcatatatcttcattaggtcgagagaacagctttaaacacaatattaaaattctcaacaggccaggcacagtggctcacgcctgtaatcccaacattttggt

SEQ ID NO: 101954 - DNA, 1013 bp, Homo sapiens
taagtactgtcctaagccactgggcctctctaatagcagcctccagtacttagacacagcctctcccctgctggcctggaagccttgctggcatctgctacaagtgtctgctttcccttcctccttgcaccacttcctggccttccatcatccgctccacaaagactcagactctcctattgtggcccattgcccttccaggtggtactctcaggacctagaagagctccaggctgaccctctttcctatgtggcccacatctgatgcatggatagtttaatttcttgcctgttatggactgaatgtttgtgccaccataaaatttatatattgcagcccatatccccaacatgatggcattaggatggtggggcctttaacagagaattaggtttagatgaggttaggagggtggatcccccaccatgatgggattaggatccttataaaaagaggaagaaccaccaaaggttcttctctctgcaatgtgaagacacagcaagatggtggccagaaagtaggtcctcaccaagaaccaaatttgccagcaccttgatcttggacttcccagcctccagaactatgagaaataaatttctattgtttgaatcacctagcctgtggtatttgtcatagcagcccaaggcaactaagacattgccctattttgggtagggtataaatttccccaatcaagccctttccagttctctccctgcactaccatagaccccttctctgaaaaaaaaaaaaaaaacaaaaatgtgttctgttcattgctcctccctttccctttccagttttcctttccactgctcaaaaatgtaatcctcttccagccagtctgatccactcactgatcttctggcatttcatgtgcaatcagacccagcagcctttcacaaacataacctcctgcttatctgtccaacctcatttccagcttctcactcacagatattgttaggtcctgcactactggacttgtacagtgacccaaatgcaccaggtt

SEQ ID NO: 101955 - DNA, 2387 bp, Homo sapiens
acaacagtccccggtgtgtgatagtccccttcctgtgtccatgtgttctcattgttcaattcccacctatgagtgagaacatgcggtgtttggttttttgtccttgcaatagtttgctgagcatgcatggttttttcctctttggacttttgccccagtcgcccttttagagccctgatctttctaagaccaagcctctgtcctctccttgctaaactccacaactcccactttatccccttttcttactggctgtgctgccctggaacttggtctggtcaataggtttttgctactaatgaacttcactgatagggtttgactagtctccacagtattgcctacttctggattgggtcctgggtttgtgtctttcaaaaaccttgctttttatggaactaagccacctctccccacagcagctttatgggagcactaacttggatcttttgccacaccactggaatttcccctggaccctgcaactaaggaagtgactgtgtgtgtattgagggttggcatggctcctagtcctagtctcagcctccagggatctgtgccaggcctgcccatgtctgcagcattcttagaggtacaaagatgagcaagcccagttcttagacttaaagatcatataagatagtaggcaatatgaaatgagtgcaagactaaggatcgtacaaggcagaatatggtaagtgtgttagggaagtacaaagcaccctgtgaattcacagaagcaagatttcaatcacattgttgaactgccatggtgaaagcaacatttgagctaggctttcagtgatagatatcaacagacagataaatgaaaagacatggctaggacagggaagcaacgtgaacaaagacacagaggtaggtaaatgataacaagggaagaatatgtagtaggtgggcgagctggagagaatctggtctgcatccagattgtgaaaaatgttaaacgcttggctaggagaaaagcacttactttgatgactatttgagaccagggctatagtatacagccacacaggttatgcacagccaactccaggggtcccattcatatgcattaggggttggtcaaccttttctgttttatctagcctgatagtaaatattttaggctttgcaggccacgtggtctatgttgtaactactcaactctgcctttggagctcagaaaaagttatagacaatgcgtaaacacatgaatttggatgtgtcccaataaaattttatttatagacactgaaatttgaatttcacaaaatgttactcttctcactttttaagccacttaagaatgtaaaaacagaatgttcttagctaacaggtcatacagaaacaggcagcagaccagatctggcccctaggatgtagcgtgctgacacctgataaagactctgtgggccgggcgcggtggctcacgctgtgatcccagcactttgggggccaaggcaggtggatcacttgagatgaggggttcaagatcagccaggccaacatagtggaaccccgtttctactaaaaatacaaaaaaaaattagccaggcatggtggcatgcgcctgtaatcccagctacttgggaggccgaggcaggagaatcgcttggaccctggagacggaggttgcagtgagccaagatcgcaccattgcactccagcctgagtgacagagtgagactctgtctcaaaaaaaaataaataaaaaaagagggactgaatgtgaacgatactcctaagttgtaagacacatggaccatggtggaaatccattgatgctgtttattaaagaccagcatgatgcagttttgtctgtataagaaatagacgagaggaaaaagagatgtgaaaagggaatcccattctgatggtactgccgtacttcaagcagagtgtgtgtgtgtgtgtgtgtgtgtgtatgtgtgatattgttgacatatttctgaactgccatgtagaaagtgacatttgaactaggccttctatttgaatacacctatttttctatactttttcctctaaattgtctacacaatgtatcatcaacttggcaccatgaccagctctctggatgtcttttataaaagtgaatggcagaagtgtcttaaaagaataaaaggaggaaagcaatcattctcaaggttataatctttggggttaaaggggaagaaactcaaacccttgagtggaggcagtagtataaattttcaagaaataaaacaaagaagccttcactttgcaatcacttgctcctcttttatcacaacatcatataaaacatcttataaaattcattgtgctttctgttaccctccattttaaaagccagcacttgggaatgtttcagaatatcgattcagtgaacttctgttgtacaa

SEQ ID NO: 101956 - DNA, 1041 bp, Homo sapiens
tcacacattccttaaaatatatcaaacattccagaggccaatacaagtgaatctgagtttgaccattatcatacataatatgtacagatactattgcctatttaaacagacaattaaaaattgattatattttgggagatctctataaactcatcaaaactagagaacttgtcatgtaacagaatcgttcagcttgatattctgcaatcaatatttttagagtgcaactttcagaagaatgcatttcagatttttaacttcaatagcaatggatttgcttgtagtcactgaaatctcaaacttttgtcatcatttagcagccattggtcatctattaataaatgcattaatatttatcaaatgacaagtcttttttaatgtgctttaaaaatgtgctaaatacattttgccctacagttcaagttggctttcaaagggcccttataaactatcaaactgtcacaatgcaaattacatagtaagagaaattacagagtgatttaaatagaacttcttggaaggatgtgtgatcctaggatgcaatcagtatttttcattaaatactggtaatcagattatacaccaaataacctagtctgtacatgtgattggcagtgaaaagtatttttagactcaggtactcaacattggctttgcaagtggtataaagcaaagagccatagtctaccttaaatacgccaacttcttacatttcatacaactgcttcattctatagaatttcagggaccagaaagaattgcattgactggaaagaatcaagtcaaaaaaggtggggagggctagtgtggaaacaaacttctgagggaaaaattgcccatatgaaagagcctaagaaagtgaaatttcacttatgcctttttttagtacttaaaacatattttaagcatgtcttttgtgtgaatgacagtataagcattgtgggagaaaaaggataagtgcaaactcttttggagatttatagtatagttattggagtttttagtattatttcagatcaagcatagaaccatatcaatgct

SEQ ID NO: 101957 - DNA, 1781 bp, Homo sapiens
tgaagtattattggaggactggaaagctaagtctgtccgtgtgtgtgtgtgtgtgtgtgtgtgtgtgtttgtgtatgtctctgtgtgtgtgtgtttgtgtatgtctctgtgtgtgtgtgtgtgtgtgtgtgtgtgtgtgtttaggaggagatgtttagggaacagatcatcaacatggaatctgatcagagttttgaaggaaaagtagatatttacataaatagtgaagaaagggacatggttttaagacagactctagcatacaaagtcaaagatacaagaaaggaaatgatccagttgagaaagtccctactgttcagtgtggctagtggggaacgagtaacctttgaatatatgtaggaatatgtaggtcagacaaaagatagatcctttaatgatgtgcttttgttggtcatgcctagcaaaactgaaacaaaataattcagtacttttctggaaatcagatatccgattttatatagaaccgacacattcttaggcatcattaagacaatagacaaagataagaaggctccaaatgaagttgctttttatttattccataaatgaaatatttggaatgcaaactttgagatgttacactatttgaaaccatttatgacaaactatgtgaccttataattatttctccatttaagagatttttgaacatgagggcaactacccgaagatagaagcctcagaatatttaaaaatgagaattgggccaattcaagaaataaacaatttcccaccagattgattctcaaacatttgattcagcaactctgcttcatggaagatagatctgtgatgaatatggaaagggatgtttaactttttgctgctaatgagatttaattggcattccccagaaagtagatccagtgtaaaaatgtggtttatagagtcctcttcggagttggtagaatttaagggaatagagggtgcaattgagtggttaattactgttatccagtagaacaagctaaacatggaactgaagtaaagttgaggaaaatgaaggtattctcttttgtaagagaataattgtacaatactgaatatgaacaaaatattgactagtttggacatagtgagctagatgacaatatatcgcatttaatttcctaactcaaaaatagattttgcttttccactttgccattgtaaagcactcatcggtctgtggattcttcagagccccatctggccaacataaaatccccacaggaaaaaaaaccaagagggagaactaataatggagatcctggtgagattaaatttcttttcttctcaatgaaatgtgaaagatgtattacccgcagtttggcaaagacagctaataaatatcacaaccgtgatttgagagccatgctatgcatgaaagcaaaactgagttaaaagataaaggtttcatattttcgagtggcatttgaggtcctatgatcattaagtatcttagtgttctggattaatcaggtaaggctattcaaacactgacaaacgtaacgcatttaaaaaggcctttggcattagtaaaaaaaaaaaaaaccatttaaattaattaagttaaaataatcttagtaattagatatgaaaagacctctaggaggtacatactgaagaaatcaaagcttgtgggagtcttatttttgttttaataatgacacagataagtaactaatatgatgttaaaataaatatgaacttgatttagaatgtagcaacaacttatgtttgctataagaaggaagtcagtgattttcaaatgtatattt

SEQ ID NO: 101958 - DNA, 1099 bp, Homo sapiens
atttattgagtagggagtcctttccccattgcttatttttgctgactttgtcaaagatcagatggctgtaggcgtacattgaatggcttttaagaacatgaagcaaaacatccccactaagcccttgggataactgaccagtctaaatatttgaataaattaaacagcactaaaaatgagagctatggaaattcaccaagaaaactgtaaaataaatagcctttaaaagtctgttgtactctgcaaaaagcatctattgtcaatatattggcttctcccttgtgtctaaatcgttagattttgtttctgttttcaaattttaaaagtggacttaagtacttactgaatctcacaaaggtaattatttttcgctttcattccttcataccacaatccagaggtaagcctcaagggtcatgtttgacaatctgtaatgtaaaaataaaattgaggagaagaaaatacgaacttttccatttgttccacaaaagccacgcataattgttaatggtgactgaactttgctgccttttaatcacatctctttgtaaagtatcatcttagcagggaagtgatttaaaagcaatgtaaaatttcctttctggataaatcagttacatggacgtgcagacataaatataatattttgtatttttaatgttatagctttgatagggaaacaaaagttttatataatttatataataattaatattaccttcaggaattgagctggaaatggattattttgtgactcttaaatgtacaacataaattatcagactgtacttaatgttttcctaatcatgtatctgaaacttatatatccatcataacttatacgactaagtcagtgacaacctttgcttgttaaacataaatcatttaggtggaataaagaatacttaaaagctagagtaatttttatccaacatttttagtataatttttcttgcagcaaaatatatggaaaaaatagtaatttctgatcctttattcagaaaataactcttcccccttcacatagtactgttttatatcttactgattcctcaatctgacattaagtaaactcttcattatttacaaaataattgtc

SEQ ID NO: 101959 - DNA, 1039 bp, Homo sapiens
agagaggttaatgttacttttttccattttggaaataattttaatcaagtaactcaaatgtgacaaaatttatttttattttttgtggttatattcccaacaacattaaaaaatactcgaggcataaatgtagttgtctcctactctgcttctcttactatactcatacatttttaatatggtttatcaatgattcatgtttccctcaaatagtgatggtttacacctgtcatggaaacaatcctagagagctcagagcaattaaaccactattccatgcttttaagtagttttctccacctttttcttatgagtctcactagattgactgaggaatgtatgtctaaattcctggagaagatgatatggattggaaactgaaattcagagaaatggagtgttcaatagataccacgaattgtgaacaaagggaaaattctatacaactcaatctaagtcagtccactttgacttcgtactgtctttcacctttccattgttgcatcttgaattttttaaaatgtctagaattcaggatgctaggggctacttctttaaaaaaaaaaaaaaaaaagaattcgtctgaaaatgctcaggtttgtaagaatctaatctcacttacataactaagcactccataataagttttattaagtacaaagggagccagaaaaaatgacatttatttcttctagatcagaaaaatttaaattaagccctgccttgctgtttagaaatatgtgggcattgttataatttattcaataaatttatgttcctttgccttcctgtggaaacagttttatcccactaaactaggaattaggggataaatcacaaacaaaaaaaaagttgcagcactgaaaaaaagtaatttattgtttttgcaactggtatgtgaatttgtgtgataaaattatttattcttatttaacaaaaatatgttcaaatttttctatatttaaaatgttttgctgttgtcctactttttaatttatgcttcatgtttgtgtataaagtacacttttacactttgtga

SEQ ID NO: 101960 - DNA, 1020 bp, Homo sapiens
cctagtaaatgctgtcgaagtaaatatctgtataaataacataaaaatgtggaggcttggaaggtcaccgagccctagccacttattttcagccataacagcagtcagttgctcagtggacaattttgttatgaggtgttggtgatttaacaagttggcccaaagtagtcggaatataaagtgaaagatttcatctctgttgggttttattggtgcacactggactcttttgctagaatggccaaagttttctgcgtttggcattcaagatcccaaggagaatgtagtcatcagtttgctacagtgtttcctaaatttgttttagtggtttgtgtatgattctagaaagctttgttaaaaacaccactaggatgatttgctgtctactttttagagtttgtaattgctcaaactactgtcctagatgttttaaatagcattgtaaatttgttgtggaatatcattttatctttagactgcatgaaaattgatcttatgtaataaaaagcaatttacttggattataagaatgcaattatgggctctgtgaaataatatctagcttgactggaacttcagagaacattgttggttgagaggcttaagcacaaatatcacctggctgagtggttttgaacactcacaactatcacttgggaaaccaagctgtcctttcttcaagctctcaaactccatattattggtattttgacattttaaaatgtaaatgggtatgttttcaaaatgagctatatgtttgtgacaatagtaaacattcataactcactaaatcaccaaaagaaatgaacggatgaagcaagcttagttttgcaagaaaccggaaacttcctcatttcacttctctttctttgtctcccctagtcctcccttttattagccacctatttacttgactaagaaaataagtcactgacattcaaaaaccatctactaagtgtttgcaacttgcacagcactaagttcaatacagaggtttcaacagtatatgggagcaaatgc

SEQ ID NO: 101961 - DNA, 1026 bp, Homo sapiens
acaaaaatgttgtgccattttacaagcagcagaagtcccagaaggccacacagttccgtggcctgatatatgcagaagaataataaaaaattttatggctctggggaaaccaatcaatcccaggagtgccccaaggcaggtaaagctggtgtgtcctcactcagcctcctgccttgacagctttacctgagaacacttagacttgcagtgcatggtctgtaaacataaaaacagtcctggatttgagataaacacatgcaccagattctggtgcatgtggtacacttataccacaatgataagtgtacacggatttgtcaggaagtggggaaacttttcagaggttactatttcattaaaacaccgcaagtggtcaatacttacatcaattagtagatgcagcccctagatgagtgtggcagcccctacaaaataaagtaaaaaactggtgatgggttgggggagggatgatccaagtaatttaaagagaaatccttccactaataatcatttatgccacttatttacttattgaaattataaagtttgtgcaaattttctgtttttctttttcttttctttttttggagacaaagtcttgctctatctcccaggctagagtgcagtggcaccatctcagctcactgaacccttttgtctcctgggctcaagtaatcctcctacctcagcctcccaagtagttgggattgcaggcatgcactaccacacccagctcatttttgcagttttagtagagacagggtttcgccatgttggccaggctggtcttgaactgcttgcctctagcctcgcccatctcaatctcccaaagtgctaatattacagttgtaaaccaccacgcccagcctaaattttcttaatatatattttttcatgctgagtgtcaaaccatgagcctcatgtcctaggtgatatttagcattcgcaaaatggtatggagtgcccagaaggcaaatgttttgtcttttgccaaatatacatcactttgctttgcatacatatata

SEQ ID NO: 101962 - DNA, 1857 bp, Homo sapiens
tttaaacatactgaaaaagaagttgccatttgttcatttgtttcacaggagatttcttatatcttagtgattgtgtgcatgagcctaagtaggaagaacttagtgtagccatcggaagtaatactcaatttgtgttaattttggagataacagaaagagcaaaaattttattgttcttcccttttcactttatcatttgaaggttactatagatgtatgtgtactttatgatgtatgttagaggagaactttaaaagttcttttagtatttaaaaccttttctttttcagtacaaatggtttacatctagcaacaaatccacttgtccactgtgtcgtgagacgtttttctgagatttttttcactggaagggatccctgaagtacatcaaacaaaggcattggatttggatccgtctgaaagtgtggatgtggggaagccagtgagcattacttttaaataggaccttctctggaaaattattttggttaatgtaataatcctaaaatcaggtttacttaactttagattgctttgtaaatgtttggaaactttcttttacaaaagaatattacatatttgagagaaaatatttctattaatggtttaatttctttgtatatttaaaaataaatatgaaaaacccctaaattacagaattggaatttgtgaaaagattgcacaactatattattgataaacccattccgtttgttgatctgtgttttagaatagtccaagtgaagcaaaacgaactgagagagctgatttacatctatagatattttaagccttatttattagttatgacaataaattagtattctgatatttgtagattattttaatgataaaaatgacactaagctattaatacggcttgtcttaagatatctggaggcatgctctgaaatcctatataaaagagtttaaactgaactttaaggtgcctccatttatcaagggttatgaaactcagaaaattaaattcttgatgctgacctttttgcttgtgggagaattatttctatatattagtgaaatttgaattgtaaacttgtcagtgaatttatcactctgagcgagtctctagagggtgagaatttgagagaaatagtaatttgattatttcattcatgaagcggagtggtagttatccttctattgagagggaagaaataaatgagtattactgaaacttaaagatcagtggaaaaaaaaaacatttaaaaatgttgtaggagactttcaattttggaagcaaactgagctattcttaccagccaaagttatactaaataagagacttgggggagcaaatgtttttcagccttcagaaatgaaagttaaggattttagcactaggtaaaattcagtataataggctgaagtggagtaagtgaaaacctgccttttgccactcttaaaaattgtgcccaaaatataaaagtgtggaactttagaacttggaataattttattgcagtcttccattacatggaaatagcatatctaatatctaggttacttgagagaccagctaatcatctctgttgcacatgtttaattggcaaaaagcaattcatgataaataaaattactgctttccatctactgggtaaaatgactattgaaatagtatgaatgtggtcagaggattatagttgagagtgaagtactatgtgtgagttatagatctctcgaattatatttatagatgcagtgtcctgcccagttttgtttgcctcctacattttactgtaaaatatttattgtcttctagccttgagcctctgagggtcagtaagtgaagtacagatagcaaaattttactacctcgttaacccttttcttaaa

SEQ ID NO: 101963 - DNA, 1133 bp, Homo sapiens
ctgtttttaaaagagaaatcagaaatccatatttttatgtgaaatttcctgattgaaaaaacaactctgagaagacccccatgacattttggaccactagtttgtgctctctgtcgtaaagggatgtcggagtttttgatacagggtgaggtcagccataaaaatgggattagttttaagcaggaatttgaaaggttaagggcaatggtgtggaaggaatgtatggaagacttgggaggagagtgagggagtcatctgtgggaatggtgaatagattttcttgtctcagacattctaagccaaggtgagtgcattgtaatacaggaagacaatttgagaaagatattagaaatgtgttacaataatgaggggatagaatgtctgctagtttatgaggaaaggaaatttgttacactttgagttgttcttttataccaattgtcttggtgtatttggtttactaacaaattctttgctctccaccagcttcgggctttgtattccatgtatcttcggaaaacaaagagtttgaataaattgctctatcacctgttcaggcttatgccagaaaatccaacctatgcagagacagcagttgaggtcccaaataaggaccctaaaacattctttactgaggagctccagctgagtattagaggtcagtaagatatgtgtttatgttctttcttggacactagattcagactaggttgaattaaacttttccctgagaatgtggagaataaccccaaaggtgggtcctggctatgagaatgttgaaattgaccattttccatatttctctaaataggatgaataattagtttttacccataagactgtgaggaatttaatacatttttgaagcttagtgtggtgagactattaacttttgactctgtaaacaaatatttcttacgtgataacattttataggcatataaatcaggggaaataaagttgaataacatttcattctgggagctcacatgtgagctgagaggacagatatgcatgtatctggttgtactacagtattggaaacaatttactaagaatatgagttttttaaatgccttggagatctgaggatggactgcatcttgtgagtattgagttgggtattccaagac

SEQ ID NO: 101964 - DNA, 1592 bp, Homo sapiens
tgattcattggaaatgacttactgaaaaattcaaaagcaaaaattttgatgtttaaatcaaataatactaaatagtaaaagaaaaagccagaagagaaagcttggcttctcagaagcatcatctatgctttactttacagacagaaattgaaaaatggcaaggtatccaatgactgttgcaaattaaaataataatacttcagataacatgaatggatgatgtgaatagaaccttgctattgaacatttgctggatcagataaaagtcattaaaacagttgagattaactggaatatatattcagttcatgtttctagttaagactgctttattgtttatgtctagtttttatttcattttcttaaatgacatttgattgtttgtgaatcatttaagctatactaactttcttttgagacgtgcatgtttctttcctttttgtcattaggagaaaacaaagatgtgtctgaaacatcctttcagaatgcaatgctgaaacccatgtgtgaaacattaacgtatatctcaaaggaacagctattgagtcacaaacttcctgcaagattagttgctgaccaaaaaacaaacttaccagaatatctccagactttgttaaatacattggccccattactcctcttcagagctaggcctgtgcaaattgctgtttatcatatgctatacaagtaagaattcatccaattgaatcaatgttacagtggtctaaaaaaatagaatatatgcttagtttttacttttaattatttaaagtaaaatttttaaaagaaggagatctgactgcttcacttatagggaccctaagttgcctcatcttttaggttattgttctctatacacaatttatatttcaatagtcctggctatagtagttattttaaagaaaactcattaaaacatttactcattataaaataagtattggtctttctgctcttgagcacgacttaataaacagtttaatatcacatatttaaaaataatgttctaatttctagattgatgcctgaattaccacagtatgatcaggataatctaaagtcatacggagatgaagaagaagagccagccttgtaaggtttttttaaataatttgttttattaaattcttataatccatctcacttataatgtctttagaggactgaagcagcacagaagctatagagttatattcattctacagatagatctttttagttatctgtaagatataaatgaaatatagatttcacccaaaagattgtgtcactctcttaattgttcttaaatcacattttccgtttgctactgttcagtaaaactatctttggccatatggtggctgtggaaagagtgtatcggttcaagtatctattgagcatccactttgtgcagagtattaattaaatgctgaggggaatatgcagtgtttagtgagcactttcttttccttaaggaatttatctgatacagatgatactgtagcgttatggaaaatatagtatatgataagtgctaagaaaaaggatagataacttttttttaaaggtcagttaggcctatataagatagcatgtatgagggcacaatt

SEQ ID NO: 101965 - DNA, 1034 bp, Homo sapiens
atgccgaacgacagtgaatgggaaaagatgaggcagtctcttcctatgcaggtattttggaaattgaagagtacatatctcattctgaagtttggatttcatgcaagcttgaatatttttattttggggaagaaaaacataaataaaatgagtattttgctttgctttgatgtctttgtatgctcatatactggatgtttgctttttgcaagacaccatttgacagtggcagtgggcatggtacaaagacttaggacctagttctgtacttaaggagtcttaaagaaatacacatgttgataatttcctgtaaaagaaaacaaacttctaggtttctgtggttttggtaataaatattctcacaacttcatttttgttcagtctcaattgcttaggtaataaataattttgtatataacgtattcttttcacagtggttacatagacctcttttagagggaagattgagtttgaattatgaatgtttcaaaacagattttaaggaacaggacataaagacacttcccagccatttgtgtacttcagcattattgagcaaaatggtcttaattgcactgagaaaggaaacagtcttagaaaataatgagcttgagaaaataagtaagtatatatgagtatttacatataacataatgcatgaatgaatataattttgaaataatcttgattatactgcagtttaaatctttaattcaagaatcttcagctttctttttcctattttaatgatgagaaccttgaagttacttaagtggtgaatgtgaaattgcaaattagatacgaatatattggaatcttgctataatcttgttaactgtggatcgtaatttggtgttagctactcaggctgtcatgacatcaatgtaaacagatcctgtggcacataccctaaagaaaatgggtgaggctttggtgttttatcaaggattcagaattttctgttgattaaaaaaaaattgatacctgataattttacatatttatggggtacatgtgatattttgatatataca

SEQ ID NO: 101966 - DNA, 1085 bp, Homo sapiens
aactcctcacctcaggtgatctgtctgcctcagcctcccaaagtgctgggattacaggcgtgagccgctgcgcccagctcatttacatatcgtaatattgtaagcaccctaattgtttattaatcttcataccatgacttagaagatatttaatatttttagttctatatcctaaagggttttttttttttagctcataaagttgactcatgacttaaagggttttcagtgtacaaacttgctcaccctaactgtagaccatttctgttttctacttaatttaaaactgccttttttacttgagggcctttatgtgtgagagaatgtgttgatttgttgataaaattttgtctaatacattttaaaatccaggaaagacccatagaattattaatccaaagtaagatatttaaaaatacacgttaatatttttattttttgtctgtttgaacctttttttctccagattacttgattggagacgtatatgttgaaagaatcattgttagacttcatgaaactttattcaaaacaaagaaattatcagaagctgaaagcagtgactcatcagtgtcttttatctgtgatgtggcctataactatttcagctcagcgaaaggatgcttgctaatgccatcatctgaagatttattattaactctctttcagttatgtgctcagagcaaagaaaaaacacatttgccaggtaatagcctactgctcaaatgttttgttgggaatctccggctctgaccttcatagtgagtgtaagtgcccaggctttattaattgaattataatgtgtttgaaagtttaaagcattttgagtaaagggctacagtcttaaacactttcagctctagaaagcaagttaaagatgtacgtagatgttatttctaaagatctcacttgatattcaaagaaatttggaatgagccataattgattaggtggaatcttagtccattcagtagttctggcatgttccttaatttcttgatgtcttagtttcctcatttgtaaaagggggataataatatccctttattatagtaaaaacattcaatctttggtgtatatcaaaa

SEQ ID NO: 101967 - DNA, 3430 bp, Homo sapiens
ccctgggtgcgctactctccaggaacctccacatgttcagctatctgaaagctccctgaatgctgtctttcttgcgtttttatggaggcttcattactaggcatgaatgattaagtaattgccactggtgatcagcttaacctttagctacctttctatccctggaggttggggaggtattgaaagttctagccctttaatcctgccttggtctttctggtgatcagcccccatcctgctatacaggtgctgccagccatcaatcaacccattagcttatgaaatgatatcactttggagattccaaggattttagagttgtgtgccaggagatgggggttgaagaccaaatatatattttatgatattctaccttttctttcagttgatcccttttattgatgcagttctcaaagacccaggattgcaacatgggcagctatttaaccatttagcagaaactctaagttcctgggaagccaaagcagacacggaaaaagatgaaaaaacagctcacaacttggagaacgtactgatacatttctgggaaagactgtcagagatctgtgttgcgaaaatcagtgagccagaagctgatgttgagtccgttttgggtgtatctaacctattacaggtgcttcagaagccgaagagctcattgaagtcaagtaaaaaaaaaaatggtaaggttagatttgctgatgagatacttgaaagcaataaagagaatgaaaaatgtgtatcttcagaaggagagaagattgaaggctgggaattaacaactgaaccttctctcactcataattcttcaggccttttgtctcctctaaggaaaaaacctttggaagacttagtctgtaaactcgcagatataagtattaattatgtcaatgaacgaaagtcagagcaacatctaaggtttctttctactctgcttgactccttttcttcaagccgagtatttaaaatgctacttggtgatgaaaaacagagtattgtccaagccaaacctcttgaaatagccaagcttgtacaaaaaaatcctgcggtgcagtttttataccagaaactgataggttggctaaatgaagatcaaaggaaggattttggtttcctggtggacattttgtacagtgctctccggtgctgtgacaatgatatggaaagaaaaaaagtcttggatgatctaaccaaggtattcctgttgtatatcttttcaaactatttgaataatagatgagtagaatgagcctgcttattgttttctggttgtttcttcactgtgagtgtcaattttaggacaagcaatatattcttgatcatgatttgggaagtatctagggctgctgggtagatgttcagcagtaccagggtgacaaatacttgtaattaaaaggtgaattcttttaatctatacatttaaaaagttggataagaacattttagttttgtattggttacatgggtacttcatttactttttaaaagttttagctgggcatgttggcgcatgcatgtagtcccagctactcaggaggctgaggtgagacattggcttgagcccatgagttctagactagcctgggcaacatacaaaaccccatctcaaacaaaaagttgttctagcagattgtttctaactctttttcttttttcaggtggacttgaaatggaattctcttcttaagattattgaaaaggtatcttagggatttttttttctttttttttttgtatttatgggaatagaaatattataaccgtagtcctatttacacaataaatatggtcagatagtcaggttctgtgttagagaacttcctcattattgtaactttcttcctataatgtgggaagatatttgttcttttcctttcctgtagtagtatttttctggttagtaatattagggaaaaatgaacaggctctggaaaatccagtgtttctttcctagaaggtaacaaaggcagatttaaacattttattatcttttaattaaagctacaactttctgctgttattctagttactttttctactgcagaaatggattggaggttctagctttgggtagaacacatgagaaaattaagttttctctactctggaacactatgtaggtaaataaaaatcttccagtctttgtgtgattgccactgactaagaaaattagtggtaagaataatgaaaagaaatgaaagaacataaacaatttacaaattttcaaaacggcttaagtattctttcctaatgaggatgtaaatgttataactaacacttttccaactgtagagatgttatgactagctacctgaaattcttactcctttttaaagcattttcaaattatttttctgttttcatagctaactcttgaatttgcaagtttttttctattttttaaattgtagtaaaaaaaacacatagcatgaaatttaccatcttaaccatttctaaatgtacagttcagtagcatcaagtatatttacatcgttgtgcagtttccataacttaattcatcttgcaaaactgaaaccctgtatccattaaacagtaactccccattttccccatagttttatttttacaaaataaatacagaatatttattatttttcaatgaggaatatgacttatcaggcacactatttgccttagtttatctagtgccttctctccctgtagccaagttacatgaagagctaaattatcagaaagctccttgataagccttgattcagagcagggggtgcaaataatttgataagagtagactaatgtatccatttccaacttaggaatgtacctgccgtgaagtgcaaatactcacatctgtgtggaagaaaatcctcttcctgagcagtgattggaagttcctagccagtgtttgctgcctgcgcttccatgactcactagcctcctcatctccttacagctaggcagcttctttcattagatatgttcatactggcatatctcagagacatcgtaagttcagttccacaccacagcaataaagcaagttacacaagtattttggattgccagtgcatataaaagttatgtgtacactacagtctattaagtgtgcaataacattatatctgaaaaccaatgtacatatcttaatttaaaattaatttattgctaaacagtgctaatgatcatctcagccttcagcgagttgtaatcattttgctgatggagagtcttgcctcaatgttcatggctgctgactgaccagggtggtggtatctgaaggctggagtggctgtgacaatttcttaaaataaggacaatagtgcagtttgctgcattgattgactcttcctttcatgaaagatttctctgtagcatatgatgctgtttgatagcattttacccaaagaagaacttctttcaaaattggagtcaatcctttcaaaccctg

SEQ ID NO: 101968 - DNA, 3037 bp, Homo sapiens
ctaatttttgtatttttagtaaagatggggttttgctatgttggccaccccagtcttgaactcctggctttaagtgatctgcccgcctcagcctcccaaagttctgggattacagatgtgagccaccatgcccggccttcatcctcattcttgaaagacatatttgctgagtacaggattgtatgttggtagttatttttgtgttgaagatactattccatgtcttctgattaaattattgatgtcaaaattaactatcagtcttattgtccttcttttgaaggtagtttatctttctccttgggctacttttctccttgtgttttcccagttgcataatgtgtctttgtgtggatttcctttatgtatcctgcttgggatttgttggactttttgaatctttgacttggtgtatttcattggctctgtaaaattctcagctattatctctaggtatttccttcctcattcttctcttgttttgggattctgattaaatagatattaagcctcactttatcccctatgtctgttacgttttctttgttgtttttcatctttttgtctctccatgatgctttgcggataatttcttttgctcggtcttctagttcactgattctctcttatttgtatctaacctccagctgtcttagtccattcaggctactttaacaaaatacagtcagccttccatatctgcaggttctgcatgtgtggattcaatcaactgtagatgaggaacccgtggatatggagggccgactatattacgccattttatgtcagggacattttatgtaattcctgagaatttggtatatgtgtgggggtgggagggtgggatatccttgatccaatcccctgcaggtaccaagggataaactgtaccttagatggagtaatttgtaaataataaaaatttatttctcacggttctgtaggctggaaatttcaagatcaaggtgccagcagattcagtgtctggtgagggttgctttctctgtttcaaagatggctactttttgctgtgtcctcacatggcagaaggagtaaacatggtctctcatacccttttgtaagggccctctgatcctattcatgagggtagtgctctcaagacctaatcatctcctagagtcctcgcttcttaatactatcacactggtgattaagtttcaacatactaattttggagggagacattcagaccattgcattgttcttaaactacgagttgagctttaagttttaattatttttagttgagtaattgtgcttgatctttttccgatctgctctgctttttccaggatcctttttcttacaagttttttaaaacttttgttcctttaaatataataagcattgtattatagaatttgtgactgatcattctaagatttaaagtctcagatcttttatttctcctgattgttgctcatggtgtcttattttctgtttgtttggctataatggaggccccaaatgaaggcttctgctactaaagaggatttgtgtttgcttcagtcaaagaaagagaaagttgaattaattctttcagccttcacttttgccttggtaattccttatgccttttcagccatttcatactctaagattttaaaaagtattttttctagctattttagttttcttagtgggagggttagtgtgaataatctactattaccataaattaaaaatcttatcaagttttactaggttttaatttaattcagctttgcattcttttagattcgctcagcttattttgagttagtctctgcattgtgccagcgcattccacagttgatgaaagaggaagcatccaaagtgagcccatcagttctacttagcattgatgacagtgacccaattgtctgcccagctctctgggaagctgtactctatacacttacaactattgaggtatgtaagagaggcacatttagtacactgaggaatgaacctatgagataagaatatccaaaacttactgggaaaatgctttcttggaaataaaataatctaaacttggcataaatcttaaagtgactaaaatggcatagagtttttattttattttgttttgccagtattaattattctttaaaccttatgtgtcctagtgcagtcaccataactgaattttatatttaagatgaaatataattaagattgaaatataattgtcccttttagaaagcagcttttatagaaatagaagttaaataattatttctaatcaatactttattgtaagcatgtcgaatatatgatcattatatgtaatacatttataatttcagttttagtttttaatggtggtgaaagattttagctttttttaggtaaaatacttggtttttctttttgagagcctatatgttttctcttttaattgagaaaagtatgtttatgatctctaattactactataatcttttgtttggttaggactgttggcttcatgtaaatgcaaaaaagagtgtgtttcccaagctatcaactgtgattcgtgaaggtggtcggggtctagctactgtcatatatccttaccttctgccattcatcagcaagctccctcagtccatcacaaatccaaagttggatttcttcaaaaatttcctcacgtctctagttgctgggtaagtaatttaaatttttgatttttaaaacaaaacagattttcttgtttttatactcattttctttcttacttaaatttctccaagttgttttactattcattaaatacttttaaagttttcagagaattacaattgatatttttttcttgagtacgttcaagacttcagtggtagcacacagcaggaagttagataaataaggtaaagctccttgttggaaataggtcaactaggctatttttcaaattagccatttttttaacagcagaatgtgctaaccaattgcaccacagacacatgtagccattttttattttttatgttgataaatacaaatgcctaaatgcagaaaattagccagtgaaatttttaaaacatcaaca

SEQ ID NO: 101969 - DNA, 1006 bp, Homo sapiens
ctgtgtgacatttttaaaaagaaggaataatatatgtagagatgaaaataacataatgctgtatgtgagatgctgtattaagtgcttttacttgcaagttgtcctgctatttaacttgaattacctgggagctacacatttggttgtattagaaagagatgtttttatatgtttccttctttactttttgacagttgtaggaggaagtattttaaggtctggttgaacatagttgaagaatataaatagttctgttgaaagagtagtaaactattttgtttacttctatattctaatcaaagttttaagagtccttgagggaaaatagtcttagatggcttgatatccattccctgggatcacccttgtacatgctaccgagagcggtatactttctcacttattgcaagccttggcttttcgtctactttcaccttgtattagtagtaaagtatgtgattaaatttctttgtatgtttacattttgaggggcgttggcacaggggaaatagaagatagaaataaagcaactttggtagatatttaatgataaaacattttaaatagaaccaccagatatatagtttggctaattctaaatttttaaatatatttattttgttttatatcaagaactgttccagaggaagaaagagaagctaaattctaccgggttgtaacttgttccttattggcattaaagagattactttgccttttacctgataatgagcttgattctctggaggagaaatttaagtctcttttatcacagaataagttttggaagtatggaaaacacagtgtacctcaggtatattaatcttttttatcttaagacatttctctgattccttacccccatcttcttagtttatgttttatgtttattgtttatacttagaactctgcaagcacatctgtgtggtaggctattcatttactgaattacctctcttactagaatgttactctgtttttacttttttatttagtttgggcctca

SEQ ID NO: 101970 - DNA, 1037 bp, Homo sapiens
cagcatttatgaaaattttcctgcatgtgatacattctgattttaaaaattttaatcaatttctttaaaattctgtcatggtccattatattgatatcatgagccactaatggattgtatccatggtttacaaaacattctaatgtttaagaaacagaataatttctaggatcagtattgatggattcttggcaacaaaaccattaatctttggggaactttgcaatagatgaaattttaggctaggaaaaaagaaaataaaataaaagctcattctgaccatgggaatagccaaggaattataaagttaagttttgaacccttcctggactctgacttttttctccgtaattttcttatcagccttcaaacagtggccgagctgcagaactccttgccaaagaacagggaacagtgcctggatttattggttttggaacatctcagagtgacctaggctatgttcctgctattcaaggagctgaagaaattgacagtcttgtagattctgatttccgaatggtgctgcggaaactttcaaagaaagatgtcaccacaaaattaaaagcaagttttcttgttttcataaaaattatcaagaaaatccctttgttaaaataaaatgtcattagcatgttttatgtaaagaaaaatgaacaatttattgctaagttcttttataattgtacttttttctgacacagagtcttaaacttagttgatatttattttctaggtcgtaaattagtttgttacagtgaacttttttaaagtgctttggaattttggctgtatagtttttcccattagggaatgtaactttgaccttgtaactttaaatgaggtttttttgtttgtagatgttttatttttaaaaaaacaactgaagagtttctaccgtagtagcctgtgaaagagctcttcaaactagtctcatatggcataaagagaaatagtgtattctcctattacataaaatagacaaagcttccagaacagaataatctatagccagttattatggttgttaatcctaa

SEQ ID NO: 101971 - DNA, 2264 bp, Homo sapiens
cttccagaatgtgagctactcaaagaaaacagctgtgacttggtcaattttgggctcctgagcgtctagcacagtgcctgccctatagtaggtgtattattgactaaatgaaggacgttttctacaaatctttaaagataaagagaatcataagtatgataaagggccttaatttaaaggaaatagccaaataaattgaaatgaatttgtagtgggggacagtggtggttatatttaggacttcaagaaagcgaaacttcacaaatttgtgtcaaatctctttctcacatatttatctcatattattcaaatatcaaacaattttaagttcagaatatcttaacagtttatagagtaaatttcatttttgaaatgtgaatcgagggtaagttttgagattaactgaagaaagtcatttttgaccttatatattccttgtctattatttgttttaatagaacctgtgtgcagacacattagaaaaggattggaacaaggtaatttgaaaaaggctttagtgaatgtggaatggaatatctgccaagactgtaagactgacaataaagtgaaagataaagctgaagaagaaacagaagaaaagccttcagtttggctgtgtcttaaatgtggccatcaggtatgcttacgttttaagatcaatatgggattttagaaaactctttgaacttactttagaaggtattacctgaaagtacagtatggataaaaggatactagtaacatagatcatgttctctggagaaccagttctgagatgtgtgtataggtggtggagtgttctctggtaccacaccagtaaaagtaagggaagcaagattaagcatagggagaagttgaatgaagaggcagtggcaacagggtctcagccaatcccacagtgatctcttgcctgaattgaggcaaggagctagacctttctacctgtgcatagaccagtcattggatgtggcctgcccctagagcaggaagtaaccttgggcaaggcagctcccttttgttgagactgattcctggggatggatggactagactgtgagctctcagccggccacattctcagcacctgggggaatgagtagtaccttgatctttggcagtgagggcatgtctggctggcacatcacagtatctactctaccagctcacagttattaccgtggtactaaagtcagggtctctcagttacccttagtggtggcaagttaagcttatatgttaggaaattgggctactaggcagtagtcatgaagtcatgaggcttcaagatcaggcagatagccagttttttgttgtttttttgagatggggtctcactctgtcacccaggctggagtgcagtggcacaatcttggctcatggcagcctccacctcccaggttcaagcagttttcctgcctcagtctccaagtagctggaattacaggtgtgtgccaccacgcctggctgagttttgtatttttagtagagacagggttttgccatgttggccaggctggtctcaaactcctgatttcaagtgatccactcaccttggctccctcaaagtgctaggaatacaggcgtgagccactgcgcccagccaggattttttgttttttcacgttttcaaattgaaaatcttattgaggttattatagatcatgtgcagatctaacagataatacagagaaatccctatgcatttttctcagagtcccccagtggtaacattttacaaaatgagtataatatcacaaccaggatattgagattgaaacaacacaccaatcgcaatcagatctcctgagtttgacttctttttttgtgcatgtgtgtatgtgtacatgtgtattacattctgtacacttttgtcacctgtgtagattattcaccaccacagtcacgatactaaatagttgaacatcacagggatctcttgtgttgcccttgtataatcatacccacctccctactgccaccactctctgcagcccctggcaactaccattctattctgtatttctaaatttagtcatttcatcaaaaatgttatgtaaatggagtcatacagtgtgcaacatttggggattggcttttgcttttttctttttttgaggcagggtctcactctctcacccaggctggagttcagcggtataatcacggctcacggcagccttcacctcccaggctcaagtgatcctcccacctcagcctcctgagtagctgggactacacctgcatgccaccactcctggctaatt

SEQ ID NO: 101972 - DNA, 1112 bp, Homo sapiens
ttttattgtcacaagtatctttgtcagagccagaattatttgttttttactttaggattgatttttgacccacagaattcattaaaaaatttatttcatgtccatgttcttgattgttttatattcttaatttcacaaggtaagatgtgttcatttgtaaagaattttcgtgcagtaaaaaagggagatttataccaaagcacatactgtttggtttcatttatcaaactaatgcttactttaggtctgagtattttttgtttactgggttttgtgttttttttctggatggcaatttacctgtatctatttaaaatcaaatgggtgggtgggttggaaagaatgacttcaggtaaactcacaaactctagtactgtttcccaagtatacttctgcattcgatatgactgtattacacattttgctaaatcttttctttttttaaagcagagaaagataatggaaatattgaacttgaaaataaaaaattagaaaaagagagtaagaatgaacaagagagagaaaagaaggaaaacatggctaaagagaatcctcccatgaattctccttgccaaataaccgtgaaaggactcagtaatttgggaaacacatgtttcttcaatgcagttatgcaggtacattgtcatttttttccctttaaaaaagctgtccttttcctcatagaatctgctacttacattattgagttttttccacctgagtaatttatttctatgtatccaaagaaaactttttttttttttttttttttttttgagacagggtctcactctgtcactcggctggagtgcagtggcacgatcgtggctcactgcagcctctacctcttgggctcaagcagtcctcctaccttagcctccagagtagctgggactacaggcatgcgccaccactcccagctagtttttgtatcttttgtagagacagggtttcgccatgttgcctaggctagtcttgaactcctgggcttaagccgtccaccccctttggccacccaaagtgtttggattacaggcgtgagccaccatgcctggccaaagaaaacttaaggaaagttttattgcatgacagtaagagagtttggtgagcac

SEQ ID NO: 101973 - DNA, 1730 bp, Homo sapiens
agaagttataaggaggcattacatctgtttgctgtgtgtgtgctctgtttttctatgctcgagtgttaagcttccttcttgggaatgtgtatatgtttgagaagccttaggcttacattattatttttaacatctttaaggtgacttaagagctgtgtaaccaaataaatattaccttatccatttttattatttacattttgctttggctctttcaattcttaggtagtaagtgttccagataatctaaaactaaaatagtagagctgaattctgcataagacagtctgtgaccaaacagtttctatctcttttgatgtacattttaaacttttaaatggggcagttctgtcaggaacattggtagtatatgttaactaattagattttagtaaagtcagtgattccagaatttgactgaagaaagtaatttcttttcccatattcaggaaccattagaaataaaccttgagcctccaggccctcttactttagccatgagccagtttcttaatgagatgcaagagaccaaaaagggggttgtgacaccgaaagaactcttttctcaggtctgtaaaaagtgagtatccacttcgattgtgctttcagtgcctcagtgagatgctgagaaataatattaatattaaatagtaaaatataaaaatattaatagcattacatttagtcaaccctctatatacaaaaggcatagttttttttcatttggattttaaaatatattttatgtgatagttaaatctcccaagggtgttaatggactaaacggaaatttgtagaaaccagaactctctgagatttgggatatgatcctaagattttctaaaaatagcttcagagcttagtagactgaagattgcttttctgtctttttgtttttctctagagcagtgcggtttaaaggctatcagcagcaagacagccaggagctgcttcgctacttattggatgggatgagagcagaagaacaccaagttagcatgttatgaccattgtattttatgatcttatcttcataagctttctgtctcatttgatatcttacgagttaaaacaatgaaagctagttattaaggccatcatactttaaaattttttcttacaccagctttttcaactagtatgttttcaccattagaatgaatccagagaattagcagtaattctctttctcatgatggcttaagtttagttgatgtttacagcattaatgttctttaaagattctgttgtactaacctatacgaagagagctgccaaatattggaaattgtttctcccaaacccaggtgcagcacacccttacttttaattctgagtctgatttaatactgttttttgaacctaggaagtattttcattttgtaagagtcagggaacattggttgcattttaaaatttttgttacttgccaggatataaaaaaatgtatttggggtatgaattaatgagtactaataatagtgataataactaatatttatttcgcacttatttttatgccaatcactgttttcagtgttttgtattaattcccttacttcgttctcacaaagtttctgtgaggtggatactgtgattttttcctattccatagattgagaatctaggctgtagagaagttcagtacctagtttaaggtcccccagaaataatggagctgggctttaagcactggagtcagaccctgtggctgtcatgtaatcattgtg

SEQ ID NO: 101974 - DNA, 1276 bp, Homo sapiens
ttaaagaccctttgcatagtgtaaacttgtcttgcccatgacatctgtgtaaatggaactagaactaacttttggattctactcatttttaaagaatgttgcagaagaaaatacaagggtactctattccttatatggagttgttgaacacagtggtactatgaggtcggggcattacactgcctatgccaaggcaagaaccgcaaatagtcatctctctaatcttgttcttcacggtgatattccacaaggtaagatgtcttggaaaattcaggcactcagcagattacggcaaaaccaaaaagtaatcaacttgaatctttccatttatgtttgatttttcattttctcatgacagattttgaaatggaatcaaaagggcagtggtttcacatcagcgacacacatgtgcaagctgtgcctacaactaaagtactaaactcacaagcgtacctcctattttatgagagaatactgtaataatatcaaaagcactttttctggaaacacatttatggcttttataatggctgaaataacgataaaaaaagactaattaaaatcatgttcacttaacattaaatacatgccagaagaaatcatgtttatttaaatattgaagggaaaaatacctaaaaatgtacaaaggttttatattgtcatagtggtttttattcctgctttgtttctggaaaggaaatcctgaattacttaagtactttgtgtttaatatatctgggtgatggatcacaacacatcaataaactgacttaccctaaaatcttgttttattactgggaagattttaacttctattgacttatcctactaggtaacactttaaaaaatatttcatcagactggctaatgaagcttcattacaagtgtgttaattttttttttttttttttttttttttttttgagacggagtcttgctctgtcgcccaggctggagtgcagtggtgcgatctcagcttactgcaagctctgcctcctaggttcacgccattctcctgtctcagcctcccgagcagctgggactacaggcgcccgccaccacgcccagctaattatttgtatttttagtagagacagggtttcaccgtgttagccaggatggtctcgatctcctgacctcgtgatccacctgccttggcctcccaaagtgctgggattacaggcttgagccaccgcgctgggccatacaagtgtgttaattttataagcatctatattgacagcagaatataaatgggagcaatgtttctttataa

SEQ ID NO: 101975 - DNA, 1171 bp, Homo sapiens
gtgttaaactttgtatatacttatgtatcaactactttagattataatggcaaagctggcaggtgggcctaaagctcctaaaccacaaggaaattgggacagagatggttggcaagacacatctcatatataaatagcaaatcaggtgccaaactgaccgacttacaccagtgatgcatgcacatattttcactttcagctttttgagttattgaagtgcatgtcttggaatgttcactaatctctgtggattttattgcggttatccataaaagcagtaaactttctcatgcgctgaaagtttacaattgaatttctaacaagggagctagcaaactctgtgctgtagtgttttatatgcagtacataattataccaagaagactgcttaatcttaaatcatgctaatagaagcattcttttcattctaaaggttaagttgataagcatactcttgtgtgattcttttttatgcagatcatcatggcaaaaccagctggtgggcccaagcctccaagtgggaagaaagactgggatgatgaccaaaatgattgaaattggcttaatttttactgtaggtgaaggctgtatttgtagtagtactcaagaatcacctgatgttttcttattctccttaaattaagagttattttgtgtttgtattcttggctggatgttataataaacatattgttactgtcaaagccttattgtctaatgaccacggttattggctctaaatgacttgtgttcctctcaaccttgttaatcacattagctgtgggacttaaggcaagtcacttatgtaagtagaggcctattacccatgtatatctggcctactgcctgtttgtgtaaataagttattggaacacagccatgctcataccattacatattgtctgcagttgctttctaacaagggagtggcagagttaagtatctttatttttgacagagaccaaatgggcctacaaagcctaaaatatttactatctggccctctacaggaaagtgctgccaacacctggactagatttccagtgtttttgtcacagctctggaattcctgactcaaggtgacttgtttcaatagcaattaataatttgttgaagacactcgacttagcaaagtacaaaaaaaatgcttagaaaatagataaactgacat

SEQ ID NO: 101976 - DNA, 4010 bp, Homo sapiens
caggacacctacctacctgacatatttaaaataaaagcacttctcggccgggcacggtatctcacgcctgtaatcccagcataggccaaggcaggcaaatcacgaggtcaggagttcaagaccagcctggccaacatggtgaaaccccgtctctactaaaaatgcaaaaattagctgggcgtggtggcgcttgcctgtaatcccagctacttgggaggctgaggcaggagaatcgcttgaaccagggagtcagaggttgcggtgagccgagatcctgcctgcactccagcatggtgacagagtgagactctgtctcaaaataaataaatagataaaagtacttttccacctaagtacttatcaaaagcagatgcatctgttttgacagggggttctagaagcaagctgagtttctatttcacacatacagtattctgctgcttcataatatatgcacatatatcttcatatttttttgccaaacctttatttcttcagtcaactattatctaatgactttgaacaccaacgtagtgaaatgattttaaagggaatgtttacttgttttgccagggaacagtgttgataaagactgctgaagaattgatgaattttagtaagggagaagaaaacctcatggatgcacaagtcaaagctattgctgatactggtgcaaatgtcgtagtaacaggtggcaaagtggcagacatggctcttcattatgcaaataaatataatatcatgttagtgaggtaagaaaaagccgatttttttttttacctatatcataaatggttttttggtggtgaaaacactaaacgaaatagaccatgaagactgttaataaagggaaagtaaaggtactaggtcaaatagcagaaggatttagtttggggaggggtcaggaaacacctctgagaaaacataaatttaagctgagagcttgaagaaccaattaccagataattgaagagggaaaagcattccaggcaaaaggaacaacttgtccaagagactagacacaagcttggtgcattgcctatcagagtatggagtcaggaagatcccttttaatccatgaacacatttatggtgcacactagacaacttaacccatttctacctaccaccatccctagtacctaataaaatgtgcaaaataaatcactcttgttcacagaacattgattgcacaaagtaaagcaaaaattttctatatgctgttgagttttgtaagggtttctctggtgttttagaactataaaccactgacatcctaaagtgacttccattctcccaattctagaacaatgccatacaacacaggcttaagatgtggtactattggccagctggactcactcagagagtcaggaatcagcttcctggccttagtgttcattgcaatccagacatgttctgagttaaaatccattgtcaaaggaatgtgacatgggggctggtatacaggttcctctttaatttgaactttatatgctatctgaaattgattaaaacttttattaaggtctttgtgttttttaaaggctaaactcaaaatgggatctccgaagactttgtaaaactgttggtgctacagctcttcctagattggtatgtattttggaaaacactaaaagatagttgaacaagatggaatttttattacaacagtcactttcttacagacacctcctgtccttgaagaaatgggacactgtgacagtgtttacctctcagaagttggagatactcaggtggtggtttttaagcatggtatgtaggaatggtaaaacatgtttaagtgtagggctttagcttcttgtatttaatcaccaaatatatttaattttttgatagaaaaggaagatggcgccatttctaccatagtacttcgaggctctacagacaatctgatggatgacatagaaagggcagtagacgatggtgttaatactttcaaagttcttacaagggtcagtatcagcaatattcttagtagtttgtaaggtctgagtaatttgtatggtcttaaaagtacagtttgcagactcttgcacatcatgagaacttcagaatgagtggtttatatgaaatgaagcacctgtttttgtttttacctaagacttaagtgtccattgttagtgaatatgatagtttccaaaaaagattgtacagaggagttaacagcaaaacagagctttaaaaaaaattgtttatcgttgttttccattgtaatgtactgttagttgctaaagcagttcttagtgctatatctgtggatatgcaaaaatgatacggtactattcccattcttcactttggtccttttcatacaccagacactgtgcactaagaaaatttgccccacccactcatttttaccaaatttgtaatatgtatttgagtaacaatgactgataaaaactcctgtttggtggggtactggaatgtgaaaagattagaaaactgcaaactgatttttagtgaatttgttttgtgttcattttttttttggtgggggcgctacatacaggataaacgtcttgtacccggaggtggagcaacagaaattgaattagccaaacagatcacatcatatggagaggtacagctttttctgtataaattgactttctttccattgcttgaataaaagacagtaattaacgcatttttgttttagacatgtcctggacttgaacagtatgctattaagaagtttgctgaggcatttgaagctattccccgcgcactggcagaaaactctggagttaaggccaatgaagtaatctctaaactttatgcagtacatcaagaaggaaataaaaacgttggattagatattgaggtatttgaaaaaacactgaacttaaattgctttatttggggaatgcacaacctaaaaatagtatgagtttaaaagaaatatcaatgagaaacagtgttctgatttgggagcagattattttcttagtttttacataggttgtctgatggaggaacgtttcattttccttctgttttattgatagtcttttgttctgtagtgtgtagtcagcccagttctgtatccattgattcaaccaaccacagattgaaaatatttggaaaaactaaagacatttaaaaatacactataacaactatttacactatgttatataattaatctggagacgatttaaagtatatgagaggatgtgcatagattatatccaaacaccatgccattttatgtaagggatttgagcatccacagattttggcatccttggaggtgctagaaccaatcctcacatactaaaggatgactctataaggtaggactgtgcttggttactttccagtactatttaaggagctatgtgaggctttttgtgggtgtaaacattttcacataaaaggattttaaatgaaaggatgaaaattgtgtttgacaggctgaagtccctgctgtaaaggacatgctggaagctggtattctagatacttacctgggaaaatattgggctatcaaactcgctactaatgctgcagtcactgtacttagagtggatcaggtgagcaaagtgaaattttgatctttaaaaatactcatttgcatactgtttaatagtatattttcccagaactagaacatagcatagttctaattcaaaggattcttagtcctcacctattagagatactatgtgcccccctccaatttttttcttctattataaattgtattgaatatataactttcaaaccttttagccttagaacccatttgtacaaataatttagagagtaaatttaatatataatactaacatggaatttggaaggaccataaagctctcaagcagacattgcagaccaccagcttgaaggaaaatggagtctctagctgtctgcagataagaggactgggcattgaaaattttttctgctatgacaaattacagcttgagatactaaaagatgttaaaggtgtttaaaatcatatttctaccctttttttt

SEQ ID NO: 101977 - DNA, 1047 bp, Homo sapiens
cacgtgttctatgtttgctgtctccctccacgtactgccagcttttcccattaaatgcaaccttgtgagaacagaatctttgctttgttctgtgttgtatttgcagtactgacagctgtggctggtatattggcaccaagtactaggtaactgaatggctaagaccagttctctgcctttggttcttcccagtacatggaaggacctcccctccctaaaagtagctcattccctcagtgatttctgcctcgagcagaagggtgtgctgtatgtccaccactccaccccttatcccaggagtcactgccttggtttatgactttattttagaaagggatatttttggtatatggagaatcaacagtttgaccgtaatgttattttcaggagattgctgatgagtttggtattcaattccttagggctctggtatcagttcctcttcagtattgcatggcatggtttttaagaaggaaaccgaaggtgatgtaacatctgtcaaagatgcaaaaatagcagtgtactcttgtccttttgatggcatgataacagaaactaaggtatgtagacttcaaaccttaaaagtaataattggggttgcactttcagattgtttgagttagctcttaaaccagtaagtacttcttaaaaaactgaacattgcaggatcttacctatttttttatgccagatttatagtcttcaaatatctaattcaactactgaacattaaactggaaatataaagatggtggccgtattatttataatctgacacacagcccttctagtagagcttatacattcagcaagtgaaagaatatgagaatgtgagtattttgtgtgctcttcacgaaaataaagttgacattctgtagcatcctaaaacaagataagctaatgtaatttgaaaatggtaagtatgtttctaaaaatacatgttagaaagtttgaagtttgtgtttatagtcaatagtggctgacttcatctctagaattcttgaaatccaagttgttgatagttttaaaattttgtagcatgagggg

SEQ ID NO: 101978 - DNA, 2151 bp, Homo sapiens
aaaaaatacatattatatatataaattcttaaagaacttaagttaaaagttaaattttaactccacaaaacacttgtacaagggtttgtcactgtgaatgttaatgttgcacactgatgatctcaggagttattaaagtacagtggtgataccgtcaaaataataaaatcacagggctgactttttatagttttcttgttgctctcagttcttactccttggcttgtttctgtaaaggtatctaaaattaaatcctaagaataaaatccacataaaattatgttatatttgaagaaaagttttatactcccccttttctttaaatcacaaatgataacccttacaacaagaatatatagtaaaatagatattgagagtcatgaccaagttaagtggtatctattttagttctcctgaaggcttttaaaaaatatctaggtttggtggttgtaattactttgttttttaatttagtgaaatatgatatggtgaaacatatgtgtggcactgtatgtgcaggccaccaaaagaggatgcactttgaaattcttatttatagtgatacatttgtgctgatcggcataaagggacttggattttttcttgtgaccacactataagtagcgtatagcagtgtagcagtgtgatcagatggagttacctaatctacaagaaaattgagtctatttaagaaatggaaatgaacaattttatgttgctttaaggatcagatgtttaacttgatattaccttttctactaggtacagcatcctgctgcaaaaatgattgtaatggcttctcatatgcaagagcaagaagttggagatggcacaaactttgttctggtatttgctggagctctcctggaattagctgaagaacttctgaggattggcctgtcagtttcagaggcaagtgttcatttataatttactcctactaaatttttgcttacatatacacctgcttaaaacataaactaaaatcattattatagtagtagctaacatgcactgagcagtttgctctgtaccagccattatagtacatatgcttcacatgctgtatcattttagtctcacaaaaaccctattagtgaggccttataatcccattttatctattttttttcccactttattttagatgagaaaagagactaaaattagaaaaatcttgcccaagatctcatagctagtgagttaggtagagttaagattcaaatttgggctgtcatctaagcctccattcataactagtagagtctactatatgttttattccgaagtatattctttgtcattttgtatcaaaaataaacatccatatgcattgggttaccaaaataagctactttaagtcatgtcagaataggaaatgttgtttatgttttaggtcatagaaggttatgaaatagcctgcagaaaagctcatgagattcttcctaatttggtatgttgttctgcaaaaaaccttcgagatattgatgaagtctcatctctacttcgtacctccataatgagtaaacaatatggtaatgaagtatttctggccaagcttattgctcaggcatgcggtaagtaaatatcagtaaatgaaaagatccaaaataaaaatacctttaacatgactagatactttctctgttgtcccaaaataatcttttgatatgtctcattttcttaacagtatctatttttcctgattccggccatttcaatgttgataacatcagagtttgtaaaattctggtaagtagaaaatgcattaatgctacatatctaggtcagtttttttgtgtgctttttttgtttttttgtgcaaaaaaaaaaaaatgtgttcatctaaacctaaatgttacttcatgatttgaacacttaggactttttttgaggcattatttttatttatgtacttatttatttttgagacggagtctcgctcttgttgcccaggttggagtgcaatgacatgacctcggctcaccgcaacctccgcctcccggttcaagtgattctccagtcccagcctcccgagtagctgggattacaggcatgcgccaccacacccggctaattttgtatttttagtagagatggggtttctccgtgttggtcaggctggtctcgaactcccgacctcaggtgatc

SEQ ID NO: 101979 - DNA, 2001 bp, Homo sapiens
tgataaattctggaaaggtattctacttgaagtacctcataccctttctctaattagtcttagcatggttccctgtacttttcactacttttaataaaaaaaattttaagtcttttgatgtgtaagtaggtacctgcggtcccccaaaatgttatactttattcattcaactagagaggaaatgtatgcatcatttatgaatatcaaatgctgtgttttacattaaaaaatcttgtttgattgtctcaacaatcctatgagttaggtactattataattacttcattttataatgaagaaatgttaagaaaattgcccaaatttaaaaagagccagaaagctaagatttgcaaccagccctcttgtgccaaatacctaagctatgctccctctttattagaggcaagatataagcaaagatatcttgtatttgaaatttttgtttcactgtcctgtctaattagcggggttttttgtttgttttttttaacagcacttttcaggattagaagaggctgtgtatagaaacatacaagcttgcaaggagcttgcccaaaccactcgtacagcatatggaccaaatggtaatttctaaattaatatttgtaaagatacagtagtagaatattgtgtactacgtcttctttcagacttgttctgaggatgttatggtatgacttcggaagttaatttgatagctcaatgatagttcatttccaatttttagttatttctaattttcaatcaactcacatctctttagaaaaatgggggtcaatatattactttttatcctgttgagaggatagaaaaattataacactttgactagtaagatagtacctaatgttcattctgacaaacactaaatataaaagtgacatagtttaaggaagaaaattctctccttcctcttgccttctaccaccaattaaatttaaatgatacagtttcatggaataaacatacaactaaatatactaagtagattattttggcctttttacatgttaatttctgttgagcacttgctgcatgacagtcatgttgcaaacagaagatagaaattggcaaaaatgtgagatttggcatcttacgtagtaaatattgtaggacattagaaagggaagaaagaatatgggtctgcagtcagagaatgcccatggggctataagataaacttgaagaatagatagtatgtgttttcttgcaaagctctttttttaatatacaaatttataatttcttaactagattttcctgggtatttggggaaggatttgattaataatggctttctttttctttttttaactgttacttttgaggaatgaacaaaatggttatcaaccacttggagaagttgtttgtgacaaacgatgcagcaactattttaagagaactagaagtaagttgtttctttaaaaagtcaagaaatattttggtgacatcaaaattaagtagattttaactagaagaaatctcttatttcagattggataagggactatttttccagcttgaaaatttattgtacagattgttctaattataaagagtcctctttagattgaatgttttagccactgaaatcttaaaaatctctcaagttattaatttatggagggattggttgtgatacattgctaattacgatatgaaattgattaccattgtcttcattctatagggtgactctgaagtgaattattccacagtgcaaaaacgtatacatataacagtggtttttaaaaagatccaaccatttggttttgtgaaaataaaaacaatcagttgatggcattttactttgttcagctttagttttactattagaatctataaaatagatactgcctgccagcagggttataaggaaggtctggcacctgaacaggcagagagagccattcctcattcccgccttgtaattaaaggataacatattcaacctcagggaattttcctgaagcttagcccttgaaagcactagaacttaat

SEQ ID NO: 101980 - DNA, 1744 bp, Homo sapiens
tgcgcattcccagcgcttcctatggtgcccaacacagagcggacgcctagagacaattttgggggatggggcagatgctctgcctcgggaaaaaaaaagcacacctgccctgacgttggtggctgggtctggaagatacgtggaaattaagctaaggatgtgtggcttccagatcaaaaaccgcaaaaatctaacgccgtgactactgactacggtcagagagcacagactggagcaacctctcacggcctgggctgtctgcgcgtgcgtgagccagaaacccgaggggctccctgggcccgccctatcgatcgacccgatcggggatcgtcagcttggttctggccacagaggttgctcttctcgcgatgcttcagacctggcggcagggaaagggtgggctaattggagagccaggaagagcgtgaggcggccccacgctgctttcccagaaggctgtgcgtgctcctcgcttcctccgcggtcttccgagcggtcgcgtgaactgcttcctgcaggctggccatggcgcttcacgttcccaaggctccgggctttgcccagatgctcaaggagggagcgaaagtaagggctgaaggaaaggaatgaggtgggagcgtcagcatagggctgcggcggccgcggcgaagtaggagggcctactaacgggctgagcgtgctgccctggctcagcggccgggggaagagaagattccagaaagggaggtgattttggaagggctcggccaccggagcctgcgggcacttctcttcttccgcgaccgggagaaggccgagggatcggcggcacgatcgacattgtacaccttgaaggtggacggatgtgaagccgcgcgtgcgttttgcctccatccgtaaatggggctaaggcccgtcacccttaaaggaggttgtgagggtgaaattgaataacgtagatgaaattgtcttgagaactgcgacgtcgattatcacatagctcgcgagttgtaggatggggaagaacgagaactagccgatccagagaagagagtgggaaaaagggccgggtcttggttgcttgcttcccagtgagaaacatacggctttcagcttagttgacagaagccatgcgttgtagccaaatgagttccggtcccaacttatgttagctggcttaatctaaaatgtaactttcttgggttttgtttccttcgtctttaaattatggagattggaccaagaggtggtgtctttgagttctgtgtaatctgcaggataagtgatagaggggtgcagataacacttttgtttaatggccttttcttgaacgttagttcggtagcatagttttaaaaaatatcttactgcactattgataaatttgtctcttgtgctattcaaattgcattcctctgtgtgtcctccagattttgttaattcaagaaatagatcagtgtggttgaatttaaggttttatgcgaggtacggggagcattaacagtttaatagaactaggttcatgtttgtaggatgcacttttcaaataatgtcggtatagtaagtaaatgtcagggttcaaggtaaatgttggtggaataatcttttgaaaatgatatgggctgattcccttgaaaaaatcaggctgagataatagcttccaatttgggtttttttcactaatacagttttggaaaactcgtgtatcacaaaacattatttgtcattccagtgctagtagttttttacagaacactgagctatt

SEQ ID NO: 101981 - DNA, 1018 bp, Homo sapiens
tgatgcaatcatagctcactgcagcctcaaccccctgagctcaagcaactctcccacctcagcctcttgaatagctgggacgacaggtgcatgccagcatgcccagttaattaaaaaaatttttttaaagagatggcatcttgctatgttgcccaggctggtctcaaactcctgacctacagcaatccttccacgtcagccgcccaaagtgctggtattacagagtcaatatcagcaataaaggactgctaggaggaaaattgctcgaactcgggaggtggaggttgcagtgagcctagatcacaccattgcactccagcccgggtgacagtgcgagactccatttaaaaaaaaaaaacaaactgctaggatacattgttaaattgggaaatatggtaatatcttatatttataaatacatgagcttggttttccaaggattgttaatgatcgttattttcattaagactttactgaagtggaaattcattttgcaacatgtcttttcccaaacagtctttattttcaagcaagatatattgggccaagtgaatttgacccaagtagttagctctccattttttgatgattctgttgagaatttctttctcattatttcataaagtgtagctgattatgttgcctctagcttggctggcgtaagctagatgcaaagagagacgctaactaaggtattttaaaagacagtttttctttattggagtcgttcagacactgcttaaggtttgaactccaaactgaacttctctctcatctccagaggaggtctccctggatcaagtttgggagaatttgtcttaagaggcgtgatgagaagagttgctgaaactgttattttaaatcatatctgttggatggagaaagagagtcaaacattttctaggattataaactcagcattggctgaatccaatttaaagaatcgcttctggcttatgaccaatgatgtacgagaggtttgttatatttttactgattttttttttcttctccgtgt

SEQ ID NO: 101982 - DNA, 2407 bp, Homo sapiens
ggcggccgaaccccctgcactgccggagctgttgtttacccgcgcgcgccgtactttacccggggcgggcgggggctgggggccgcggggtccctgccccacccccctccctgccctcgggcgccagcccggcccctcgcccgcggcccgcccgggctgtgacacatcagcaccgccctcgcggctggggccccgtattgtcctccgccgcctcccaccgcatgcccagcctcgcgtctactcagcccggtggctgtcgcgcgtggaatcgcgtaagaaaagccgagtttgtggctggggagagaaggccaccgtgctgagctggatttagcgaagactggttttggggaccggagagcccaggactccctttgttggagttttgcccacgcgttgtaattaagcctcgcacaatatggtgagagtgggcgttgattctggagacaccagctttgtgctcgtgtaatgtaacacgagtgccgttgctttctcattcttacacggcagtttcatgtcattgagtagaattgtgcggaatgcttttatggagtgaggcttctgcgttaaacttgtgctgattccaggtaaagtgtagtagtaattgtgaaagaacgtgtatgaggaaaacgagctacaatgtcatgcttggaggaacaaagaatgttttgtaggatgctttgctttttggagaattgtgtaggggtagggactgttacccatggatgatgctatgggaatttgatcatgtatttgaacaccctttacatcagagggtctgcattgaatgcagttcagaaggataaagggtggaaatcccagatgtgttagtggcagagcacttgagcgcttcacatagtcaagcagagaaatgggaagaggtcggcttgcttcttcctggtctttgggtagtggtgcaagggctgggctgggcttgaaggcacttgccacttctgcctttggacatcttgaagaagcttagggaagaaaggctcccggtgagtcagcttggagtagggtgactttggcgtagtgattcttgtattgttgtttaacctatgtttctgtcaagtggtttactgttgttcggtatgttggttggttaacaaggtaggatgactctctaaaaagttgggttgctgagtcattcgccccagcttgagaggtaattagaaacagctggtgcaaatactctcatcacatgcctccactataaaaggccaaagagcgctctagagaggttgcttcagaaggctgaaggggacccagctggggttgttttgatacaggttatcagtgggtgaagtggaagagcactcttaggcagtggccaatagcactgaggcgggtttaaagacggagcctcgtgacctgctgtctgagaataaatttgcgctggagagagctaaaactggggaagaaatttgcagctaggggtaacccaataaaaaatattgtaacaaaaatatttactactcttactggacttagtttcctttttgtggtttctgttacgtggtctataagtttcaagcagtgagcttaatttgtgcgtcataaaaatttggttatgagtacacagaagggacttgctctgtttctcatggcccttggcttttcatgcatacacaagaagtttcaggagtcagaggagggtaagcaccatatgggtggaattaataggtctcattgggttaagtctcgaaagagctgtttaataaatagccaaccgtaaatacctgtctcattgtcttgattatatgacaccactgcctttacacctggtgtcattgcttcttgctttaaaaaggagcacacaacccaaatatttatatgagtcctcattgcaaacaaagtttaggaatgggaaatgtagagctgggaatttggccctttggtgaaaaaaatgatgattcctattaatggtagttcatttaaaatattctgtattaggaaaaacgatttattttgttcctttaagtctgggactagaggagattagaaatcatgaattttgtaagtattagggcctccaaggtggggtgcaaggaggttcatttggaaggaatatattaaaacttttaaaaactttaatataagaaagacattaagcttaaagatgcagactaacaatcgtgtattcatattatataatgcgcgtgcatgtcctccacccctttgttgctgggggaacatagcctgttaaccactgtcagtaacattctttcaacaaccggaatgctttttcttttaacttacggtttcctcctaagagttctttcagactgttaatattccatttaagttttattttataggtagttctattgtctgtatgttttactttagaagcttgagtgtaaatttcttgttacattgttgatactggggatggaaatacaaaaaatac

SEQ ID NO: 101983 - DNA, 1882 bp, Homo sapiens
gagaattgtcttaaccctaaaacctgcattccctgagcattctagacagagggtttattttatgtggtggaacgatgatttttgagattgttttgatttaaaatatatgtcaaatgaggtaatgtaccgatggccaaggtatgggtaatttgagtgcaattcgccagaatccgtgccccttggagggagtaaacatttcaggactgcagctaaaacattgacttacactctcctgaagcccaggcacctggcttacacagtgcactaacataactgaagtctgggtttgatcactgtacagttgacaaagaagcagtaagcagaatggttaaaaagtagttctggagccagactgcttaaggtcaggttctggttgtgtcacccactttaaagccttgggcaagctcttctacctggtaactagtgcctcattgtttcctctgtaaaacaggggtggtgatagtagaatctgtatcagagaggttgttgtgaggattatatgcgttaatacggggtaagtggttagaacagtgccagctttataagaaacatcaagtgttaggtgttattatctgttgttcagaatcagggaagtacttagttacacagtagtgttttatagctgttgagagctgaattgccggcattgatcacaagtgagactggaaaaacaacccggggaacactcttatgttaagtcagtagcaccatctcaaacatacatccaacttctgagggcaacgaacacaggacatagctttttacttaaaggaatcttaacagtctcagcggagtgcttgaggtagtcactaaccagttaattgaaactggcttttacgaaataaaaacacttgccattctttggctagtcttttccacgttgtagttgacattgtggcctggcagctttagtaacctgtccacccctcccttcttgttaataccagaacagaactagtttctcagtacatattcctgggccctatccagtttgttggaaacatttagaatgtaaatttgtaagctaattagtttcttctaagtattatgttttctttagatgatatgcctgtactaatacagaaaaattatccatgaaatggatatgaatacaatggacatatttatcgtatagctttttgtacctgttagtaattcagaaaggttgtgttattttgaccattctttcagccagattgtaagtttcctgatggtgagaatctgtgtctttctgttttatctcctatggcactctgaatgtgccttggctgtgtttctttaataaactgttggttgctgaactgggtggtatgatatgcgttcattctagttctgtgattttgaaacttgggaatgtttaacagattgaaggagagaacatcgtgtgtggtaccttgtaagtgtgcactgagttgaaattcttttgattatttagctttctactttctgtttttatcattggtgtgattattgagaaggcagctggaattaagtaattctagttcatctcctaagatagacataaaacttgtcttgtgacttatttttacccataattggattagaattgaattgagcaaaatataatttggttttctagatgttaaatgtcttatatgtctaatactttgaatatcactcctctagaacaggttctttgttttatttaggatcagggacaggttagaaaatattcaaatattcataggataataaaaaactgccctgaagcaaacgtgaggaagaagaaatagtggtagccagaatcttggttgttaatgaccagtgtagaaacacagtgggcatgcagtgaaattggctggcagctggttccttctcagtacgggcacaatttagaaaatgttacattaatgcagctgaa

SEQ ID NO: 101984 - DNA, 1058 bp, Homo sapiens
aaggttttcaattcctttgtagcctggacattagtaatagcctacctctaaggctgtagagtaaatagtatagtaagggaaatgtccctccctccccctacacaccttttttccagttatctcttctttttattgatttgtctgcctccaggaccctagggaggtgtttttgtcctaaggaggtgaactcctgagggtcctattgaagaaatagggcgacctatccacccaacttcctctttactgatatcttcacatgcttattgccttattcattttctaaagtgtgccagcgtctttcagaagtcagctaaattagtgcagttgctcatccatcagacagttttgttataaaatatgtggctataaaagattgaataaatttattaggttgtaatttcattaatgtgtattttatatttaaatattattttaaaaaatgtacagtggttatctgatcttggcccaggcctcttcaatttccagtgtacctgatgtctctttatcaactgtttttctgaggtgtatctcagcctggccttgggtactcccctaggtaagagtcataattcaggttaaaagaggtaagaaaaaaaaaagcttttggcttttgtaatcttgtttttttttttttctttcacattagcaaaagactgttgaagtagagagcattttgcccagctcactcggattctttgctggcatgccttcagtttcagttgtcatccagagaagtcaaaggaaatgctgcttggggatgagcatgtaattacgattaactttccctacttcgttgtctctttgtggtaaaagactgtcacaagtgctattcaaactataggtatttttttttagatttctaaaaagtatattttgtctctgagggcctcctgtctttggactagtttgtctttttccagaccccagaaaggctgggccaccttttcttctttgagcaggttggcaacagtggtcacaaatagcagaggagctgagattctagagagctatcctaccactgcttctcagatgccagtgtggaaacagcctcttctttt

SEQ ID NO: 101985 - DNA, 1326 bp, Homo sapiens
taagaatatagaaaaatgcaggcgtaacacaggagtccaaatttagtattaagttaatagaattttagattctggaaggctggagtgtttttaggtttgagaaatgttagaaggtgcatgatggatgttagaggacatgaaggtgccgttcttgtctgatgtagttgttacgtagttattgggtaaaaatggattgctgaccacttagatggtttccaggattaggagaaatgattttcagaacacttctgtagtgcctcatgctaatgaaagcaaaaggcaaggtgttttcatgactgtaggtcatatatattggccatgtttatagttgccagtccttgctcttttttggcctgttgttgcaggtatgtctttgacttccagagggatgagctggcctcttttttgtccctcaagtcgctggaaaagctgtccaagaaattttctctgaatgcttggctcagtggcattgttccacatatgttggaataggtgactaggctgtgtttggaagaagatctagattggggtccccaacctccgggttgcacagcaggaggtgagtggctgtccagtgagcattactgcttgagctccacctcctgtcagatcagcagtagcattagattctcacaggagtgtgaaccctatggtaaactgtgcatgcaagggatataggttgcgcagtccttatgagactctaatgcctgatggtctgaaacagtttcatcctaaaaccattgcacccgcccatgtggggaaaatttgtcttccatgaaacccatccctggtgccaaaaagttggagactgctgatctagatgatctctgttttgtttctgtattaaaaataagaaattactaattcagcagcatgtacctgtgttggaccaggtccaacaggtatgcttgggttatggcagggaacaaatcagacaaagttgtgacatttaaacagagaactaaaaggtgaggcattagctggctgaagagtagaagtccagatagtggccacagtgtatgtggaggccctgaaatcagtaggagcttggggcctgtggagcaggaaggaagagacagtgaggctagagaatagcaagaaaggggggcaatggcttgagataagtctggattaatggatggaaaacccaactacataggacttgaggacgtgttaaggattttgaagtgatatgccatttatttggaagatgacgtagggtttttgttaggaagagaatacattggagggggtcaagaggggctttaggggtataaggcttttgttaatattatcaccactaataacagctaatattatttgttg

SEQ ID NO: 101986 - DNA, 1111 bp, Homo sapiens
atggactttattctttgtctcttttacacacatatgaccaatatggtgacttgaattttgctggtatgcaaaacacaacagtgttaacagaaaagcctttgtcaggtacagacgtccaagaaaaaacatttggtgaaagtcaggatttacctttgaaatccgacttgggcaccagggaagatagtagtgttgcatctagtgataggagtagtgtggagcgagaagtggcagaacacctagcaaaaggcttctggagtgacatttgcagcacggacactccttgccaaatgcagttatcacctgctgtggccaaagatggctcagaacagatctcacagaaacggtctgagtgtccgtggttaggtatcaggattagtgagagcccagaaccaggtcaaaggactttcacaacattaagttctgtcaactgcccttttataagtactctgagtactgaaggctgttcaagcaatttggaaattggaaacgatgattatgtttcagaaccccagcaagaaccttgcccatatgcttgtgtcattagcttgggagacgactctgagacggacaccgaaggagacagtgaatcctgttcagccagagaacaagaatgtgaggtgagcaggaatatgttcttaattcattgttttaataaccattaattgggatttactgtggatcagctccctttgcatcattagggatataatcaggttcagggagtggggaggaaactcatacaaaattaattgtaagactgtgtgatagggctgggcgcagtggcccacaactgttaattccagcactttgagaagccgaggtgtgggtggatcacctgaagtcagaagtttgagatcagcctggccaacatggcgaatctccgtctctacaaaaattagctgggtgtggtggtgggtgcctgtaatcccagctactcgagaggctgaggcaggagaagcgcttgaatgtgggaggcggaggttgcagtgagccaggtttgcaccactgcactccagcctaggagacagagcaagactgtctcaaaaaattttttaaaaacactgtgtgataaataccaaaagagagagatgaagtttgaaggacttctgtt

SEQ ID NO: 101987 - DNA, 2024 bp, Homo sapiens
aaaaatacaaaaattagccaggcatggtggcatgtgccagtagtcccagctacttaggaagctgaggtgagaggatcgcttgagcctaggaggttgaggctgcagtaagccatgattgtgccaccgtactcctgcatgacagagaccctgtctccaaaaaaatatgtgtagatcagtgcagatatccttttgagattgtatagaaattgggatagaggcctatgttttctttaatgtaaaataagttctctgaaaaacttagatgtataccttcatcttcctaggtttgactataattataaaatacagcaataattagtaatatttatttcatattctaggtaaaactgccattcaatgcacaacggataatttcactgtctcgaaatgattttcagtccttgttgaaaatgcacaagcttactccagaacagctggattgtatccatgatattcgaagaagaagtaaaaacagaattgctgcacagcgctgtcgcaagagaaaacttgactgtatacagaatcttgaatcagaaattgagaagctggtaagtgtaaaagtttcttgttactatttaaattccaccactttcttttttgtcaaggaaatagtttttaaatttctaggtcagatataatgctcaattacttattttaatatgtatcaattaccattttatcatttttaccatgatatgctgtgatatgtaagtgctttttaaaaagaaggttttcaaattaagaatgactttactgtctacctaatcattagtggttgtgaatagattcaagaaattataaagcactttaggttctctgttttgtgtctatagaagttaatattccaggtgttcatttaaatgaactgtggacctgaataacttgttttggttgataccaaaaccagaccaaccaggatctttcatctaaggaaaaaaattctgatagatatggtgatatgaattgaaaatattaatatctaatgggatcctaagtgagaacaatgcttgcttttgaatcttttctttttcttttttgagatggagtcttgctttgtcgcccaggctggagtgcagtggtgcgatctcggctcactgcaagctctgcctgctgggttcatgccattctcctgcctcagcctccggagtagctgggactacaggcgcctgccactgcgcctggctaattttttttttaatttattttttgtatttttagtagagatggggtttcactgtgtgagccaggatggtctcgatctcctgacctcgtgatctgcctgtctcggcctcccaaagggatttcaggcatgagccaccgtgcctggcctgaatcttattttctattccagcatcaagacacaaattaactgaaaattgattagtttactcctctttcttttttccgttggtggaaggaagcattgtatgaaagaggacaactctgatagtacaggccagctaaagctaagatatggtaaaagatagcaaggaaacagcctagaagtagtaaaaacattgcttgaatattcaattttgtgtctattaattgttgaaagtttaaaagttgggattgtggcaagttttcaagcgtgaacattctagctatgaatggcaattaaacagcaacaatttagggaaaaaaattgtgcctccaggagaagttgaaaaataaaaaattattatttatatattgtacatatactttgtgtaaaaagataaaaaatcataactatattaaagagatgaagcataactaaataaaaaatagaggaactagatgttttacaaatagaggcatgagagatgttaaaaaaaaaaacaaaaaacccaaacaccgacatgatattgctgaatagttaaaattgttaaaaccaaggaggaaaagttttcaattctatagtacttagtacttttagagtgtgtatcagtaatacctttaataaacactggtgttctttcttattcagttttgaattaaacccttacctgcctttagaaggagtatagcattttgagcttcag

SEQ ID NO: 101988 - DNA, 1257 bp, Homo sapiens
cataaaaagaaatgggtgttgattgcatttaatggttcctactgtgaacaagcagtaggtaccgttcttgccctttcagtatctgcagactcattttatcagaagagtgcaactgataaactttgcataagagaaaatgtactggccaaacattgattttgcttacatacacatacttaacacgcacattcttgacctacatctatttaaaaaaaaaaaaaaaaagaacttgtatataaaaatctgaacagattggagaatactttgccatataaaaatttagtattttgtatttattgtatattttctcaaaatattacaaggctttaaaatattttagaaataacaataattggattcatacataattttatagtaatacttttgtataaaaccataacaatacttttgtataaagcaaaattcgttttacccttttagtgacttttatgtcataaaagactaaaggatggcacttatagattagcactatgaactaacttgtctcaaggttaactggcagcctcaactctccagaacctgtcaatgaacagaaagcaaacagaacaacactgacttgttgagagttgtgataaatttcataagaaaaacgtttgactttctagcaagtgtttatttactcttttcttataaataccttgattatttggtttcctggctcataatagattagaagcaataagatgttagaacaagaaggatgaaatgggatgataatagaaaagacatgctgtcagcagtgataagtgacatggacaggaaggcaggaaccagaaaaacttttgaaaaattctgtggtagactttcttataggggtaatatcttaaaattataataataacaaaaatggtaattagcaagcacaaaattacccccccgaattcttcacactttagtaactcacccaccggctgtctctaggcatcttaaattcagtcccatcccttcagtgggtttgatgttgcttaaatcaagagaggtgttgtgtggattacatagctgagattgcatgttggaaaacatttagcacaatatctgtcagagaatctgctcaacaaatgctggtcattagttgaatcttgcaatgctttgagtctcagtaattaagttatgctaactgtacttttactttttttcttgtatcccatccaaaatgccatccatacctgttatgtacagtctgtaaatccagaaagctccaaaaaccgtatgtttgtcacaaactcttttgaccga

SEQ ID NO: 101989 - DNA, 2632 bp, Homo sapiens
tcagatttctgtcagcagatgactgataaatgtactactgatgagtaaacttgcattcacttccttcaaaccatctaattttctcctgaagttttggcagcgtcttgaaagcctaatatgaccatctgttgctcaacaatactgtttttttcctttagtagtttaccataagggaatttcctttaagtcaaccatgatttctccttgatttctacaagagacaaagaaatgattttgcctcctggatatcagaaaaatccatgtgaaaatgtagtaaacctttaaaactcatgttttaaagaataataactctagtaataactcttcctgctattcagaataagtaggagaatgaaaactgcagcatatcagacagcaatttaacagcttgaaacatctacagatagttcctactaaaagaagtggcctgcagaagtttaataatttgacttttttctaatattttagtttgaaagaaaatttcttcccaagcaatgctaatagagttctattcttagaagcagggtgtcagctactgggaatatttttgtagagctgcattgtgaaaaaaagatggtcttacctgaatcttagggctttgttcttcggctcctaaaatcaggctttaagctacattgggaagatttagtaaataggcaagtggttggcctaagacgggggctgcttctcctcttcagtatggactctagaaagtctggctacatgaatagatttaagtgtcactttccctccctgccccccgcttcagtctctaccatatctggtcccatcatggacttcctatttcctggcatttttgtccctttggaagaagaaataggactcagaatacagtggcatgagtgattacactggcagcattatctcaggctccctagaatctggagagcttaccaacatgtaaagctgttcatttttccaccgtgggtcaccaatgccagaaaaccagacatcacggggaaagaatgttgcttactttttaccaggagtgcagttcatttttttcaccctgtttttgaagtcgtattattcacttgtaaaaatgattgtaacagataaaaaatgtatctgcagcaactctgcaggtttgtgaaataggatgaaactcaatctttttctattgtgggtttgcatttgaaaagcaggttgaatccttgctctcttctccaaatttggtgtggtataaagacacacaaatcattttaacttggacatttaaagatcagtcttagtgtttgttcagtcctgttacaaaatagataactgagcacctatcgcataacattttgcggtggcttttagccatgctggggttagatgtgtttgagagtcaaatgaaagctatggatcttctcagcaattaaaaaaaatgcatatattcacattcacagaaacattggcagaacccagttttaatggtacagaggagtagtttatagtgttgatttcaccaaaatcagagggctgaaagagacacttctatagactgcatcctgagcctagtgcagggcttgtctagctaatgtgggcagccaccacccactgtgtatgaacaagtctgaagcaagttggccttgcccttgagagtatatggggaccagtcttcatgtcttggagtaatttgtcaaatgttaccctttttgatcagggtgtagggggaggatattgctagtatattttcagtggtttgtatgttctctctgtcactgacttatttgtaagagaaaattagttggacttgtttattttctagtagcttttataagtacactcaagaatttgtcagggagaataattctgatagtgcatcccatactgcaaaagaatttgtgtgtgtgtgtgtgtgtgtgtgtgtgtgtgtgtatgtgtatgtatacatatatatctctccatataggtatttctttgatacttgtaattttaaatttcagcttcacgatataaaataatataagaacttctggtttacaaaatgtaaaatcttaagccaatggaacccttgatttcctacctcagtgtacacccaactattggttgtatcagtttgtgtatgtgcaaatgtcaaataatcttttgctttaattgctactgtacttgctttgaaagattacctactattttatgataaaatgtagttgtctccagagcttaaatataatttgtaaagcacttggtttaaatttctctctacctataaacagtttagcattaagggtttctattaatgacacagaattattggccaagtgtaatttcttaaaatttagcattactttaaatagccagcatgtaatacaagtaactacactacctcatatctacatgattttcaagttgtaatgcagatggacagataaaaaagattttacgtttgtcttttggccataagtgggaaagttttctgtatattgcatagcattacacatttatgcctattttaacattaacttctaaagaagttttttctaagaaaatgtttcaaggcaatattttttttgaggctgccgaagacaaatgacaggattatgagtatacagtgtatgccttttccttcatgcagaattttgaaatgttttcagtttgtatattgcatattcacatgatcattgtt

SEQ ID NO: 101990 - DNA, 1043 bp, Homo sapiens
attttttaaaagctgttatgttgaattcagtaaaataacattaccttattttttttcttattcaaattctggaactatagcaaataattcgttaaattgtcatattcaaaacaaatgtggatacagtcttggttctccatctgtaattttttttaacagtttgctatagcttactgcttaactaattttaaataaggaaataagtatgttagatgcagtagacgatacaggttgcatgtggacactcagtcacattaacaacttgggaaaaaaatggcaatgttacggtgaattctcaggtgaacttttttcagttataaaacatctattttgaatctgtaaatattttaaatgttttattaaggcatgtaataaactattctttgaaacttgttgggtagaatgaaaattaaagccataatggtagaagatggcatactgattataaaagaagcagaaaaacattgatttttttatatctttcataatataattttctaacaatgcaataaaaccactaaacttttgtgtccatattttactgagaccatgtttcattaaaagcatagtttcatagtatttaatttacatttctccctaatgttcttacccaaatgtacctgaactaaaaaatgttagatgttggtgataagttgacagttaaataaaattctctaaaattgcttctaattgaatagaattgtacattccattttcattttctcacttcatgtggatttactcagtttagtcttttgatcggtaattagtatatctgaatttgtaggagagaatctttccttagttgatgataatcatgcctcaaaaaaaaaaaaattccagcattcaggtgttttaggaagcacagattttagctttgcttctgattttacttaatgttagtttggatagagaagtatagggactcttaaggggtattatctctatcagtcattaagttttaaaaacttatctgccgagtcagctctttgtatcctattcaatttccaaccaggcccttctgaccaagctttgggcagctg

SEQ ID NO: 101991 - DNA, 1024 bp, Homo sapiens
tgactttgggctgacaatttagcatttaaccactgtctccgcaccagttccacaagagcagggatttagattaattggaaaaacctcattggtttctgatggagggggcattcatagaaacaacctactgacaactaaggagctactgcgatgggatgggcagcctgcagcttcactcggtgggcagcctccacaggtactttaattcctcgctcttctggccaggcatctcttggtaaaggcaggtagaggaagcaaagcaattacctagataattaaggaaaaacaaacctgtatgtggcaggtaacttggggagctgcttctgattttctaggcaactattttcattcttcacttctctggtgtcagcaggaatctgagctagatcccaagagcaactcgaacaattacaatgctctcagttggcaaacccggcttcatagcaacttccctcctcattgatctagagtttgaaatagctttgtcagatctcgggtgtgttcctgctgatttatggcaaaatcccagtaacagctgtgaaaatgtttgtccatttgtgaaacttcagaaagcgggtctagcaaatcattctcacctggtgattctggggcaaggtgagaactgtaccctcacaggccgggtgaataagattctagttgcggtggaggccaaggaagaagatgtactatgagtcaatctctctatgaggcattgctgaaccttcccctcctacaccttcctacaaggcaggtccgatgacttttactttacagatgagaagatggagcctccacaaggcacatagctggtgagtgacaaaaccagaattcaaacccagatccatttgatagtgacatttgtttccactaccctagtggctctgggggaagccaggacacccatatttttgtaaagtcccgtagttgtttctagtgtcatccgggttggaaactgtatattaagtcagtggttctcaaactttagcatgcattagtatcccctgttaggcttgtaaaaacacag

SEQ ID NO: 101992 - DNA, 1080 bp, Homo sapiens
ctgccagtctcaggaccacactttcagatccgctgctattgtgccatctataagttaatatgaattccacagcacacttgtatgtgtgtgcctgtgtgtgtgtgtatgtgtgtgtgtgtgtgtaggcagtgttggtggtggtaggaataggggtatggtttgaccaggtaggacctggacatagaaaaggttgcaggtatagatcattgtgagaaggccacggaggtcctgaaggatcccaggtcccaaaggcataaggatgaagggaagagagaaagaaaaaccgacatgttcctgacagctggatgcttctcccatttagatttctctgaactgaaattctagatggtttaattactccataaggtttgctaaattgccacgtctcagcctcacatacaatgctggtatctacattctatgctctcagactatgtattaaaactgtgcactggtggagtaagctagttaaatatttgtacatttgactgcacacagctactgcttatgttttcttgttcttctgctctatcttaaggaatctgtatgagtcagccagttaaaatgctggctgggaggtaattagctgggaattttaaccccatcatagtcattcacctgcttgaagaatgaagtggatgggtactttagtgagtctagcaactgtttctttctctgccaaatgcaagaagttcttcgtgagttgctggatggctcaaattatattctggagcttatcctggaaacaggcaaatgtcagtccaatggaacatcagcgcacattgatatataaaattgcaggtgatgaaaggctctgaaagaactctatgagtctctggtcttaacgctctcttagattttgatggtacattgtctttttcatttcaactctgttttaaattttttattatgtaaatttttagacatacccagaattagagagaatagcataataaaacttgatggtaccattaattcagtctcaataattgtcaatattttgtcaattgtgttttagtcagtccccactcttggtttccttgtggcctgatctctatctggcagctattaactccaatt

SEQ ID NO: 101993 - DNA, 1049 bp, Homo sapiens
ccattcagcatacatttatggagtgcctactgcgtacttgggatgaaacttgcttttgacaatgctctaggatttctcatgttgagaagtctgtgcctttcaggaaattacctcataacgatgggaatggcaaaccagtgccctgagagagtaaatgcaccttcaggaagtaattttctcacctcacccacaagacatttcaaataatggtaatcatgagcactttcctaacactgaattcataattccatctgtgtcatataatcatggcaaccatggggatccttttcttcttttacagatggaacaaagggaaagcacctcttattccagtaaattcaaaagctgaacttatctaagctatatacatatgtgtgtatatatatccacacatatacatatacacatacatatacacatatacacaatacatagacatatatactatttattaatatatactatatacacacacacataacagtcagtttccaatttacaaatgggttaaactccaaaattgatatggtaagtatttcattaaactctaaaacccacttttttatcaaaaattctaacgtacaaaaattatgttgttaaatcagcatataaagcaaacattcttatttgcacctgcagtcctctccatcaatacatgtgtaaatatttgttatatttatagtatcatgaatacataggcccacagaaagctcatattcagaaattagtttatttaagagttttctgcttaaaatatttcaacaaatatatgcaaatttcatcttggttcttcctctctacagtaatctccatcctctcctttatcaggccctccaactccttagtagtcagcatttctctagggctttcaactgcttttactagactattagaaagccatcattgaccaattgcctgcccaccttaagaataaattttccttctttgccaaggctgagaatccagtaaaagtcttgaggcttgcttttcatacagttcaacatcatgcgtggactatttcaggcccattgaactacctaaactatact

SEQ ID NO: 101994 - DNA, 1018 bp, Homo sapiens
aaatggcttttccacctgagtttgtatttcgattatttgggccggatatgcttggtgagctgggacttctcccactcctgtcctcctttctctgttcacactcagttttttgttttgttttgagatggagtctcgctctgtcgccaggctggagtgcaatggggcgatctcggctcactgcaaccgctgccacccaggttcaagcgattcccctgcctcagcctcccgagtagctgggactacaggcatgtgccaccacgcccggctaatttttttgtagagacagggtttcaccatgttggccaggatggtctcgatctcctgacctcgtgatccacccgcctcaacctcccagagtgctgggattacaggcacactcagttttactgttagtctttagggtattgggtgtttctggtgacaggagttgagcatccatgaactccccttcaaagtttcagagattttaaatattcccttacctcatacatgctgtctgatgtcttgcctccagatttaaatgaaggttgagttttttatgatattgatgaaatcagttttatatgacagacatggccattttgaggaataaggatttattgacttttttttttttaaggtttgaatagactcaatagttggaccagtgatgtcacaggactaggtctcaagtgaccataatcttacaattcactcctaaactccaggagatgggaaagtggtaattgctccaggaatagagttgtttagtttggggaatggacagaaagtcaaggtagggacggagtgtcattcacttgaaacaaatcttgataccttttactaagagcccttgcataaaagatgtgtttttgtggaaaactagggaaacagacaatgactggcaggtctcgtattaacctttcaagtctcagggagtttctcgccaccagctggagtaaggtgcatcagacccaatagagcaatgatccttgaaccaaaatgtgactttccaagggttcaagggtgcagatggttt

SEQ ID NO: 101995 - DNA, 1037 bp, Homo sapiens
ccaaatactaagaagaaaaacaagttatagcactttcaattttttttttttttttaaaaaaaggtttatagctttttcttttcccatgtcacaatgtccacttcctaagaagggtttaaaatactatgaaaactttctttttggggaaaatatctatttggtgtttgacacatcagtaggtactttaaagacctgaattttatagtagctttaggagttatattttataaaaatcagttatgactttatatttccagacaatagagagttcagtacatcatgctcttgtgcctctgcctgcttttcctgcgttcccaccctgtattccccccgcctttcgggtttccagggcttcgagcttgatcttttgaaagttttattctattaaatttttgctatatcttctggttttctgaaaaagctttagaatggtttctataccctttgtatcactgcatttttccatatcatctccggttcgatcgcgtccagatggaaaacggaagcagaggcttctaatcgtcgcatttactggctccagtgcaacacatccatctgaaaacactcggaagtctggtgcttggagagggtgccattgtctcttgtacataaggtcatgacgtgtctatgtcaaaagttcttatatatttcttttataagctgaaagaaggtctatttttatgtttttaggtctatgaatggaacgttgtaaatgcttgtcaaacaataaaaataacgaaaagtgtctgggcggttctatgcctttttggatgggaggatgagtatgaattgttggcgggagagcggccgtgggagaagattcctgggaatgccatttattgaaataactcgtgatcatcaggagaacgctgttgtagcgcttgaagttttaacaacaacaaaaggtgcattacagttgcatggcatcttgacctaacgttgcccctactgggcactgtttcttttccagtctcctgcctatcccgatgggagcaggctgggggggttcctgtgaaaatattggggtgaagtgcaga

SEQ ID NO: 101996 - DNA, 1581 bp, Homo sapiens
gtgtgtgtgcagtgtctgccccaagcaagtctcttgggaggaggaggcggcggctggctcgaaacaggtttaccattgattctgatgccgtctccgcaagcagcccggagaaagagtcccagcagccccccggtggtggggacactgaccgatgggtagaggagcagtttgatcttgctcagtatgaggagcaagatgacatcaaggagacagacatcctcagtgacgatgatgagttctgtgagtccgtgaagggtgcctcagtggacagagacctgcaggagcggcttcaggccacctccatcagtcagcgggaaagaggccggaaaaccctggatagtcacgcgtcccgcatggcacagctcaagaagcaagctgccctgtcggggatcaatggaggcctggagagcgcaagcgaggaagtcatttgggttaggcgtgaagactttgccccctccaggaaactgaacactgagatctgactgcgtcacctgccccgtagagaatgtgtgtagatacttcctgccctaactctgcccaccctcctgtaccgtcgacaagaatgtccccttaggtcgcgctcttgcacacacggttttggcagctgacttggttctgaagccatgtagccacccaactttgtcattttcaacaacatcagaaagaattgatcagaatcccaaataagcttgagtcctatcttctgtatattactaagggcttttatttattctcaataaatcagggcctgaacaattaaaagaaaaaagattctatagcactggaaagcaaatcaccccaggagttaacggatgtacaacagattaatttaagggatagtagcacacacacgatccttctatctgaaatcagtctcctagctggggaaacctctttcacacacaaaatgaaatgtgtacagcttgccgtgttctgactgtacccttccctcttccatgtctgagaatctccgtgtattttaagaatgtgtgaggagagggtggcgattcatgtttcaatgagcctctttttttttttccttcctgttttggtctatggctggtcttactctgtgtccatgttcggaagctctagttttgcatagaattatagagatgccaaactctttgaaaagagatccaaatttatcgcttgagagaaagaaaagaaacactattttttgtattttacctgagatacaggggcacaaatagatgagaattttacagtgttagtgtatgtatccctgagcctaaaaaatgaggatataaccttttacagagagagtgaggcgtggtggttttatatttatatatgaaaggccagcaagctcatgcgaaggatatacttttcttccaaaaagcggattttttttttttaatgtttgaatctatatttgagatgggagtttggttggattaaacatgacaccccggtgggcggtgtgtgtgtctgttgcacatggcagggaggggagcctccttctcatggggttgccatggtgatcattggtttttccatcaaaattgcatcttcatccatagattaccttccccttccctgacagtccataaccaaacc

SEQ ID NO: 101997 - DNA, 1190 bp, Homo sapiens
catccctgaaagactgggaagaacccaataatggtagccgggttcttaagcatactaggaacagatactcatgcttcattttgctttgtcttgaatactcaggtagtttatttctccctctgttctgtttggctaggatagtaaagccaaatactctgcttccatattcagcctaaagtactatacgtttgccaataacccaattaaaaatttttttctttgttctatctattttcttatgaaaatgtttaaacttatagaagagctgaaagaattcatacctaccatctatattctataatgtttttctatattctcattatcactcatctgttagaatccatctgtcatccatcacctcatcttatttttgacatatttcaaagatgtagacattaacacactttactcctagatacttcagcatgcaaatcattaacaaatatttccagtagctttgagttggggtagttctaatgtggtgattggagagagggatgctgtattttgctggtgctgagataaaagtgaacaagaatttttgtctcttctcaatagaagtcagagtttgtttgttttttttcctattttctattccctttttccattttgcctggaaatggcttttattcccatcctcaaccaacagtagtgtccatttgttccacagttttagatggcggaacactcaggaatagtgatggacacgcaggggtctgaagcagaggatggctgccatgagagccaattcagcccctcgttgaccactctaaccctgtgcctgctgggttcgaagtcaaggctgcatttggcagtaattgagacacgaggcatcttctagcagcactgaagcaattggatggttctggggcttaggtttcaggaaagcagctcccagttggcgttgagactcttcccctccactggaaagcccgtgttgcatttcaccttttcgtgtctaatgcaacaaccgcttcactctcgagggagaagcagaagccttccctgtgagcagtctcgtgtatgtgtgtggtgggattgttggcttgatcggatggtgtcttttgtttgcttgtttttaattctggcttcctagagggcagtaggtgaaagaatgaatttttcttaactggtagtcactttatacagcactttgttgatcaaactgcttggatgtcatcggtttttta

SEQ ID NO: 101998 - DNA, 1134 bp, Homo sapiens
atcgtgtctagatggctctgcaaccagcacttgtctgtcggagacagtttagcgtgtgaccgctgggggtgagcgactaaacctcatggtctcttgggattccagcattcacgctgcctgtgccaatagaggaatcttcaaactctttattggcttctctctccctcatctaaagtgaaataaagtcgtctttgaaatggattggaagaagaaataatttgcctacatttcccaaaagtggatattcactggtggaaatgtctgcagttatctgggggtggatctttgtcatggacggccattagcatctccttgggaaactgtctctgaacacaaaacatctccagttttgtagatcagttttgacagactaactgcatgtgaatttcagagccccagtttgtacctatttgccatccttttctgaaattctagtagacaagcatggaataaatggggaaaaaaaagatgagccttttctctcccctgtattccatgtgtttctttgggaatggagaggatttatttttcaattaggagatttcatatgaattaaaggattttttttttcgttaaaatttcattgtattgttcctagctcaaacttggctagaacataatgatactattatttcccattggaaaggttaactggatattgtatcttcagcctgttttgatgggaggtggtgtttattgagacagtcacaaatcgaaaatatttttaaaaaatgtagtctgtcattttggtgcgatttcttttctcaaaaacatgaaattgacaagtaaaaattttatatatttatggtgtacaacatgatgttttgatatgttacattgtggaatggctaaatccagcagtttaacttagcattatctcacatatttaagcaaatgtttttaggagcagtattttcttgaagtaaaattaatatcagcatgctgaattttcaaacatcatgaaaatctgagtattgataacaccacccagtaagctttgtcacgtctctggctttcaggttgcagatctgagcatgggagacctgcttttgcacactaccgtgatctggctgaacccgccggcctcgctgggcaagtggaaaaaggaaccagagttggcagcattcggtgtgt

SEQ ID NO: 101999 - DNA, 1049 bp, Homo sapiens
atagatctgactgcctgtggtctccctgactgccccctcccctacctgtccctcttcctgccacccactctctgctcagtcctgcaaaaaggcaccttggagtcactgaggaagggagggaaattgtgggaagggagtcacgtgggcgttccacccccatgacctgtgtttaaaccctgccagccaagacagacacggctttcaaggcattcttggatgcccagaacccgaagcagcagcactcatccacgctggagtcgtacctcatcaagcccatccagaggatcctcaagtacccacttctgctcagggagctgttcgccctgaccgatgcggagagcgaggagcactaccacctggacggtaggcctcggcctgggacccccggcaggcctgagtctccatgagggtctctaaatagcctctcatttcacaacctgttttcttccagtggccatcaagaccatgaacaaggttgccagtcacatcaatgagatgcagaaaatccatgaagagtttggggctgtgtttgaccagctgattgctgaacagactggtgagaaaaaagaggtgagggtccccatcttctcaggacatctgtcaggaaagccgagtttgagtttgcttttatttatttatttattttttaaaaaggtgttacttgtaagtaaaatagttaggatgctgttgtttttcttagtggaacatctgtgctttatccaaggctgcaatgtgaattttcttcctcagctggactatttcttcctgtaggaaatgttttcctgatgttcagctcctcaccctggggatctctggctttattctgtgttaagtgtgaaagtgaacttccattaccacaatctgggctgtttctagaaatgtcatgaaagtccaaggctctacctccagagattagaatgacaccaggcacatagtgggtgcccaaaaaatagttgtcaaaggaatgaaaatttcaaatgactctgaatcagttaaatctacccaaaaacctacttagaagagcagtggcaggaacagatacacctgag

SEQ ID NO: 102000 - DNA, 1551 bp, Homo sapiens
tctccattccatctgtaaggtgagatggctcatgaacactagtgtgcctgcctgcaggattctctccaggctctctgagttggtttccagatttgctcccaaacctgttgctgctgatttccacaattgctgctctttttaaactcctcattgtatatttgaccaaaaaaaaaagaaaaagaaaaacttgttaaaatcttcaaactgtgttgcatagagcactagtctcaaggtagtatcagaaggaaataattagttctgatgtcaaataagttttgataaaattttcatttggaaatttgcaatgtacgtcagcctgtgagaagcgttctgaagtcctacagaacagaaacattggggaagtggagtctttgtgtataaaccctcatatttgtgtgcacattgttccctgagaatcaatttttaaggcgggaggaataagtgaataccttagtgtttcatctgtggttatggtagggtaaataaacagtaaatattaagttaaataaatgaatggctttaggatggctaaagggaggggttacatttagcacattttcttccacaactttttttgcttaattcttgggtatgactctgtattagttcattttcacattgctatgaagaaatacctgagattgggtaatttgtaaagaaaaagaggtttaatggactcacagtccctcatggctggggaggcctcaggaggagcaaagtcacatcttacatggcggcaggcaagagagcgtgtgcaggggaaccgccctttataaaaaccatcagatctcctgagacttattcgctatcatgagaacagcacaggaaaaacctgcctccattattcagttacctctcacaacatatggggattatgggagctacaattcaaggtgagatttgagtgaggacacagccaaaccatatcaggctccaaggataactccctcacagagtccgatggcagtacccagggtactcctgctgacaccctccaagccagggtggagatttgcggagggcttggaaagtaaaggaggaaaaggagaacacgtaagaagagtagtgaggcatctaattaccaattatgtatggtttaaaataaaccttttttttttttttttttttttttggtcatggacagactcagaatcctctgcattgttcattagataaattgcactttggggaacctagtttgttactcaaattcaaaaccttatttctttgcttgaaccctgccttttaattctaagcctcaataagctaaataaggtccctctctaaacaagactctttcagtgtgaaacagaaggtgtttttctgaggccatatatatatatatatattttaatataatatattaatataatatattaattatatattatatatttttatatattatatattttatatattatataaaatatatattttatagaatatatatttatatatatctatatattatatatttacatataacatatctctatatataatgtgtgggatacaaagtatcttctcaggcatagtaaaatcttaatg

SEQ ID NO: 102001 - DNA, 1047 bp, Homo sapiens
tgttataatgagttttctattacagttatcactggatcatctaaaagacacatgaagattttttgctaaaatggatgtatttgttcctttgtaatttttaagacaaagccctacttgactgtatatttaatgatgattttgagttagtgaaattctagctaactaaataaaattgtttagtttatttctactgaaacaagctttgatgaaaaacacagtttttcttttctaacagccttgttgagatataatttacataccatagagctgagcccattttggtcaatttttccagtcagtcacctaagggaaaattgtttgtggggttactcagtgtcagaaacatgcatttccacagaaaacattgaatagtgccactgacaggtgactgacaccttctggcatataagaccagggttagtgctagcaatgaataagctgtggtaattgtaagagaattagaataataattatgtggatgtgggtcctggctctcctctgtcctgtcatgccactgcagctaatgcatccttcttaggttctgattttccctgtccttgcctcatctttattccagacttccttcccttttggatatgctaatgagggaaaggctcttcagtgttggctgccttcctctgtgtttaaaactcctccatggcatacacttgattttagcttttctgacctacacaaaacagcagccttgacttttagctctgtgcaccaacgattgtttttgggagggtattctcatgttcttgctaggtaggtggatgatagaagaagttattctttatttgcaccggtatttactggaaatgctttgtgcctagagttgaattagacaatagaagcagagagagaagcgtgagaaggacagccactagcttcaagaaaatttccggggccgggcgcggtggctcacgcctgtaatcccagcactttgggaggccaaggcgggtggatcacaaggtcagattgagaccatcctggccaacatgttgaaatcccgtctctcctaaaaatacaaaaaaatagccgggc

SEQ ID NO: 102002 - DNA, 1047 bp, Homo sapiens
gagcgtgttgagaagctcccattgaggcgacctttcttggcacttgtggctacagcgcttggtgtgggaatgactaggatgccatctgtaacactcagtggtggagcggggcaaagccttgaacccaactcctcctatattccacatcatggctaagctgcgtggagaagggcctgatggattttgatgtaaagaagtttggccacagtaaagagggagggggatttaaaagctgagccccacagtatggaaaaatctctagcttagaggtattctaaagaaaacctgcatttcataattccttccaaaaaaaatttgggggggtgttattttaataaaacagaattttcaaacttgatgacatccttttaatttgtttccaagcaaattttaagaggcttgtatataacaccgcttaacaacatgtatgtgcattataacttgtaatgatgcatatggtacctttttattctttattcaaataacgtgcagttgacagtaaagagattacatccatctggactcagttccttgtgctacacctgagggttggtgccttgattcattgagtagggttgccggtggggaaactgctttgccccttgctcaacttgagagaccactcagctaagtctatcctaggcctaggtcgtacctaataaggaagggatacttaaggctgtgaaatgtccaaagaggacccaagggaattttagctgtcccctgagatgctaaaggtgtttcctaatataagccagaacttatctctggctgtctgagggtgaggttgggcctaggagacagctgaatttagaggactgaagccctagcctgcatcctactaacctgagctcaccccacaggcctgcttcaaactaaggatgccaaacctcaggcgtggtaaacttacatagaccaagtcagaaaccctgttcacactcttaaaaatggaattctcaaagtatttatggtagaacagatggaatgaaaacccagaggtagtgaggtgtgaattggaagcacaaaggaatgtgttaggttcctttg

SEQ ID NO: 102003 - DNA, 2302 bp, Homo sapiens
atttatgatgatttgacttaatgattttttgactttatgatgggtttattgggacataaccccatcataggttgaggaacatctgcatgggatggaggctctgtttctgagctctctgttctgttagcctgttgtgcactgctttagattactgtaattttataatatgttttgagatctggtaggtaaagtaccctaatcttgtttttctttttaaaaactgtcctgggtgttattggcctttttttctttcataaaatatttagttccaagaaaaatgttgccagtgtggtctgcatccatacagattctttggtattgcttgaaatttacactgtggcctaatatgtggcctacttgcataaattgctaattcttatggaaaatgtatattcaccaatttcttgggaataggtttgaaatgcattcatggatcaagctgtataattactgatttttacatcttctgtatcctgactaatcgattgtgtctgacatttttgaggctttctttatgtttgcctaatatagttttccagccttttaatcttgtgtgtcttttgtgtttaagtctattacttccatatagcatgcagctggggctttgttttgcactgtttttttctataatctaaacatgaagtttaagtattacgtttagcctgttttacatttgtttagaatatctgtgtatttttatttgtttctattatcttgttttgctgaatttgtcttgcttgtttttcttttcctttcctgtcctcttctaggttgcatttataaattctgctttctcctttcaacctgtataatctatttctgttcttttagtgtttgatcttaaaattttaagatgattattaacagaaaccaaagttaatgtttctagttccctcttgcataaaattatgaaatggctttaaatataatcacttccaccattgttttagttacagtttgtatttttttttttgcccccaagtaccttttttggggagttgagggggttgtcatatatactaagacttacctgtgtgtgtatcagctgtttatcattttcgcttgtataccagatctttttctttctttccccacctgaaagtacatcctttagcgaactttttcagtgagattctgttcatgataaactttctcattctttgtttctcaaaagtcttaaagtctccttcgtggatgatattttagctgaaaatgcaattccatattgatagttttaacatttgaaggtttctttaggagctctagtaagtcagtgtcttcggatagatgttccagtcttctctcatttcgtcaatttacatctcatctattgagtgttcatttcattggttatagtttctatttctaaaaattctattaatttacctggtgttttttgaaattatctctttcttcttctgttttagtattattattattattattatttgagacggagtctcactcagtctgccaggctgaagtgcagtggtgcgatcttggctcactgcaacctctgccttccaggttcaagtgattctcctgcctcagcctcccaagtagctgggattacaggcatgtgccaccacccccagctaatttttgtatttttagtagagatggcatttcaccgtgttggccacactggtcttgaactcctgacctcagatgatccacccgcctcagcctcccaaaagtgctgggattacaggcatgagccaccgtgttcagccccctttcttcttttaaaaaaatattttaagcatacttatttgacattctacatctgatcattgcggtgtcattccttggtggcctgattttgtcagttattgtgtctgttgcctcttgctcatagtgatgtgttgcctcttgtgttttataatatgggattatgggttcttctttgaccaagctctatctctgggtattatatgatatcatcattaagagtgaattctaccagagtagatttgtttttgctcctaccagatgccttggaatacaaacatatgaagtcagtcctatgattagaatgtcagggggcctggcacagtggcttacacctgtaatcctagcacttggggaggccaagacaggtggatcacgaggttaggagatcgagaccatcctggctaacatggtgaaaccctgtctctactaaaaatacaaaaaattagcagggcgtggtggcaggcgcctgtagtaccagctactcaggagactgaggcaggagaatggtgtgaacccgggaggtagagctggcagtgagccgagattgcgccactgcactccagcctgg

SEQ ID NO: 102004 - DNA, 1020 bp, Homo sapiens
gtggtggcaggtgcctgtaatcccagctactcaggaggctgaggcaggagaattgcttgaacccgggaggtggaggttgcagtgagccgggatcgcaccactgcgctctagcctggacaacaagagcgaaactctctctcaaaaaaagaaaaagagaaaaaaggtaacaattttaaaaataataaaagttccagcgttccaagagctgcttcttgttcaaaaaatggttattcctgctgtggtgttggagaaagccaagtgcgtgtggctaacagcaggcctatggcatgttaaaggcaattagggccagcgctggagttgcagagtcagatcctttgataaacctcaggcgtgtctgtctgatgccaagtggaagcttgtgctctgcagtccagaccagtgtccctcctgcaggaagtagattaagcagcgtttgttgaacaggaaaggcctctgtgatagccgtgaaagtcgaaggcaccttgcttcagagagaggaattgccaagtgctgagcacggacagccgcttggtctgcatgggcaggacgtgcctctgtgcagtacccgtgaagtgtgaggttctattttggtctgatgttccatggagatggcctggagctcgattctgaaaaccgaagacagtcaggcggcagggaggggcggcaaaggaagaggaactgcacagatttctcttcccacaaacaaatatggtccagggcttcagattctctgaagtctcacagatacccggcagcacatggtcctctgtttgtttgtcgataacatttggagacacgcgcgcctcgtaaactgtcggcctgctgtgcttcttgtcacacagcacatggcctgcctgcgtgggccctgctatggccgggggcggggtaacttccagtgagatttgactgatgacaccgtcaaatcctgcgtgtgaaaaaacatgtttcggagactgagatgctctattttgatatttttaaagattgttaatgtatatttgactttcacaacaagctaac

SEQ ID NO: 102005 - DNA, 2043 bp, Homo sapiens
aaaaaaaaaaaaaaaaaaaaaaaaaaaaaaaagaagaagaagaagaagaagtgctgggaatcacataagatgctgagactaagtcctacctctgttcctgccttctctatcgtcatcttccaaaccaccactcagccctgctttcctgctgtctgagagaaggacgtgagctgagatgctgagaggcccagagtggaaatgtgtgcagagctctgtttgtcttttggactttttcaacctgaagactgaacccgagcgcttcagtgacccccctgccctgcccttccttcctctccccgctccttctggcaacctgtgctcattctactagaagcagcgtgagtgccacctgcctttcgaagtcttcctgggaccccatagagttagctctctcctctgggcccccacaaccctgcaaatttgacttccatatgggccctcattagatcatgcgattcttacttgcttgtgtctctcttttcgcctaaatgtgtttcctgagactgggtttatattcctcatttttgtcttcccggctctttacatgtggtttgctacatgggtggccctttcttgttcagcaagagagtgagtgagtgatggaacagatgaacagcatagattactatcatttatttctccatgaccgggttctcgggtttgggttgatttagtaagttggggttttgtcattattttctcttttcaaagcttgggatacaaaaggagcgttctgttcaaaatctgaaatggaaggctcttgggtagttggatattcttgccctgctattgttgtttttcaaatcattttctgaagcttggcttgctaaggaagttggacccctcattcttttgtccattggctccttggaagattttgacaagttgaagcttcagaaaattgattgctctcagttacagttgacttccttgactcattatgttattgtggtccccacatcccaatcaaatttttgaaaagtggctccagtgagttgtgtacccttagtaaaggagaatgaagactataaaggctgttatttcatgtgaccacaagatggcaggatcgatcccataaaacggttcacagatagagttgtttctggaatatgactttgaatgagacatattatgttagattagattatttaaaggattttataagcttgcacatatgtgctataagcaacagtgtgtactcaactttctttggatttttttcttctgtctgagcccttcttctgggttacagatataaaaaaaaaaagaggtgggtaaactataatccataggctaaaagcagcccaccacctgtttttgtaaataaagttttattggaacacagtcatgccattcatttacaccttgtctctggctgttttccttctgtaatggcagagttgagtcgttgtgacaaggacttagggtctacaaagccaaaagtgtttactctatggccctttacacatcaaattcgctgtccctgatgtaaagtatgactgagattgctcacaatttgtttttttaaggatagacacggttaatgttttcgtctatttctttcttcttttttaaaaaaagtctaccgggcgcagtggctcacacctgtaatcccagcactttgggaggccaaggcaggcggatcacctgaggtcaggaatttgagaccagcctggccaacatggtgaaacaccacctctgttaaaaatacaaaaattagccatccgtggtggcaggcgcctgtaatcccagctactcgggaggctgaggcaaaagaatcgcttgaacccgggaggcagaggttgcagtgagctgagattgcaccactgcacttcagcctgggcgacagagcaagattccgtctcaaaaaaaaaaaaaaaaaaaaatctgtgtatgtatatgtacgtgtacgtgtgtttgcttaaaaatctattaaaatacatttaatagagtttaaaatgcattgaataaatcttgaaatgcatttaaaagatttttaaaatgcattttatatatatctattttagaaatatctgagtattt

SEQ ID NO: 102006 - DNA, 1099 bp, Homo sapiens
actgtcatctctaagtgtatttggaatgagacattcttacttctgtcctcatagccagagtgaacgccctgcattttggttccttggaaataatcaatagatattagctggctgtgacttaagtgtgcactgaggcatgaacatgtacaaaacacagtgatggcagtcatcagagagcactgccattccccgctcgccccgccccaaaagtgtaggaagataaccggaattaattagcatttgtgagaaatttgcagatgcttggaacacacaaattaatgaaggagtaagtttgtttgcttgatgtatgaaggaccagctaggcatgttgtaacctgcaaatctagaaccttcagaacctgaggcccctgtcctctcctgaggatcactcccgagcaccgcagcctgtctgcagcagcacctggggctgtgagacccacagcaggtgtgccctttatagcagagctcctaagctgttgtgttctgataatgtgtgtgaaattaaaaattttccatcttgcgttggcaggcctgaaagcaggagatgagattcttgagatcaataatcgtgctgctgacgccctgaactcttctatgctcaaagatttcctctcacagccctcgctgggcctcctggtgaggacctaccccgagctggaggaaggagtggagctgctggaaagcccgccccaccgagtggacggccctgccgaccttggcgagagccccctcgcctttctcaccagcaacccaggtatggctgtgcagggtgctgggggcgagtctgaactccgttgtgccacgacccggggagtttatcatgcggcttgtgtgtttcagtgagtgcctctgtctggcaggtggtataaaatgtgtgtgcaagatgggctgatgactggccctgcatttcctgttgaaatttcaaaggcgcagggaactttattttctcatagagctgttttgctacagatccacctgtcacccatgggcagctttataatgcttctgctgtttctcattttggggaaaggtgaatatttagaagactttgctgtggatagagatacagaggcacagaagtgttgggaattgggccacg

SEQ ID NO: 102007 - DNA, 3032 bp, Homo sapiens
gagtttgaagctacaatgagctatgatcacaccactgcattccagcctgggggacagagcaagaccctgtctctttaataacaaacaaacaaaaaaattggtctcagaatgtagtagaatgatggcatttcaaaaaggaaattccaatagttagatgaatcctattcattctttcctatgacgtagcccttgattctatctcgcctaatagatttttttttaatttccactaaaatgcagataaatacacctgtgttaaggctaatgtaacttaaatggttcttgtgtaaaaatattttgatttcagcagggcttcttgacacttaatctgaaagttagaagttgctgaaagaagagaatttaaaataagagaatgaaatgaagactttggaaagtcctcacgggtggccctctgctgttccctatctgagggtgttacggtacttgagagggcgatggcaattagcctttttgcctatgtgaggttatccatttcctggtcctgtaaactaaacaaaaaaccatgtgttcatcatgacatggcctaaaaaggctcaatgactccctggaacccaatcttacaaaattctgttttgctatttgcctgcttgtttttttttcaaccactgctctcccctcagcattacgatgggtatctatattatgggatgatttttttcccagagctgaaattattgcagatatatacaatgacatgtgttccccttgccctttttagaaatatctgcaaaggtatttctttcccttagcaaagtaggtattcactgtggacattcaaagtaattgattaggaaagagttttacatgaggcggtctggaaacaggagtgaccaggacttgtaaccatagagttttgagtacctaggatcctcaagccacgtagaatacctcggcctcactctgctttcctctctgaagtatgtagcagagcccagggttaattagcaagttggctttgagctctgggagcccagagaagtataagataatcttatgatcagatactgctagagtgtgaaatcaggtacagtttctgtaatgtgtaattcacattacagattcgtaatgtgagttgcatcttgctcctgtttgcagaattgtattaaagcagtgtccatatagtcatacatatggatgaacacacaccctccaacagtacagttgttaacatattctaggacatagatttgatgaaaaacgtctggggactttgaggtaagctaatctttctgttttctgctttggaggagagtatggaaaagaaaaaatgatggcgtttaccaggaagcaagattaaacaaaataatttgctttcctttgagttgattggtaggtaatatgaagatagacgtacatagtaatctttatttttacaagtagtgacttccagagtgatctaaaaatacacttttctgctatgtaaaacaagaaaaaacaatcagtccaaactataatgacaaacatgaaacatacctagttcacagcaggcacttcctgttgtttgctaaacattcagaaggtgtgagccctgccattctgtctttttgtgtttcacagggttttcactttcttctgtggaagaagatggtattcgaaggctgtacgtgaatagtgtgaaggaaaccggtttagcttccaagaaaggtaagtcagtgaaggagggctggtctgtctgtcttaaatgccctttggggcttctctagtttttgaaggagaaagatatgcccaaaggattcatttgtggaaagtatttgaacattttctcattgaaaacccttccagggaatatgcattttattccattaacttaagtgtaccagaaaggtcatattcttgaactttttttttctttttttaatttttagagacaaggtcttgctctatcacccaggctggagtccagtggcgcaatcataggtcactgtagcatcgaaatcctgggctcaagccaccctctcacctcagccccccaggtcgctaggggagtacaggtgcatgccaccacacctgactaatttatttacttatttatttttcagagtcaggggtcttgctgtgttgccccggctgttcttgagctcctgggctcaagcgatcctcctgtctcagcctctcaagtcactcatttttggattttaaactgattgagcccattaccctggggctggtgggaaattccattctaatcatgtggtcgtccttctccatcttctaggatggtgtggggatcctgggggggttcttcctggagcagagcatgggggaagacccctctgtactttggtccacactggtcaaagctgacattggctattgcctgagcctgcagagctctttcaaaccagttgttctgttgcttccgttcatagaagaatctgcgaaagttgagaacctagggatttgagatccagcctccctccccttctttagagagcgcttccccgctacatcctgcctgtttcattttagcccttaaatggcctataatgcatttgggctacttggggaaccccaactcttcatcctttttctacccctggaaagtctttgcaacctagatgatttgctcacagtgctaatttcttagagctactgtaataaactgttacacactgggtggcttaaaataacagaaatttatcctctcgccgtttaggaggccagaagtctgaaattaaggtattggcaagattgatttctctgaagcctctgagggaagaatggcttcatgcctccttctggtttctggtgtgaaagcagcacttggcattctgtggcttatggctgtatcactccaatctctgcctgaagtcacatggcttctgccctgtgtgtgtctctgtgtcattaacatggctttcttataagaacaccagtcattggatttaggacctacactaaatcattgtgagttcattgtaactttcgtgtgtaatagtatataattatgtgtaattattatataattataatgatgatattgtaattattataatataattatcatataa

SEQ ID NO: 102008 - DNA, 1023 bp, Homo sapiens
acctcggcctcccaaagtgctgggattacaggcatgagccactgtgcctggcccaggttattaagctttttagcatttgaaaatctttaaaactcttttctgagcactgggatattacattccttctgcaccttcccctgtaggccaccagtcttcatctcggaatactcaatagaggatttgggcctaatgaagagaatccagttttgaaccctggccacttgcgttataactttatgctgtttatttcttgaccttaaaactaaagacataataaagccaggagaatgtttctcatggcaaggaataaatgtttatgagcggcttattatgcagcaaaaagccgacctcagtaattagagctgtaattggtagcagtgaagtgcctggatcctccaaaattagatgctccataatgattattctttttctcttcagtttacttaatttttgttgagtaaggataaactagcaaagatcaagttcagaaggctgaatttcaaagctcttggactctgcttctaagattgagtgattcagggactcagaaattggaactgggcatgaaactgctaccgtttgtatacattttaatactttttgttaaagtcactgaattactcacagaacccatttacttttaccccctgaggagggtatgacagggcaccaggcgtcagtcttgagagtgttacaaacagtgcttcccaactcatccgatgtaaagaagcaggtattttgttttgttttaatttccactcttttgtgaccactgctgcttttgtgaaatacaaaatcccatgcttggaggttgtggcaatgtcaaagctacaagaggttctcaatgcttagtcttgatttctgtcctgacattactgccattagcaaacagttggcacctgttccctgacttcactttgaaaagccctgccacaggctggacacagagggtcacacctgtaatcccagcattttgggaggccgaggtgggcagatcatgaggtcaagagattgagaccatcc

SEQ ID NO: 102009 - DNA, 1002 bp, Homo sapiens
ttctagttccagatatcgtggttgcattgaaaatatattttaaagtacaaacgcttcttgagatatagttttagttttgttcactaaacctggctttagtccaaccagcctaaggatgttgtggccagcgggcctgtcttatgatactgagttgttgtctgagaccagcaaaagacacagtgatattcacactaatttcaaagaaaactaggaagtagtattatgaaaatataggaaagattatgcacaaagctctagtcccactagatcctgtggaaatgattaaaacaaacagttatatactgccacctggaggaagggtttggctcttaaagttttaaaaaataaaagtaaggctcctgataagttgaagtgaacgtagttgataacatttccttgagcattttgtggtgttaggttatacattgtaaaccttattgaatttagtatttagagttttggtggctattttctgaatgaaaaagtagtataactgatttcttctcatttgtaaatgtatcagtatgaaacatttctaaagtataacactgaaaccacattcagtcatgcccttgacacgttgcatttggtggaaattgcattaaattgaggtgtttaaaaggatccaagctgtcctgtccacgttcctatcccccacactccttggcattctattatagcaaacgctttctcaggctcctgagtcacaagtattatgctgacctttcaaatgccccaagcaaataaagagaagaaactggccactcttttctacctgcctgaataaaatcgtttctggacgaatggctgtgtggtcagggatacgggcaagtttagataatcatcaagacttctctttagtgctaacggccacgttttttgttattgaccttggctcaaaattggttttcattttaagatagagtaataattttaaaaatctatatgagcatttgacacatctatttgtttgtgagtttttattataaattttggatttga

SEQ ID NO: 102010 - DNA, 1051 bp, Homo sapiens
tgtttcatcctttgaaatagtcatagtaagatgcgaatttaaaaaattatgccaactaaactaaaaattgttgtaccataatacttagggtataatttgcggctgcattgcctcaaaatgcatcaaatgctaagtaacttaagtacatgtacattggaaaacaaatttataccatttaaattttttcctaactgaattttccttgaatgttttacgagtctcaattttcttttgagttttcacttgaatgttttatgtctaaagcaaggccacacatttagaattactatgtttaaatattcattaacatttgaaattcctttgcacaaagatgtattctgaacatggttagttgtttgacttgctttgatattgactaacaggtatctaaggagcataaaattcttcttgatcgttctgatgatctgatttaattaattcattaggattttatttttatgttagaccagccgtgattaacaagggctcataattcagaaacttttaccaaaatagtaagacacactggtatatattttgatccaatgtcctgttttgagagtaactatttactgaccaaaattagggctcttaagttacaagtaagaccattataattttcatgtttgctgcttgtgctgatttttattttttaaagttatcaagacattattgtaacttaaagaagtttgaaaaatatgatggtttgtggcaataatctttttttccttttacttatttattaattttttttgagacagggtctcactctgtcccccggctgaagtacagtggtgtagtcatagctcactgcagccttgccctcccaggctcaagcaatcctcccgcctcaacttcctgagtagcctacagggactacaggctcaccccaccatgcgtggctaagttttgtatttttgatacagacagggtttcaccatgttacccaggctggtcaaactcctgggcttaagcaactagcccaccttggcctcccaaagtgatgggattacaggcatgagccaccatgcccagccaagaatcattctta

SEQ ID NO: 102011 - DNA, 1117 bp, Homo sapiens
tgagcctgagaaagagctgagactttgccattgtacacatggaggaagtgaagctcagagggccttagctgcttgcctgaactcacatcacagtcagttgcaaaggagagactgaacccacgtctggcttctctacagctgggtgcatcctgcagtgccgagtgtccacaagaactctcagaacctgggttagtcttcaggaaggacaatcagtaaggctcagaagaatctagaatatattcttaggggagtgaattggtcttctttggggctgctaaaaaaaaaaatgaaaaacttttctatcacaattttatcctagaagaagttggatggatgaaatgacgttttaaagatctcatcattcaacacaatgtttgtaaatactgaatgactttcactacctccgcaagtacctcaattttgtagttctactatcagcaatttttgtattttcaaaaaagcaaatcacagacggctttttaaagaaaaaacatggctcttcatatgaatcagagaaatggacagttcagctcaaattagcctcttaaaatgtcttatgtatgtggaggaaaaatagaagaatcacttgttttgggccataactaaagtcagccctgacatggatgctaaaaataaatggtatcacctctctgtgtgctttgaatccttcatgtacgagggttctagcttttggagataatggtatctcagttcacaattttttcatgttaattacttaacaaaattggtctgtagaggatttctgcattcctttatttataattagcacaattctttagagacccattaacattctgcagagctgaagagttattgtcagatctgcagatgaaggtgttaaaagtagaactttctggcttttttgtataagccgaactctggaaggtgtttccagaagaataacatggctttggagcatcctgtgcacattggctttaaactggatcaggaatcgaaggttaagccaaagttttccgattaccattgattggtggaagattgatcagtgagtgaagcaatgaatgattggcccactttacgtatgtttcaagcttttgctttggaagaaactaggggaatgaagaatagtattgtc

SEQ ID NO: 102012 - DNA, 1388 bp, Homo sapiens
aatctaacatcattctttccttgcttatttcgcggggctcctaacattgtatcaatctaaggaaagtaacattatatcaagctaaggaacatcctctgcttcatctgcttagcttgcttaggtttaacccagctgctaaaggaggacttccgacccttctcccacattcacaaacttcattccactccctggtcctcaggcagtgatggagaggatacagtgatggcagcaaaggaggcttgtttttgctacattgtgccatgatgttatccgtcaagttctttgacctccagaaaactgaattgtctctggcgccgggtcgtgctgaaggtccaaggagagcacaaaaatgatgctgtctataaatataaatataaatatgtagtgctaaaacatgatctttttgaaaaaaaaaaatgattggggcttcaccattgctttgaactgtaaagttctcatggcagatgtgcttgttgtaggaattccctgcttgaaacttgaaatgagtttgtggaagaaataagagccataaagctgagctgaatggtgacctttctttctttctttctttctttctttctttctttctttctttctttctttctttctttctttctcccttccttccttctttctctttctttctttctctttctttctctttctttctttctttctttttctttctttctttctttttctttctttctttctttctttctttctttctttctttctttctttctttctcccttccttccttctttctctctttctttctttctttctttctttctttctttctttctttctttctttctttctttcttttccttccttccctatctctctctctttctttcttttcttccaaattttgatgcccactcattcatgccgtgatcacctatggatgctgtgggttgtgaagcctgcctcacagctgaagtttgaaatctctccattgcaccataaatctgctttctcagtagtttctctctctccaagggttcccctgcctcccaccactgcctccgcttctgccctgggctgttttcatgggaatcggtgattcctgtgtgcagtctgggaatctagggttgtcagagctccactgctgctgccctgctaactttatttcttgttatagagggagaaagaagtggtcttacctaacgttcaccagcacaaccctgactgcgacatttgggtccacgagtatttcactccatcctggttctgtctgcccaataatcagcctgccctgacggtcgtccggccaggcgacactgcacgggacaccctggagctgatttgcaaggtatggagctgctttgggttgtttctccaagaagagcagaatggggtgtagcaatcttctaaggcac

SEQ ID NO: 102013 - DNA, 1026 bp, Homo sapiens
agcttttcatttccattctgaatccatgaagggctctcaaagtcccaatatgtctgggtcatggattgaatactttaggcattggggtcagggttggctggcatgatggaggagggttttttgaagggtgggacttacggggacctcaaggcacaagtgggtggtcctgatgcatctcccttgtggctgcttgtccttgccatcctcaggtggcagcacgcactggtgaaactggagtgagaagacgtactcaggccatgtccagatccgcgagcaagcgaaggagcaggttttcttctctgtggggtctggatactacctccaaaaagaagcagggacggccaagcatcaatcaggtaggttccagagcagatgaaaagtgagcccgcacaaatcacttctgtggccacctcaatttggggtgtgtgtgtttcttcagtgaggccgagtgttatttaaaatcaactagttggcacaaagaaactagctgtgctagacacttttaatagataatgcatacccataacattgaactctgctattagtctatcaccaagctgcagtttcccacctgcatcctttccaaaccctcattaattacagacctactcaaagcgcacaattcaccctgagtcttcaggaaaaagcagggctctgcaatgaagccaagtgggtacctgagtgcagtctttttttttttttggagacagagtctcgctctgtcaccaggctggagtgcagtggcacaatcttggctgactgcaacctccacctccctgattcaagtgattcttctgcctcagcctcccgagtagctgggactacaggtgcccaccaccatgcctggctaatttttgtgtttttagtagagatggggtttcaccatattagccaggctggtcttgaactcctgaccctcatgatccacccgcctcagcctccccaagtgctgagattacaggcatgagccactgcacctggccatgcagagactttttaagctgcctctggcactggatgaaaggc

SEQ ID NO: 102014 - DNA, 1033 bp, Homo sapiens
cctatgtcagtaatgtccctcagtcccactcatgtcctataactgaccgatcctatctggaaactgacctttgcttcacagcaaccctcgtgagtagacaccaagttgtgtgttaggagtatcactttcacaagtgagttcagtaagtacattgagtgagcagacatggtggcttcattcaggacagcccttgaaagggaggaggggagagtgggcatctgacctgagactcactttttgttactgatttcctgaagaaagaggaggtcaggttattcttatccatgggtgtctagacctgtcacctcgactcccaggcattgcttctctggaaatgctccggttcatttctcttaagttcctaagaggtgcctttttcttcctgccccttcttcctggtacagaccactagccagacggagcttgaaaactggatcaccgccatccactctgcctgcgccactgcggtcgcgaggcaccaccacaaggaagacacgctccgactcctgaaatcagagatcaaaaaactggaacagaagattgacatggatgaaaagatgaagaaaatgggtgaaatgcagctgtcttcagtcactgactcaaagaaaaagaaaacaatattagatcaggtaatcgttcttccgtgtttaggtccggacaaaattgttaggtctctaaaagggtttttttttttttttgctgttttggaatcgtgaaacatcatcggatatctcctcgacagcctgtcatccaggatgctaagttctttactgtgactgtcagtgttcttcaccctttgttcatagctgattgttaatagctaaacggaacaatattacattgaatgaaagacagaaacccagtagaggagccctggcccccatcaatgatgtgctcttctaggggatctgtgtaattagaaagtttgcaatttcatttcccatgttatcagactgacttggagttctcttatggtggggactcatttctgactcctcagtaaattttgaattcttaatttggaaaaggtaac

SEQ ID NO: 102015 - DNA, 1038 bp, Homo sapiens
ttgtttctgccattccctcagagagtaaatgacacaggaagtcagggtgcaggtgtccaggagcacagcccacaggccctttagggaagggagtctttactttcttggtgacgcagagctgagtgacacagcctgttggaattcaggcccagaacatggagccaccgagttctttgcttcatcctgatgggttcccaggatttgttgacatcctcagggctttgtccttgctgctcaaaagcaagacttgcagctgactttttcttagcaatgcttgaatattgggaaataaaaagcagaacatgttggaactgtgggatagagattttttttccctaaagattctttcccattaggcaaagtaattgatttttttaaaaaaagatttcatttggaattagtctctggagtgtttccatggacaacggaagaacgtacagattatgttccagggaagatgaaggtaaacagactttcaccagggagaacgtggttctcagatttgctgcttcgcgttcatcttaaagttggaacgagttgatcatgagtaaaagctgattttaatcacttttggtggtgctttgttgtggatgattctaaatcaaagttgaaaaattatacaaacagttacctgatgggaccatacaacattcactaggtgcgtgtgttaggattggtgagtgtcccctaattcattatccacaggcttctttctctcttcttaagctatgctaacgtgtgttgctccttttatgttaggaatctacttttcattagtgttgaattagtcgtaaaaactatttagagcagggtttctcaacagtgacactgttgacattttctggataattatttgttgtgagggctgtcttgggcattgtggatgcttaacagcttctttaggctctgtcctctagatgccaatagcaccttcccccaagttgtgacaaccagaaaggtcaccagacattgccaagtttgccccatcataagaacctctgacttagaggaaaacggtttccccctcccatttttgtt

SEQ ID NO: 102016 - DNA, 1032 bp, Homo sapiens
taatttcataggattcaacctgatattaatggattgtatagaccatcatgtttatgaaaaagccagtcactatttaatagtcaaactttgtgtttttgactgtgtatatatagatacagacatgcatgtgtagatcactttattttctgtttatataaccatgcttgtatttgttggtatttgttgtcattttgcacattttcgtgaagtacatgtacgtattgttgcacgtactgcatacatcctggtagcctagaaaatgtaatatatttatgagctctatattttaaaaggaaaaacacttctcaaacacacagacttttcttcccaagctagacttgaaacagggttaatacatggcaggctaggttagataggtcaacaggattgatggaagggcacaagaggaagaagcctgggcttatcagtatcaaactagaccgttcgatactggatttcacagactgtggttggtttgggaacatgcaatcctagagacatggagcagcctagagctctgctcagtgaggtgaacacaaatgcctatgcggtgatgtgcaggtgcaggtcaacccttgcacaagtaggacttgcgttggccccattattcttggtgccagctgttgctcagatgcctgatgacacaggaagggagggtattggtcaggatataggttttgctgcatgtgccagagaccagcaatgccaatcccaatgccataagcaagacagaactttatttccctcccacctatcaaaaatagatgatttaaggcttgtgtgataactcttttctatgaagtcactcagaggccctggctccttctgaagttttgttgcccagctattcctacagcattatctttttcttttttttttttttttttttctgtttgagacagggtctcactctgtcttccaggctggaatgcagtggcacagttacagctcactgcagccacaaattcctgggctcaagtgatcctcctgcttcagcctcccaagtagctgggactacaggcatgtgccacc

SEQ ID NO: 102017 - DNA, 1034 bp, Homo sapiens
tcatcaccctttccagcaatgctggagaatggacttctgggaatttgggacatcccaagtttcatgactgaataagggctggggctgggcaacctgcatccgtttctcaatgggctgggtcacatatcagtgggggcatgtgtaccactgagcctgaataaccacttaaggagacaaggtggagttgtcttggatcacagatgacaagagcattccccgttgatgacacggagctgtttgcttccaaagcatgcaagctcacctggggcccgcaggtcttttacctggagtaatcacttccttgcttggtttagtggttgtcccagagttgaacacacacagtctggtcatggcaaagctacagcatcagttggcatgagcagatgttcaggtcttatacagaggtgagtgtccattgaggccttactcttagtttaaatagagacagatgtgagggccttctgtaaagggatggatggtgttggcaatgtagtgaactcttatgagacacgcccttgagagttggtctttcgggtttctgcctcgcttttccttattctctcttcccatcctccttcccctttcttgcacttgcaggttttagctttttgccaggcaggtcacagtcactcagcttttgctgaaaaaatctggaagagccattgttggtaagaaaagggggaaggcatgggattgatttgtttgtttgttttgttttgagacagggtctctctctctctgttgcccaggctggagtgcagtggtgcagtcttggctcactgcaacctccacttcctggactcaagtgatcctcccacctgcctcaacctcccgagtagctgggactacaggtgtgcaccaccatgtgtggctgatttttttgtagttttaatagagatggggtttcaccttgttgcccaggctggtctcaaactcttgacctcaggtgatccacccgcttcagcctcccaaagtgcagggattataggcatgagccaccatgccctgctgagactgaatatttagacagaatc

SEQ ID NO: 102018 - DNA, 1154 bp, Homo sapiens
ggtggggtggaggtgggagaggagatgctgtggagaggttggcatggtagttggaggaagcacagagaagccttctggttgtagtaaaaggggggacgtgagtattcttgggagtgagaaaggttgggagtatgccctggaatgagttcttcaatttcactagtgggtggggacatcgaagctcaagttttaacgcgggacaccgggggagggtcttgaacagcagtctgaggagtcctccacattgctcctggaacatttacctggcagtggtgtgccggatggattgatggaaggaagatgggttagaagagagagcttattgctcaaccagtgatgtggcactcggaggggaagagaaaaaactgagtctctgatatattatggatagtgaggagggaggggagggatgactgtaaggtataagcacatacatagaaaagcagatgaaaggagaggcaatgattcatttaacttagacataaagcttctccaatcaggagttacctgaaggaacatttcaagcttttgccaacttactttggaatccctttttagtaacagtaggaattttggttccaatgcttgtagctgaaattgtgagtcactcccattggaaatcgttagaagaaaaggaatgggttgttggaaacataaaaagaaaggcatagagattttgccctaagaaaggaaggggagggaaaatagagttgatttcctattctggcaaatcagggatggcaattattagtatttcataatagtgaccagtagttactaatttataatgtagagaacgtcaccattttcctagtttagtgtgctgttttgtgaacgtgagaacaattaacaagcctaattagtattaggctggcaccagccttggtatgcctgtgtttttcccaggtttctcagagacctttcttccatgttggtgcaggaagttagcaactgagttcaggcaatgccttctctccttgggccaagatgtaagtagggctgaaggtagagatgaccgtaattatagttaacatttttgagcaggtactatgtgctgggctcagtttaagacacttttcctgggttaactcaatctcacagtgtcttatacagtgtcttacaaagtagatgtgttgctctccccattatacata

SEQ ID NO: 102019 - DNA, 1061 bp, Homo sapiens
cacttttgtcacctaaaacactgattacggagagagatggccaggataactgtagcagagccatccctcacggctgctttctttgataagcaagtagtcgcgttgatgatttcattaataacaaggtaaagagtgcagcattgtcagaggaggagcttgagttcctagaaaaattgtcttgatgtttaaagttttgttttattttgcaactgagcttcaatgactcagagataagtttgtttcctgggctgaaaatgcacatcaacaaccatatgattcttgacctttggtcacagactcttgagaatcagatgaaaaatgtggacgttttccttagataaagacagggaccacccttctgcatatcatttcaagggatccataggtcccctaaagtccatctagaggcttctttctggttaagaacctcaggtttttataaaacaaattttttcatgtaaaatcgatttttaaaacacccttttttttttctgttctcctctatcttctgtttgatgcttttttttttttcttttctctttatctttctttttctggcacgtaagttaagcaatgagatatttattttgcaaacaaacccatgcattttcaacaagaatatatatcttctttgccaagatctgtttttgggaagttggaaggtgggtaggtagttgagagatagcttatgttagccattcttagacctttttatactcttaaaaagtaattcaggaggccgaggtgggcaggtcatttcaggtcaggagttcgagaccagccttgcctacatggtgaaacccccgtctctactaaaaatacaaaaattagccaggcgtggtggcgggtgcctgtaatcccaactactcgagaggctgaggcaccagaatcatttgaacccaggaggtggaggttgcagtgagccgagattgcaccactgcattccagcctgggcgacagagtgagactccgtctcaaaaaaaaaaaagtatatatgtgtatatatatattttattaatatatatttatataaaaatatttatttatttatttatattaaa

SEQ ID NO: 102020 - DNA, 1794 bp, Homo sapiens
tctaaggaaagaaaaaaaaacacttgtgtcctagaaaccaagttgctaccaaggctgcatctgtggtctgagaacgtaagcctgaagcttgcctccagatgcactccctgaattttaaacccatctcttctgaattgagattgtaatgacacaaatgaccagataacccacctgcagcccctctgtctaccctgcgagggctacttctgcactgtcaattggacagatcatggagatatgtgacctattaaagagtcacctgaaagggattgaagggctgtcttgaaggcattatcagattggcactgcaaggctgattcaaagagatgatctatggggccttcggagcttagagaaggatacagtgacgcagactgttaaaaacagaacatcaccttggactttcatttctacctgaacagtgctcagttagtgcatatgctatgtaagatttgagaagggtgccctgttgtattttggctctctgtggttctgacactagggatggctctcccctatactcgatggctgatggggatttgagcctttgagttacggctacccccagaaaatgggcaaagcaaaggacagttctcccctctaggtctggtaccactgaaagctctcatgtgtcattattatacgaaatttctattctttggcttgtcaccttctaaaattgtgaatatatggaagtgagatcatctaaaggtggtgtctcataaaatcactgcttaggcagcttaatgtaatgggaagtgccattggccaggaatcctaagaagtgcatttgcatcctggcatgtgtgcttacccagtggtgaccttgggccagtcactccatcttctgtgccccaggatctgttgctgtccagtctgagtgacaccagcctcccacagggccattgggagaaccaaataggataccatgcatggaaacctcttgtggagcgtataaaatgcacggaagtattatttttgtattgactttatatgttgagtgaggatctttaatgacttgaaacaaaccccggaattatgcacaacactatccacccgcccacatttcctagtctaagtttggcgtgttcatccaacgctatttcttgagagcccactatgttccaaacagtgtattttaagaggcagtgggtgtggaagcttccttgaaaagaatgcttttttaaaaaaaaatttttttctttttttttggtaaaagtttttgacccaggggacctctccagtgagcttgaatcatagatattaaagtctccttggctgccctgatgatgtagttgaatctgtgatcatcctgtcagcaattttactccccagaaaagagttcctggcagacatttgacccaagagcatgacctctaagcctggaagaaaacacattttatctgaaataatgtgaacaacttcatttgatttgaaaatgatcaaaaatgggtttttggccctttttcctgtttttggattttttcagtagttggatggattattgtaatgtgaagtcacaggagttcacatttaagtcttgaatggtggcacatatgtgctacagggtctgctggcaatttttggtttaattcgtgtattttatgagcatgtttgttgtgcatccacatgtgcgctgtgcagaaaagtttgtcttgggagtcagtatgagtaaagcctcatgctatttgaagcagaatttatttctgttggtttctgtaaaagtacttaataggttactccttagatttagttgatggctagttcgtctttgggcctgaactttatgaattt

SEQ ID NO: 102021 - DNA, 1023 bp, Homo sapiens
atacgctttgtgtcagatgattttgctcagctgtaggctaatgtaagtgttctgagccatttagggtaagctgtgctgagctatgatgtttggtaggttaggtgtattaaatgaatttttgacttaggatattttcaccttacaatgggtttatgaggacatgaccccatcataaatggaggagcatctgcatttaatttggtgggatttaaaggcccttaaggtgattacttattgaaaagtttaacttatcactttaagagagggatcatggtgttggtaagaaaagaaaaatcacactcatcctattgtctttgatccctggccctgagcactcccccaggaactcctgatgctttgaccccataccactttcagatgacactcttgcccatcatgccactaagactcctttgctctcactttctctggatcgtcctaggcctgagcagttctacacttgccctctcaactcttaacctcattcctgaacctctgcactgcagctccaaaaggaagaggaagataggaactggaggcaagaattcagtggaattagacaggtgcaagcccttaattctttccccaggaagaattgggggtggggaggggaacacactggagcacaagctgaacaccctcacccctaagttcatggatcaggatgaccttcaacccagtggtccagagtaagggactgacacagacctgcaggtggaagggacccagagagcagagagctgattgggaagtttcttccaggcatcctgagagaagaggctagcgtatttaagactgatgtgtgctgtgtctcattagcattgtggtcatgttctcacctatgttgcattgtagttgtatgagttttcacatcttagattaaagtgtctttgtcattcattcattccagtatttttttttttcttttgggtttttggtgttttttttaatggaccacctacaacctttcaggctgggttctaggcaatgaggatacagcaggaaacaagacacttccagccc

SEQ ID NO: 102022 - DNA, 1030 bp, Homo sapiens
ccctgccccccgcccccaccacacccagctgatttttgtagtttttagtagagatagggtttcaccatactggccagactagtctcaaactcgtgacctcaagtgatccacctgcctcagcctctcaaagtgctgggattacaggtgtgagccaccgcccccagccacatcttaatattcttggagaaaatttttagctgtctcaaggtctgtatgttgaacgtgcatctcaaatctcagattttaattctggaagatgagaagaattttgcactagagatgtttgaccccagtggtagaatcaccttttggattatttactcccacacggggcaagccctggccagctgacccacagggctgggcattgttcatgtggaagtttcctgttcttcagctagggggtgaggcatcctgtcctgctgtctgctaggagcaccactggaaccgctggtgtaattgagggcattagacatcctaaaccataaaaatattattataacctccttagttctcaaggtgatgaagttgtttccagattcctttgtgtctttttctttcctgttttccctcaacaatctgtggttgtggaaatatttttctatgttctttatgcccaggactttgaacacagggtggctttctattaactggaatattttcttatgcagtacaggtggtttaaaaatgcaaggtacgtgctgtatcttgggtcatatagggttgacctttcttttttatgtgtgttctgtttgtttactcatgtacttttttttttgagaaggagtctcgcactatttcccaggctggagtgcagtggcacgatcttggctcactgcagcctctgcctcctgggttcaagtgattctcctgccccagcctcccaagtagagctgggattacaggtgtgtaccatgcctggctaatttttgtatttttgtagagatgggtttttgccatgttggccaggctggtctcgaactcctgacctcaagtgatccaactacctcggccccccagagtgctggga

SEQ ID NO: 102023 - DNA, 1053 bp, Homo sapiens
agccaaccgggtagcaatgggggaattgtggaaagggaatatattgtggggtaataatggggtattgctgagaactcgtgctcctttccctgcaagcatgagtcactaacttcatggttaaatagcatattttccaagataaggaagaactgtctttgcttattgttccattctggatagacgtatatatttatttactgcctgtatgtggctcctttccacaaaataggcagttttcttcatattcctgctcaaagtgtttgtcatctcaggttcccacctgctgaaaccaccagcagcgggcagccccaggggaatgtctgggaagaaagtaccaaaatgaagccacccaaagagcccttcaggcctttcttttgcttgccttagtatttgtaatttcacctctaccagcaggctttaaaaagatgaaggaaataaaacaaccccattaaccccacgtgttcctggagctcttgtccattgattttccatgttaaattgcagtttggatcttttacctaaattttttcctgtgcatattcttcatgcattttctctgaatttgatgtttgccttcgtaagaaaacgtgtatacaatggaaagttctatgtaagtgatttgggcttctgttttactctctttcagcattttcttcaatgtttgttataaatacagcactactttgagaataactgagggttgctggtttcctttcatttctgtttcttgagactctgaagattgagtgggacatgggaatcattctgtagtaacctgtttctgttgtccaacaccttaatatacacagatagattaaaataataagataacttagtctgtagggctatgtattaccctaaatgtaaataggctggtgtgtatttatttatttatctgatttaagcctgtcattttatgcctgtatccaaatgttgcatcatttgatttgggatgtcatattgttacaggaaagaggtcccgatccagactctaagagagggttcttggatctcgcacaagaaagaattcagggagagtctataaagtgaaag

SEQ ID NO: 102024 - DNA, 1031 bp, Homo sapiens
atcctattaacctgtcaggaccaggttcaaccgagagcctctcctagcagaattagtctatttcttcacatccttcactattaataatgccagactagctgttacagccctgtctgagtgggtagatgcccactgtcttcccagattatatgcatcataaagaaatggtctatttcctcattccaaacatataacaggtgcccagtaaaatgttggttgagttgaactgaatgtgtgatcatcagtaaaattctacatagatactctgtcttacccaaacaattcataagcagtttttagatagccctaagcgtagctatttagaagcctatttttatatactctttttcataagatgctgtcatttgtaaaatgcaccactattttgcataccactaagaagcagagaaaatggcaccactaaaccccaatacaccattgtgattgtaagatatattcaatttcaaagatgttaagagtcaaaaatagtgtttcttaaaatcaatgaaataaagaattatgtttttacatgttagagcttgtagtcttaattgtataactgtgaaacaacttgaaatgatttgcaaataaaaacttaaggtcattttttttttccattttaaaatgaggagtgactaaaggagaatttgggaccaagtgcccagggagtgacttgggactcaaggccttttgaccatggttacgtcactctgtcttgtggtacctctgacaaagtcctcaagtttcaacctcagttcttctctttcaaaagaatcatctgtattttgaaaatctgtgggaagaatttctttaaataaataaatgcacacacacacacaatttgttgagacaggatctctctctgttgcctagggtggagtaccatggcacagccacagctcattgcagccttgatctcctgggcttaagtgatcctcccgggcaagccatcccagtagctgggactacaggtgcatgccaccacacctgactaatttttttttttaattgcttttacagatgatgtctta

SEQ ID NO: 102025 - DNA, 1020 bp, Homo sapiens
atatattgcactgtgatttgtacagctttgatcattgcctgcattcagtgatcttatttaaataataagagtgagttcaagatgtgagtcaacagcatggtgggtttcctgcagcctgagaatattttggagactgaacccaaatctgatttactttttaactttatgatgccaaggctgaggcatcctatttttatttttgcattaaattattgaagctgttaaatccatttattattacaggtattgatttagtccatacaaagtgtggttgagataatgtttgaaacttctggcctctcatggataattagagggtttggttttgtttttgtgtgtgttttaagttccataaatctgcattggaattggccattatttgtgtctccattccaatatcctccctgatctaagttttttgggagttgctatgctctgaatgttggtataaattcatatgttggaacctaatacctgaatgtgatagtatcatgcggtggggcctttaggacgtgattaggtcatgagtgctctgccctcataaatgggattcgtgcccttatgaaagagacttgaaggagcctgtttgccctttctatcaggagaggatgtatcaggaaggtgccatctgtgaggaacaggccctcatcagatgctgaatctgctggcaacctgaacttggacttcccagcccctagaactgtgagcaagaaatttctgttgtttataaattactcagtctaaggtattttgttatagcagcccaaacatactaaggcaggaaggttgttttttttgtttgtttgtttttgttttttaactgtattgctgttctagtgggttccagtcctttgtttttgaggtcctttgtggaatggacaccaaatttccagtaagatcactgtgagtgaattgtggcccctcagggataacatttgaatctggtgcttgattatacctcagagtggaaggtgttattgtcaccttccatttcagttaccaagccaggaacttcagaga

SEQ ID NO: 102026 - DNA, 1786 bp, Homo sapiens
accatacaggggtcagagtcacagcatgagctgacccattcctgccagtcaatcggggcgctggaaaacggcgaaggtttccagtggaggatcatgccttgcccgtgattgtctcgtgtctttagactccttcagtcaggaacagttgcacagtctttcctggacttacaacgttgatactttggaagagtccaggcaagttgttgtgtagaatgcccctcagtttggtttgcccagatgttttctcacgattcactccacattggatcgttgcatcactggcagacacatcacaggccacgatgtagggtgtcctcctcctgtgtgttctctgagtgctcccgaagttggcctgtcctacttctgatgctgtctactcaccttggccacttggttaagacagcattgccagccttcccagttgtgaagttattattttcctctttgtgaaggaaagaaatgttagtaaatgttttgtggggggatactttgaaattatataagtctcttctttctcatcagatttccaattttatttctctctatatggacttgtagtttcctattttattcagtgggttataatctgctagtagtattatttattgatttttttttttagagacagggtcttgctctttcatccaagccagagtgcagtggtgcaatcagaactcaccacagcctcaaactcctgggctcgagcaatcctcctccttcagcctcttaaatagctgggactacaggtgcatgtcaccatgcctggcttatttttaaattttttgtagagatgaggtcttggtgggttgccaggccattctgttatttattttggtactcaaattgtccctgatttggcctgcaggcaccccttcaagtgtgctcctctgtctcgttgtgtgccaccatcctgtgctctgcctggattgtgaggacactggcggttcctcccctgggggacttgccctttggggcttctgacaccaccatggcagtcacccccgtgagcagacaccttctggctccagtcaccacgtttttaaaaaaagtatatcttgtagttagattgggttaaataagccatagacatttttttttcctggaggttttagggagaattgtttttgtgcctaaattgaaaaaatgaggcctgtttagaattcataaactggcacagaagggtagctctgcgcctccaggcaaattctcatacaaattattaaaagactcaggaggggttcagtcatgttaaaaccccagtttgaaaatgtcgtaatcacttttctctcagcaactggccgttgataaaatttccagggagctaggagggcagctttttaaagagaggtgtgggtgagagagaaggaggtgagcccccgtgaggggcagctatcagtggaacctttggagattgttttaaaattctcatccaaggtcctgtaaagaaggaaaaaggctaagaactgttttttttttttttttatttttatttcagagttaatgcccatcgctccttccctaatctatttgctacccccttgctgctgagtcctgagatccagcctttttggccagttgtagaaccaatcgcttattcggtatcatctaattttctatatggtttattctcatttaccacattgaaagtaatcagtgaaaactgttggctccaaatttaatttaaaacattgtttataggtagattttttaaaagtcagcattttagtggagtgagggcctaatgaacacttctagttgcacatctttgttgagcaaaatattttaa

SEQ ID NO: 102027 - DNA, 1158 bp, Homo sapiens
ccgcacccagcttaattttggaagacctttaaacctttcatctgttactagtcgtctttgacagaatatgttaaattactctaaattgatctttagtcagttttttccccctcccacagaattgatcggtatatcgtgcagagatttggtgaggtggaggtcattgagcttgtaaggcccagaatggtgaagttttcaagctaattgcatttgcttcctatagttgcttcatttttcatccctgtttcctcctctgcatcagcactaacccccccaactcccagcctttagtttgctgtaggctgtcaaaccagataaccaaacttgttaaattgagaatcaataggctgtacatagggactacaacagaatgacgctcattattgacagaatcaagttcaaactccttgtcctggcgtctgttggcctctggcagctggctcatctggcattagctggttgcacgagttgctgcaaccctcccacctccatcacacacacattgcatccccttcccgaatcacaccaaattataatggatattatcaatatcatcataacaaattacaacacgcgtttattgcgtgcatacaatgtgccaggtccttttatagagtatactatagtaaacattcctggcgactgaagcatttagaatatagtaaatgtagattaaattatgaaatgtttaaaataattatatgtaattaatatataatataaaccatatattagtgatttaataattacaggttaaatattaaatatataaaatatataggcatatagaatatatgaaaacatttaaccctcctcccaaggatgagttagataatgccattatcttccttatacaaacgaggaaatgagacggaggttacctaccttgcctaaggtcatgcagacgaaccattgtgcagcttttagttttttgttttgagatgacatttcactccatctcccaggctggagtgcagtggcgcgatcttagctcactgcaacttccacctcctaggctcaatcagtcctcctactttagcctcccgaatagctgggtctacaggtgcacaccaccacgcccaactaatttttgtagtttttgtagagatgaggttttgccatgttacccaggctggtcttgaaccctgacagggattc

SEQ ID NO: 102028 - DNA, 1027 bp, Homo sapiens
ggacaagggtgatgataaatcaccttccattctgtttgggccataatccctggaacccatggtgggcatatttgaaatgatttgacttaaatgtttaaagctttagtctttcattgggtaatgtcttagagaagacaatttcttagtaatatgaattgttcccaaactgaagtccatcccctttttaggaaactggcagcccaatccaggccctcctgctcccctttggagggtctttgttcctccttgagttagcaattttgacaatattcctccaaatttgacaaaaaaaaaaacaaaacaaacaaacaaaaaaaccatttcctgatggcagagacatcagggagaggaatcaaatttcttctcctttgttctggaacgagcttattggcagttcattatttacatatcgtgagagagtcctgccaagccaatgcaggtgttgctgacttgctaagacaagtttgcactctattttctcttaagaaaaattggaatgcggccctttgtcagaggattgcattgcacgagtcactgagctaaatgtaaatatccgaaaatgcaaagtatgctttgctgtagaaataaacattttgacatcctgccttacatgattttcctcaatgacggttgttagtgccatccttcttctctcatcctgcattgtgtaacctttcctttagggtttttggctacgctaacaagagcacttttctaacttgtctgctttgtcattttggggtcaccaaattggtagtagaaggaaatgcagtaggtagcgttttccatcagggagtggttaccttctgcgtctgaaaggcagcgagtgacctggatttttaggaatcaggtgtgtcccggttgtaagtctgtgaaattagtttaacctccatgggggtaaatttcccagactttattggagtggttttggtagctttgtgactacctagaagattctcacagaagttcgttaacccaaggccatttttcacccagggtggctgactcttgtaacgcacaacccgga

SEQ ID NO: 102029 - DNA, 1046 bp, Homo sapiens
cccagatctcttttttttttttgagacagagtcactctgtcacccaggctggagtgcaatggtgtgatctcagctcactgcagcctccacctcccaggttcaagcaattttgcagcctcagcctctcaagtagctgggattacaggtgtgtgccaccacgctggctaattattgtgtttttagtggagatgggtttcaccatgttggccaggctggtctcaaacttgtggcatcaagtgatccgcctgcttcggcctcccaaagtgctgggattacaggcgtgagccgccgcgcccagcccaactctcctttttttcaattccacatttagcgaggctctgagaggtagagggagtcacctaccattgctcactggtcagtgtgcagctggggttgacctaagcttctgataccacataccctgaatgccattttctggctcattcctgccttggagacctcagactcaaccatcattgaccaaagccattattttttgtaatgttgtggattttttttgactaatgatattcagaagtgtaaagtgaattttttgcatttgataaaatatctataataaaatttaccactgtagccatttttaagtgaacaattgcacaaccattaccatgatctaattctagaactttttcatcatcccaaacagaatatgtacccagcaagcaatagctcccatttctcatcctccacctccctgccccggtaacctccattctactttctgtttatgaatttgcctattccaggtacctcgtctaagtggaatcatacatcatacttagcatcgtgtttttaaggttcattcatgttgtagtatgtgtcagaatttcattcctgttttgggttgatgatatatatatgtatcttttatatatatgtttatatacatgtaagcataggtgtatatatacatatgttttgtttattcctctgtaaatgagcatttgggttgtttcagttttttggctattgtgaataatgctgctataaacagtgatgaaacaactcagcaacaacaacaaaac

SEQ ID NO: 102030 - DNA, 2009 bp, Homo sapiens
tcggggggtgggggtcaaggggagggagagcattaggacaaatacctaatgcatgcgggccttaaaacctagatgacgggttgatcggtgcagcaaaccaccatggcacatgtatacctgtgtaaccaacctgcacgttctgcacatgtatcccagaacttagagcaaaataaaaaaaaaaaataataataagccagtcgtggtgccgtgtgcctgtgttcccagctactcaggaggctgaggtgggaggatcatgtgagcctaggaagctgaggctgcagtgagccgtgattgtgctgctgctttccagcctgggcgacagagtgacaccttgtctcaaaaaataaaataaaatatgtacgtgttaagtacaggcacaatcatttcttgatttattttgaatatttttgatctacggttggttgagtccacagatatggaagccatggatactgaacccgtggatagggaatggcgactgtagttacaacatgtaccatgtgggaaggtgattgttacagtggaggcccttgaagcaaggaagtgttgggtgtttgagcttttgaacataggggagttaggaaggccccactgcatgggtgacattggagccaagatggcaaggggttgaggaagcgagccctgtgctgacagagggagcatcgaggcagagggcagagggctgggctgggcatgttggaagtttgggtggaaagagcaaagtgggagagccaaggagatgaagacagaggagggtcgtcagggcagggtctgcgggactgctggtgagatgggaagcctttgagggttgtggataggactagggagacacgatctggtttaggtccataggttctccctgacagctgcgttgggaggagactacgcaccatttcatgtggaccatggttctcagtaagcctgtgtttgggcatcgattagactttcttattgctcacacagtctggatcctactggtgcagggtgatggtggggtggtctttatttttgcaatttctctaggcacaaatcttttttcttcttttctgttttcttttctttcctttttttttttttttttttgagatggcggcgtttcactctgttgcccaggctggagtgcagtggcacatctcagctcactgcaacctctgcctctcctgggttcaagcgattctcatgcctcagcctcccaagtagctgggatcacaggtgtgcatcaccacaccaggctaattttttctatttttagtagagatgggttttgctatgttggccagattggtctcgaactcctgacctcaaatgatctgcccacctcagcctcccaaagtgttgagattacaggcatgagccactgcgcccagcccacagatctctttctttatagaagatgaagaaagggactttttatcctataagggtacttagctgatgaattctagaatgagttcaagcgtggctaaaaaatgcttgaagataatttcgggttctctgcagcccagtgtttcatttaccttccaaacagaaagctcctcctccctgcacatgctctgtgttgcccccttgccttgcctgtgagcagattcgaccgtcttttccattgatcacttccctttttggctcaggctgctcctctggggttttagttctgaaataagtgaaccatttgtcatatctgcttccttctcactggagccgcatgttaaatcgcggccggaacacatctgtcagatctctgagcttttcaaaaatgcaaacctgaacgttttggcatatgaccctgttagcctgttttaagtggcgtgtggtaaacttgcccacagatgttagtatacccgtctactttgaacaaaataataataactttcacatctggtcctcttttcatctagggatcttaaaaccccaagtgcacattagttaaacctcacatcactggaaggtagggaagggatggagggcaatcgctttaatcaccactgcaagaaacttagggggattgcccc

SEQ ID NO: 102031 - DNA, 1068 bp, Homo sapiens
ttattgattgcaacaaacagaccattctgttgaaagatcttggtagtcgggaggctgtgcgtgtggggcaggaggtatatgggaaatctctgtgctttctgcgtaattttgctgtgaaccttaaactgctctataaaatggtattatgaaacagcaacaacattcaaaccaaattgaggagacacagcactgcattctactcatgacatctagtaaagtgtcttttgacctatagtacttcttgaagttctttgcagcctgtcggcttgggcagcagtcactgggcagcaggggagaatccctcatcaagcaggaggctctgatactctaagaatgggattttccctggcggcttcatagctgtgaaagcactgacttcatgttcctgttttcttccttctggccatgtgctgcgctgtggacactaaggatgcattttctggtgagctgattcatatggtagatgccgtgttagccacactttcctgcatcaagggtggttacggacagcagggatttggtcgtatttgaatgtactgtgacctggggaccagaaatgctcaaatcctgcctcagtcttatcacccttcccacaaggagtcgtcaggactgtgtgcacaggcaccttagcacgaaagtgagcagttacgaggatttttctgggagccgacctcagcgtttcttcttgcgggttgtctttgacttttgaagtcagcatctgtgtgttcactgcgttcacgtgctcagttgcaggtagtaaggagacaatagggcagaaggctgggaagcatccttaccctcagggaactgacattctggatacagacaatatcaagagatgttgtccctgcgtatttgtggggggttcgttccaggacatcccctccctgccctgaggacaccaaaatccatagatgcttaatctcttttggaaaatggcatagcatttgcatataatttaggcacatccttccacacatttgaaatcatctccggatacctaaaacaaaataaatgctaggtaatagttgttatactgtattgtttagggaatgatgacaagaaaaa

SEQ ID NO: 102032 - DNA, 1196 bp, Homo sapiens
gaatgtcagccctcagtaggaaagtagtgctgtccaatggaaggcctggtcaaatgccttttggttggatgtttcaagctggtgtggcatagccggagattcccagtcctcaggagtgtggtagggtaggctctgtcctaccaggaatgcatttggattttagagatagttgagaagtagtttcttttggaataacatttaagacacgtttgggttctgggacatcctccttcctcatttttcccctgggagtcattgtggctggttgggcctatgggcctgcaggctgtgtttgatgtggtgagctccccttttccaaaggatgaacctatctgccttgagatgcctacagttttgcaacttcagtttaataattatatatggattttgagacataattggtgggatggatgcttactttcataattcatttctactcctgtgtccagaaatttgtaggcatctttgttttacagtttgtcatcatcttcgttgactacttggttgaatctttgaaatgcattcaacccagcatttttgttttttttagcactggctctgtatgtcacaacagtggatccctcagagaacacgtgggctggtagtaccagttgggaaaacatagcctaagtataatggaatctacagcgaagttccacggacatgtttatttaatagggacaaaagaaaatgttcaaatcacattttacctttccgagtttataaatccatctgaagtgcttgaaaaaaaatcatagtattagaaatggatgcatgtgtatataaaactaacactagaattctttgccaaatttaacttctcaaaagtgttcttagaaagagggactttcttggagagtatgaagtctattttgtctctaactcactaaggtcattctttgcatttctctttcggtgtgtctccccacaccaaactgctattaaaaacatacagagaaccttgggaggctgaggcaggtagatcacttgaggtcaggagttcgagaccagcctggccaacatggtgaaaccccaactccacaaaaatacaaaaattagccaggcgtggtggcgcatgcctgtaatcccagctacttgggaggctaaggcatgagaatcacttgagcctgggatggggaggttgcagtgagctgagattgcaccactgtactccagcctgggctacagagggaaac

SEQ ID NO: 102033 - DNA, 2097 bp, Homo sapiens
ccctgtgcctcatgtgccacagtgttaagggattctttttgggattaaaacccggtcagagctgtccaaagaaatgtcaacgttgcttccaggttctgtgagcaaaggaaagtaatgaggttaaagagcaaaactaaaaaaaaaaaaaaaaaaaaagcaaggggcaattctaaaaattgttagcccatttctgtgtgagcctgtgtgtgtattttcacactgcagctgctcaagttgagtcatagaatggatgtgtcatctcttggcttcaggcacagtggctagcccatcttccccccggagggagtttaagcacatttatgtgatgaataatgtggattctcccccagtacttcagatgtagttcaacagatttcatgcaaatggtaggtgaaacatgtcaagcatcttttgtccccattcgaaagataacagaaatatgtcccagcagagtcagtgcgctgagtcttagctgatggccggccgaacgctccccagtggcgtctgtcttcacttattctgtcttggacatcttctgcctcctgggtgcgcccccgacattgtaaggctatggaaggagggctagggctggaaaggaagatgcaaacattgagcacctactgtgtgcctggcatacttctgctttgtgatctctaacagaatacatgattgcacctcacagcccctctgagcctgtgcgtattctcatctccaagtctacttggtggaacctaggtagcttgactaaaatcactctattgtggcagtgaccctggagttgaactgtgtgttatctgatttctaaactcgtgactgttcccacacatcttgacctccggttgtgaatataaacagagacatttagatgagcatgtctaatggtcatattaactctagaatttggagactcttgagtttctttcttttttctttttttttggagacagagtctcgctctgtcacccaggctggagtgcagtggtgtgatctcggctcactgcaacctccgcctcccaggttcaagcaattctcccacctcagcctcccaagtagctgggattacaggtgtgcaccaccatgcccagctaatttttgtatttttaatagagacagggtttcaccgtgttggccaggatggtcttgaactcctgacctcaggtgatccacctgccttggcctcccgggattacaagcatgagccaccgcacctggcttgagtttatttctgatctaaatcttttctacattagccaattcctcctagcatttcactgttcatgagcttgttgaagtcattattgtctgaaataccatgtttaggtttcactttgtggagggtggggagggtgaggtaatattttaaaaactgcaaaattagggatctcattttatttttagatgttggtccacaggtgaaacgtatcaggctggttctttgaacaccctcaggaaagttaaagagatggatgcttctctttaggaaccgggaacctctctggttagacagaggactcttctttcactgtttttgttttgtggcacaaacggcctgggatgtggatgccttgggtctgatgcaagataccctggaggcttccctggcctgtccttctcctgcccatgtcgcgtaaacattggcatggcagggacagatggccactccgggaactccttggatgtcacatttggttgcctgggttgggggtcgggtggttgcagccagtctccactgtggggaggagaggctgactgggaaatactcccatggcagtgggtaaacacaagctcacctccggaaaggctgggcgccctggtacatgtgcaggctggggcggtaatggagtcagatgcacataagtgtgtttagcttgggaaggagccagtctgctcaaagcacacagccttttctctctgctccgaactgatgctcagcagagttcggtttgcttatggggatgggaatgaaccatgtgggggctgtgaagggagggatgggctgcagataactactttcagagctagaaaaaaattctttccagaggcctgggttagctttactggaggcgcaggtgagggtatctgaaatccccggagagt

SEQ ID NO: 102034 - DNA, 1217 bp, Homo sapiens
gactgagacccacctttctagacctgaagcccaggaggaggaagaggaggctggttggtaccatgggcataatgctctgaatcctagtctctcacctagtatgtgagcagtccctgcagatggcccatttggagatcttgacaaagcctcttctgtttccaatggggtaagtgtggcgtttgcaaaaggctggggaatgaggattgaagcttttaaagtctttattatcttgatcctgcccaaatccaccttttttgggacaatagaaagttcattgtttgtgacgattgttttggtggttaaagggttgctgagtctccccacttgcaatctgaggctttgaaatgggtttcctgggaacctttcccattcttcctgggtggttcccatggttattttattttggagttggctgcgggtaatcctctgtctttctgacttctcttttgtctgcccccatgatactaggaaaggggaagaaggaattgatttggatgcagctggggaaacttggtatcaacgtgctggtttgggggctcttgggtgtgggttcacatcactttcaatgcgacagggtaagcattgatgtaaactgctaagtggttttgttcaagtggaatatttcatgcggcctccctgctgcggtgaaactggacgtctttattgcatgacaggcttggggctttcacagaatggatcaagaggtcgccgtgcaacgttcgcagttaactccaagagaagaaatatgctgcaaagacaccctccctacttcctgtatgtggcacagaccccttctagggaattccagcagaaagggctgtgggtacttcagtttcccttctaagtgggaacggtcacgttagcccatgcagtccccgtttacttcctaggaggagaatgacgtagaccaaaaggggctttctagctatgtgaagttgctcttgttcttttcaactttgccttcctctcgtggacaaacgcacctcgaccttgttagcaggtgacatcgggatgcattatttaacctttaccaggttgggctcctatgttggttggtccagaaattgaacacaataggagactgtggacttgagagagggcaagaatcacaggtgcttcctgaggaatgcatgattcctgtaacttttagagtttcccaccctgcattccgggtcctgctttgcagatcttgccgtgacttgttcctccagtcttac

SEQ ID NO: 102035 - DNA, 1063 bp, Homo sapiens
tacccactgctctgctctgttgtttttttctttcctttttttttgcctgcctttagtgtaaaaatgaaatgagtacaaagcccgaaacttggcagcgactgagatgtaagttagtgggttgcttctatgaaggcaaagtgtgttaaatttagttactcaagaatttaacttggaagctggtcatggcggtgtgtgcctgtagtcccggctactcaggaggctgagacgggagggttgcttgagcccaggagtttgaggctgtcctgggcaacatagtgagaccccctctctaaaaattaaattaaaacaggaaaagaattaaacgtgaagatagacgatgctggtgactgccatagcagtttcgtgccacagaccttggagtactttttcagaccttggagtttctaagcacttttgggggaagtgttgattgtttgatattatggttgatgctgtaaccaaaaagggacaataagagcataggacagaggagcttggctggttaatattccccgacaagggaatgtagcgttattgagtttgcccaaccctgagccattggttcttcttagggtctctcagttgacaaggtcctagggtataaggaccttgtcctatgtaatggcataattacttagcatttatttatgcatctagtattgcaagggactggactggggatggaaagggattgtgagctgggaaaaggcttcatttgctttatggtgctatgctaaagttctgctttgctcaaggagtgagtcttggtttacattttgggtagtgaatcagcttcaagtgtggagttattttcaatgaagacagattgactagctgcacctggtctggcctgcccactatgacccagtggtgctattttgttctagccaatgctttcatgagaatggagaacaaggaggcgtcgttttcatgagtattttgcaacacccacttctccagtttattttgatgccgttgcttgaaaacaagtgttagcatggctttcattggtaacacttttagggaagagatcatcacttttggaaagttttgtttcttgaat

SEQ ID NO: 102036 - DNA, 1900 bp, Homo sapiens
agcgaggaagaggttgacagatagtttccactatgtgagtaattttaatttttttatgctacatggtgggcacgtgggtgttcattatattcttttcaaatatatgttgtatattggaaatactttctagtacatatgaaagaaaaggcagccaactgaaagtttggtttctgtttttctgcccttcactccttttcaatagatgtttgggagttaggtctccactgaatgaactacccacgtttctgtccttgaagggctggtggggggcgcttatgtaacattgctggccttttatatcttttaagaggcgctgcttttttgccacgtgctgtagaaaattatttgacaagcactcacgctttgtgcagggtgaccaggttcatccgtaaaatggttaagaccttttcgaaatacattgcccccaaggatgtggtggggagggtgctgggattctgagtgacagccggcgaatgccagagggaagaattaaattggagagggaggcggagaggagggaggtgatggtgggaggaggaagggaggagcgaccaaccctctccaacacacccaagtgaccagattcatcatagcacgaaacttcacaagttacacccactgcctccgccagcagccggggaaggctgctgcttcctcatttctgttactggaagtttgggacatgtgaagccagacggggagaaacgtgcgcgccttgttgagcagcggtgagcttgaattttgaaatcgattctttccaccggcgaatctctttgtgtcgggtggtcaggggaggcagccgaatgtggctctgaacgaggataggtgagagccccgagctgagctgtgcagctggggccggggaaccgtgcgtcccgtgccccttcccagaacgagcaagcgcgtctccaagctgcgccccgaggctcggcgcgcgttgccggctgagctgcaggggacggcggcgacgctggttctggctccagggtaaagagattcgggctttgaaagcgtcatctttcccccttgacttctgtaagcgaggatcattgtatgggatatggggtcggggaggagactgcgggatcacgtcacccacccaggatgcgtcctgcccggggctgtcccgctgctcgttgggtaattgcaggtcagtgccattgaaaaagaaccccatgacaggcttgggaatcaagtgagaaaaaagttccgaaggaatattcagaagctgtggctcccgaccgcacctggatgggagttctggagtgggacgtcggaagtctcggggttctcattaattttacatctgattaaattagttcgactctaggttcctggctgtggaggtgtgatttgtttatctggatcatttttttaaatgtctgtctttctgtgaaagctagcttacctttggatcgattgcctaagtcaattttgtgagaggaagtttgggtggaaggtggtgctgggggctgggatcattgcaagtggcagtatgtcccagcaaaggataaacttagctcaaatgaggcttctcacagacaggatttaggttttatttcaagtctggagctggtcactgggcttccatttggcctgtgtagcttttgctcagtgtgtaggggtcagagggaggctattgggttaactgttacctgttgcacttgtttcatacctgatcaacaacttaatagtacaccagcagctggagctggtttttgtttttttgtaagcgaatccttcatgagaatgtttacagaatcatcttactttgaggggaagaaatgaaggtgaaaaatgtgtggctcctgttgtatttatagcaagccaaatgttctttcccaggtctggggtgggtacaatcaggaaaatgtcagtagctgattttatcatttttctt

SEQ ID NO: 102037 - DNA, 1060 bp, Homo sapiens
ccttggattttagggaatttgccacacagtccctgcaatgcattctggaggtggtgtttaaaagctattagagtttcctggcctctttttggctggccctgtattttttaagaatatctctatgtatttgttaggtattctgttttcagatagagaaaactatgtaaagagtctctaagtttggttggcataaggtttactttgaagttgtaaaacattcttgtatcaaatcaaatttaatgaagactgtgttttaaaactttgcctagaaaggtgaaccttgtttgtctctcagagaatagaaagaccccatccagggctgaaacaagtgtttgcagtgttttcaaacatgtccgtattcccaagcagaccctcagattacctagcatgggagtgtgtgggatggatccatatttagacctttcatcagtttcaaatataaaaaattgattttggcaatccgttggtagtcaaccacaaaatgtagttatgaaaaaccttctgcatttccatagcagtccaaatatggattccattaacaggatgcatatttggaactgcagttatgctgggaaatcgtgtttggattcaggtaatttgacggtgttgacacccctgttgcgtatcacctaacacgaggaggaggaggagactcttccctggccttgctgctgataacattgttgctaggtgacataggtgaggacgcgttggtgccagcacttcttaccttgtttttgttctatgaaggcttgaaaaggtggaggtaagctccattgtggctgatggcttcaaattcgcagatcttgaagacaccttgattcctgaccaagttggttctggagacccctgaagagcaatccagaaaatgcttgcttttggaagtcatctctgtcactgagaatgcaatttgaaaggaattttaaagcccagctattgtagatctaatatatagagagagagagtgagcaagctaaacacttgagttaaaatttttggagagaatatgcttaaataaactctccatacgttttcatttctgagtgtaaatccacttgac

SEQ ID NO: 102038 - DNA, 1983 bp, Homo sapiens
gtatgtgccttttgtactaggttggagcccccaaattatatgtgcatacactgcattgaatgttcattttatggacatattttttaaaggaggtaataattgagtggaacatacagcaagtttatttctgttgacctgggtactgggctgaagctgtcatggttttattatgtgagcttgaacaagtcacttactccttctgacttcagatgaatgagtgatttataagacctcctttcttctcttacatatagaggtctatgaccctaaatgtgtcacccctatgttagaccctttaatattttgagatacaggtttgtcgtattctctgattgaaagtaacttgtacatgtttggttttcatttacattagggaagatggcagcaagtattcctagagtgaaatcaaatgcctatgttagtggaagggaacacaagacaagtggattctcatcaacacgtttccctagccattattcattacaagtcacctaattttaattgattttgtgcctgtggttagtacaaaactctgtaaggtgtcatgtgttacaagcaggtctataggtggggtccttttcacttcaccatcctacccctgtgctagatgtctcatcgtgtattgggccattcttgcattgctataaagaaatacctgacactgggtaatttataaagaaaagaggtttaattggctcatggttctgcaggctgtacaggaagcatgatgctggcatctgcttggcttctggggagacctcagaaaacttacagttatggcagaaagagaagcaggagcagacatgtcacgtgccagagcaggagcaaaagagagatgcggggagatgccacaaacttttatacaaccagatcttgcgagaactgactcactatcacgagaacagcaccaaggggatggtgctcaactctacatgagaaatccacccccatgatctaatcacctcccaccaggccccatctgcaacaccaaaaattacaattcagcatgagatttgggtgggtacagatatccaaactatatcaccttcttagccagcgtcattctccactccctgccccagtatgttttggccccccaaaattttaaagtgacagttactgtatcttagtataaaataaaaatcaaaatgattcccacccatgaataccattaaataccattaaattggttggacctggttagtgtcgggcctttgtggctcactgcgtccaccctcacaagggtggcctgctacttccccacagtagggactctctggggaaggcttagggctcaagagggtgagccctctgtgaccccattgggaaggacctccattctgttatctgacacgtaactagtgccagaactgtactttttgccaaaatagcaccgtcaatgtgaaaacattgagaacattataaatgctaagatcgtttaagaaacagggttggcttatttcctgattgaaaattgtcttgacatgtttagtgcccattcgcccatttagagacagtgttgggcatgtgcccagtccaaagcctgttaacccatgcattccattgccaataggcatctattattttaagttcccactttaccgaagggtaggcagagggacttgctctgagttactcttctggttgtcgctggaccctggacttgaaccggctcttctcattttgtatccttgcttctctcatgacccaatgaggcctccccgatgggatactccctgacccagctttttcaagaggctatactggggattataaagctatcctggcattctttgaagaaatggcaggactgaaattagaacttgactttttgtcttcttagttattctatattatcttacttctagtgccaataacaattattattgtttattgctgccgagcagggaggtatctgaaaggtcccaaactaggaaaaacttcgatgcttttaccccccgtgaacacatgcaccatttgtgc

SEQ ID NO: 102039 - DNA, 1079 bp, Homo sapiens
gaggttggagagagctggggtcccagcctcacagagactaggttagaattttagacctgcctcttacttgttgagtggctttgggcagttcatttaacctctccgtgcctcagttttctttatctgttaaatgggtctagtaataagtagtaccttgctgagctgtcatgaggaccaggtagaaaattgaatgagcagcccctagcctagtggctttcacagagaaagtgctcaggaaatgtcagcaactcattgtcatcaaagttgtcttcacatagttttatgagggaaatgctcttattcccattttacagatgagggactgaggctttatgaagattaagggataggcctgtgactggaagaggaattcctggctgacccgcaattctcacttagactgcctggcacccctgcttacgtcttaactgctgaaattactgcgagttgagggtacacctgaatgtggtcagttaacatgtgtaacatttaatatttacaattaagaatttgggtttgattcatttgccccactgttagggttttggactcatatctgaccctttttggtttcttgatatgcgttgaaatttggggttgggatgggttggtggaagcagctgttccctactgctgtgcctccagcatactgtgcaagggtgtgccttgttttatcttcataattgtgaaagatttaccttgataggtgaggcaatgtcattttatctcttacaatcagagaaaatcacttatctgggcgtgtgaagatcatggtgatatgacaggaagagttggcttattggaaggcttggttaatgtgtgtaaagttttgattacttttgtttttagcagcaacttttttttttttttttgagacagagtcttaatcttttgcccaggctacagtgcagtggcatgattacagctcactgcaaccttcgcctcccaggttcaagctattcttgtgcctcagccacccaaatagctgagattacaggtgtgcgttaccatccctggctaatatttatttatttatttatttatctatttatttttaagtagagatgaggtttcattgt

SEQ ID NO: 102040 - DNA, 2222 bp, Homo sapiens
tgcaaaggagagggagaaagcagcaaattttcatagttataatttgatgatgtggaggagagagaggaaaattgctaaaacattgcccttgagtgagcaaggggtggagattggacctcatcacaagtggaggggttggctttagagaggagtatggatagttgtctacatcaacaggcagaaaggtagagtgtatatacctgcatgcagatagatcaccagagaatatatatagtcttagaagtttgtggtagtcctctctgattgcttcatttttctcagagaagtagaacaaaaggtcatcagatgggaagaaattgttgggaatctggaaggaaagcagaagacataaacttcgtgagtgtgggtgagggaatagacagagaattttggtgtgattgccagtggcatttaaggggacacttgacattaggggtcaggaatttaaagtgagaccagccaacatgtttgcatgctttcttctgttttctctagccacagtcagctgtctgggtacaggtgtgaactgggcagtctgatggatttaaccagatgtttttgccaaaaggatatgaccaagtaaaagatgggccagggagttgagggagggaaattaatgacagatgatggaatctacacttctcttttaaaaattttaaaaatgtttattcattcatttattttttaaagatgggctcttgctgtgttgcccagcctggtctcgaacccatgggctcaagccccatcctcctgtctcagtgtcccaaagtgctaagattacaggcctgagccactgcgcccagatggaatctacatttcttaaggaggagcatgaaatatcgaagctatgaagggattcttggagtgtgtcttattccattggtgctgctataacagaataccacagactggataatttataaacaacagaaatgtatttcacagtctggaggctgagaagtctaagatctaggcaacagcagattgagtgtttagtgaggggctgcttcctctggacagcgccttgtggctatgtccttacacagtgaaagagatgaatgaactccgagacctctttttaaaagagcactaatcccaatcctgggggctccgatctcatgatctaatcctctcccaaaggcccccaccttagaataccatcactttgggggttaggatttcaacatatgaattttgaggggacacaaacattcagaccctaacagagtatgagattgagtggtctgaaaagatgggaggtgtgagctgtgggggggatgcatgacaatgatggcatacgggcaattggtatctttaccctttattattaataatctgtgtatttcagagatttggcatgcagtgtcttgaacatccttagtgaatgtataagttgaaaactccaagtgtttgtgtattattgacataaatgtctatttctcctattgttccttatttctttctttgctgttaaggattcagaaggaattggttaaaaggactttttttctatggttaaagaagagacctcagacctgggtggttttgatcatgcttcttgtcttgaattatcatctcggggtaatgaatgaccgttattcaaatcatgcaatatttgttgagagtctaccacgtatgaagccctcttctaggcacttgcaatagaactgtgagcaaaatggataaaagtgcctgctcttgtggggcttatgttctagtggaggagagaaacaagaaaaagagtaaaataagaaaatattcagcatgtgtacaaaggagagaaaaatagccgggcgcgcagtgctcacgcctgaatcccagcactttgggaagccgaggcgggcagatcacttgagtccagcagtttgagaccagcctggccaacatgacaaaaccctgtctctactaaaaatacaaaaattagcccagtgtggtggcacgcgcctgtagtcccagctactcaggaggcggaggcaagagcattgcttgaacctgggatgtggaggttgcagtgagccgagatcacatcactgcactccagcctgagcaacagggcgagactctttctcaataaataaataaataaataaataaataaataaataaataataaaggagagaaaaataaatcagggaagtaagaaaggaaatgtgccagggatgaggggtggaggtggtggggtggggccactggccaggaggacaccttcattgagaaggtg

SEQ ID NO: 102041 - DNA, 1029 bp, Homo sapiens
tgggtgggcagttctgggaggtaagcggggtagattagggtatagtgatgagatggtaccatttgaatgaagactaaaagaatataaagaaattagcagcctacctggaatgttccagaaagagggagtgtgtctggaaagttcagggaacatcgaggaggccaagtgtggcttcagtggcatgaacaaggggagaagcagcaggagatgaggacagagaagtaataacgaggccagaggggtgatatgctttgtgggtccctctagggagtttggcttttaccccttgagcggaggaatgctgtgatctaatttatactttaaaaggatccccatggtcctggatgaggatggattgtagaaggacaagagtggaaacagggagacttgttcagaggttttgtcgtaatctagtagagaatggtggctcggattatagtggcagcagcaggaaggggtgagaagagatttggattggcacatatttggagagtggatgcaacagaattttccgactgattcgatgtgggatgtgaaaggaaagggaaggcaagtatggcaccaagtattttggtctgaatagttgggagggttcaattgcccttagctcagctgggaaaggcacctggaagatacccagagggtgtacgtgcacagtgcggtattcgattgtggagtctaggggaaaaagcactggctagagacatgcattgggagttgttagcatgtggaaagtattcgcagtcatgagaccggaggggatctccaagagttgtaggttgatttctccagaaacaggcaagaagacggcatttagatgaactgcaaaagaaagaggaagcaagcaggaccgcgtggagaagtcaaacagtggtgtagaacaacctggctggaagctctggaattaatactgcccatcatccttgtcctgcagaggctgatatgaccagtcctttatccctgcctcattcagtcaccagatatggcctaccctgggatgccgccctctgccctgagacaggtcctgca

SEQ ID NO: 102042 - DNA, 1060 bp, Homo sapiens
aaaaacctcaggattacccatagctaccttggattgcaaagtctaatataaattagtactttgaagccttcctagataatacaaggacattagccttcctagataatacaaggacattagagtatattaactccttttattctctactggattataatatatagtaaatttttttctttcatactattctaaacatctaagacattattgttaattattattattattattatacttctgtccgtcttaaattatctttatttctgctgcatatagaattctcagttggcggtgattttcttcaaacacttagaagataccagttcattatcttctggcatctgttcttgctgagaagtcggctctctgcctaattgttgcttcttagtacaatagctcatcagtctccttcttgttgcttttatggtttttctctctgcctttggctttccagttccactatgacatgtctaggtgtaaatatatttttatttattctgttcagggtttgtaggacttcttgaatctatgggttggtatcttttttgcattttgggaaatttccaacctgtatctcttcagtccagttctcttttttcttcatattacatcctttcattgtctttcctccctccctcccttccttccttccttccttccttccttccttccttccttccttccttccttccttcctttttctttctttttctcttttgacagagttgtggactgtctcccaggtggtgtgcaatggtgtgatctcgacttgttgcaacctctgcctcccgggttcaagcaattctcctgcctcagcctcctgaatagctaggattacaggcacccgccaccatgccctgctaaatttttgtatttttagtagagacaggatttcactatgttggctggtctcaaactcttgactttgtgatcctcctgcctcggcctcccaaagtgctgggattacaagcgtgagccaccatgcccggccctttcactgtattttctatgtctcctaccttctctttctttctttgttttatttttgtccctttatgct

SEQ ID NO: 102043 - DNA, 2029 bp, Homo sapiens
aaaaaatacccatcagagaactcgatgtcctgttctgtagggcatcctaatcagaaaatacaatgataaacccccttacagtgtaagtaagaatgagagtgagcgctccctgccctaaggggtgatggactagcattgctttaaaaataattgttggctgagcacagtggctcatgcctgtaatacaagcactttgggaggctgaggtaggtggatcacttgaggtcaagagttcgtgaccagcctggccaacatggtgaaaccccatctctactaaaaatacaaaaattagccgggtgtggtagtgggcgcctgtagtcacagctgctcgggaggctgaggcaggagaatcgcttgaacccgggagctagatgttgcagtgagccaagattgcaccactgccctccagcctgggtgacaaagcgagaccttttctcaaatataataataataataataataataataataataattgtcactgcattaatgggtaatggatctatgactcgtcatgaagagaaaggcgaaccttgggtggctggtttgaatctctgggctcagtgtgggataagtcagctcttcccttctcacttactttctagtgcccttgggctggaattgtcatgtccataactcatccagtccagtgacaccagagagagagtgaaggaagagggtggatgcactgaactcactcttatgctgccttcattttcaaataaagtcacagtaaagagtatatctttttttttttaaaagggatagggtgacagctccgtcacccaagctgtagtacagtggcacaatcatacctcactgtaaccttggattcctgggctcaagcaatctctctgtctagcctccctggtagctgggactataagcatgagccactgtgcccagccaaggaacatgtttttatgtcagtcatatatgtatacttgcatgcacatatatgtgtatgtgtatatacacttacatgcatgtatatgtatatatgtgtatatgtatacataccaaatgtatacacatgtctgtctatctatctatctatctatctatctatctatctatctatctaatctttcttcctcaaaggaatctatgataatatcatctgctattagtttaatagttggaagaggagaatgtcttaatgaactaagtatcacctttagttgtcttatctgtcattaaatgtgttactcattgggcttttgagtggtttaatgaagcagtgatatttatacaagattttatatctatagccaaaatctaaaaggctttcttatttgggaaggggttactattcagtgggaaatattcgtctacaggatagtttatgtggattttataactcttcttaaattgtgaaacatgccacacattcagaacagtgcacaacacgtgactgtacagcctactgggtaatgtggccatcaccagctcgagaaatgcaacattggcagcccccaagaaagcctcccctcccatcctcaatcacaattttctccctgcctcctaaagataacaaccaggcttgatttttatggaatcatatttttgcttcttgtctcacatttagtgcttgagtgtagattcttaagcactgtagtttaattttgcttgtttttgaactgtatatcagtggaatcatactttattaagtattctgggtctggctttatttcctcaacttttctcttgggtgtagctctagtttgtacactttaattattatacaatttcatggtataaataggctataacttcataatccattctactgctggtgatcatttggattagttccaatgtttgactattgtgaatagtgctacaatggactttttttggagataccttccccagcactcatgtccatgtgtttcttggggtgtatttctagaattgaaattgctgatttttcatctttactaaagtgcctgacccaattacactctccctagtaggataagggagttcctcttgcattatgccctcagaaaaccttggtgttattagt

SEQ ID NO: 102044 - DNA, 1050 bp, Homo sapiens
tacagaactcttattaacaattcctataggtagagctgctctttcctctccatctgtggctgatgtctcagtgctttctcaattctaccatcacatgctcaaatataaccttctccactcccccacacccacttcagttgctgggggctcattcattggctccctctgcggaggcttgagtgtaagtgaggtattcagcagaggtctttggagggtttctcatttgatcacaatcttagtttgagaaatggtgcctcattcattaagctgtaagagagctctctacaagcaattttatttttaagtagccctttggttaacaagtttactccacctgggatgctttttatttttggtggcccacagaaatctgaaacagtgcagtgctggggcctctaatctgtctttaggaacgggggatactatgaagctcaccatgcagttacttaagaaagctatcggctagtgctattgtgaatgtgtttttaccttcctgtaaaatgctgaaatcacagactttattactaggataatgaagaaatgtataagttcaatgcaagtgacaccagcaggcctgtgtgttgggtagagatgtcctggggctgttttgctctgcacttttcctcatgggtgtttctttcttgaaattgaacaccactgatctctcttaaagcaaaatacttcagcaaatacacaggaagaaccccctccccctttttttcctgtggtttcattgcatgttgtgtggtttcagagatacttccttgggttgccccccaaccaaccagagtttcctcagaaacagagagctttcttctggaagaactctaagattgtaatctggatgctagcaaagcgtctgcagctgctccatttttaattcttaatttgggagtgatcagcagtttcacagaagagagaaaaatctaagacattcatcgtgtgatcattcagcatttggaaaagggaaaaggaggattgaatgaggtaataaacaagggtgttaatcaaggagaagacatgtaaggtgcagttttaaaagacatcatt

SEQ ID NO: 102045 - DNA, 1107 bp, Homo sapiens
gcgtgagccacttaacatttattgtttgagacaaagtctcactatttcgctcaggctagagtgcggtggcgtgctccaactgcaacctccacctctcaggttcaagcgattctcatgcccagcctcccgagtagctgagattacaggtgtgcaccaccatgcctggccaattttttgtatttttagtagagacagggtttcaccatgttggtcatgctgatcttgaactcctgagtcaaatgatccgcctgccttagcctcccaaaagtgctgggattacaggcatgaaccaacataccctgccagttccataattttagtacatttataaagttttgccaccatcctcaaaattgttcttaggacagaagaaactctgtacccattaccagccatccgtatttccctccagctcttctcacccaatccccaaccccaaccatttaatttgtctccatagatttcctgttctggacattttatatgaaaggaattatgcagtatggagtcttttttgactggcttctttcacttggcatgtttttgaggttgatctttgttgtattgtgtctcagtacttcatttctttttattgctgtgtaatactctattgtatggctgtaccatattttatttatccactcattaattgatggacatttgggttatttttctttttggccataacagctaatgctgctacgaaacttgtgtacaagcttttgtgtggacatacgttttcacatttttttttttttcttaaggactgggtcttctattatccatttggagtctagagttacttataacttgcctagagtccaaccttgggtgattctttggctagggcatagtgcagtgtttttggaagcagaaattattcattgatgttatttcattaatgtcactgtatagtcatcccttggtattcgtggggaattggatccagacctctgctcccccacagatactaaaatccatggctgctcaagttccttatataaaatagtgtaggccaggcgaggtggctcatgcctgtaatatcagcactttgggaggctgaggtgggcagatcacctgaggtcaggagttcaagaccagcctagc

SEQ ID NO: 102046 - DNA, 2375 bp, Homo sapiens
aatcccagctgcttgtgaggctgaggcagaagaatcgcttgaacctgggaggcggaggttgcagtgaacctggatcgcgccattgcactccagcctgaacaataagagcgaaaccatgtttcacacacacaaaaaaagacagcatgaagccatgtggcatctcctatgacccaaacacctcccactagcccccacctccaacagtggggattccatttcaacaaaggatttagaggggacagcattcaaatcatatcagtgtgtgtgtgtgcttgtgtgggtgtgaggttactttacctagtcctgatgtcatgggcttaatgtgctactaatacattttttaatacacattgaaaaatagttataactgtaaagatgaaacatggttttccatgtaccactaaaaatggtttcctgttccattagtggtatgtgtagcccttctgtgcaaccctcttgggtctccactgacagctcttgacctatttgtgggacttaaggtaagatattttgtagattctggtttttaaatttaaagcaaactcaagctgtatgatcctgaagtacaagagacgatacagaataattcaaggaggttgggaaagctttctttcttttgttttttagagacagggtcttgctttgtcacccgggctggagtgcagtggtgtgatcatagctcactgcagcctcaagctgctgtgctcaaacaatcctcccacctcagcctactgagtagctgggactactaatgcgtgccaccatgccagctaattaaattttttttttttttttttttgtagagatggggtcttgccatgttgctcaggctggtcttgaactcttggctgcaagcagttcttctgctttggcctcccagggaaaacatttttaatttgggtatcttcccccttgatctttgacattttttttttcatttgatgatgtgtttgcttgattacttctatttccatcctcttcagatgttatatatttccttgagtatcttaattgccttatttgttcattaaacttacgaggtgcccagtcccctgcttgagactggaagtgcatctatgaacaccacaggatatgtggccccagagtgcgttacaagaatatggtcgtcagccagcaaatgtcttcacctgctctacttagattttagcaatttgcattgctcctgaggtgctcgattgcatatgataatttggaaacagcaggtcccagcagatagaggagcagctgtcagatctagaaacctgtccattggcccagattgttctgatgatttgcagcataaccttggaaacatcgtttcattttccgttccaggttttcactctggaaagtggaaaatcacagcaaatgaagctggtcttaaagaaatcgagtgccccacatactgtaatgagctcgcttttcatttctcatgcctaccttgtttacatggacacgtcctgttggtgtgtaaccttatgtagtagatagatacaaggtatggagatacatatatacgatgtgatacctgtagtcccatgtagatacaggaggttttctttcccaaggcatgtcaggaattgtccgtggaaatgacagcctgaaagagataggtgtacagtgttggtggacaagccagtatcagtttggcgaatctctgaaagcccattttgagcctgtttgtaaggttgagtgaaagaactgttgaagtgtgaagaggtgcctgggaaaggactcatcctaccaacttttgagttcctggggagtgggatatagcctagggtcgggtacataataggtattcaatgaacatcattttgcacaatccttgtaatgcttagtggcccctggcactcagagaatcactgtatgtttagatcatgacagggctgggattaaaagctttactcttttaagtattctgaatttatggaactattatgttttacacttttttttttgagagggagtcttgctctgttgcccagggtagactgcaatggcacgatctctgctcactgcaacctctgcctgttgggttcaagtgattctcctgcctcagtctcccgagtagctgggattacaggtgcccaccaccacgccaggctaattttcatagttttagtagagacggggtttcaccatgttggccaggttggtcttgaactcctgacctcaggtgatcttcccgccttggcctcccaaagtgctggggttacaggtgtgagccaccacgcctggcctatgttttacacttctaaaagatattgataatattgagacatctagtttaaacctaagtgcataatggtaattcgccaaggtgaaattgattacttttccatattgaaggcataaaagcatacttcttgaac

SEQ ID NO: 102047 - DNA, 1069 bp, Homo sapiens
tccattagtgagattctcaaattgctttagagaatatagaaaaacaagaaagttggagtcctgaggttctgttctcctggtgattggagagaatctaaataataccttgtttttacatcattaattatttaatcaaaactgaaaacattatgtccataatactgcatccacaaagtgggtactgaggaatgagtaagtataaattctccaaaaatctctcacgttccctcattcttgcttaagaaagtctttgtgctttctaaaaaattcctcttaatagattttttaaaaatatatctttaaaatgaggaagccatactgaaaagtgatatgttccaaggctttttcccaccactggaaatattcctgattactgaatgtaatgaaataaatttgtcatgttggacataatgtgtggtggagtgcagaatgaagagcccaaaactcagagtggaggcttgacatttatagttataaatatgtgctttaggaattgatttatatagaaaaataccagggctaagatagataaattgaagcttgttctcactaagtaggttagacagttcatcaaatattggttaaaatctttctctctctagaggttgaaaataagagattaaatggtagtatccaacgcatgggactttgattgtctagccgaccagtctgttcaaatgaatataaatgtagttgggcagcctgtgtatgcctagtgtgttgtagcatgtggctcagcaacctagccggccactgccttgttttgttgcttaggctaagaatagactttatggttttaaatggttgggaagcctgggggcggtggctctcgcctgtaatcctagcactttgggaggccgaggcaggcagatcacctggggtcaggagttccagaccagcctggccaacatggcgaaaccctgtctctactaaaaatactaaaattagctgggtgtggtggaaggcacctgtaatcacagctactcgggaggctgagaattgcttggacccgggaggcggaggttgcagtaagctgagatcgtgccactgcactccagcctgggtgaca

SEQ ID NO: 102048 - DNA, 1049 bp, Homo sapiens
cttttgtgctctgcctgttcatccctcctttcccccatctcctggcagccactgctcttgttactgtctctatagcttcaccttttccaggatgtcgtgtagttggagtcatacagtgtgtagctttttcagatgggcttctttcacttagtaatatgtcttcaaggttcttccatatttttctgtggcttgctagctcatttcttctcagtgccggataatattcctttgtgtgatataccattgattatttatcccttcacctgctgaaggacattgtggctgcttcctagttttagcaattatgaataaaattgctataagcattcacatgcgggtttttgtatgcacagaatataaatataaatgtatattcacataatatataaatgaaatttatttgtttctgattatgaaaaaacgtgctttattgtataacatttggaaaatattaaaaaaagaaaatctttaagaatcagtataagcctatttattaatttaatgtaataagatacatgaaattggaactctcctggaaatgcaggccatatggttattatatagtataacagtcagtggtaaagacaggaaagatttagggcattctgagtgctggttctgtttccattaaaaccactccttaagtgactttttatgatactccacattcaaacagacactctcagctttagaaaatggctatttagcagtcctcacaaacaactgaagtccaaggaggtactgaaattcttctcttaaaaaattcagatatactttagccatggttctcagtggtggtggagaggattcccgacattcatgtggaatccagcagtttggacacacacaggttttataaggctcgatgtgactgcattcagctctgggagcctccatgtctcttgggcgtgttctgggtgcagaggcagaggatgctgctggggaggacagggtggtgttgagctcatggaatagtaatgcctcaaaagcagcctcagaagtggacgtcagtggacagcctgttgcattcgtttttcatttttaataat

SEQ ID NO: 102049 - DNA, 1001 bp, Homo sapiens
gtctcagcctcctgagtagctcggattacaggcatctgctaccaggcccggctaatttttgtatttttagtaaaggtggggtttcaccatgtgaagccaggctggtcttgagctcctgacctcaagtgatccgcccaccttggcctcccaaagtgctggcattacaggcatgagccaccgcgcctggcccaatattttgttttatattaatattattaaatataatattgttataattgataatataattgatattatataatatttcatattattatattaattttaaacattttacatttattattattattttttatatttattgaggaccaactcagagccagacagtgtttcgggagctacagtggggcaggtaggagaataaacatggagggggtgataggtatctattttagacagggtggtcagtggatacttctcccaggaggtgtgatcctgaggtctgcgtggagggagagaccccgtggaaatctagagaaagagcattccaggcagagggacccgcgaatgtattgaagattggcaggaggcatgcgtgggaaaggcaggaatggggcaggcgccgaggtcacagcccaagtcacctgcaggagcgaggttcttgtttggattttgggcagtaggaatcggcataagttgaaccacaaacaagcccctctactcctcttaagagactttgttagatgtgttttgcagagaagatggaaaataatagtgtatctgttactttgattacaattcccatcatataataattaactgctagctgtaattataagacttcctctaatttagtttagcactctggggacctctgttagcctatatcccaatcaatttcacagccattacggaggaaaaaagccatgttcctgttgaattttaaatctagaggaagaatgatgccctcatttgctagacagccttattttgttttcgctccttgttttctttctgttcaggccctccctactggc

SEQ ID NO: 102050 - DNA, 1031 bp, Homo sapiens
tttgtttttttgtttgttttttttggtagataggatcatatacagctgacagtcaggcttctctgacttatatgtgtgagtgagtgtatgtgtgtgcccatacgctatcaggagcccttagaaatcaatgaaagtgtcaacattctctgaaaaaggtctgttttccaaggcaaccatgaagttagctttatttgagttaggggaataaagaaaacttgtgagagacatttatgagctggtatattggctttgatgatccagggaaaggcatgtctatttgtgcagggggccactcatttcgcttgtatcaactcaaagtcaaaaatcttaatgggttttaataatgctaaatgtcatattgaatttaagcttggaaaatttcagataacacctctttgtaacagctatggtttactcatctcttgggctataacatatatctcaagacacaaaatcctccattttagaaatgttcacattttgcaacctttgctgtgagcaatagaaacttttggggcaagctcttttagatgaagaaggtatttccccccacagtggatgcatacaattcattctgtcagcctgaagaagcaatttcctttctttgccttgggatttaaagcaataatgtattgtatataattatttaatttagttgacctaaacgttaatttattatttttaaaactttaatagattgtaatatatcttaaatcaaaatcggtttgaaatggcacgaagtatttaaggatattctcatataaattttaaagagagaacttatccaagccaatattaaaaaaaaataatttccttgctttatagacaaattttagtatatctcagggggcattgatgttatatctaaaatgtcaaagtaagatttataataatagaaatttattactctttattatacatagtataaatgagtaaagcaaccaattccgccttgtggaattaattttggctttgctgtttctttttagtttctggcaaaggctatttttattttattttatttatctatt

SEQ ID NO: 102051 - DNA, 1667 bp, Homo sapiens
caatcctcttgcctcagccccctgagtagctagggttccaggcgtgcataccaccatgaccagctaatttttatattttttgtagagatggggtctcgctggtctcgaactcctgggctcaagcgatcctttagcctcagcctttcaaagtgctgggattacaggcatgagcccaatcttaattccaaatttttaagtgagagtctgtttggccaatactgagtcatgtattcacttagcttctgctgggatgcaagggtgtatgtatgatgggtggtctcagacttgcccaggcaggctctccaaaaggtgggattgttgggaagcaatgattgacatggctgccatatcccaatagaggaacagtttaccattgtttatattcggctctaggctacaataggagggcagggcccattttttcttgcctagtgttagcttccagcttttcccagttaaaatttcaggtctagacagtagaatgaggaagaggtacagaagtgctggagtctatctgtagctgatgaagagctggttactaacactgactaggggcagaggtcattggatacatgacatcaccaatgaatatttagtttaaaaaatactttcattcatgcttttgaattaacttagtgcatatgaattcatcttttcatatgcacttgtttactttttgagttcctaacttcgacttaaaaaatgcagactcaccctgcagtgattccactttatttatttatttattcatttatttatttattttgagatgaagtttgctcttgttgcccaggctggagtagcccaggcaagagtagttttgctcttgttgcccagcctcctgagtagctgggattacaggagcctgccaccatgcccagctaatttttgtatttttagtagagccggggtttctccatgttggtcaggctggtctcgaactgccgacctcaggtgatccacccacctcggcctcccaaagtgctgggattacaggcatgagccactgtgcccggccgggattccactttaatagtcaaggacttctgatgtgtgttgaagtcactggatgacaggaatacagtaaccaaatggtaaagacagagaagaggactgggcaagacctaaaggcttctatgccccactaaccagctgtgtcactttggtaacgaagttctttgaatttcagttccttatctgtaaaatggggtaggaatagtacctgtctcatcatgtcgttgagaggattccatgagctaaaatccattcaaaggcactttactaggcagttgggatataggagtgcagaaaatccacaaagatcttgctctcctggagtgtatatttcagcatgtgctgccactgctctaatttataaatcagaaagtgtggtgtctggccgggtgcggtggctcatgcctgcaatcccagcactttgagaggctgaggtgggcagatcacctgaggtcaggagtttgagaccagcttggctaacatggtgaaatcctgtctctactaaaaatacaaaaataatttgccgggtgtggtggtgggtgcctgtagtcccagctactcgggagctgaggtaggagaattgcttgaacccagggggtggaggttgcagtgagccaagatcacgccactgcactctagcctgggtggcagag

SEQ ID NO: 102052 - DNA, 1004 bp, Homo sapiens
agtcatgctgccttttgggattcggcatttcagggatgttggcagtggtctgtgattatgagccctgcacattagccgtggtgctgtgagcccctgtcttcttggagacgtacaggaagatacattgtttagtcactttttctttttgagacggagtctcactctgtcgcccaggctggagtgcagtggcatgatcttggcttactgcaagctctgcctcccaggttcacgccattctcctgcctcagccttccgagtagctgggactacaggtgcctgctaccacgcccggctaatttttttgtgtgtttttagtagagacggggtttcaccatggtagccaggatggtctcgctctcctgacctcatgatacccccgcctcggcctctcaaaagtgctgctgggattacaggcgtgagccaccacgcccggcctttagtcagtttttctaacggggagaaactgaggggggaaatactatgttcttgggatcttttggttatgatgaaatgtgaagaagctctctcaagtgaactcatgcaaaaatggtgttactgaagggatatgggaaatgtcgtggacggccagggttgtgcgggccttgtaaagcaggaaaatcaggaagagacgttggtcctgcatctctcagaggcccccatagtgtcaatttttgcttttctctgcaaggttttgccattttcttgttcctacttgcagactgactttcttggttggtctctgacgacatctcagatttactgcttaccaaatggctttgatttggtgcaatgttgctctagtccaatactacctgacctttcctctaggtaactgtcttagtctcacagtgtctcaattccaattttttgttgttgttgttttttttgagacagagtctcactctgtcgccaggctgcagtgcagtggctcaatctcggctcactgcaatctccgcctcctgggttcaagcgattctcctgcctcagcctcccaagtagctgga

SEQ ID NO: 102053 - DNA, 2081 bp, Homo sapiens
tacagcaaaatttcaaggagccttttcaattgcaagcatgcaaatttccaaagagctcttacttccttctgtgggcacattggacaggtcagccattcactgattccttaaatatccttaaaaggattgatttaggctgggcccggtggctgacgcctgttatcctagcattttgggaggctgaggctggccgatcacctgaggtcaggagttcaaaaccagcctggccaacatggtgaaaccccgtctctactgaaaatacaaaaaaattacccaggcgtggtggcgggcgcctgtaatatcagctactctggaggctgaggcaggagaactgcgtaaaccagggaggtggaggttgcagcaagccaagattgcaccactgcactccagcctgggtgacagagcgagactctgtccaaaaaaaaaaaaaaaaaaaaaaaaattaagagcaaatgactcatttgaaaaggacagtattgaaatccttaaccttagaactggagcctgctcccgatgggtcgagccacggactttcttttggttttaaccagggtatccagtggctcacctcagcaccagtggtagcagtagtgcttgggagaggaggttgagacttctgggtcttttagagctatgtttatttacaagttgttgggatctttgccgaggtgcttgagccgcttcttcgtgtttcggtcccaccatctgtgaactccactgatggtgtgtaaattaataaaatgctccatgagcccaggatgagagactttggaggtgccaagaggaatcgtaataaacaatattaaacaactccagggattttagcagcgtttacaattttggcttcacacacttagaggtttggaatcgttttataaaactgacttgaaaaccatgcattaggctttctttgtgtgattggcaacacttcagaaaccacaaggatccctgcttttgagatgtttcgagagaacctcatcaatatggcacggagctctgcctcctagtgagagctgtcactttcccgggaatccttcccttgctcatgggaatgttggggatgtcattggtgtatgaccttaaaagtgtcctgggaaagaaggacaagaagggaggagaatggttttggccagtagttgcagtgttattggtatgtctggtgttttaatagagtgatctgcagaacttaaaaaactcatctaatggcacaaactttgtgtgaaacagggcagtgtatttgggagtttgttgattttttttaaggtgaaaattgaatgaggaggggtagagtgacacataccactgacatttcatgtctgctttgttggagttttatttgtgactcgtaagttctacctacagggctgagagctctgatgggctggtggcaccagcatggtctgacttttctctgtctgaatatttagtaacatgcagattcttccagaatcatggctgtgccttcttttatcttgcattcgtagagtttgggacccaggtgcttgatgaaagtttattgcattagtaataataatagacaacacatgctgctgtagggcaggccctgttctaaagcttttttgtattaattatttaatcttcccgagaattataatgaagcaggattctaactaatcctatcatcctctccattttatagagaaagtttaagtaacttgcttaagattattcaggtcttaaagggtgggttctatatgcatccagctaaagggatttgacctctttagcatcaaattccttctcttaatcattgctctataggcctagtattaaagttctcaaaagtttaataaattataatgatgtctggattttatcttgggaacctgctcaagagtgacaatgttaggagtgatttttttttttttttaagataacatttaagccatgggactcaatttgtgttgagtggggtgggggtgggtgttgagccatattaatcactgctaagccagtgatcaccagcagggcttgcacgtttgtgtatctttgagaagaatttaggatgacggcaatctctttgagtatgtcttgtgttttgaattccataggagcccagt

SEQ ID NO: 102054 - DNA, 1020 bp, Homo sapiens
acacctgcttcattggcagctatgaatattattgttgttgttaataagataaccaataacattataaatttaggttaaatttactgaggattcctgaccttgtgctaagcactttgtagagacatcttatatgggatagtgggattttctcttacgctttggggccgttgggtaagaagacattctatagctgaggctctcccatttgttttacgtggactgctgattttgccctagctttagttttataggtgtaaggagacactcagtgttggaagagtcacagaacattccccatccctcaggggtacaccctttctgtgacttcctgcctcctagggccatctaaccacctgaccacacaaactttcccaggggccatttgtgagaatgttccttggagtgcgtgatgatttcaaatcagtggtggctttctcctattgtgggcggtgtgtgtccgcccatgccttttgggactctcttcgtttggttgacatatttgtttggacgtgacctttttccagttcctcttccctgggtttttgcccgctgaggaaatgattctcagatctcatccatctgcaccagtggcaacagaagagagaatttcttttttctatggttcgggtccaactgcccagacacctgtccttcagaggctcatattgttctggttgatgtcacttcctgacgtagacactctttaatattttagttctggaagtcatcaagttggacaagagacaggaggaaatggtggagggtcctcagctgacctgggatgcttttttgattgttcactggacacatagaaaggggccgttgctcccacctccatctgccactggcccctggaattagccctgttagtaagcttttcccagtggtggctgattcattctgagagcttttcatatcctttgggattcttcactgttagattcgagaagaaaaaggacagcttcgcttttgagtctgatgaaaaccacctgcagaagacatgtgtacataagctgtata

SEQ ID NO: 102055 - DNA, 1135 bp, Homo sapiens
gtatctccgaaggatcaagatcttggggaggatggcatttaactgaaggtgagtcttctgttccttgaatagatgttttagatgacacatcgctctacaaggtgcgtcactgtcctgtttttatcactctattgtttaatgatgatgcatctattgcttatggtaccagtgaatgtttccattattttactttacttaacatgaatttctcacgcattcatgtgcagctgaagagaattagcaataatgatcccaataataactcccctttgctgagtaccatccttgtgctgagtgctcttcatacgtgaatctcactgaataccgatttttggaggagaagcgaggaggttggaggagtttagttaccagggtctcaggctgagttgattccagagctgaagctccttcaggagggtcactggccagccctggtgtgcccggcagatctcgtggagaccatgggaggtgcagagaagagtaatttgcacacatcttcaacctaggattactgggctagaccgctcggtgggggctgggcttcaaagccacctgagtgtgtgaccttgactcctttttctttccttcaactgcagtaaaagaaacggtagttctaagaggcctcgccaccctgcttgcagcaaaaggcctctctctgaagctgattctgtgcaaagtccagtgtcgctggtattttcagggcgactttcttctctggcggtgtgttttcctctgtttccaggggagctcccaagagaaggttgtctctcagtctccttttcatttgaggtgacccctctaactcctgtgtttaaagctgggctgcacttactgctaacctttctaatagcttctgtggagttggcctgaaaaactacagagagctctcctttcatccctcgccaggatgctgcaggtctttgtatctgcagccaccggggtaggggagagtggacacccttggccattttcttaaatccaagttggtagctggtgttttcagtccctgcctgaaaacagcagctgtttaatttgcatttggatgctgctttttctcttgccttcccaccaccctgtgtctaaacagtagccagagggcaactttttttttttttttttttttttttttgagaca

SEQ ID NO: 102056 - DNA, 1056 bp, Homo sapiens
ccggctaatttttgtatttttagtagagacggggcttcaccatgttggccaggctggtctcgaactcctgacctcaggtggtccacccaccttggcctcccaaagtgctgggattacagacgtgagtcaccgcacctggccgacttcatcttaattacacctgcaaagaccctatttccaagcaacgtcacattctgaagttctgagtggatgtgaattttttggggagaccctatttgacccactattttgagggagaccctatttgaccccctagatagaagtttgagttctgaaagcaattctactctgctggacaaagtttggaaaatacacacttggttaaaaccacatccaacactaacagtgatgtagaccacagtaaaacaagtcaggtggtcaattcaatgaattctaaatggttgcatcattttggacaatctgatatgctttgcttcgaggctttattgcatgtactcacctttagactctttagggtctgggatactggaaaagtttttcacaaatttcccttaagtaagcctccctggaaaggtcaactggttctttctattagttcctggaatttctgtggagcttgtgttcactgatgtccagaggagatgcaacagaagaggagaaggctctggtgcatgggtattttttacagacatggaggctgatgtggctgtcctgggctatgagctgttttgtccctttcaaggcttgttttctataccatgacatatcattattattatgtggcaaagtcaggaaattgcatctcatccaaccttgcccatttgctaggttctcaggtagctcaggttctcctgacagatatttttcctaaagtcgctttttcaaaaattgcagagaagtttcttataaggatgttatatagtttatttattttttatttttagtttttgagacggagttttgcttttgttgcccaggctggagtgcaatagcacgatcttggctcgctgcagcctccacctctcgggttcaagcgattctcctgcctcagcctcccaagtagctgggaccaca

SEQ ID NO: 102057 - DNA, 1050 bp, Homo sapiens
ccagtgtgctgcaggagcaatggatgattctcccttaagcatgctagggaatctttacggagcaatgatgcttaattgggattttggaaggtgaacaaactttctttagaaagccaatatgtccatggcagggagaggaacccctgagtagagatcatgagcaaaggtacaaagatactcaatgtgttcatgagaggtgctcattggtgcaaaggtggagtgcaggtggaggcacaggacattgctggtggcagtcgtggatggtgtgagcgcaggcatcaaggggtcatctggttttgggttgctggatagggagtttgatgaacatccccagaggatgtttttgttatatgtatgttcagctcccaacagacttctcgtaaatgtgatcaggaggccagtgtcactggaatctagggttccttgttaaaaataccatctgttgcatcaggatcttgggtgggggcttgggagtctgcactctaatgctcttgccacgtaacgcttatgcacaccaatgcttcggaaccactgctcagaggaacaagaaaactgcttataaaatcttaattttagctttcagcatttcttcaggagtatcttccatccttgatacgtatcctgagacggagctgtaaagtaacatgtgttcttaatattctctcctctcaataatccctcttttgtgtgattttcttgtctttactttgagacttttgtatgtaggttgtattagttttctagggctgccatcacatattgccaccaacttggtggcttacgaaaacaggaatatattctctcgcagttctctggaagccagaagcctgaagtcaaggtgttggcaaggcatgctacctttttttgttgttgttttttgttttttttagagacagggtcattctgtcacctatctaggcctatggaactcttgtttacctgcagcaactcgactggagtgcagtggtgtgattataactcactgcagtctcgacctcctgggctcaagagatcctcctgcttcagcctcgcgagtagctaggagtactg

SEQ ID NO: 102058 - DNA, 1043 bp, Homo sapiens
gggattataggcgtgagccactgcgccagcccatcttagcacttttgatgtgtacagttcagtacagttaatttacattcctgtgcagtctccagaactcttttcatcttgcgaaacggaaactctgtgtttaataaataatcactccacattctccctctgctcccccagcccctggcaaccaccattttccttccttctctatgaatttggtactctaggtacctcatataagtggaagcacacaggatttctctttttgcaactggtttatttcagttagcataatgtcttcaaggttcatccatattgtagcatgtgtcagaatatttttccttttaaggctgaataatattccatggaacgtctacaccgcatttcgtttatccacacacctgttggtgggtacttggatggcatccacaaatccaccctttttcttctgtgaatagctgtgattgagtttgaatcttaagcttcctcacactggctgtgagatcgtagacaaatcactgaacttctgagtctcagtttttatttctttagaaatgagcagctcagaccagatgttcacaagcatttaagctctagttacaggatactaaataaaaccgaatctgcatctattaaaaatgaaaaagaaagaagaccatgcgtcttctaaaagatttccatggtttctcccaattagaccattttccttttctgagcaaacttaattttcaagtatctgtaacagcagaacttctataactttaacagctttattgagatataattcacacaccgtgcaattcatgcacgtaaagtgtataattcagtggttttttagtatattctcagtgttgtgcaatcatcactacaatcaacttcagaacactctcatcatgccccaaatcattccctatttctccccaactcccttgaccccccccccgccccccccgataatcattaatttactttctttctctgtggccttgcctattccggacgtttcatataaatgggatcataaaatgtgtggtcttttgtgactggct

SEQ ID NO: 102059 - DNA, 1084 bp, Homo sapiens
cccaagcccctcaaaaacatagcatgttattaaatattctaatttccctcaagtgcttgtctttatagcatctgtcttgttggttgatgaggctctgggccttacaaattgctttttcttgctgttctgatgacttttctttcaagttaattttcactaagaactggcatgaaaccccagacttcatgaaaaccaaagttgaaaaaaaccgtgctatgactctctgcaaagtggaatgtttgggctctctttcagttgtagctcctgacattgtggcttaccaagggacctgagtgagtttctgaatcagttattagaccacattccactgacttctgagttttaagtcctattttatatttcctttagaaacagaccacagttggtttctttccttcccctgcaatcaagcaaccaatccactggcctgattttaacataatgaagatttcattttcacaaaccgtggaagtgaaatatgtatgttttctaactcaacctaaagtgagctgaaatgtgttggcttgtcatcgtgtgcttagatctactgaaaatagaatgatcccatggagccccaagtctgagaaggtggcttctcatttggggtaaggaatgtgatgtagtttcattgctacgccagctactcaaagtgttaaaaagcgggcccttatgcaaagacataagagtgatacaatggactttggggactcaggaggaagggtgggaggtgggtgagggataaaagaccacatactgggtacagtgtacactgcttgggtgatgggtgcaccaaaatctcagaaatcaccactaaaggacttatccatgtaaccaaaaaccgcctgatccccaaaaactattaaaatggtctgggcgcggtggtttacgcctgtaatcccagcactttgggaagcccaggcaggtggatcacctgaggtcaggagtttgagaccagcctggccaacatgacgagacctcatctctactaaaaatacaaaaattagcaaaaccctatctctattaaaagtacaaaaaattaggtgggtgtggtggcatgtgcttgtaatcccagctactcgggaag

SEQ ID NO: 102060 - DNA, 2133 bp, Homo sapiens
tgcataaagtaaaccctttttatcttcttgccttaaacttgaagacgaagagcattttaaagactaacttgaatgaagcaggatgttagttttaaagacatgaaggctgagactgctggtgtgcaatgtgggttccagtgttcttttacaaacaggttcagttcaggcaaaggggtggtgtggccagtggccccgaagttcttggcaagaatgttggggatcactcttagggaaggaagccaagaatctgctcagtaccaaagacatctccgtagtctgttcagactgatctaaatatgaacagcatatgaatttagcaaagaggatacatgctgcctgagacttttaaccataatacttcattcgtttactaagtaattaattagttcagtggttattcattgcatgcctactgagtgccaggccagaggtcacttgttggcaaaagtctccgtgggacattacagagaactgggacggccaagctgttaacacagagctcaccacagtccttgtagtagtgcttcactctggagggtcactgtgtgtctcacctagagcctgtccacacactctgagctatcgcgtttgggactcaaaagatggaaggtgcaattaactataactgcaattaaaacacggttgtggttagttgcagtgatggcctgttaggaagtgaggaagtaaaaattcattataagagcatgtctgaatttttaaaagtttaacagtattgagaagagatctttccagctcttaaccatggtcttcacaatattcgagcataacatagtatacaagtgaccatttgccatcaagaagcaaacgctttagcatgcccatttcaaatggtggcatggttatctatttcagcttcaacttctcaactccagggcaccacagattctgctcgagttccctctccctgtgctaaggcctagcagccgggacactggggcagatcgtaatgctcatctgtttggtatttagtctgttagagatcagtgtcctgtgctacctgttgttcagtgtctgaaaaccattgtttcatagattttgtccaatttttaaattgtttcaggtgggagtataaatctggtccttgttactgcatcttagctggatgtagaagttctgcaatatattttacaatgcctttttttttctttaaaaatagggatttaaacacatttaaacaaatatttggacatttaggccaggcacggttgctataatcctagcactttgggaggccgaggtgggtggatcgcttgagctcaggagtttgagaccagcctgggcaacgtggcaaaaccctgtctctaacaaaaatacaaaaattagccgggtgtggtggtacatgcctgtggtcccagctactcaggaggctgaggtgcgaggatcgctggagcctgggaggtgaaggttgcagtgagccgagatcaaaccactgcactccagcctgggagacagagcgagacttcgtctcaaaaaaaaaaaaggacatttagaaatattaaggttcagttatgtggtaaattcacatgtgtggaataacgtattccctgacaatctgatcattaagttgtgtctgtgtatgagcgctgagttaagatgtttcagagtataagtcaattaccaccctcatcttaaaggataattaaaatctctcagcctccaagggatcaatcctttttttaatttgcttccttttcttcttatattctgagaaattgttctaaaaggaatgatttgagtttccagagtttggtatgcattgccctagcttccaactaaaagaatggaccataaagcattattgcagttgaagtataaatctaattattccatttactttcagaggttgtatctgcaaatggcataactgatgtattcgttttcattctccttctacccagtttgctcaacctaatcacctgaatgatgttaatttgggtttaaggcacatttcagaagattttggctgtaaagagcaaggcaaacttagctcttctgcatagctctaaatgataccaataactataaatggcatcattcatactggtgaagtctttcttactttttaaaggctaggatcaaatctaggaaggcttgggtgactcccctgctctg

SEQ ID NO: 102061 - DNA, 2948 bp, Homo sapiens
tgataatctgatcaagttcctcattttccacctttgatgtgtaagtccttggcctgtctttagcaagaattctgttaggccagttttgcaagattgcaagaatctcccggctgggcgtggtagctcatgcctgtaatcccagtgccttgggaggcggaggcaggcagataacttgaagtcagacgttccataccagcctggccaacatggtgaaaccctgtctccactaacaatccaaaaattacccaggcatggtggcgtgcacctgtagcctcagctactcaggaggctgaggtgggagaatcacttgagcccaggaggtggaggttgcagcgagccaagatcgtgccactgcactccagcctaggcaacagagggagactctgtttcaaaaaaaaaaaaaaaaaactccctactcctgacgttacgtcttagtaattgtccattgactgaccctctcagcttcactccttggctgtaagttctcacttgtccttgctgtgtttggagttgagcttgatctcttttccctgttacaatacccttattgttctatatatatatatatatttatttatttgttctgagatagggtctcatttcattgctcaggctggagtgcaatggcactgtctcagctcactataattcccacctcttgagctcaaatgatcctcccacctcagcctcctgagtagctgagactccaggcatgtgccaccctgcctggctaatttttgtatttttttttttttgtaaacatggggtttcaccatgctgcccaggctagtctcgaactcctgggctcaagtgatccacccaccttggcctcccaaagtgctgggattacaggcatgagccaccatgctcagcaatagttttgaattaagtcttcattactcttttaacaagtgtcaatttttttcttcagtgacctccagatcttacttgctatgtctaagataggaagcctgtatgttaggtagggaaggctcaatcctggaacaaagtctgaaattacagtggcttaacccaacaaaaggttatttcttgtccacataaaagttctttaccaaatggtgattccaggacccaggctccttccatattgtggctctgctatcgccaacttgtgccttccaacattgccatattcctgggactcaagtcctagaaggggaaagtgcttgcaggtttgtgagaggggcagacacatctttcccactcacattccttattggctagagtcaagccatgcagccacatttaagaaggaatgagtttgttgaataccaacacatgaatctgcattttaaacaagtgtcacatgtgattcttatgcagggggatgcttgggccacaccttggtaaatgctgtttataatatttgctaagttccttccaaccctaatgggccatgattctgttgtgctgtgagctttcacatggaaaaaggcaagcatttccctctaagatgaagagagaaattgaaccagcaaaatcacaaaggattcttcccatatcctgagttcataaaagcatggtgacctgttaagaccagctgattaaataggcaccataatcatcttgctgtgactcttctgctctgggaacccactgagatattaccttatgtgtttccttccacgatggggtgctgggaactagaatggggaacacagaaaatgtaaatgcatgttttcctttgcaactaattaaagtggacagtttaccacttcatttgtctttttttctttttttttgaaacagtctcactctgttgccaggctggagtgcaatggcatgatctctgctcactgcaacctctgcctccctggttcaagtgattctcccacctcagcctccccagtagctgggattacaggcacacgccaccacacccagctaatttttgtatttttagtagagacggggtttcaccatgttggccaggatggtctcgatgctctgacctcatgatccgcctgcctcggcctcccaaagtgctgggattacaggcatgagccaccatgcccagccatttgtctttcaatccattggaaatctaaaggttttcttaacctattctgctaagaatcactgatctgggaccaggacaaccctgatagcatctgtattaacttggtcatttgtgttgtgacttttttttaaaggccaagaatttaggtttattttgtgtcaggaattaggctataatcagatatttggggactgggggagtcagcagtgtggtgatcagattttcttaattccactaaggactaggtaagaagaaatatttggacctgcatgagatgtagtttgagcacactgaaattataagggaaagctagattgtgaatacagcctttgagtgagactttttctgagtttctcatttcttaacaccttcagttgctacgctgctggcaaatatgacacaagctgttggatgctttctcgattgaatatagttctgacatcacacaatattagctaacgtttgtagaatacttactgcatatggcttttgttattctcttatttcttcatcttaacaacactaggaggtatgagtactattttttccctgttttaccaaacgagggaaactgagacacagagaggttaggtaactgcaaggttacattgccggtgatcaagaccctattgacaatcggaagcatcagccatccatggttttgttccatctcagtctggtttgttctacactagctgttatattcttagacaaccagtggttcttcgagagacccctccctcttttttaaacatagattacatggttcagcagaaagtggttctatttcttttcacgataattatggtttctgggttagcactcagtgctgccaactttttgaggatgcgggtaaagtaagttctatttcttaccagcctttgatggcgtacagcgtgcttggata

SEQ ID NO: 102062 - DNA, 1566 bp, Homo sapiens
ctgaggcaggtggatcacctgaggtcaggagttcaagaccagcctggccaacatggtgaaaccctgcctctaccccaagtacaaaaattagccaggtgtggtggcgggtgcctgtaatgccagctacttgggaggctgaggcaggagaatagtttgaacctgggaggccgagattgcagtgagctgagatcgtgccactgcactccagcctgggcaacaatagcaaaattctgtctcaaaaataaaaaaataaaaaataaaaataaaaacaaacatagtcctcaaaaaaccaaaagtaaaaccatgaaaccaaccttcccaaaactcaaacgttaaaatacaaccaacaaaaccccaatctctcctttagcgtctctcctcccctcctccccctggctgtactcatgtccctgagtcagagagggctgttaaaatgtaatgggtatagtccgatccaggaaacaatggttgatagtcttgaataaactcttgaattttacaaggattggggatctcctgggtctcctgatgaagagaacaggtctttggatactgcctgcagtttgagtgcctgagatttctgcagggtaggcagtgagaggtgagcatttggggtgatagaattccatgtagtcaccaatgagctgtgtccctattaattggaattaatagacgacatccagaatggcaagtgggaatataacatctcctggatttaccagattattttccacaaagtttggaacttacataaaggagtcttttggagtagccattgcccctctttcagcaaaaccagaggaaatgtcatacagaagaactgtggttaaagaacattctggaagacacacgtattaaacagagtgaggctggtcttagcattacagaaggttgaagccagcaggggcacagtaatacaatgagcctagattctttatttaatagatttaaaaacaaaacctgaggccttggagtttccgtgtgttgctcaaagtcaagattcactcatcatcatagactgtttctcacattagcctgcgacatttgatgttgtatctcatatgctaggagacatttcccacagaaacatctacttgttactggtcataaaattgcctgtatcaaaagcagtagttgtctttgcattctgttctttcttttctcttctcttctgttctttgttttccttttttttttagatgtaatttcgctcttgttgcccaggctgaagtgcaatggcgtgatctcagctcactgcaacctccgcctcccaggttcaagcagttctcctgcctcagcttcccaagtacttgggattacaggcatgtgcgaccatgcattgctaattttgtatttttagtatagatggggtttcaccatgttggtcaggctggtctcaagctcccgacctcaggtgttccgcccaccttggcctcccaaagtgctggcattacaggcgtgagccaccgcgcctggcctgcgttctcttcttagaaaagtttgctgactttttaaaagaattgtcaaatatttcatggcagactgcagttctttggatattggatc

SEQ ID NO: 102063 - DNA, 2076 bp, Homo sapiens
ggtggctcacacctgtgatcccagcactttgggaaacaacagtgtgacgatcacttgagcccaggagttcaagaccagcctgggcaacatggtgaaaccccatctttacaaaaaatacaaaaattagctggatgtggtggtgtgtgcctgtagtcccagctactcgggaggctgaggtgggaggatcacctggcctgggaagttgaggctgcagtgagccatgatggtaccatggcactccagcctgggtgacagagtgaccctgtctcagaaaaaaaaaccaaaacaagccaatcctagcaggtgggcactgttatatttgctgttgcaaatggggaaactgaggttgggagaggtcaagtacctaggccacagggactttcagaagtagatgccagggatctccacttggcagagctggactttctgacccgaaacccatgcctataatttgaggatttgccatcctgtcttgtagaggttctgagagctgccacagttctgattgtggagtcttgagtgacagggaagttgcagcctgaggtctgtggtggagctggaaaggaatatttgcaagacacctccatgctcagcaccttccttgggcttctccaatttgcacttcttgtttttttttttttttttaattgagatggagtctctctctgtcacccaggctggagtgcagtggcacaatcttggctcactgcaatctctactgcctaggctcgagcaattctcgtccctcagcctcctgagtagctgggactacaggcacgcattaccacgcctagctaattcttttgtattttaatagagatggggttttgccatgttggccagactggtctcgaactcctggcctcaggtgatccgcccgcctcctcctctcaaaatactgggattacaggcatgagccaccgcgcctggcctccaagttgcacttctaatttagattctgtcctctaatcttggtcaatgtagatgttttaggagtaaccagtgttcctcatgtgtttttcttggggcctattacacaatgactgctgtgatggttaattttgtgtgtcagcttgactgggccacaaggtgcccagatacgtggtcagatattctggttgtttctatgagggtgtttttggatgagatgaaccttgaaatcagtagactgagtgaaagatattggcctcgtctctcctcctctcctttcagttgaaggcctgaatggaacaaaactcgggccctacccctgagtgagggggaatttctcctgcctgactttctttggagctaggacatcattttttccctcctgctttcagccttggactggaactccaccattgctctcctagttctccagtttgccaactgcagatcttcagatatgttaacctccataatcacacgagccaattccttataataaatctcttcatgcagatatatacatgtgtgttgtgcatatatgtgcatatgtatagattctgtttatcatgagaaccctgactagtacaagcactcatccctggtcactgtccacctcctcatttctcaggccagcaggcatctgaccaacattcctgcagatgcttcagggaaacacgtgagccacagtctcttcacttccatttgcttttgctcctcttatctccgaactcacagttcagtttttaacacattcagatcactctcatatttttcctcctttattctaatttattgatcttcagagaatttctttcctatttctctgctttctccatttttctttccttttttccttctccttgcttttcttccttttttaaatcttcttgagatagagtcttgctctgttgcccaggctggagtgcagtggcatgaacacagctcactgcaggcttgacctcctatgctcaagcagtcttcccacctcagcctcctgagagctgggactacaggtgcacaccactacaccctgctaattaaaaaaaaatttttttcccagttgctaccagctatagtaaaataaagaaagaaaaattttgtagagttggggtttccctttgttggtcaggctggtctggaactcct

SEQ ID NO: 102064 - DNA, 1021 bp, Homo sapiens
ccgcttggctctcattctctctcttgcctgacaccaatgtaaggcacgcgtttcgccttctgccacgattgtgaggcctccccagccatgtggaactgtgagtccattacactttgttcttataaattactcagtctcgggtatgtctttatcagcagcatgaaaacagactaacacaactctcaaggagggaagagagtccccctgtccccctggtgcctctgtgggtcaatgctgcccttcactgaggtcctttgggtatgtgctctgcattttcccaggcccaggaaagcaatgtgcagagagaaagcacctgttctgccttgaagaatctcggatctgggtgggaggcagggtgcccaggggcaagagtgacacttcctaacaatagagctacaggaggagctggcaccgttaataagcacgacctgcttcttgcagaaagtcaaggaaacattccaagaaaacatctcggacgtgcttctccttggagtaggagagaggcactgttgtttctgtagggaagttggatggggcctctctgaaaagaggtaatttgcaggattccagttatgataggatacagagttgtcttgtatattctgggaagaagggaaattgcatcctgcctttgtccgataacaggcagtggggaaaagggtagcaatgctttcggggcccaggaggcctgtttgctgcagctgcacgattcacgagcagctccttccattatcccttatattctgtggggagggaagaggcaaggccagttacgtggttgctgcctgattatcggcctggctgcccaaaggaagtcccccaggcccctctggccttcctctcaaccaacctgccaggcatttgcttttctgcctaattcagttatgcctcagtgtgaacattttctgcctaggcttggtcaatctgcagggacctctcttggtacttgacatagtcagttgcctgactacaaaccaggcctaccctggatagaaagaaaagggagttgtgacagttgcca

SEQ ID NO: 102065 - DNA, 1050 bp, Homo sapiens
cctgaaacccaaacttactgttttccctcttccaacttcttcatctctattagcatcacctccagtgttccagccaccagatttttagtctgggtgttagcactgacccttctttttctttgtcattttcagtatccttgcacttacgaagtactctcaaactttcctggacatgtcctttgtaaaccatcttcctaaacactagtttttgtatctctcactctctctttatctctctctctctctctctctctgtgtctcacacacacacacacacacacacacacacacacacacacacacgcacacacatgctttcactcagcctggtgcctggtgttggcttaattgtccatccttttctctatgaacaaattgcttcacttccacatttctgctgtgttggtttggagcttgtctgtccttcctgggatgtccttggccacatttcccattacccctcccaagccaccgcatttgctctttctctgaactacagactctggtccacttaggcccagtgactttctttatgttagaatcatcaaggtcattgaaattggattactcagtcatgtgtagacttggctaacttccctgtatgcagtgtgtatatatacatctataaaagtaatgcggggtgaattatctgaatttaaaaattcatgagaaaaatatgataatattaatcaaacatgctgctgtttggcagccagtcaccaagccctcctgtccccgtggccgactctgctgatggctgggcagccacagtgtgatggatggtgctgtggcatgcctgtggccaggtgggctggccgcacctgtggctctgggcctgatttatgctggcctcggagccgcatattgctccacgggatgacgcagatgccggggcctatcctagcatgtgggacctcagccatatccatccagagcgaaccttttttttttttttcctctgagaatctcagtttagcttcttagcttaattgaccactagatggattaggagctgcttaatgatgtctgaagcccacaaggactgttttg

SEQ ID NO: 102066 - DNA, 1034 bp, Homo sapiens
ctggaaggaatcttgagggacctttggacaaatattaaatgtcctgttaatgtcgttgtcattgctgtcattatcatgatctttttcaatgcctttaatttaaagatgaggaagctaaggggacagtggtgcacccaaatcttggctaatggtagagcaatgaccgtctgggtgtttctgtggaatttacttgcacttttgttttctgtgaagttcgtgctgggattagcagagctctctacctcctcctctgagctccctgccggagcctgaacataaagtgcccgtattctgggctcatggaagatttgttaataagaaattttctaaaaaaatgatcagggaggagacatggggagtcagtaaaaagggggagagaggagcatcttaaactgcaaagatgttgaactggaaaaggaaaactgtgaaaaacattgcaaaaggaaaagaaatagaaggaatctgtggaagaatcaaatcaaccaagtgcaatgttgggtcttgtatggatcctgatttgaacacaacaactgtgagagaaggagagagaggcagacagaatcagggacatttaaacagggaatggttaattggtggtggtaaggatttttgggtggtgggtgggatgatgtttaagtaaaaggtccttctcttttagaaataagtgttgaggtattaatggatgatagaataggatgcttattttcttcaaaataaataagccagtgttgggggagtatagcaaactaggattgaatagttgaagctatatcgtgagtacatggggattatgtacctaccataaaacatttccaagtaaaaagttttaaaaacatgaaagttgatcaactgtagcacatcacaaacctctttgcagcctaaaataataatgaaagaagcagtgtgagaaatttgccaactttttcatcttatcttaaaaaatcttccaaatgcagcagacgtttcccagtttccctggcaaaggccctttgccctgagtgacaggcggatatgggaacaggagctcgaggaag

SEQ ID NO: 102067 - DNA, 1702 bp, Homo sapiens
gtgatctcagtttactccaacctccgcctcccgggttcaaacaattcttttgcctcagcctcctgagtagctgggattacagacatgcacatcacgcccagctaattttttgcatttttagtagagacggggttacaccatgttgaccaggctgatttcgaactcctgacctccagtgatctgcccgcctcggcctcgcaaagtgctgggattacaggtatgagccactgcacctggcctcaaattcagcattttgagacccgattcgctgtgccctcttcttttacagagtaaagctttctctttcataggagtatgctaccatgtggtttgttttatctgtgtttggtcgggagttccccatattttaattgactatttcatgctaagggctttcaaaatacgtagacttgtattttttccccctaaatggaattcatcttgttttatctaagttattcatttttcctttggctatattgtgtgctacattataatggatggctattgaattctttatgtaaaaaaaatgaaatagattgaaaatttaaaggacttttcttttttaattgcatcttaatataaaaacaggagtttaattattaaaaatggtggaagaaaagaattaaaacagtaaaatagcttaccaaagattctgttttataatgcattcagatataattggtgtcataatgtgtaattaacagtctttgaagtgtgaagcttaagtttgggtggatgaaggacctcttaggatgcggggatgtctatacttgttcttcaacagtagcacttcctttttcatttttgtttttgagacagagtctcgctctgttgcccaggcaggaatgcagtggcaccgtcttggctcactgcaacctctgcctctcagttcaagtgattctgtggcctcagcctctcgagtagctgggattacaggtgcccaccaccacacctggctaatttttgtatttttagtagagatggggtttcactatgttggccaggctgatctcgaactcctgacctcaagtgatccacccgcctcagcttcgcaaagtgctgggattacaggtgtgagccaccacgcccaaccttgaacagtggcacttccggagtggtgcacagattgtggggttttgctacctgcctttatgtgtgtgtggtcgaaggagatggtagaagaaaggcagggacaggggatcatcctctgatgcttgaccacccacccactactgcctggggtttgtcagggaggagaggacaaactccttaaaatgggcagtggcttcagcttcaggtctcaggctaacttcctggggagttggagtctaccacgtgctagactgacctggggcttgtttaaaacctgcagaggagcttccttggtgcattttctagatccacactgtaatctgggtgtgggtcccccatggaccttgttgccatgctggctgggaataataagtatgaggaaaagcaccctgaggaaaaagaggggaagataatggaacctcaggctgagagtctcagcctccgtttttcccatgcaccatccggctccagttggctctttgaagactgggagaccagaacactcaagaacacaaataaaatatgagagagagtataccacgcagatctgagcttatattcactcttactctggtccaaaagttccttgtgcattgctccctctggc

SEQ ID NO: 102068 - DNA, 1037 bp, Homo sapiens
ttagtagagatgaggtctcgtcatgttggccaggctggtctcgaactccttacctcaggtgatccgtctgcctcggcctcccaaagtgctgggattacaggcatgagccactgcacccggcctcttacttcttttttaacatgacaatattctgttggaagtgaggcaagagcaaagtcagggagaccaattaggaggtgacagtgatgagggtgctggcgatgtagctggtactggcaatgggctgctggcgatggagatgcagcagattctggaaccctttgagggttgaattgacagggtttgctccgggcggagtgtgaagtgtgagaggaagatgtgtccacgagaaggaagaacccatgtatttggggtttgtgaagtgacagtggttgatcacggctgctctgggctcagtgggctcttctcggcccttcggcaggtaagagttcaaagctggagtcgaaaggcttatgtcttgagctctcatcgagttgttgattagttcctgggtaaggtcactccctggtagagcagttacctcttttgaattggtgaccacagcctgcgtccccagccctggtgtgctgctagacataagaagaggcaggctggctgggcgcggtggctcatgcccctgtaatcccagcactttgggaggccgaggtgggtggatcacctgacgtcaggagttggagaccagcctggccaacatggtgaaaccctatctctactccaaatacaaaaattagttgggcatggtggcaggtgcctgtaatcccagctacttgggaggctgaggcaggagaatggcttgaacctgggaggcggaggttgcagtgagcgaagattgcatcactgccctccagcctggtcaatagagtgagacttggtctcaaaaaaaaaaacaaaaaaaaaaaacaaaaaagtggggttaggtaggcagttcggagaggtcactatagaatctccagtggatatgcagttcaggggacaaaccccatgatggaatgttgctgcttctgtgagggagaggc

SEQ ID NO: 102069 - DNA, 1156 bp, Homo sapiens
tcctgcctcagcctccgcctctggagtagttgggattacaggcacgcaccaccacgcccggctaatttttgtatttttagtagagacggggtttcaccatgttggccaggctggtctggatctccagacctcgcgatccgcccaccttggcctcccaaagtgctgggattacaggcgtgagccaccacgctcggccaatccttgggcttatttctacacaatagcaggggtggcagctggagttgcagcactgccagtaattgcaacaacacttgaatgaagaggcaggcatttctaccagttggcctcttttcatctgcaaagaatccttcctggaactccccagtctacttcctgtcttgttccattggtggcagctgagtcacatggccagccctaacccaatcacaggcaaggagtaatgggaggctctcattggtttatatctggcttatttcaggctggggctgggcagcggcggttccctgagtctgtcctggcctgagaatgaacttggatgatcagtgttctgttgacagggagggaggcatccaaggggtgctcttgggaaggcaactaggcatttattattattattatgtaaaggctaggtccagtcctgctggcagtctaaaaaaaatcattttatttcgtgttttaatcaatggtgacatttgggtattttgaatctctgcatttttgggtgtggtatcttaaactttagagattcttctttaaacttgaggatatctgtaagaatttttttataaagccacttaattattttacataaagtagaattagagagggcctcacagtgaccccaagtcatgatcacagggcaggaatagaagaatttgcctctctgagttaacaagaataataacaaaaaagatttattagataatgggcacctctgcatacagtaggtttttatggtggaaggagactccaaacagaattaacagtaacacatgtacaagtttttttgggaaaaaaattggaaaggcacacttttcagtgaacgctagaattcttttccttttttttcctagaacaaactttcatatgaagggctggataaaaaagtcttctttttcctcttactcctgccagttaataaaactgctgaaagacaattgtaatgatccggaaa

SEQ ID NO: 102070 - DNA, 1050 bp, Homo sapiens
gcctcagccttccaaagtgctggcagtacaggcgtgagccaccgtgtctggccaggaccctgttttctcatcccatgtcttgacttctcactagtcccacaccctttttcaaatacaaatatcaatcacatttcaggctacagttcatgtggtacaaacatgcacaggtgtgcccaatcaaatccttccccaaagcactagagactgggtcatggagccgggatcttggctgggagagcaactgtgggtttccttaagggagagtgggggtgctgcggggtcccttgcctggtgttctgacaattggaaagccagatgagctcaccatcttctcagtctggcttctgcagacagtagtaccttcttacctctctatggttgtctgagagcttgctcaagtcccatgaagtttaacgtggtgagtctaggctggtgagaaagttcatttgtccattcagaattgcttgctgctggaataatctgtgatcatcttggaaagctcttgcgtagatccaagaatctctttccttcagtgacacaccaccaaatggcttgttggctgttatctccaagggagggaggctgccactgaagagggttggatgctgtttacattcgggtttgtccttccaaggaatgggatatcctcctgagggctttagcaggttgtgacagtcacatggaggacagatgtgcagtgtgtcacatgattcagtcacagaaccagcaatatcagcttgggggaacagggctatggggaattgtggcttgtaagtcaatcacataatttattttatgtgaaagttctgtccaatttaggctgaaacttgatagaacatgtttttccaagcccccagctttacttgtctggaatgcgccctttctaaacaggcaactctccaagcacagtggctcatgaggtgacatctgggcagcaccctgccaggtggcttttagctgatttcttatgtgtctctggcctaagccactccaaactgtctgctcgcgctattattttattattttccttgaacatattttcaaagtaat

SEQ ID NO: 102071 - DNA, 1039 bp, Homo sapiens
caaagtgctgggattacaggcgtgaaccaccgcacccagccttcttcaccattttcctaagggagacacaatagcggattatggacaattttgaccttggtacatttagccatgtcactgcaacatacatcagagcccagggtgtggctctcacagcaggcgtgagccactgcgcccatccttttttttcctctatttttgatttggcccctgccaagtcaatttcatcatcctaactcaagtaagagcttggaatgtgagggtgccttgcttgactgattggctttctttaaacttcctttgctctccctttgatgagatgctcctaagcagagaaatggctggcaaccaaaattggagagtacagccacctggattagcaatccttgaatcattaggatctgattgtaaagggaaactacgaaatgctttaaagggtgcaatccggagtgaaccaggaaactcaagacggatgatctaggcataatacatcttaaggcagcgtcctgaatggagcagaaactcctctcacctgactcattatctaggcttcgtgatctcctttttttcctagctgaaatcctgtccttagttccattttcctcatgcttggtgctgacccagatttgggggagggtggtaggaagtggtaggtgatggtggtggttgtggtagtaatggacatggaagtcagccctctcttaaaattgcttccaggctgggtgcggtggcttacacctgtaatcccagccacttgggaggctgaggccgggataattgcgtgagcccaggagttcgaggctgccgtgagcctagattacctcactgcactcctgcctgggcgacagagcgagaccctgtctcaaaagataaataaaaaacaaataataaaattgcttccttcctgacagtgtttgtgggcccctaaaatgtcctctctggtatttctccttttacctttttttttctttaagatatgttacttggcggactggtttggtaaccttattagaactgaagctattgagtcattaattct

SEQ ID NO: 102072 - DNA, 1011 bp, Homo sapiens
aaaagaggaagcaacccaagtgtctgttgattgagtgggtcaacaaaatgtgtatacgtacagtggaatatgatttagccttaagaagggagttttttgtttgtttgtttgagacagggtctccctctgtcgcccaggctggagtatagtggcacgatctcggctcactgcaacctctgcctcccggttaaagtgattctcctgcctcaaccacccaggtagctaggattacaggcttgcgccaccatgcctggctaagttctgtatttttaatagagatggggtttcaccatgttgcccaggctggtcttgaactcctgaccttgagtgattcaactgcctcagcctcccaaagtgctgggattacaggcatgagccactgtgcctggccaaaaaggaaggaaattctgacacatgctacaacatggatgaatcttgaagacattacgttaagtaaaattagccagacacagaaagagaaatactatgtgattccacttgtatgagggacctagagtagtgaaattcaagggagtttgtgttggacgggtatagactttcagtttagcaagatggaaagagttcggaagatggatgttggtgatagttgcacaataatgtgaatgtacttaataacactgaactgtacacttaagaagggttaagatgatagatgttatggtatatgtatttcttataccttaaaaaaagatatggaagggaggaaaaagatgcagatgcatatgtgtgtgtgtgtgtgtgtgtacgtgtgtgagagtgcgtgagtttagagagagtgctattagggatgggaagagagatggaaatggggagggagcctgtgtaggtggctgatttcctgctgtgaagaggagtcgtgctgggcagaaaactatgagggcagccatcagtgcctgggttgtaatcagagctttgtctccagcaagctgtgggaccttgagcaagttggtcgtttcctgttgtgcgcatcagcctttttttttttttttt

SEQ ID NO: 102073 - DNA, 1027 bp, Homo sapiens
gagaaaccccatctctactgaaaatacaaaattagctgggtgtggtggtggcttatgcctgtaatcccagctacttaggaggctgaggcaggagaatcgcttgaacccgggaggcggaggttgcagtgagccgagattgtgccattgcactccatcctgggcaacaagagccaaattctgtctcaaaaaaaaaaaaaaaaaagaaatttcaatatgaaaacctagttctttatttctctatctctctcctccccactccaaggaaaggtagaaaagaatccaacctaggactacgttccaccctgtagggtttcctagggctgtgctaacagagtaccatggaggggaagcgtcaagcaatgcaaatgtagtctcccacagttcaggaggctcgaagtccacgactgaggtgtgagcagggccacgttcactctgaaggctctaaggaagaacctgtccttccctcttccagcttctggtggcttcctcagtgtgcagctgcgtccttcctgtccctgtctgtgtcttccatgtcctccttccccatgtctgtctgtgtccaagtctccctctttttattaggacattggtcattagaatagggcccaccttaagccagtatgacttcatcttaacttgattatgtctacgaagaccctatttccagttgggtcacagtcacaggttctgggaggtaggacaggtaggacttcagcatatcttttaaggcactcaattcaacccacagcacacacccacccctgggctaccaccctaaaacaccttcccataatatgattgatggcagagttactgctgcctgcgtcagtttcactgttgtctgtctgctccagatagctgcctgtgatctgattcctgtctgtccctcctgctagactgtgagtcccaagaggacggggaccatgactttaggtcatgattgatcgtatcccaggtacatagcccaaggcctaccatataattggtgctgaataaacattagttgaataaaaaagaaaacatattt

SEQ ID NO: 102074 - DNA, 1042 bp, Homo sapiens
ggttagaaaagactgtctttggctgggtgccgtgtgtcgtgcctgtaatcacagcactttgggaggctgaggtaggaggatcacttgagctcaggagtctgagaccagtctgggcaacatggtgaaatcccgtctctaccaaaaatacaaaacaaacaaacaaacaaacaaaaaaacacctaactaggcatggtggcttgcaacggttgtcccagctacttgggagtctgaggcgggaggattgcttgagcctgggaggtggaggttgcggtgagccaagatcacgccactgcactttagtctgggtgacagagtgagaccctgtctcaaaaaaaaaaaaaaaaaagaaaagaaaaaagaaaaagacaggactgtctttgactctggaaaagaaaagaaggtcccgggagttttcctcagaatttagtccctggagttaaatattctgaaaaaatgaagtaggaaggattttgcagagggctgtgtccgtagttttcaaactgggtcacaggccattcattgatttatatagtgctgttgtgacaacagtaaaaataaaattgtggccagatgagatggctcatacctgtaattccagcactttgggaggccgaggcgggtggatgacttgagcccaggagtttgagaccagcctgggcaacacaggggaggccccacctctacaaaaagtgaaaaaaaattagctgggcatggtgatatgtgcctgtagtcccagctacttgggaggctgaggtgggaggatcgcttcaacctaggaggtcaaggctgcagtgagccaagattgtaccactgtactccagcctgggcaacagagtgagaccctatctcaaaaaataaaataaacaaataaaataaattgcagtaggataaggaaattcagtgcatcccaggcagcttaggtaaatgtcttgtcaacgtttttgtgtgtgacatacccaggagtttgccacgggctgtggtttgccacttgaccctaacctgccactctccttcgtgcccatggctgagatggtgtctctct

SEQ ID NO: 102075 - DNA, 1049 bp, Homo sapiens
tgacctcgggtgatctgcccgccttggcctcccaaagtgctgggatcacaggggtgagccatcttgccccactgagtacgtactattatctccactttattgatgagcaaactgaggttcagagatgaagagatttgcccacagtcacacaattagtaaacagctaggttgagcctggaggcttcaggctgtatccctgatgtctgggagcttttgctatttcatgctgctgccctgaactattagtcttccttcctcactttcaaaatccagacatctttctgcattttgaagagtcttaaatgagtggtgcatatgacttgttctcatttgggaagaagatttctgctgcttatataaaatcattgtgttgttttagatttttcttaattgcactgcttaggactttttctgcaaaagcattgaactattcagttcattaggctatatttagtgaaaattgcacccagtaaaatttcagggcatcctttttatgtctcgatgctgtagctctgtactttgataccgtttgtaatgggaaaataaacataacttacatgttttgtttgatttacctctctttgcaggtatcttttgtaaggtgtgataagttgcaaagagaaatattgctttgcagaggagttactgctgcttaaaaacatggcattgggtgctgttgaaatccgtgaatgatgacagtttattgagaatgattgagaatgtgctaaaaatttattttatagctggtcggtgaattattgtgattgctcctaaatttaaacgacagaatttgtggttgtagcttaaaaacctatgacattgaaatacggggtagtgttagatatgagaataagtgttagatatgagaaaaaaatgttgttttaattggtcaaatcaaaagaaacttcctggtcatcactatttccaattcttgatatgttatagccagtgatcccatttggatagaactttataaaggactgcttcggttggacagatgggccttacaagtgttgtggaacattcgtgttagaagcctcctttgagag

SEQ ID NO: 102076 - DNA, 1010 bp, Homo sapiens
taatttttgtgtttttattagagacaggtgtcaccatgttggccaggctggtcttgaactcttgacctcaggtgatcggcctcccaaagtgctgagattacaggtatgagccaccgcgcccagcctcagatctgattattaaagagtctggcccctctctcttttcctcctccttgccacgtgacatgctcgctcccccttttccttccaccatgagtggaagcttcctgaggcctccccagaagcagatgttgctgccatttttcttgtacagtctgcagaaccatgagccaaatagaccccttttctttgtaattacacagtctcaggcattcctttgtagcagcacaaatgtactaagacaaggatgtgtctgcctccctgagatgttgggaagagcagatgaatcacatgatagaagtttggaatggtacaaggcacacactaaatgctatgtaagtttttgctgtaattatctagctaaaggagcattgcatgataaaatggatataaaactcttgggcatagtgttcaatacacttcagctcttttgcttataagcttggcagagagagagtaaactctgattattcctcctgatttcccattagattttccatttttctatttcaaagctctcaggatcaaacccttcaccagcaaatgctttttgccatctagcaagagaatatacttttgagtccaggttctgggattcactagctaatatagttggatgtcccctccaaatctcttgttaagattaactcccggtgttggaggaggggcctggtgggaggtgtttgtgttgtgggggcggatccctcttggcttggtgcagttcttgccatagtgagccagttctcgcaagatctggctgttgtaaagtgtgacacctccctctactctctcttgctcctcctctgccatgtgagactcctacccccacttcaccttgcaccatgagtaaaagctccctgaggctttcccagaagccgtgcttcttgtac

SEQ ID NO: 102077 - DNA, 1091 bp, Homo sapiens
gctggagtatggaggcgcgatcctagctcactgcagcctccatctcttgtgctcagggagcttcctgcctccgcctcctgagtagctaggactgagtagctagatgcaccactatgcccagctaattttcaaattttttgtagagacagggtcttggtatgttgctcaggctggtcttggactcctggcctcaagcaatcttcctgccttggcctcccaaagtgctgggagtatagggatgagccactgtgcctggctttgggaagtattttaaatagaggtcacatacttagtgcattgatagtgctgcctcttccctggaagaaatattttcattgatcggcatcccccctccctgctcccttaatctccctagttatctctttctctctgtcagtgaatgttgtttaaacactgaagtctcatcaatcttgtacgctggaaagcctagaatcactagtttagggcttcccatctcagctatattaacactgtaacacttgtatcaacaacagtctagcatcctgttggaattaacacacatggtgctcccactctgttcctgtttgtgtagggagaagcaagacatttccttgggagcaaatctgtttctgaagggtagtgatgggcttgatcaggggactcaatgtgatcaacattgagagactgttgaccacaagtggcccaggtgagtggagactgggacacactgaggagattctaagcattgggttgggactggtggcctttaagatcatatctgtattttaggattttgtgataagtgacagggtggaatggggtggggcaggtggctgatagatgggtgattttagctccatcccttccctctgggaatgtcttaacacccaatcagaagaaaatggttaaaactggagagtcagctgtgaatttagtaatccatcagggcagatggagagctggcaaaaatgtgtgctaggtccccatgctcttcgaatgtctcactcatctttgtcttgatcttttagatactcaacgtgtttgctatttaaataatagattgtagtttaaaatcacttccacttgaaatcaggccctctatttttaga

SEQ ID NO: 102078 - DNA, 1049 bp, Homo sapiens
acaccttgctatatttttttcctttgcttgctcctcttcagtcccaagacccttgacctatgttcagccctatgcgggtgagttgaatactatccctccaaacactcatgtcactggaacttcagaatgtggccgcctttggacatagggtctttgcagttgtcatcagataagaaggggtcctactggattatagtggaccccagatccaatggttcagatacagaggtgtgggcacacagagaatgccacacgaagacagaggcagaattgcagcaatgcagccacaagccaagaagccgcccggagctaccagaagttggaagaggcaaggaaggatccttccccagagtctcttgagggagtgcagtcctgccaacactttggattttggacttctagtgtccagaactgtgacaatcaacgtctctgtcatggcaggcctaggaagctaatgccctcttcttgccctctctcctgaacatggcctcctggtccctgccatcttgtcctaacctttcaatgtgacttccatgggaggtcagctgtctccctagtatgtgtctgagtgttggggtttagaattcatcatcttccccgtggcttgagatgaggtctgaggccatagggctcgtgcccatgccctgttccacccgtttctcctcactccttgctcaccccagccctgcccactcagctctgctgggggacacacgtcagcagatacctgtggggtgactataggtttttaggttggtgcaaaagtaattgtgatgtttgccattacttttaaccaacctaatatgtttggattgaagagtatcgggtgagagtttgaatctctagtgggtcccggctgtcctgaagactcccttccttcagcttcctgcatttaggtgacctttggggtatccggggtggtccagattgcaccatttgcttgcagttcacaagcacagcatgcgcttgcatgggcaggtgccatggtgtgcagtgggtaagggcagtcatctcacagaccataggggaaacccccaatctgagccaga

SEQ ID NO: 102079 - DNA, 1118 bp, Homo sapiens
gtgtgtgctcttggaggcaaatggatgtttaagagtgtgtgaggtgaaggatagcagactccggaagtctggggaccacttaggtctgtaaccctccctttcgcaccagctgtccagctctgagaggcctcctgggtttcccatttatggggcccctttactgttacggcacctgtttaaatgtggtgtttccattacgggaggcatggtaggtggctggaatgagcggccgtgcagggacgatgcgtgcaggctgcccctcctcccaccacttcttggggaaagtccatttttggtcttttgtttcagcgagaaatgcataaaaacgttttcagggacccctccccgcttgctttgcagctaaaatttcaggctttgacaataaggggccaaatctctttcgaaaccaaggcagcattaatgaaaacattgtcatgtccatatttcttttggaaaaatcttttagagcatgtgacatggacgtgcatgacattgggcttgaatgatgacagcattctgtgttcttccttggaattctgggcgtcctcaggcaggagagctttgctgtaaacggggtgatatcatccccattttacagataggaagctatgcactaacattatgtatatatttacttattttaaaaatactttttaatttatatagagatacggtcttctcccatctcagcctcctgagtagctgagactacaggcgcatgccatgacacccggctatttaaaaaattttttatagagacagggtctcactgtgttgcccaggctggtctcaaacttctggcctcatgcattccttctgtctcaacctcccaaagtactgggattataggcgtgagtaaccgcacctggccacatatgtatttaattaaaaaattattgaaattaaatataacatacatacagaaaagtgtacgttattgtatttgtacagcttgatgaattcttacaaatgggataaaaccatgtaaccagcacatagatctagaaacagaacatgctgagaccccagaaactttcctgttgcgcccccttcagggcaaccccaatcctgatttctaaccccatagatgtatttttgtacttgatagtaaggaatcg

SEQ ID NO: 102080 - DNA, 2361 bp, Homo sapiens
aaatattttcagaaaacgttccaagtgtggtgcatggtctaccatgacattttagaaaagatgtgtgaatgttcaaataattatctcatcttgaaatctctgtgattagaagttacaatttcagtgccacaattatatcaattgaactttaacatttcattgtaattataaaaattaaaaccttgtaactgtggttcttagttaactaaacaatttagcaatcgaattccttaaaagtagattgaaaatcctcaccctgtagtttttttccttttttccccctgctgacggacagctaattgctttaattttgagggttggatctgcctgcaaccttggccctgtgaaacctcaccaattgtatcaaacaattcaaattatcttaaaagtttgtgggagtctgttgccacaatttcagtggacttcaagtaagaatacacaaatgacagtctctttcttggaagatgggctcaaaaccagatatactttgtttctaaaagttgccggttagcatgaggaacctgcagtcttcatgacaaagactttagagatcccagttaactgcccattctttaaaacaggaccagttaatgtagcttattagagtgggaagggctaaaattgttccttttggacagactgaattttaattgtagtgatccatgtcttctcagcctgtgatacagcagttctgaatctcatccaagtcaggaaaagtgaatttatgagcctcctagcaactagcaactagtaagctggaatgcctggaccttatctttattacaacataggagccagcccccccccactattttggggcacagccctgcagctgagacagctgagacagtagtaacagggctttggggaaagttgtttcaagggtataagatatggtcttggttgctgcattatggttgctagagaactttaatttgggaaaaacttgaaaactcaaggtttttcaagcttcaacaagttacttcgtggaattctggagcagaggagagtcaggtttaatagtttttactcccactgtagatgctgtgacatgcatatccttgaattttttcctttgccatgaataaaatatttctgacctctagcagtgttaaaatggttaatagcctttgattacatgggcccacccttctccatttttctcaggcatgctctggtttctttctttctttctttctttctttcttttttttttgagatggagtcttgctctgtcacccaggctggagtgcaatggtgcgatctcatctcactgcaacctccacctcctggtttcaagcgattctccttcctcagcctcctgagtagctgggattacaggcatgcgccaccatgcctggctcatttttgtatttttagtagacatggggtttcgccatgttggccaggctggtctcgaactcctgacctcgtgatctgcctgcctggacctcccaaagtgctgagattacaggtgtgagccactgagcctggcctctggtttctttttaacatttttttttccttctacctgggtaattcttctggaagattccatcacagtttttttttttttttaaattacaaatacctcttttcattacataaagtgtgccagaatacccattataaatattctttagtgttgagattaagggtggttgttattttcttttattaaaaattttttttaaaataaattaaaacaatttttttctcttcctgtataaaagcaacttattttcttctgtatgattttctctaactttgaaagattttgtgatgagtagtagttacttgtataatcagaaaaatcacattaatgaatatacaccttcatctttgaatgggtgtgactagtggacacttaagccccccaaagtcatattttctcgttttgtaatccactttacacatggagattaatcacaaagtgttcctcttaacaacaaggaccttgggaagaataaagaatatgtgggctctgtcagagtgaacaaagatgagaaagccagtgggggccacagaggagcccagtgattaaatctcaatggaaggattagcgctattaatggatcctttcaggctgggattgaaccaagaccctcagtcatcagaacattgttgaccttggagggttgagtgcctccccttttttcccctttctccttagacactagtcttatatccacagtcccaatcatggttgtgtctcatgacttcagcttttctctaggattgcctcctggttcatgaatgatcccatcttctctgaatgtcccaaagcattgatgatttccaagacatttaattcatgtctttgttagtttcctcccggtaacaaggtacctcaatctggtg

SEQ ID NO: 102081 - DNA, 3345 bp, Homo sapiens
caggggcacggctgccccgcatcgtgcccggccccgtcgcggagatcccggacgaccgtcgcgggtgagtaccgcgggcctggggtgcgcgggcgtccggccggagccgccccgggagacggcggcgaggatgcccggagcctcggtgcccgtgccgggcacgttctgacccccgtctcccgcacactggggctcccggcgggtcctagctccccccgatcgggctttccacgtattgttttcgtgttcacacacttgggaggtggggagatgcggggaggagaggcaggaggaggcatccctcgcgcgaaggagggagacgagaccgtgcagcccaggtgccttcgctggatggaaatgacagcgtccggacgtcggcattcggtcctctcggcagcaggaggtcagcgctgacctgcggcggccgcggcactttgtattttatcggctgatttttgtcaacttcggggagggcgtgcttgtgcatccttgtgtctatgtttgcgtctcggtccctgacttaggcacctccgggcctggcttttcggcgacgcgtcctgggcgctcaccttggcgatccgtgccgccctcggggccgggctcaccgggcggaaagcccgggggccggcgcacggagctggggacccgcgacgaacccccggaggggggcattaaaagcggaatcctgcgggtgcgcagacaatgcctcatccgggcggtcgggtcccggggactgtgccctgggtccccgcgccctatcccgtccccgcctcgccctctcaccagctctgccgctgcgatgctgctgcgccgcgcccctcgccacccggctggggacccgcgtggggcccgcttttgtttacagacctcgccattgggcgagagcagcgcgccgtgcgccccccagccccggcggctgccgcttgccccctcgaaacctggagaagttgttgcgcgctgtcaggtgacgccccctccccccggccgcggggcgggatgctgcaggggaaagatgccgtctcggcgccttcgcgcccagcccccgccgcgcacggcgcctctaggtcccctgcacccgggggcgcccgtgtcccagcctggggtccaggctggcggccctcggggcgccgactcggccacactcacccggttccagtcgtcgcgtctcctggtcttgcccccgggtcagccctggttgactcggagcctgccttttcccgcgcgctggcaggtcttgaaggacgtgcgcgagcccttggggacactgtgcagtctgtgcccgcctcggtgacacccgcgcggccccgcagggcagctgtgccgcatcccgagtcagagccgtccggatcgggttacccatgcacgctgacttggcgcatactttgagttggagcagaggtttagagcctgtgcgctgaggtcaaacaaacccgggttccagtacctgctcggtgtcactcacaagctgggtgatcccggccgagctattctatcttcctgtgtctcagtttgcgcatctgtaaagtggggataaggaataacctctaggggggcggggcttaaacgaccatatagattaacctcaaagcacagtgacagccacgtatgaaatattagagtcctgttgattctgtgttagaggaaatctgtaatagaggatggccccttgtcgctttccttttctgcgttcttcactcccccagccccaatttctttttattataaaaggcatgaaggactgctgttctcagcttcaaacaggacttgttttacttggccttaggtttaattagatttatctaatcgcttgcagcccttttaaaaatgtgtttgaatttccattaggttttagttgtttcttctttcttcttcaagattctgctgggacccagacctgggtttggagaaggaaaaacccttccaggtggaaagcagttgccagtgaaccaaggactgctgtggaaagtgattaagtccaggaaggagggaggtttgaacaaagagatgtctggaggttaggagggaacactttctaggagagatgaaatttaagctatgccttgtagctgaagaagtttggtaaattgttggtttccagcatatgcttttttgtatctcaaggtaaaaagctgggctagggagggtggatgcctttgcgtggtaaacaccgacgttgctaagtaattatctttgaatagaggagaaataaaacttaaggaagaggctgttgactaagcagggaaggtagaagagaatcaatttcattgaatatcttcaaaatgttgtgaatgtgttttgagttgtttttcctccactagctctgcactgctacttttctttaggcaaaaagagaaatcagtttcatatagaaataaacaacacaaaataataacagtccataatcagatcagatgatctcaggcttaacgacaaagattttattgaaaaaaaaaaacttcctgttttaacacccttttgcctgttggaataaattattgggtccaacaacacattctttgaatgtaggccccaggggcctttgccagccaaaacaggcaaacaaacaaacataaactcgacttgtaggctgtccagtggttggagaagccctcaggattgcgctctgtctcttccgttcccctgggcctgcctcagttaccccgagtggaatctgactcccgtgaacccctattcggctgttgatgtggaacgcggccagtagcattgttgctagatgtcaattaataaatatgataacctatttaaagttgaactctcagaaatgattctcatccttcttgtacttgttctgggaattctcgcgcccttagggatgctgaaggcctctttcccccctgctgttgtgtggggatcaaatcagttgggggcctagacttaaaagggagcacgtggttaggaaatctcattagctgacaatttaactccactctaatgctcgtccaaagagcccggacaaagacttcctctcctttccctttgcagttctttctccttgctcctctcttctcccctccccctctaaaccagaaaggaaaagcagcgttgggcctgtctccttccccccagattcctgcagttctagtgtgccgactgaaaccctggagccctgagcaggaattccttgggagagtttgctgagggcctactaggtgcatgtattaacacttctgcgatttctgcaaggatcatactgtctaaaggagaaacacgttttgtgagacaacactttcatagatgtgcagtagaagcctctggtttttccaaatgaggaaggcaggtgagagcatgggaaccacatcaaagccttgcctagaaatctgtgcc

SEQ ID NO: 102082 - DNA, 1062 bp, Homo sapiens
tacaaaagcatccatcttggggcgtcccaattgctgagtaacaaatgagacgctgtggccaaactcagtcataactaatgacatttctagacaaagtgacttcagattttcaaagcgtaccctgtttacatcattttgccaatttcgcgtactgcaaccggcgggccacgcccccgtgaaaagaaggttgttttctccacatttcggggttctggacgtttcccggctgcggggcggggggagtctccggcgcacgcggccccttggccccgcccccagtcattcccggccactcgcgacccgaggctgccgcagggggcgggctgagcgcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggcaagggctgggacggaggcttgtttgcgaggccgctcccacccgctcgtccccccgcgcacctttgctaggagcgggtcgcccgccaggcctcggggccgccctggtccagcgcccggtcccggcccgtgccgcccggtcggtgccttcgcccccagcggtgcggtgcccaagtgctgagtcaccgggcgggcccgggcgcggggcgtgggaccgaggccgccgcggggctgggcctgcgcgtggcgggagcgcggggagggattgccgcgggccggggaggggcgggggcgggcgtgctgccctctgtggtccttgggccgccgccgcgggtctgtcgtggtgcctggagcggctgtgctcgtcccttgcttggccgtgttctcgttcctgagggtcccgcggacaccgagtggcgcagtgccaggcccagcccggggatggcgactgcgcctgggcccgcctggtgtcttcgcatccctctccgctttccggct

SEQ ID NO: 102083 - DNA, 1042 bp, Homo sapiens
gagtttcgtatttggaaattagaagacctggagtttccattacaccgaattggcacttaataactgttgtcggagcatttcttaagccacattttcgtaaagtggctttaaaattgctctgccagtaggcaggttgctaagatggtcagagacaaacttctgaacgactcttgtaaaatatacagaaatattttcagaacttttatcagtaaaattacaaaacgtgttgcaaggaaggtgcttgtgataacactgtccccagaaccttagtgaagttaccaactggtggaaaattttctcttgcactcggcttaaaaatcatgagggaatatttactatacgaatgagattcagtctttaaaggggtttacagaaacgtgagaggacaggaacagttagtctgtgtaaatgtctgaaatatatgtgagggagataatgagtttagcctttttctttaataggtctccagattttctggaaaaggttctttggcatttgactccattttgctgtttcatttgtcagacttctttttgtccctctttacttctccccacataattcaccagtactagtgttttgtttttcagaccaagtctcgctctgtcgcccaggctggagtgcagtggcgcgatctcagctcactgcaacctccgcctcccaggttcaagcaattctcctgcctcagcctcccgggtagctgggactacaggcgcgcgccgccacgcctggctaattttttatattttagtagagacggcgtttcaccatgttggccaggatggtctcgatctgttgacgtcgtgatccacccgcctcggcctcccaaagtgctgggattacaggcgtgagccaccccgcccggccaccagtgctattcttaagacgcctctgaggaatcccttctccctggccattgagaatccatgcatgaacccaggttttccaccttccctgagcagcttgcatagttccttcttttaagcgcctgacttcgttttgtttggtgcccgttgtacctgagaatgagccttggatagtg

SEQ ID NO: 102084 - DNA, 1040 bp, Homo sapiens
gacatttccagggcgactttttctttttttttttttaaagtcaagtgagtatgccatatggaaaagggtgtgcgtggagaaaaagcaaggggctccagagtgtaggatgagacatacaccttttgggttaaaaaggctgaggcaggagaatggcgtgaacccgggaggcggagcttgcagtgagctgagatcatgccactgcactccagcctgggcgacagagcgagactcttgtctcaaaataaaaaacgtttacatgtacatgtatattcaacatgtacaaatataacctattcaaaagtatttactacataaataggtacttacattacctatttactgtaatagtcaaagcctatgaagtatctaacactgatgtgtaggtactcactttgcttgccactctattaggtgctttttatgttatttaatcatgaagcctggccacagggtgcttgtgcattgagtgtgggaacaagattaccatctcccttttgaggacacaggcctagagcagttaagcagcttgctggaggttcactggctagaaagtggtcagcctgggatttggacacagatttttccactcccaagtctggctgctttttacttcactgtgaggggtaaaggtaaatcagctgttttctttgttcagaaactctctccaactttgcacttttcttaaaggaaagtaatggaccagtgaaggtgtggggaagcattaaaggactgactgaaggcctgcatggattccatgttcatgagtttggagataatacagcaggtgggtgttgtgctgtgctggtgacccatacttgttcaccctagttagataaacagtagagtagcccctaaacgttaaaacccctcaacttgtttttgtttttgagaaagggtcttgctctgtcgctcaggctggagtgcagtggcgctgtgcgatcatggctgaccttagccttgacctcccaggctccattgatcctcatgccttggcccgtagctgggactacaggtacacaccaccacgcctggctaatttt

SEQ ID NO: 102085 - DNA, 1043 bp, Homo sapiens
aaagggaaagagttgatgttttgtcttacagcatcattgtagaagagggtgtttttttgtttgtttgttttttgagacggagtcttactctgtggcccaggctggagtgcagtggcgcgatctcggctcactgcaagctccgcctcccgggttcatgccattctcctgcctcagccccctgagtagctgggactacaggtgcccgccaccccgcctggctaattttttgtatttttagtagagacggggtttcactgtgttagccaagatggtctctctcctgacctcgtgatccgcctgtctcagcctcccaaagtgctgggattacaggcatgagccaccgcacccagccagaagagggtgttttttaaagaaggcaaataggaaataaaaacttgggctcttaacttttgtaatgatcccaggtgtttgagctgggggttgagggtgggtgcctcgagcaaaggggctgcatttatttgcataatgccatgtaagagtagctctacaccccaaacacaggcttcttagtgggaccaaagtatgatacaaactgaagatggaatgcagaggattattggtactttggaatatgcttaaaaaaaatttttttaaagtatttttaaaaaatcaggcaacccctgaaccagagtaggttcagagaaactgccaaattttattttcttaatttgggattggaagcaagttaacagaagtttatgagttaagttgcatttagtgatcttttgccatatttgagtaataatctgatttttttgtttatagatttcttcttaaattaactttattcatcttgctaatttagtttcaaatagtgatttgtaatgatcagatttgatccatttctgtaattgctgaaattcccccgagttgctttttggctttaccgcctctggtctgggaggtgattgctctgctgcttcctgtaacttgcctgcctttctccctgtgtgggactcctgcgggtgagagcgtggctgaagacagccgtgttatgaaagggcctcctgtgctgtcgaggt

SEQ ID NO: 102086 - DNA, 1204 bp, Homo sapiens
taagataattccgtgtttcccccacctttgcttttgaacttgctgactcatctaaacccctgctcccaaatgctggaatgcttttacttcctgggcttaaaggaattgacaaatggggacacttaaaacgatttggttttgtagcatttattgaatatagaactaatacaagtgccaaaggggaactaatacaggaaatgtcatgaacagtactgtcaaccactagcaaaatcaatcatcattgtgaaacataggaagcttctgtagataaaaaaaaaaattgatactgaaaactagtcgagactccatttatatgtgtatgttttctgaaagcctttcagaaaaatattaaatttaaggacaagatttttatatcagaggccttgggacatagctttgttagctatgccagtaattaacaggcataactcagtaactgagagtttaccctttggtacttctgaaatcaggtgcagccccatctttcttcccagagcattagtgtgtagacgtgaagccttgtttgaagagctgtatttagaatgcctagctacttgtttgcaaatttgtgtctactcagtcaagttttaatttagctcatgaactaccttgatgtttagtggcatcagccctaatccatctgatgctttttcattattaggcatgttggagacttgggcaatgtgactgctgacaaagatggtgtggccgatgtgtctattgaagattctgtgatctcactctcaggagaccattgcatcattggccgcacactggtggtaagttttcataaaaggatatgcataaaacttcttctaacatacagtcatgtatcttttcactttgattgttagtcgcggtttctaaagatccagataaactgtacttgcagttcaaattaggaaaagcaattttattggacaattacggtgaaaatgaattattttatctaggtcagttaagaacactgttctgctaagatgcagtaaaaagcaggttacatttgaccatattagatctgagtttggaaaacagaagtagtctttagttttaaaatggccagattttcttgccaggattgggtttctcacttgttaaacagaacattttgttaagtttaaaacctgggatggacttaagtattcatgttcattcatgttcattcaggactgcaggttatcatgacttgtttaacttgtgggaa

SEQ ID NO: 102087 - DNA, 1100 bp, Homo sapiens
cttagttccgcagtcactcttactttggcagtttttttaattgctttggaaaaaaaggaaagtgaaagtgaataaaactcaaaatttcatgccaaatgaatgacgggcctataagtaaggtataatcctaaaaaatcttaatactttaagcaacagtattttgaattttgttcaacaaacctttataaatgatttttctgctttacaactatggctcaagaaaaaccataaaaataaagggttaactgaatggaagtgactactgaatgttaatgccctcaaggggaggtaaaagagagcctgtctacttggtgttttgcaagaaccagatgcagttccccaggataacttgggacaacagcttcccacaagttaaacaagtcatgataacctgcagtcctgaatgaacatgaatgaacatgaatacttaagtccatcccaggttttaaacttaacaaaatgttctgtttaacaagtgagaaacccaatcctggcaagaaaatctggccattttaaaactaaagactacttctgttttccaaactcagatctaatatggtcaaatgtaacctgctttttactgcatcttagcagaacagtgttcttaactgacctagataaaataattcattttcaccgtaattgtccaataaaattgcttttcctaatttgaactgcaagtacagtttatctggatctttagaaaccgcgactaacaatcaaagtgaaaagatacatgactgtatgttagaagaagttttatgcatatccttttatgaaaacttaccaccagtgtgcggccaatgatgcaatggtctcctgagagtgagatcacagaatcttcaatagacacatcggccacaccatctttgtcagcagtcacattgcccaagtctccaacatgcctaataatgaaaaagcatcagatggattagggctgatgccactaaacatcaaggtagttcatgagctaaattaaaacttgactgagtagacacaaatttgcaaacaagtagctaggcattctaaatacagctcttcaaacaaggcttcacgtctacacactaatgctctgggaagaaagatggggctgcacctga

SEQ ID NO: 102088 - DNA, 1147 bp, Homo sapiens
actgttgcttaaagtattaagattttttaggattataccttacttataggcccgtcattcatttggcatgaaattttgagttttattcactttcactttcctttttttccaaagcaattaaaaaaactgccaaagtaagagtgactgcggaactaaggttactgtaacttaccatggaggattaagggtagcgtgtggtggtctacaacatagttatttgggttttagtatttcatttagacagcaacacttacctaatgtttaaaggtaatgtctttgcaacaccaagaaaaagctttgagtagtagtttctacttttaaactactaaatattagtatatctctctactaggattaatgttatttttctaatattatgaggttcttaaacatcttttgggtattgttgggaggaggtagtgattacttgacagcccaaagttatcttcttaaaattttttacaggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaattagctctgatacttatttatataaacagcttcagtggaacagatttagtaatactaacagtgatagcattttattttgaaagtgttttgagaccatcaaaatgcatactttaaaacagcaggtcttttagctaaaactaacacaactctgcttagacaaataggctgtcctttgaaagctttagggaaatgttcctgcttagtcattttagcattttgat

SEQ ID NO: 102089 - DNA, 1153 bp, Homo sapiens
ttttccaaccatcccattgaatttttcaaaagggtaaaagaatcaaggttaacatttgcaacctaagagctttttgttgtgtttgaggacttcagtgcagcctactactgtttccttatataagccttgcctgttgcctttcttcaccagcgttttaattcccctgcggggcagaggtaaacgaacttttcccccacatatacgttctttcttttgcttaaagttggtgggttaaataggaaaaatcgttgtaggttatccaagaattatcacatgaaaacatctaaagccaagtcaagccttcatctgaaattgcaggaaatccagtgccaagacctgatgtcacactatccaagtatttatggccttgaagttgttttgaattactttttcaaactcctggtttcagtatgctgagcagttaactttgtctttgccttcatcctcaggcgaagctgctttattactctggtttttaaataatactcagcagcaagacctttggtttgatggggagaatatatctagggcaatgtccttatattcctgcctttagaaaatgagagaaaattgttttatatttatctgtaaatttaaattataaaacttgtccttaattttacactggcccactgagaagttttaaagtcctaacaaatggcttctggaagaaaacgtgattacccaacatccagacttgaaggacttacagcctgtatttccaatttaaagtattgggaccatcctatatgcacatgtaaaaactggtagtgtaattatatttgaagtttcaaaaggcataagtgagtctctaattgagttattccacataggcaacaaactacattagggaaatgtgttaaatactgctttttaaaaattctctactgagatttaaagaatggttgttttaaccacttactgtgaacatactgttgtttaccataattttaaaactttggaaacactacagatttgtcttccaatttagcttttcctctcctaaatgatctctcctacatttgataaagtacatatttatgaacaaacagcatttcacttatttctggtttatcagaaataatattctacaatttccaattgaataatttagtcaaacctgagttaggttaacattgaaaagcattctctc

SEQ ID NO: 102090 - DNA, 1186 bp, Homo sapiens
acagagacggaaggcaacagccgccgcagcagccacagcagcagccacagccgcaggcgccccagcaaccacagcagcagcagcagcagcagccaccaccatcacaacagcctccaccaacacagcagcagccacagcagtttagaaatgataacaggcagcagttcaattcaggtagagaccaagaaaggtttggaagaagatcttttggaaatagggtggaaaatgaccgggaacggtatgggaaccgtaatgatgatagagataatagtaaccgtgacaggagagagtggggaaggaggagccctgaccgggacaggcacagagacttggaagagagaaatagacgctctagtgggcatcgagacagagagagagattctagagatagagagtctcgtagagagaaggaagaagcccgaggaaaggaaaagcctgaggtgacagacagggcaggtggtaacaaaaccgttgaacctcccattagccaagtgggaaatgtagacactgcttcagaacttgagaagggggtgtctgaggctgcagtcctaaagccttctgaagagttacctgctgaggctacctcatccgttgaacccgaaaaggattctggctcagcagcagaggctcctcgttagagactggaatttgtgaaaatgtgacagtgacacttcctggagtgtagagcttgaggtgtacagatgctgtattatatccgctcccgctgtactgcagccccgcgccagctggtggggaactgtaagcaatttgattgcttcccttctatttaaaaatagccacaaaataacaaaaaatactgaaaatatgaataaatattaccctttttgctgtaactttttaaaagttttgactttaaaaagtttacaaatcgtaattagaagtgctctctatttttttttttttttttaatttaagacaaggtaacggtgaaagctcctcaaaacaatagggatgtttttaataaactctattttcgtaacaaactttaatgtgtgctattcttcctacactgcattaaggtggaaaaggattgttcaccgtcaaagtttgagctgttaatactgtattggagtctaaattagacttatttgatgaaaatagacattttatgtagttattctcactttcatatgtaatacttttgatttttagtgctcagtcataa

SEQ ID NO: 102091 - DNA, 1052 bp, Homo sapiens
tatatgcttagggatcttcaggtattgatgaaagagatgagtggttgatacatctttttcttcatgtgggaaaagttcatgtttagttcatgcaaagtgccacagtgacactcattctgtagagatcaaatcaaaacggtggaactgcaacaaagaacagaaaaggaggttgaaagaaaacatcctttctcaaagttcaagtcctcctaggtttatgctgggaagattcttaccaccctgggaaaagacctggagcttgtagcctctattcttaattccctgagaggtatcttctccttgatgagtttggtcatcacctctgcaaacaccattcactcatatgttcaataaatatctaatcaataaccattgtgtgccaggcacccttctaggtatactagaaataccagaatgaacaaaacaaaacctgtctttctggagtttatattttcgcagacctgggctaataatttaacatggagagtaaaacaggacagttaggcagtataagggtgtaacacggatatgtacaattttaaatacgattgctagggaaggcatctgaaccagtaatgaagagaatatccccatgtaaatacagaggaaaggaatgtagagtgaggaccaaaggaaagggggcctgaattgagatggggcatggattgttgaaggaccacagcaggaagggagagcaaagggaagaaagtggcaggagatgagcttagagaaggttgttgagcactaggctttgagtgcagtgggaaatggtgtagagtcttttatccatgccatgatctgatgtgcagtttttaaagtattactgtggctgttagagaaacagactctagaagttggtaagagtggaaaggagaccggttctgatgctgttgcagcagatgagatgggagctagcccacgttgggctggtgcaatggaggtgataagtggttagagtctgaagatattttgaagatagagccttcagaattgccatattacttaaatacggaatgcgaaaaagagtcaagaatgactcgttttttatgtgagca

SEQ ID NO: 102092 - DNA, 1368 bp, Homo sapiens
gcacacctactagatatctgtagtttttccagtgagcgagacttaactgagttcttggatcttaatttgtgaaatgtggcaatatttttaaagtactaggcaccaaacagttgttcagtgggtctccaaaaattctgtagtgaagcctgattatactggaaagaggcagtgggtgccttaaggatggtttggttgtatcatcagacttaagtgcgggtgttagtttgggagtaattagttgagttgtactactgaatttggagggaataaaaccaacttttagagattttgattcttttagtaatactgataatctgaaaatataaaattacttgatgcgcaataattattacttgattttaaagaaatctcacacacccaaatagctacagtggtggtagtttcataaaagctaaaggtaacattctacagttgttggtcacttaggagagaaggaatattacaaatgatagcaattcagttcattctctttactgtataagtgtttgtgttttacttttcaaaaacttttgtataacatgtatctctaatatgtacaacctatttttattaaaaagttcattgtaaatgtaaagtttgggttactttggtgttccaaacaataaaaaagaatacacaaaaaaatgtttgtttgtgttacctatctgtactgtgttaccagtatatccaaaatatcttttcaagcaaaaactgttctaggtcgaactcattccttttatggaaaattaaagcctcttgacaagtatgtttattcattaattatcaatatgaagagattaccaccagtttttgtcacactactgtagctgatggtaaaatttataaataagagttgagtatttgtaagatcacttcctacttgtaatttttgttaccaaaggttttaaagcaagagtaacaagttggtggcctgtggctaaattactaggcagtggtgtgctgcgctgcagtcctggcatggcttcagtagacatttgagttgatgattccagatttggacacctcaggaaattgtggggacagaattggtttgtgaattatatttaaacaagcgcaaatgtttttatgctatcgttatgatccctgaaactgcctaaaagatgaataactttgccagcaatatcaataggaatttgattttgatgatttcacttaagtttggatttctttgcccagtttctgtctagaattttagattttttagtagctcatttttagcaacacttactagaatattaaagcaccagtctactagtaatgcactagttagccactgacattaaaaggaagcctgaagaaaattctagaaagtagagttttcaaagtactaacataatacgtaatttt

SEQ ID NO: 102093 - DNA, 2534 bp, Homo sapiens
cccattccaacagtggtgtctggggctagaggaaacgccgagtctggtgacagcgtgaaaatgtatggctctgccgtgccacctgctgcacccacgaatctgcccacccctcctgtaacccagcctgtttcacttcttggtaagttatttttttttatcattagttttccttgccccaccccccccccacccccccacccatccccaagttagatttttttaaaaaaacaatgttaattttggtaaaattatttccaagactggcttttttggttgttttgtttgtttgtttgtttttgaggaagatcttcctcttaaagtcaaatatgtgtacttgatctttaccaagagagaatctcaaagacaaaatcatgtttgtctgtcttgaataaaagtttggatcttcacatccttatttggtatagaaaaatgattaaaagtaatctctgtgcaaaggaattggtacagagttcgtaattcacttaaccttagtctcttcccagcttttaggagatacttctttaacggcataggtttttctctgtctggaccaattattatctatctgaaacccctggacttgggtagcgttctttgtgggctagcaaagaaatcatctttgatacattccaataaaatggctttgttttctaagtaacagttgcgcagcctgaggtaccactttcccactcactctcagtttacttggctggagtttatctgttgtactttttacccacaacttcaatactgtgatcaagggcgatgtgacttagatcttttacatctttaagcaggcttactcttgcctgcttaagttatgaataaatacatcacatgcttgttacagtagaccatcttttaaattaacaaattgttgtatttgaagtggtattgccaaatataattaacacttgaatcccctaactggaagttaatatcttgagagtattacagtgttctagtcctgtgagcccatagtatttttcaaaggtatatgcatatgcctgtttgctttcataatctgagttgttttaggaaagaacctattgattacctctgagatgtaggactgtgagacattggtttgtaatggaggacttttacttttcacctatgctattcagtactgttggaattttttattttttgcatgtactatatttataataaaaaaacaatttgtttttaaatggtatactgtattctgccctcccctagactaagcttaggctgataatagccttgagtttatttcccttagtacacagattgggtaatggtaaaagaggatttgggattaaaatttatcacaagtgatacaggagtgtagttaccataatgatggaaaatgatttgtttaatgaggaagttgcttaagaggtctaccttccaatggaagtcatatcatagaaggaacattggactaggaaccagggaacatctttgcatcttttttgttatgcttttttttttttcatattaacatgattgcacaagaatcacagaatctggatagcaaccccttcttcacatcccacatacacacccttgattatgaatcctaatctaaggtccatggatgttagactacctgaaactatttgtaaaattgctgcatttgtgttttttactgggtttaataaatttattgaatgagtgaaaagatctcatgaactccaggagtttaataaccactgctttcaagcaactgtgaagcgtagtaagtagcctgcctgtgatttaacatttaggtcttgaagaccctgcctgttatttcttatcactactgaacatacaatttaacctctgcatccaacatgtgcaaccaaacacagatgagaagtcggtgagcttggaaaaacatagtaagctaggcatggctagaaaagtaattaaattctgaatcagtcgtagcgtttatcatcacctgacatactgtttgcatgtccatcttcctcccactagatggacccatgagaggggaacatttgttacatgagcgggtggttttcaatgcaggactgttcatattttacttctgatgattatcttcgttctaaaacagaattttaaaattgaaggctattctaaatccagaagggtttagaatttgacataagaaaagtgaaaacaattttgttaaaataagcactttgaactaaaatgcaatatgttagttcagtcatgagaaagaaagccttccatgtgccttcagtcagcagtcttgaaaagaatatcacaggaattttgaccttatagaggaatgagttttaaatgtgtatgcaagttaagaagggttcatctaagactaaccagttttatcattttgataaaggaatgtggtgaccacactgcagtattgcagtactaaaggatcagtaattaggttgggataacaagtgatggaatcccagaactaagatgctttggtatttcctcttggtgctctaatgttttcttttaagataataaaaggaattgttatgctcaccagaaaactataagtctagaagttgatgctaaacttcagt

SEQ ID NO: 102094 - DNA, 4695 bp, Homo sapiens
ttactcatacactttctttaaaaatgaaaggttccacttcctcctaatggacaaatgccaggatttggacttcttcctacacctccatttcctcccatggctcagcctgtgattcctccaactccaccagtgcagcagcctttccaagcttcttttcaggcacaaaatgaaccacttacacagaagccgcatcagcaggtaaaactttattctcagatagttttatctttttttgttgccttgacttatatgcagatttctccttatttgcttgctgtcttcatttttgaatatgaagaaagacctgggtacatattaaaccctctcagtgctccaggtttttcatctggaaagtggacatgctaatactgccaacttccataggattctgtgaggtttgatatagagtgttgaaggcttaactagtgcctacttcactgcattagataatggtttattaaaatggtatgtaatttaagcaaagtaactttaccagaagtagagaaatatttcttttaatcttttaaacaatataaaagtggtttttgtttttgtttttttttcccagtgatggccagttgttactagtaatttggtcccaggcaaccaaaagagaattgcttcagggaaggagatttttaatatagcttttgttagattttgtcctcttgcttttatactttttaaatttctcattttatcatggtttttgttttttaaggaaatggaagtagaacaaccttgtattcaagaggttaagcgacatatgtctgataacagaaagtcaagatctaggtcagcatccaggtaatttatagaaaatgttttttccaaccctgtatatcttaggggacatagaaattaaaattagattgggttattttcagatattcagaatgttagtaaaataacagttggtatgtttgtatttgtatatgtgtgtagaagggggcaggtgaagtattgatgtaaaaaaaaaaactacatcattcatcttactttttttccctatatttaagttgctcagatgtaacggaattttgaagatataattctatacataggtaatcagtatgtgatattagaagaactatattttcaaagttccattacagctttatcagccagcaaaagtggaaagatcacagtaatgctgtaatcagagaatgtttttaattgctgcagaaaagactttactaagaagataggtaacagtagtagcagtgtatctcaactgtgaaaattagctacttaaattacaaggatgtaattttatatagtaccagacggcactgaagatgacagatacttatataagctgtcaacattgtgtattttatttaaataatgtgcatgatttctaatttgggacatactaaatctgtaaaatgaattctcaggtattgcattcttacatacccaaacattaaattacctagtttttgttctgttttaattagtatgtgcttatattttctggtttttgtctatatgctatgcattctcccttctcttgaaaacattaggtcaccaaaaaggaggcgatctagatctggttctagatctcgaaggtctcggcatcgacgttctcgatctcggtccagggatagacgccgacattctccccgatctcgatctcaagaaagacgggatcgagaaaaagagagagaacgtcgacaaaaaggcctccctcaagtgaaaccggaaactgcaagtggtaactcaacctttatattcaaacctcatgtactattttttcatgtcttgggtttaaagtgttttataactgttagcaaaactataaaagaaatgttaccactgtgttgatttttatttgaaatattgctttcttgtgccttgtttattcattgatgtatacccttagatttgctttcgtaccttaaaccagctataaagcagcagtaaggagtgaaccaaaaatttacagaatgtattcacttgcattattttctgaatctcatcagatgtcttcagaatacatttagtaaggtgtgctagacatatatttgatataaatcagtaactattaagatgactaagattttaatttataatatgactagggcatatgtaagatttctgattccataaggcttatcacctaggacacaacataaaagaaaaaccatcaacacttaagagtggagaaaggacagttacatgcaagtgaacaaagcactgagctggttggtaatcaagagacttgagctccaatcctagttctgctgttcattggcagggtgaggtgggcaagttattgcttccctggcttcagtttttatagatgtaatctttagatccatctacaaaaaaaccagttttttccaacttttatgtatatctttcactatcccagttctctttctggaagtactaatgcagttttctagaatttttaaaatgtatgtgagatttactatttaaacttgtggtgttgtaatatagttcatgaatattttgtgtaatgattttttaatgtaagctacagtgctgctcattatcaaatgtgaatctctttatgattgtaattttattttaagtttgcagtactaccctctgggtggggcagctggacaaaagaactactcagcaggatgttgccagtctcttggaagagtttggtccaattgaatcaattaatgtgagtgtttattcagttttttaagtacgatggacaggtgtgattaatgtcattttatgaaatggaggacctgagaccaaagttacaatttgcccaggtttatagatgtgactagaatttaggtgttcagagtccacgtttagaattatctgtatttaacatttcttagaattctttgtatttaacatttcttggataaccaagtttaatttcaaacatttctaggtaagtctttatataacaaagcttggaggactcagttgagaccaaacttgaattgccaacttagaaatgaatttaaccttacattatatagcatggggtgagggatgggattgttggaactgcttacttggtgttgtatcttgttgcttttcaattttgttatcttttataatattaaaatgttttggagcagatgattcctcccaggggttgtgcctatattgttatggttcataggcaagatgcctatcgtgccctgcagaaactgagccgaggaaactataaagtgaaccagaaatccataaaggtacagtcttacatgttataattaattttttttttaaataggcagaaggggaaaaatatgtggcatataaaaactaatttgggtcttcgaaatgactttcaacactgaggcatttcatgtgcatctttttttttttttttttttaaagaatatttcctaaaagaactccagtgtttcagcataaaattgtaaatgttacgtgcatggtagaatttgttttgttttgtttttcctaaatgtagatgggttcatcatggtaaattagtgctttaaatataatgtcttttagcaatatgttttgtcctgttcaaaaaatttggatactgtatttttaaagtttgccatcttagaattaactgaaaaatattcaccaaaggtggagaaaaacatataggtatatgggtatttttcccctaaggagctaaagtcagtgtttcttcagtgtcttaacaccccattctaccgctggattgcactgcaaaaagattttgtctgatgttaagtaattacaaggcacccctagacttggaaaagtagtccccagtatactactaggctattcagggaacttcagcctttccctgttaaactttttccttttctctaagttttatgttggctgggttgggtgagagttggtaaggagaagatgccagtgaaatttccatcctaggacaaagtgagaattaaagggtaaccagttctgtagtgagaataaggctttgaatgagatccaagcctagctggtccagattgctcccttggtgcccgagtcggaatggatagaatgatagagaataataccctcaagacttacgaccttgctttgttttctttttatattttcactaatggtgaaatagattgcctgggccttaaacaaaggaataaaggcagattataagcagtattgggatgtagaacttggtgttacttatattccatgggacaaagtcaagcctgaggaactggagagtttttgtgaaggaggaatgttggacagtgacacacttaacccaggtaaagcagtatttaatttctcttacagttcacttatttgcttggtagtacatatgacaaatcgaatgtcctgttccttgcattaggacgtgatttttgagattttttaggatccctcctgtgtcagtatctccattataaactgagggttaaatagtgaatgagacaaaagagatgcaaacacaagtgaaatacttaactgattatgggatctatgaattacagaattaagtagaacttttcctgtgaaacttaataaatcatataggtcttaactgagcatctttggtattatgtttttttttatttattttttgaggtggagtctctgtagcccaggctggagtgtagtgatgcaatcttgggtcactgcaacctctgcctcccaggttcaagccactctcctccttcagtctcccgagtagctgggactacaggcgcgtgccaccttgcccggctaatttttgcattttcaatagac

SEQ ID NO: 102095 - DNA, 1538 bp, Homo sapiens
tcctaaaaagcaactaaaatttctttttgggtagaccccattttaattttttaattgctttaagtattttaaagcagtattcttcaaactttaaagaacatattaatatgtaataaactgtgaagatcataggttttgttttttataggcgactttgaccagattttaattttggctccaattacttacagactgtcctgttgttgaattaatgtttactgttcagtagtgtaaaataaagatggtagtaaaaatattttattgttgccatgagggttaaataaaaatatgtaaaacagcaaggtacctgggctgtgatggttcctgttcagaaaatactaacttgctcatttgtaagaactttactcacttggcctagaactacaaagaaacataagttagctctatcccaaaacacactttacacttagtttagtcctatatactgtgttgtctaaggacagaacttttcatttgatttagaaatgtgttgttcaataaagcaaaaccagaatctctaggcagaactattatagaatgacaaggttcaggaatttaaggttgaagtctataagcagaatgagcacggcttgaaaggaaagattgcttattgaaagccagagactgagggctttgaagtcaaaaggactagtgtccgcatcctgattctaccattcactgactgtgcaatcttaatcatgtttcttaatcacctgagcctttgtttccttgtctgtaaaaaagaagaaactatctacattgcagtgttcttgtgatgaagtctatatgatctgatacacattagtaggtatttaagcattatcttttttctgaataaatcttacttaaaattgttcttctagatatgtgatctcattaagtctcttgaatttttttttacatgaaagtttctggtaagctgtgaagttatgagaaagaagcaagcgaacctcttaggaactgctagtgacttttttgtgtccttgccattttttttctttttttatattagtatattcttgaggaagcagtatatggacacttttctatatgcattatggtgattgaataagacagtctttttgtacattttatgctgactgaaaatgtatacccattttcatgtgcacaaagttccagacatttttaggctagggaaatgagtattttagaaaaacatgtatgctgctaaattacttgtgaaatacaccaatagaaaatagaaagcactgtacttacaattgaggaaggaaaacagaatgaaaacactgtgtgttttccaaactggcatctgtgtaaaaattgtttatatctacaaaccaaggtcctgaggggcataagggaaaataagattgtgcttgacaatgtgggtttctagatggtggtaaacatcccttgttttcataaagttttttgtgcagtgaatcagtctaaattttaaaatgaaatattgacataattattccagaagttgcttgatagatttgactatgatgatgagccagaagctgtggaagaatcaaagaaagaggatacca

SEQ ID NO: 102096 - DNA, 2271 bp, Homo sapiens
gtgtttctcatgcgtaacagagtaaaatagttcgtgtgctgaacctttggcaaaaaaatggagtgttcaaaattgaaattattcaacctcttttggacatggcagcgggaaccagtaatgcagccccagtagcagaaaatgttaccaataatgaaggtatggtcagatgtatctgtgagctcacacaatggtatgattttttgcacatgaaacagtcagagtttatgtgtattgaaggaatttttctataagaaggaaacttgagtttacatcttggaaggtatgattttctttccataattcctatttataataaaggtctgctcttctggtagttgttacagtataaactctagtgccacaatctctatattttatactttgttaaattggataaaatgttattttagcaaagaagcttaattaggaaaacttgtaggttaactttttttttaggccttaatgcccttttcttttttaggctcacctccacctccagtaaaagtttcttctgaacctcccacacaagccactccaaactccgtcccagctgtaccacagttgcccagctctgatgcttttgctgctgtggctcagctgtttcagacaactcaaggccaacaggtaaactgtctactcaaaagtgaaattgtttgcaggactaggtactgttgtcacttcttgttttctattcttcattaataagcacattgaaaggagaaaatacatctgcttttcaactagaaaagccttcacaagagaagtaatgtaggaggaacagggaaaatgtagaagtgataaacaagggaacaacacacttagaaatgacagtacctctttgaagaggactttagaactactaagtggctcatgttgctcacaattctagcatttctgatggatttcaaaattatttttaacggagagaatttttccatttttctagaaaacttatgcttactttgttcacaattcagtgtattttctctttttttgaccatcatatcattgacattgtcagcatacatttttaaccttaagaaatgcacattatatctctgtatattcattcacaacaaatttaaccattcataaaaggattttttccccaatttgttctgtgcctatgctactttgaatcacctttaagacatttttttattaaattaacttttgatagtatgattatactttgttctgtgatttattggttttcccattctttaagcttcagcagatccttcagacttttcaacagcctccaaaaccacagtctcctgcccttgacaatgctgtgatggctcaggttcaggctatcacagctcagttaaagacaactcctacacaaccatctgaacaaaaagctgctttccccccacctgaacagaaaactgcatttgacaaggtatatttctctcacataacccaccccaccatttatatcactcaacttgagttatggaaattatcacttctgtatcccttctgtggattgttcattatgtcgttttgtaatttgagagattttccccctcaacaagaaaacatcgattattttccctggttttaaatgtgatatgtgctcagtgcaaaaatttccagggtttgaagctgaatttactagtgtaaaattaaaaaagtgaaaaaaaaaaaaaaaagaaaaagttagggagtaaaggaaacagaaaattcttcattaaccccaatacttggggattactgtgtaacattttgccttacatcttttcagaattaatttcctacagatacatgcttttctttaattgagtataatacatacccacttgttttggtgttaatactcttgtatcttttttgttgttgttaaggttaatagtggatttagatctacatttttactgaatgcatgtaatacatagtattccactacatgggcacattacagttcagccattccactactaatagacattcaaattgctttcagttttttgctgttaaaaaaacctgacagccaagtgtggtggctcacacctgtagtcccaacactttgggaggtcgagaacggaggatcccatgagcccaggagtttgagaccagcctgggcaacatagtgagactccgtctgtgtttatttatttttaatatatatgtgtgtgtattaataatatataggtattatttttaatatataaaaatatataaaattatatattatttgtgtgtgtgtgtgtgagtgtgtgtgtattttaaccttagttaccatatatataatatgagggtttggga

SEQ ID NO: 102097 - DNA, 1325 bp, Homo sapiens
ttattttttatgtacatgtacatttataaaagtaaaaatggacataatactggttgttaggctgcttttcccactgagtttatcgtaaacagttgcaaaatactcctctgcggttgttacagtgatgcacacagccattttctgagttgttagacctaattttttttttttttgcataaattcctagatgtagaattggtggattaaataagactttgcttttattgctaaattgtcttctataaagggttatacctgtttccactaccaccagaaatatatataggtgtctgtttctctgcttttctctgctgttgtcagttcggttagccaaaaactacttcttgtttttaatttttatttggtactgtaatagaattaaaattgatatgttaaaaaatgttttgttaattttgaaagataaaaattacctttttgagcagggtgaattgtagagactatcataataagtgaatttatatggaactggcttaaggattggtaaagtaatgtcgattttgggacattgggtgtagggaagtagagaaatcaaagaagagtaaaatcttgggggtcagtagtatcaagagaatggtagttccattatagacatgggaaatttgacaagttagccatttagagagctgaaacattcaagtagtttttaaacaaaagcaatcattggatggatatataaaagtttcataaatgtgaaaataatgggtgtcagattgtgactttgctttttctgtactgatcttacatctttatccttgcagtgtaaaccagaatacaaggttccgggattatatgtaattgactcaattgtgcgacagtctcgtcatcagtttggaactgataaagatgtttttgggccaagattctctaaaaacataactgccacattccaatatttatatctttgtccatctgaagataaggtataattaatttttaaactaaaacttgtattctttaaaaaatattattttaaatgtatgttagatatttggagcctactatattaccagataagattttcatgtagcgatgtctgtgagcttgaaacaaaacagtttttttcttcagtggtcatttcgtgtttattttcttatgagttcttcaggattatcagtcatactgttgaaatatgacaggaacaaaatttatagaatcaaagagtttaatagtggttgccagggactaggggtaagggaaacattaggagctgctaatcaataggtatgacatttcagttaagcaagatgaataggttgtagagatctgctgaacaaccttgtacctatagttaacaattctgtatt

SEQ ID NO: 102098 - DNA, 1028 bp, Homo sapiens
actgtgtgtatgtaccattgattaactcatacacagtattctgctttcaggtaaagtgacatagtggtacttgtttaacatgtgattggctttctttcctcgccccattatattacctgatattaaaaaagtattaacccagacacacatttagtaaattatatattgaaggcataagatgaaataccaggttaagaaaaggactgtacatgatcccttacctagttgttctagcagtagtgttttatggagttgtcttcaggtttaaattagatggataaagcatctttacaggaaagatgattttaaaacttgtttaaaattatcttttgttaagaaatttagcgtgtgctttgttatacagtgtctatgtgttgctaataaacataaaagttgtgttggatttaactatttggtttaagacagtgtctttgatatattaagttgagtatgaaagaggaggaaagactgtagaactaaatgctttgatatttgcatctaacaggaaggagatttgaatactagcctgtcattgtgagtatatatgtatttcttttaggaaacatttctattttttctttaaattcaacttcacatagtaataggagcttaagggaaaattgctttgtcatcttggaggtcatactaccaaaggaaggaatactggaaataatcagtgtaatccgttacaaagtaaatttaggaaaatacattttttaaagtttaggtttcgaaaagaaagggataaatatcccattgagaaagattcagaaagaaatattgcttgagagatttaagttttaaaaagatggcttagattagtatatagtcttctaattcttattgcctcggcaactttatttcaaaaagtaggaaaaagcatactttagaaattgtagactctgggccagtttacttttgtctgccagtttttattaattttagaaattgctagtcactaagagccagaacagattcactaacaatttataacagactaccatttgtaaagtatgttatgtctagtg

SEQ ID NO: 102099 - DNA, 1050 bp, Homo sapiens
gaagaaaagtcaacaagattgtggaggagaatatggtatagtaaagaaatttaggaagaagtaagtatgaaaattttgaatttgaatattatgtgcggttttgttgcttatgaaagtacctggtttggaatctcttgaaatctgaagagtaaattttgtacagaagtagatggaactgttttgtaatgtttacattcaaacaagactctgctcagtcggagcaggaaaatggtagagcatctttcccctatttgttttaaaaagcttttcggggtgggatgaggtggctcacgcctgtaatcccagtactttgggaggctgagactggcaaatcccttgagaccaggagttcgaaaccatcctggctaacatggcaaaatcccatctgtaccaaaaagaaaaagctttgtaaattttctctaccttaggagtatttcatattgacaatgccagatttatcttgttttcataccttcctctaagcaagtggaaaagtggttaaatgtttaggtttcaaaaggtttgagtctgtgacaagcaagtggaatttatatggaagtaagctgtatatcaataattaaagggacactttctttaatgaagagatgttgaaaaaaatataggcctggcacagtgcctcacgcctgtaatcccagcactttgggaggccaaggtgggcagagcaactgaggtcaggagttcaagaccagcctgactaacatggagaaaccccatctctactaaaaatacaaaaaaattagccaggtgtggtggcacatgcctgtaatcccagctacttgggaggctgaggcaggagaatcacttgaacctgggaggcggaggttgtggtgagccgagatcgcgccattgcactccagcctgggcaatgagagtgaaactccatctcaaaaaaatatatatgtgtgtgtgtgtgtgtgtgtgtgtgtgtgtgtgtgtgtgtgtatatatgtgtatatatgtgtatatatgtgtatatgtgtgtgtgtgtgtgtgtgtgtgtgtgtatatatatatatatatggcagcagt

SEQ ID NO: 102100 - DNA, 1048 bp, Homo sapiens
gtgataactatcaaaataatgtgtacttttggaaggacttgtcacagtttaagaataacaaggtttggttaagtttttgagccatccacagtaatgcagtaaatgtaatcagcatttaaaactaaagatgtctattctttttaccagtttatactccattaaaaattttaactcattaaggattttataaatgctagcattaatattgttttctaattaaatgattttatgtcctggaatcaatttttatttcttgtattgatgtctaggaagaagtgtttaattcacaaaaatgttttaatagccaactgtgaggggagggagaccagaagttcattagtgaggcacagtaaatgtgatgctgaggtatggcacctgtactgctaaaggagagcactggcatggataaaacatttggcatttcctaaaatcacctcctggcctgtctttcaagcaagtgaaaaggaagaagttgtggattgatttgggaagtacatttggaaaatgacctaatgtgataagctggaaccaatagggttaaaaaccctggtgaggtatacagccttgattctaaaagtggaaagtttgagtgaaggctagacccttggaaattgtaggggaggtagtgtaaaatgaagaatacatggccaggcgcggtggctcacgcctgtaatcccagcactttgggaggccaaggcaggcagatcacctgaggtcaggagttcgagaccagcctgaccaacatggagaaaccctgtctctactaaaaatacaaaattagccgggcatggtggcacatgcctgtaatcccagctactcgggaggctgaggcaggagactcgcttagacccaggaggcggaggttgtggtgcgctgagatcacaccattgcattccagcctgggcaacaagcgtgaagctccatctcaaaaaaacaaaaaaaaagaagaataataatacattaggacatgctttatagagtaagttttcagaaattaactattaatacttagaaaattagttctgcccggagtaaatggtaatagaat

SEQ ID NO: 102101 - DNA, 2069 bp, Homo sapiens
ggccagaaagaaaacttgaactgtatgtgcgcgcgcgcgcgcgcgcacacacacacacacacacatcatataaatcataccagacttttaaattgcattaatatatgttttttgaaatagtggaaaaacttatctgcatactgatatgtcacaataatgaatacaaatgttacaggattttttgttttgttttttgttttgtttgttttgttttgttttttttgagacggagtgttgctctgtcacccaggctggagtgcagtggcatgatcttggcacatagcaacctccgtttcctgggttcaagcaattctcctgcctcagccctgcctagtagctgagattacaggtgcacgccaccgggcccggccaatttttgtattttaagtagggacggcgtttcaccatgttggccaggctggccactatctttaaaagtcttaggcaggtttgtcaatgactattaaaattgatcttcacatatttgtgttcggtagacagttacaaccagatttattcatctgttttcacctacagttaagagcacttttaattaattttaattacaaaatgttgtacatacagcaacacatacacaaataggaagttttaaacatcatactgtgtttggcagcgatttataagcatacttcacaataaattctagaaatcacaatactatccatgtatttttttcagcattgagtgtaatgactttttttttagatggagtcttgctctgtcacccaggctggagtacagtggcgcaatcgcagctcactgcaacctccgcctcctgggttcaagcggtttccttgcctcagcctcctgactagctgggattacaggcacgtgccaccacacccggctaatttttgtatttttagtagagacggggtttctcaatgttggccaggctggtcctgaacttggacctcgtgatccacctgcctcagcctcccaaagtgctgggattacaggcgtgagccaccacacccgaccttgagtgtaatgactttgaaatgcctcagtcaaaattttactgaaatggttatcacctaaaaattcaatgtaaatgtctattatatttgataaccacttttgatattcacgtacaaggaagtacagcttccttgtactttgttgcttagtgatggcatctctataatttttgttcacaggtcttcacttttaaagttttatttatctctatatttgtttgaggccgattctggttgtttgtaaatatttatgccagaaaaaatttatctcagaaaaattggacacagctataattttgaatatactatttaaacagaggaatgtatataggtacaataggattggagtcatgctgagcctgaggagagctgaagctatcctgaacctttttgtacttactctccaaatgaacaggtatatcaaatctgcatgtgttgggaactgactgtataactgggggatttcctaataaacttccaattaagatggattgcttattaaagggtatgtaataaaaatgtgcagatttgacatttttatgttgttaaaactcagcagtaaccacagcaaccccttaaaacttaaagagtattgccaaaatattttgggggcgatatattttatccctgggttttttagaattgcctgtgctcaggccaggcgtggtggctcacgcctgtaatcccagcactttgggaggtcaaagtgggtggatcatctgaggtcagaagtttgagaccagcctggccaacattgagaaaccctgtctgtactaaaaagacaaaattagctgggtgtggtggctcatgcctgtaatcccagctactcaggaggcaggagaatcacttgaacctgggaggtggaggttgcgaggagccgagattgtgcctgtgcactccagcccgggcaacagagcgagattccatctcaaaaaaaaaaaaaaaaaaagaattgctcttgcttgatgttaataaaagaacaaaatcaaagtcttgctgttttatttagtcttgatagttcacccacttactgcctgcacctgggtggactgctcctcttgcctcact

SEQ ID NO: 102102 - DNA, 1013 bp, Homo sapiens
ttgatatttaccatattagaaatttaaactgagaaatgcaagtgtttattaatttactaaaaataacaataaacttattacaatatgttaatataaataacatttttaatgaaaagtaacgtttctaaaacaaaaaaattaataaagagtgacatcattttgcatttttgcacgtcatttaaactttggtttaataaaacctggatcctcattccactttttcattcagtctgttgcagtaacacacatcaggtagcctctggaatatactgctacatacttctgagaaaacgaacaaaaaggcaagaactatcttagtattcatatgaaaacagttctgacctcaaaccacggaaagggactcaaagacctctcagaggtccttggattactctttgagaactgcagtgctgaggtggtatgcatataatgctactttgcagtacagaaaaaaaatgcgagtacttgtatattcatggttatctttaaaattggacataaattaggctttatgaatacttaatgtacgaattgacattggtacacttatccagttgggctgtcaatcatgttattctgaaggaagagttgagttttacatcttagtgggagcttggtactcccttctcttactgtaaattgttctgtatgactattgttgattactagggatgattgtcttctagaatttagttcatctgatggggatgccttattaagtattttttttttaacctgtagtgttaatgtttggggtttgatcatttctgagacgtttatctaaagacatgtagacagagggttcaaagttctttactgtatggaaaagatgtagaggaccaggtcgattattggcagtaaaattggagatttcccttgcaaaagttgaccatgttgtgctgttatcccaggagtttttgaatgttgaaagttggttatacagtgttttctttctctactttcttgacccagggaattcttagtttctgacaagggtattggtctggctttat

SEQ ID NO: 102103 - DNA, 1583 bp, Homo sapiens
ccccgcttctctaccaatcaaaacaggtgcctcgcaaataattgttgaatgagaatttaaacaaatggcacaacaatagttaaaatatttcaagtacatttttctcccaacaatgaatgtgtattttaaaaatttatttcagaatcggaagaatgaatgtttttgatgaaagaagaggatttttagtttattcttaagatcagaagtattctgattcaggcattatggaagttgacatcaagcacattgttaagcaaagtattttctattaatcctgaaaaggcacaatcagtaatttttactttgaaaaaccaaagttaggaatggtattgattccttgaaaaagggaagtgatatttgaccttttaaatgtgcaaaatgagcattttcttatcattgttcattttccagttcatttcagttctattcctagtctttatgaactgcaaagaatgccagctctcttctgctaaattaaaactcctctagagaaattaatctgagtttaaaattcatcttactgtgcctacttgatttgtagtgcttctcaactatttctccccattcatgaaatgttcttgattcgttccccatataatcttgaatctctgagatctgatcttcacttaaacttttgagtgcctgctcacctgcacagccatgtcctgaatactgtagagctaccaaggatttcagtcacctaaaagtctaatccaatagaggacataagacttagacaaataattttaataggaggtagaacagcttcctttgggatccttccattgcagtgtggcatagccattggagataagtgaaggcttgggaagaggagcaggtatcagttttaggatttcagaagatgtaggaagcagtgatcgaagggcagtagtgctgaaaagtgagtattttgattctgaaggctactggaaagtaaggatggtaaagtagtttgggcctgacaagtttcatgtttgcctaatgtgtttgaatttcagttttaggctgtgggtaaacattgaaggttttaagcagtgggataatgtaatcaaaactgtttcgttcgtagtgttatgtgttgtaggaggcagagacttggtaggaaagataagtaaaacctgaacttggcaagtgtatagtgggaatggagaataggaaaaggatgtgggccaaaggaatccatggaccttggcatctgataggtttataagcaccttttgtccccacatcctaagggctgagagagtggtgatacccttatcacaagtcatcaaaagcctacttagtagagaagaaaatgtgtttgatttttgaacaggttaattgtggaacaatcatgtggaaatttttggcaagtagttgggcttataggacttaaacttggaagcaactaagagatagagggagacatccaggagttcagatgggaaagatgggggaaaattgaaagggggagaaaaaggaattaatataagaccaatggcatgtcaggcattagatatgtacacatatctaatttaatatgtattcccacaaccctgcatagacgtccaattacagatgaggaaactgattttccaaga

SEQ ID NO: 102104 - DNA, 1108 bp, Homo sapiens
ggcggatccgtggcgaggcgggaaccagggctagaggaggtgggctcttatgtcggggggcggggggggcaggaaagctaacagccagcctctggggggagcttagagtctgatccccgtcctgggctctcggaggaggtgggagaaggctgagatcctgcattccttcccacctgtgggctccggcagctagggaatgttttttggcagctagggaatttttcgtgctcagaggagggtttttgcctccgccctccacttgtccatccctcaacctgtgctcctctctatccactcaaccctcccacccctgccccctcatcacccaccattctcatccccgccattctcatccccttctctccgttcccccagctcctctgtgccctccagcctcagggtgggagctgcagtgaagaccctgctactggcaggaacagaactacagatacctccccccagagactgggagatgccttcttatctttctagaagaggggaaaggaaaggggacctccgcgagaccaaaaggggcacctctccagccttgttggaagttagatggttgtgaacccttgccaggcgaggggcaggtaagatggaaggtgtaacttagagctgtgagaagaaacccaagagcttggtgactcgcttttgaggccgggtcaccccaggctggagctgcccgagctcagagccaatccaggctggagctgtcccaagctcctgtcatctcgggctcaagactgcccccaggctgggggtggctcaaacctggagggggaccagctcctttgtgtggtccgtgggtcagggaggcgtcagccgcaaggagggaaggcggagttcacttcccaaccgagcaggtggcctgggagccgagccctctgccttccgacctgggggcctctgcccagcctggggctgccctgtgaaacccctggtcacagggccaacctgcccttcctgcctgtctctagcctcaccccacctgtagttccctccccaccccatttcccctctttgtcttggagccttttgcctgtgaatgcaggtctccgtcacccttgtcattttccctgtgttccctacagccgttttgagtgag

SEQ ID NO: 102105 - DNA, 1054 bp, Homo sapiens
tgggtattgcctaactaaggccaaaacaaagatgaccacagcctcaggctatttacaacctgaagttcttttaaaaggtgagctactaagatgattttggcctggggaaagtttcctccagtgagcagagctgaggaaaaggaggtcattaagcctccagtgtcccccactgtgggtgacccagggaggcctctctccctcattaattcctcttttcttggggtgtgtacattttggatttagaatttcacttttctcctgtcctatctatttattttttaaattttttataaagacaggggtctcactgtgttgctcaggctggtctccaactcctggcctcaagtgatcctcccaccttggcctcccaaagtgctacaattacagatgtgagccactgcacctggcccatccttttataaaggatccattccacattaggaggggaatgaagtcattaatactgtagtgagaagtactcccagcccacgtggagcgaaaggattcagggcagcttgtcttgggaaatcagtccatgaaaaagctgaaagagggcatagggaaacagaagttgagagggcaccccaagtttggcctgcttcatagctgcattctcaaactgtgagaattagttttgggtgatttgtgctaaaatctagggcattgctagttgaaggcatttggtatgggggtgtgtgtgtgtgtgtagcgtgttgtgtttcgacttggttacacttccaaaaagctttgggtgaaatccttcatggtttgctgggaatcactgtctgagtccagatgacaaagggagccagtttttcccaactttccttttaggtttcaatttgatctcatcaagaggctgcttttgccaccactgcctgtaggacaatcttttgcctgcttttcctctgaagttgtttgtttagaagccatttgaatctagatggctcttttactgcttgtaaaggaaagatggcttgcggctgagacctaattgtgtcctcctttgagttaatgcaatctctgttaatctggctttaaaaataaatagttc

SEQ ID NO: 102106 - DNA, 1109 bp, Homo sapiens
ctcatgcctgtaatcccagcactttgggaggccgaagtgggtggatcatttgaggtcaggagtttgagaccagcctggccaacatggagaaaccccatctctactaaaaacacaaaaattagctgggtgtggtggtgcacacctgtagtcccagctacttgggtggctgacacatgagaattgcttgaaccctggtgatggttcgtgatacctacaagaggcatggtctctggcacatgacaggttattgtgttttgtaaaaaattgataaaagttgaaaaaatatagttggaaaagctgaatcgagaaaagagtaggtgtatctcaggtattgagccagtgttgtaggcaggcaaactacagaacaagaacagacagtccatgccactgttaccttttttgtgattgagtctcactgagatacaaagttgagtacataaaatgattggttaagatgttgaaatatcttgttctaacccttggttaaagaataataagccggcttgtcacttccatcagaactatttttaggctaagagtaagggttgcctgcttactaagttgccagtaatcatgcttagagcatgacagtgccagatacctggagtgaaggagttactaaaaatacgatttactatgttttgcagagcaagaaatatgactaattttagaggtggccttttggcagatctgtttttagcaagtatttctgaaacaaacaggtgctaaatcctgtatttttgaagtgctagaagtttaggggtaatcgctctgaggaacaagaaatgcttagagaactggaaattcctattaatccttggcagggacttcttggcaagaaggaggcatttgcaaagcacctgcttggtgagccctgtgtgacaaggcagtgcctgtaatttcgaggattgcattctgcagttgcaggcggattcttttgaacttcctgccctgcctcatctttttgaagtacttgtgaatgatggaaattggcacgtagggcctggttcctagtgttcattgatacaggtcccacggacttcaaagggtgctttgagtcagcgcaacagtgcagaaacggtgcccacggagaggagtacaaccctaca

SEQ ID NO: 102107 - DNA, 1096 bp, Homo sapiens
ctttgtgtctcctgagtcatcattcaacctgcttcaggggcccagggctctcagacttcctgtgtgttaagagctgaagcagctgttgaactagggtctcagagactccagtctgcaaattcgaagagaaaaattctccccagtgttgattacttatcagcccggttcctttcttggatggggaaatggtgtgacaatttaataacgggcctgtgacaattacatgcaagtggagagaatgaaaaaccagccttggaacagagatttttcttttctgggaatggtacgtggtggttttggctttctctatgtgtaatgggagaggcccatccatctctgtgtgacagaggaaaatttcagcattaggagagtaacttctgatttatcacaaacagctgggtgggccatgcctcactggtgcccaggcttaagcagcctttgaaatagagttgctcagtgtggcttctgcatctgaaagggccagtgagctgctgtgtgtttcacagtggttgctgagctcttgtcatcctgatcacccctggtagagggtcagtgtgaaggagggcattaccttgaacctgacaagtcttgtatctgtcaaggtgtttgctatgggctgaattatgacccccaaccacaaattcatatgttgaagtcctaacccccagtatctcagaaggtgactgcatttggagataggatcataaagaggtaactaaggcgaaatgaggttatctggataggccttaatccaatgtagctggtatgcctagaagaagaggaaatttggacacagatgtgcgcacacacagagagagactgcacgaaggccacagtgagaaggtggccattcacacgccaaggagaagggcctcaggaggaagcaaccctgctgacactttgatctcagactttgggcctccagaactgtgagaaaatacagttctgttgttggagctgcccagtctataatcctttgttttggcagcccgggccaactaatacactcttcatacacctccatttgctgagtgtcccagaagctaaggtcggcttcaggaatcatgccgggaaacttcacctgattcacgagacc

SEQ ID NO: 102108 - DNA, 1444 bp, Homo sapiens
taacgttctctattagtttcctgggctgccataacaaagtaccataaactgggtagtgtcaaacaacagaaatttattatctcacagttctggaggccagaagtatgaaatcaaggcgttggcagagccatgctctccctgaatgctgtaggggaggagaatcttcttttcttcctagctctggtggttgcctgcagtctttggcctgctttggcttgtagatgcctcactccagtctctgcctgcaaattcgcgtgacctttgctgtgtgtgtgtgtctgtgtttcctcttgttgtaaagacatcagctctatgggattagggacccatcctactccactatgatcttatcttgactaattacatctgcaatgaccccatcttcaaataaggtcacattctgaggtactggtggttaggacttcaatgtatctttatgggaaacccaatttaacctataatgtgttctaaaccaaactcgttgcctttgccactgaccaatctgcctcttcttcattccctgctactcctgctcagcaccatcttggttcctccatcttctcagtcccttttgggttattcagctcctgtaagttacacctctggctgctgtgtgttttttttttttagacagagtttcactcttgtcacccaggctggagttcagtggtgcgttcttggctcactacaacctctgcctcccaggttcaagcaattctcctgcctcagcctcccacgtagctgggattacaggtgcctatcaccatgcctagctaatttctttttaaatggagacggagtttcaccatgttggccaggttggtcttgaactcctgacctcaagtgatccaccctccttgggctcccaaagtgctgggattacaggcatgagccactgctcccagcctctggctgctttttgatttttatctcctactgagtccctttgacacagtctagtttaatcctcgttcattctccccatcccctgttcctcgcagcataatccatcctaattgcctagaaatgaactctaatgagtccacaaactctccaggcccaccctcctagctccttccagccccactgaaatgccacgttagttcttcctggagcctgccctcctctgcccagctggaggtagtttctccccgctctttgttctgtctccatgtcacctctcttactccatgcaacatcttgagcacaagcaagcgtgtggtagctgcctcccaggttgcaggattatttaggctagaaccaggtcttagttactgaaacacacacacacacacacacacacacacacacaaactctactgtgctcgtcatgatttttcacgaatagtgggtactttgacagactcggtagaatgcaggtctccatgtggaagctctggctacaattctgaggttttgtcatggtccaaaggtctcctcttcg

SEQ ID NO: 102109 - DNA, 1049 bp, Homo sapiens
acttgataagcaagaccctgcaaaacactgtacatgcttcatgtaactcccacaagccctacgaggaagaatatgccattatttcccctttttacagaggggaaacttttggttcacacagattaagaaagttggccacggccgggcgcggtggctcacacctgtaatcccagcactttgggaggccaaggcaggtggatcacctgaggttgggagttcgagagcagcctgaccaacatggagaaaccccatctctactaaacatacaaaattagccaggcgtggtggcgcatgcctggaatcccagctactcaggaggctgaggcaggagaatcacttgaacctgggagacggaggttgcggtgagccaagatcgtgccattgcactccagcctgggcaacaaaagcaaaactctatctccaaaaaaaaaaatcttcttcctcgtagggcttgtgggagttacatgaagcatgtatagtgtttcgtagggtcttgctggtcaagtgcttattcaatgaaactagtcccagttggaggtttatatggcttcatgctgtggtccacacataggcctttttgttttcacaccatgaaatttacagagaaatggcgattgtccaaagagctcatcaattgcatgcttattgacagctaaactagttaatttaggccactaaatggatctcccagccattggaatatttactaagcttaagttaatcagacagttgcctacatttatttattgattttctagaccatggagatccgccctgtgtgctgcttaattataagctctcacactattaatcttttctttatgtaatgataaaatgtgtttaatataatgagattaacactactgatccacttttgaaaatgtgatcatgatcaaagtgtctaattttactttttttttctcggtgcgggagagaggtggaatttgcaaccaataaatcttgattcgatgaaagccacattaaactctttctaacatgattttaacataacaaagctccattaatgttgatgaaagcaatggataact

SEQ ID NO: 102110 - DNA, 1388 bp, Homo sapiens
ataacctctttaaagtctctctctttaaatacagtcacgttgggggttagggcttcaacatacgcaattcagtctattgcagatggcaatcttgaaccatgacaaagaatctgaattatcctcccctccccgacaaatggtcctaaagatccaggactcttttatagtacaggttaattatctcttatctgcttgggaccagaagtgttttagatttgggatttttttttttttttttatatttgcttagtatccagtggagcacccttcattccaaatactccagtgaccattttctacaggtgtcgtgttgatgcttaacaagtttcagattttggaacatgttggattttgggttttcaggttagagattagagatgttcaacctgcatacacttatacctagaaccctggcaggtatattttaggtgtttaataaatgtttgttgaagaaggaaagattcatttgagtttagtatacagtattcattaagaaaccaaagtgttctgggaagaaagcttttttggggataatttccatatgaaaagaaaactcagttgatcagggcttcccattccctgtgcattttgattatttaaaacatggtgtaaaagtgctttgattaaggaaaggctatgaactttctaaaatacagcacattgtataatgtgtaaaacacatatgtatatttctgcgatattaaagaggagtctctttgatcagtatattttttttcttcctctcagttgtacagaagatccattttacatctgacttctcattttggagattggatacatcaatacttgatgtgtttcagagtaatgaattttaaaggcagtgaagggtgatacaggaggaagggatgaatttaaaatcctgttaactctgatcctatgtagacagtctcagctaagtcaatatttaaagaagatgagagactcgcctgataggaagtcactgccttgggatttaaaagctactctattccagagagttgaaaaccctgagatagagttcagccttcttttttaatatgctgaagccaccggtcaaggaaatgcatattgttttccttagctgaactgagcttgaatgcttattcaccctctctacgggttgattcattgaaagtaaattggtaatgataataacagcatcaatttaaggagcacttcgtatgtgccagacattgtactaagtgctttctttttttttttttttttttttttttgagacggagtctcgctctgtcgcccaggctggagtgcagcggcgcgatctcagctcactgcaagctccgcctcccgggttcatgccattctcctgcctcagcctcccgagtagctgggactacaggcacccaccaccatacccggctaatttt

SEQ ID NO: 102111 - DNA, 1029 bp, Homo sapiens
ttcagggtgtacctgtgcaggtttgttacatgggtatattgcgtgatgctgaggtttggggtacagattccatcacccaggtactgtgcatagtacccaacgggtagtttttcaaccctcgtcctcctctttcccacccttctctggtagttctcagtatctgttgttcctgtctttgtgtccatatgtacccaatgttcagctcccacttacaaggaagaacatgcaatatttgattttttttttctttgttaatttgctcaggataatgacttcgagcggcatccatgttgctgcagagggcatgatttcattcttttttatggctgcatggtattccatggtacatatgtaccccgttttctttacccagtccacctttgataggcacctagtttggttacgtgtctttgcggttgtgaatagcgctgtagtgtcttttgggtagaatgattgattttcacccttttttattccagttgtctctcaatttttctgcctctttggatcatttgtgtcctctttgatcactgttgagtagctgagcagagggtctgggttgctcactgttctgaatggactcagggacataacttcagggggctaaggatgtcccacagtgaactgcctgagtgaggcacttggttgtagttgtaccattcttagtgtggattgcttaggaaagggaaatgtatccaaaagctgcttttacaaaaatctatagacaatgttttttagagcagtttcagatttacagaagacttgcatagaaactatgagagttcccgcataccttccccctactcacattttccctgttacgaatatcttgtgttcccctggcacatttgttacaatggatgaaccagcatggatacagtcgtattaactaaggtctgagtttaccttagggttcactctgtgatgtccagttctgtggattttgataaatgcacagtatcatgtaacaccactacagtaccataaagaataattttaacaccctaaaacccctctatactccaccta

SEQ ID NO: 102112 - DNA, 1051 bp, Homo sapiens
ttcggaattactgtttatgcctgaatagaagtcaggctgatattacatcttcagtatcttcagaaaagaagaagtgccttacagagtccttgcaagtctctcatatgataaggacacaatttcaatcatagtattttattttcaataacaaagtactagttagagaagacacataaacctttatttggctcactgatgactttgggtgctctagaaatcactcgaggaacccagtaggaaggaaggtaaaagcatttatggggctttaataataacttctagagatacggcctcttgattgtgagagtttgagagaccagtctcaaaacagttcactgagtggttaatttatggagattttaaatgggtgtgtatgatttgggataagatttccagcaagtgcctcatatgcaaattttaaaaatactttatctcaaatatccagtcacctgaaagatcatgttacattgaaccactgcacaaggactcaaaaagtcatcctggttctgcctgtgactagtttgaataaaattgtttcatgaaatgtgacagtgtggaaacagtatttcttaaattaactatgttaaccttttaatgtatggtcttaaataggaggatgcagcttcaaagataagtagtatcaacagtcatttaataattctattgcattcctaaaaattatacatttgtgttttccaaaaaccttttactgagggacaaagtcttcctgttggaaaagcgaggatatcactgtatatttggagtcaccctatatttggacacgtgatatctttaaaaggcagacacagttttgaagtattctgtgtattgtttcatttggagtgaagggaaagtatgtaattcttcttcccattggtgggcacattggattggggaatgtctgtttatatccccagtttgaacatggatcttccttctcagccagtgcccagccttaaggctattggcaactctgaatctgttggacaccttttagagttcacctttttttctgcatttgactccttaattcttaccatcttgtagtcct

SEQ ID NO: 102113 - DNA, 1049 bp, Homo sapiens
ggttgggacacagccaaaccatatcacccagtttcccccaatagtaatatattgtataactgtggtataatatcaccactgggaaattaacattgataaaacccattgaccttgttcagatttcacaagttttatgtacaatcttgtgtgttgctgtatattagttctatagagttttttcacatgagtaatttgtgtgacagccaccacagtcaagatgcaagacagttccctcacaaggatccctcgtgctgctcctctgtagccacagctaccttccttcctcctgctctccctaagccctgtcagccactaccctgtatcatctataattttgtcatttcaaaaatgctatatgtaaatcactttttttcccactcagcataattcccttgagataatctgagctgttttttttttattggtgagtagtatctcctggtgtggatataccgcagtttgtttcaccatttacccactgaaggaccgttgagttgtttccagtttggggctatcatgaataaagatgctgtaaacattcatgtttaagtttttctgagaatatggtttcatttctctgggacaaatgcctaagagtgaaattgctgggttgggtagtaagcacgtatttagttttgtaagaaactgccaagcctctttttcagagtggctggaccattttgcattcccactagcaatatgtgcatgatctctgcatccttgccagcatttgatgctattattattttttattttagttgttctgataggggtctaataatatctcattgcagtacaaataagatgtgatgtttccaaatagatgcagtctttcaaagcagtctctgtaggggttatatagtcataaatattgccatctctcagagtgattccaaagtttctttgagggttcagagcctgttttattcaagtgacccataacaaaggacaaaaggaggatgaatgtacccccacagtggggaaaggcagacagtgctctctttgaacccgatgacagcctgaggagctggagaactgctgatctgctg

SEQ ID NO: 102114 - DNA, 1050 bp, Homo sapiens
ccaatacattttaaggaaagaatgtgtgatcataaggaaatctgggggacagttgggagatttgagtataatctgggtattagatgctattaagtgattattaaaattttattgggtatgttgatggtattgcggttctgtgggggacatctttggtttttgaaggtgcacactcaagggttaaggggtaaaatgtcatgatgtttgtaatttaaaatacttcagcaaaaaaaaaatgcaaggatggcaaagtgatcactggtatatctagatgatggtatacataaagtgattgtactattccctccgcttttctgaatacgagaacattttcaaaataaaaactcaagtcagtgaatgaatgagtgaatgaatgaagctgattgtgcccagggggtctgtgtggggctctccgtgaagtgcaggggtgactggtcctctctctctgcacctcgcaggatttctctggaagatctgagcccgagcgtcgtgctgcacatgaccgagaagctgggttacaagaacagcgacgtgatcaacactgtgctctccaaccgcgcctgccacatcctggccatctacttcctcttaaacaagaaactggagcgctatttgtcaggggtaagtgcgaccctagaggcgatcgtctctgctgtctgtggaaaaaagagctcctacacccaaagtgcttctcagttgctgacacttgatccaagctgctaatttaatctaatgtgaggctgagttttctgaatgtgggataaagtcgtagctaaacctgcttctcagggagtgccttttatctgcaatgtttttcaaatactctcccaccgagttaagccctgggcagaattgggaggggttcaagcctctttttccttcaacagcatctctgttgtcttttttttttttgttctgctgcctcttaggtctttgggttccccatgttggaggcattggagggttctctggtcctaaaactcgggtagcagtgcctcccgggcatttgtctctgaactatggtattatatatgagaaagccactattta

SEQ ID NO: 102115 - DNA, 1046 bp, Homo sapiens
aaggtcgtgctactgcactctaacctgtgtgacagagcgagactcggtctcaaaaaaaaaaaaaaaaaaaagcctggttactttgggggacagaatgcctggcagaggacatggggatggcagggaggaccttccagatgctggctgtgttctgttttttgatccaagtgccatttctgtgggtgtctttgctgtttgagaaaacattgagctgctgacttatcattagagcactcctccatacggcatcttagattttaataaaaagtttacctagaaaatctattcagcacacgagttaggacatctgctgtctacttccatggcaatttcaggatttgctttctgtctatgaaaaccgaaacgaataattctcaaccagagctgcagggccgtaggggaagcatttagggaataaatagcaggtgcagattctcgaattgttgaaggatgttccttttcacaggcctctctggacacctggacacgagatcttgaattccatgccgtgcaggtaagaacttgggggattattatgttagtcagggttctccagagaaacagaaccaatagagtatggagagagagagagattgagactgagatttattttaaggagttggctcacacagttttgtgggggttggctggaagtctgaaatctgcagggcagaccagcaggttggttgaattgatgttgcagcttcaagtctgaaggccatctagaggcagaatttcttttgccagaagacctcattctttttttttttttaaagccgttgactgattggatgagacccacccacattatggaggataatctacttgaagtctactaatttaaatgttaatcactttatttatttatttatttatttatttatttatttatttattgagtctcgctctgtcgcccaggctggagtgcaatgttgtgatcttggctcactgcaacctccacctgccaggttcaagcaattctccggcctcagcctcccgagtagctgggattacaggtgcccgccatcacgcctggctagcttttg

SEQ ID NO: 102116 - DNA, 1052 bp, Homo sapiens
ccaccaaactcatgttttcacaggagggttcagtgtggagagcaaaaaagctgactgtggtgatttgctgagtgctgtggcccacaggcagggcaagtctcggtggccctgtgttcatcctgttgtttaaggcatagccctgatccttctggaaggcatagaacacggttacagctggttctgtagaaagagggaaaagatgattgtgacaattcagagcataactcagatggcgagaaggcagcattatctctgtgcgatgctgatttcaagctgcccacagaactggtgcggctcagagctcggcgagtttgctgggagctgggagcaggcttgcctggcagagaacctgttcagatacaggccagtttcttcttcgaggaaagccaagctcctcaaacagggttcagtccacgttgtgttttcacacctttctccaaggatcgaaccaaagatgtgtctccagtattgtgtctgtgcccctgtgtgtgttttgtggacagccgtgttgtctgactgtatccagctggcacttgacagggtgcagtcattggtgagaagaatcagaaaaagaagacccatcagcacaggttggataggggttagtgtaggagaccagttacagaatggcctggagtcttcaacttttgaccggtgcaggtgtgaccagagaccacctctgtggccacctcagatagtcatctcagtccaaggatcccaaaacacaaatctagaattgcaaagccagcctttatttccctggcaggcagccttgccagaaggcagagaggcagttctgaatcattctctcattcaccagtggtgacatccttcagtccctcacatctctgacagagcgggacagaatggatatttggctgaccttggtgagacctggagctgcctgtttcttccctaggggatcaccacggctctagggcattctaggatgaggtcagaccccttggccattggtgttattttttgtatagcttcagactgggttccagaacttaccattgaaaacagagcttttaggccaggtgtggtgg

SEQ ID NO: 102117 - DNA, 1049 bp, Homo sapiens
tcgcttgagctcaggagttcgagagcagcctgggcaacatggtgaaagcccgtctctaccgaaaaatacaaaaaaaaatagctgggtgtggtggtacgtgcctgtagtcccagctacttcggggactgaggtgggaggatcacttgaacctaggaggtcgaggctgcagtgagccaagatcatgctactgcactccagcttaggtggcaaagtgagaccctgtctccaaaaaaagaaaatagagctttataagcagagagaagaaaataatcatctaagaccatctctccattcgacatgaagtgtaccttttctaaagacggtttccagctgcaacggctccactttgcaggcttgcagggtgtatacctgcgcattgggaacttgctggaacccctgatgcattttccttgagagcaggggtacttccgccttgccgttagcttgtggagaacgtgcttcttattcctggcaggcttcaagaacagctgcacatgtgccgctaactgaccgcgttgccattggcgacctggactctgaactcaggtttattctaaacccagtgagaggtgagggggagtgatgaaaggggatcagctgtatttgtgtgtgtgtgtgtgtgtgagcacctgacaaatctatgaaaccgagtgaaaggagaaatgttagattctttattattttattatatttatatggaaagctcgactctccctttggtaagtccgaagcatgttgtctgttcgaccgtgactgtcttcctcagtctgtgcctgtgattccagtcaccctgtagttactgacagaaattgactggactgtcattgtgtgaagtctaggaggaaatgtccattttaattgtatgatttggtcataagtaaggactatatttatgtcaccattattagatatatgtacttttgtaatgactgtgaaatacacttttccctcactacgactgcttctttatttgctgataaatcttaaaacaactaagtacgttgcaaataatagtacaggtaccatcttttatgtgaagttctttttct

SEQ ID NO: 102118 - DNA, 1017 bp, Homo sapiens
ccagaaaggccccagcagactcctcctatttctcattggccagcaaggtgtcacatgctcacttcaagaccaatcactaatcaaaaggaaggtgattgcaagataggcttggccaatcatgactcattctctagggtgcagtgtttttgtatgctcacccacttacctgcaaagtccattttttagttttttatttttttgcaggaaattaaatggaataactgctgatgattcagctaatggtgtctgccacaccatgtcccaagcttaggtcttcctgaccctctttcatccatttcataacacccataaaatatactcttctctttgcagtcacagaaactgccttttttgggggtggggagttctttctatgagaaagccaagttgaggctgcttttgataatgtcatagtaaagtacattgtgtcaagaacagactgataaagggacgagtggtttctgcctcagcatgtgaacagttcattatggttgccgagtcgattcatgctttgaccaaaagtgtttgccaaagcccagaggccaacatcagcattattaataaattggctgttattaataacagccaggccacacaaagaaaccgctggttatgcttcaagtgcttgtgatcaaccactgtgggcgcttgcattgatatagagctgttgagtgacggtgccttgtctggtcagttgtgtgttaggttgttctgcccgtggctgatgtctgtgcaggctgatatcatggcagccaccatttattgtgtatatactatttgtccccttacgtgcattacttcatttaacactcacaatagtcctgggaagcaggtattgccatcaccgacagacacacaaggaagttgactcagatagagacagtaggttcctaatgtcacccagctagtactgggcaagaccaacaaccaggttaccccatgcttgtctgtgcagtgtggcaggccccccaccaggttacttcagggtgtatgtccactgcctgaactctgaaggcc

SEQ ID NO: 102119 - DNA, 1154 bp, Homo sapiens
cccggccaagtaatgcctttttaattgtatcctctatctattggcataggacagttctgtgtcatacctgtgtgattgtaaaatgtcttgtacctgcttattgatatgtagtagtgaccatgctttatcagagctatttttaaggatgttattctagaatgttttctttccagatgatgattcagaagctaattttaaaaaatggtgccagtaccataacagtaacagaactttgcaattttctggggatttgttttttacctttccccaaccccctgactttttttaaatggagtgtgctggatgtctctataattttgttcagatgaccgcagaacctagaaaagctgttgctgttattgatgtataacatactgctattattggtctttttatataaaaatatatatacaaatatatatatataatttgaatttttggaaacttcagctgtgctgtgacctttggaaaaagtatcccagtttactgtgttaagttggcgttgtacagaaattaacagccatattggtctagaaacattaaacttaatatttttccatttgtacaggggtaacacactatattaaatatgtaaggtcttatctacatgagtttggttacagaaactaataaagtatcctctaaataatgaaaaaagaaagtgtgcttcttgaaaggtttgagaattcctgagtactctcacgccggtaattgaatatagctacggggtggactgactgtgctaatactggctctgcaactctctttatcccccatcttctagcttcccagcacctgattaaaatctgtgcaggatgctttatactccttatcttgttgaccactgctatggtttggatatggtttgctcggcctcaccaagtcttatgttaaaatctgaccctaatgttggaggtgggggctagtgggaggtgtttggatcatgggggtggatccctcaagaatggcttggtgcagtcctcacatggtaatgaatgagttcttactcttagttctcacaagtactgcttgttgaaaagagcctggcacctcctctctctcgcctcttctctcatcatgtgatgactgttcctgttcaccttccaccatgagtggaagcttcctgaggcctcaccagaaacaaatgctgaccc

SEQ ID NO: 102120 - DNA, 1050 bp, Homo sapiens
ttcagcatgcaaagcctcttttatagcttgttattagcataatccacgtggtggagccgatgtcacctcgtttttagagatagaagttggagaagttaaatgatttgcctcttgacacagggtgcttctgatgatgagagaagcagtcttttaaaagaactatttaaagaaatacagaaatgtgcagagaataatagtagcccccacatttaatacatgctgacagttttctgtgtttgtcctgtttctttctcatccctctgtaaccaaaggtcaacactcttctgaggttctgctttgtctcgtcagtatcttattttgtattttcatacactgagtgttagtatgttgttaaacagtattatttagcgtgtttaacattttacactaatgtatcattcttttttttttaatgtatcattctttatacatccttttgttcactgagatgtttctaatttacccgtactgatacttgtagatctaagtcattcatttttactgctgtagaatattcggtcttttgactatattccagattacttagccagtcctctactgacaaatgtctaggctgttctccctattctcccctttacatcacatctctctctccctccctctctgtttttctctttctctgtctcattctctcattctctcccattatagtcttacagtctctatcatgtctcttggggtggattggggacttactagcttttagtgtgggtgcatcttcagttctagatgctcaaactgctctccaaagttgttgagcaaattttttgtttttgtttttgagacagagttttgctcatgttgcccagactggagtacaatggtgtgatctcggcttactgcagcatctgtctcccaggttcaagtgattctcctgcctcggcctcccaagtagctgagtccacaggcacgcaccaccatgctcggctaattttttgtatttttagtagagacgtggtttcaccatgttgggcaggctggtctcgaactcctgacctcaggtaatccacctgcctcggcctcccaaag

SEQ ID NO: 102121 - DNA, 1039 bp, Homo sapiens
gctgggcttggctgcgatgccttgggcaccccgaggggggcatggaaatgtaggcttgaggatggaatggattaggaaaggggccttctgctctctgtctcgctaacaacagtgaatacttgcgtggcagctgccgcccctgtcttagccctgtgctctatgtgacgtctgtgcctcgtcactgcctttcagacgctggaggaggtgcttgtggccatcctcaggcaccccaccctggagggctggttcctggccctggagcagcaggccctcccgccgcacacgctcagccctgtcctcgtgaagctcctggccacccactttagtgcaggggtccttcagctgctggcagcaagtgccccgatcctccagaacattgggcagctgggccttctggccaggtactcagaggccatcacccagagtgtgctgaaggaacttcagaacaggagggcgggcccggccacatcaccaccaaagaccccgccgcagctggaggccctgcaggagctgcatccatacatggagggtgcccagctccgtgaggtcaccctggccttgctgagcctgcctgagacacacctggtgacccagcaacccacgaaatcccccgggaaggaaagacacctgaatgctcttggaaagaccctggtgcagctgctgacctgcagcccccaggatcagctgcagagtggtgagctcctgtggtcctccgagtatgtgagaggcctgggggctctgctgcccacgctagcagtggacgagctggacacagtgctcctccacactctgcagagagaccctgtgctggcccccgcagtcggggctgatctgcttgactactgcctggcccggcgcacacaggcggccctcagcatcgctgccctgctcctccaggagagctgcacccacttgctgtggttcgagcagtggtgcctgcaggctggcccagggctcggcctccagggggacctggacgacttccttcccctcatccatgtgtacctccagtgcaggacacggagccacttcacacgcc

SEQ ID NO: 102122 - DNA, 1039 bp, Homo sapiens
tgacctcaggtgatatacccgccacagcctcccgaagtgctgggattacaggcgtgagccactgagcctggcccagccctccctcttaagtgtattaatttagtaactggctgatgaatttctgttcctgatgtggttcaagggatttttaagttttgaggtgggcctgtccctttcagtttagtcaaaacaacctttgtgtttcaccaaggcttaggaagacacatctcttatttgagaaatggcattgcattgatgggtgtctcacacactctgtgaggagttgccatctcagcctgcctcccgagtctcctgctctgaaaacacgggccctggaagtcactgcctggtagctgtgaacccgtctcttccctgctgaggctcgtgctcttgtcctcacagctgggcagaagtgtgggcccgcccctcctgcagctcttcctggatctcctcaggcgcctggttgtccactgtgagcagctggatgcccagaaccagcagagatgcgaggccgcccgggccgaagccgacctcttcctggacatggagtccgtggcctcgctggagttggccaatgatcaggtaccgccacaggttgcctggtagcctattctcagagtcatgggcagtggctttctcttcacttctgattaaaaacaaacataggtccattgtgggaaaattgggaaatgcagaaactacagcagagatcataaaaacttcctggcacccgcccagcatgcggtttaatttgggcttctctttcctgttgcttttctgtgtacagtcaccctccctgcagacagctttctctcacgctgtgtgaggtgagcctgctgagaaacagtgtgaatagctgcagcttgtgttgagtgaaaggtgggcagcaggtgctgcttttcacaggaaatacacacaggaaatagactgctctgagaagcagcagcctttctgtcctgttgggagtcttgggaagcaggctgtttaattggggccaagatgactatttcacagtttgccatgtaacctgttttaccgg

SEQ ID NO: 102123 - DNA, 1195 bp, Homo sapiens
ctcctgctccaggcatatgataagcttgagcctccatgcctggtgccttgctgccagcagctctcacggtttaacagatactacagcctctggatcccggagcaagcccgagaggcctgggtgagctgcagccacagctgtggtcactgctgctgtgcagggttcttcccagggtcccagctggctgggccacagctgtgcagttgggtagccagacagcctgcagggtgaaatttcttaccctaaagtcccctgcataagagaggaagctaagtagtatccctggtgctcagctaacataactgaacacacaggactcagtgatgcagccaaattaaattccccattggctccctgataatgataataggttaattcctcttccagcctggggcaggagcgttgcctcttcctttttttccttaccttgttatctgtgcgtgcttgtctcctggctctcctctgcagaccttagcatggccctagacaaactgtgctcagctgtcacacatggcccctcaaggcctccagcagggtctcttctgttaaagttggggaaggaaaggaaaaagtatattttcttttgctggggactacattctcttaatgggattctggctccaatgtgcagggtatttacaatgctgtgtggggcacgaaatttgtggtatgcatttttgtgcattcatttcattttagctgcattcgaaaaagcagtcagtttagaccctccttatcttgtgatattggtagcaatagccaacagcgattgcatgttttctgtgtgttttttggaggcataccgggtcctgtactaagtgtactatgtgtatttttggccgtttaatccttactgtaactctgagaagtaggccgggactctcaccatcctttatgcatatggggaaaccgaggcccagagcggttccaacaccagtcagtggcggagtcaggatttggcccaggcagtctggctccagagccctgacccataatgttgccaccttcccccacacgtaggccacagtgatagccagacagcaacttatgtggcagtattagaggttctgtcctgcccctcgtggttgcttggagtgggtgtccaccttctgtggaataagacttagcagtggttctcaccctccagggtgtgtcggaattccccagagggccttttcaaactggactgccgggt

SEQ ID NO: 102124 - DNA, 1051 bp, Homo sapiens
cgcctggccccatggtatgtttctaatatataactatatattaaaattatatatgtaattatatatactaaaaatacgtaatattgtttaaactctaggaaggcccagatgcagaaattattggaggtgaacgatcagtattttacttactaatgaaaatgtttgtgaccagtagccatttacaactgaagtcattgaccaaacttctgatcatgaaggtgagcattttctaccagtttctaactctgaaaagcattttgtatagatcttccttatggtaagtgtttagttaacagttattgaattcaggaggtattggaattgtttttagttttaaaatagaaggttttatggcagtttaatttattgtgtcttacacttagctacattcctgggaggcagcctggtgcattggaaaaatgttttttttttttttttttaggtaggtcatttctagcttgttgtaggctcaatactaaattttggcttcttggtgtttattaggcagtgcctctttcctccttctcaggctctggcgttatccagggctttcagcctttttgccagaatccatcacccacagcacatgggtcatcaaagccagtggaagagaataggaatttatttccttatcttgttttgtccttgatactcatgtttccagagctatgtcaggtcttatgatagcagtaggacatctagtcctcatttctgctctgcaacaaacagcttgggggatgcactatgtttagggtacagaggtttgacctttcacttttatttgaaatgctgataaccttgctacacttacagccttctctcttgagctgcttaaagaatgtggcagtctaagtcttgacctccataggttgccatttccttccaggtagtgcagttgtgaacctgaccccagccagatttcgtgatcactgactgcaaataggtgaaattggcacagtcaggctttcctttggtgcatgctgttgcagggctctgtgccgtgaggcctcttagactctgagtttctgctttcagaccatttagggaaatc

SEQ ID NO: 102125 - DNA, 1082 bp, Homo sapiens
ggcaggcaccaccatgcctggctaatttttttgtgtttttaatagagatagggtttcactatgttgaccaagccaacatagttcaaggccaaggtcttgaactcctgacctcaggtgatcctcccaccttggcctcccaaagtgctgggattacagttgtgagtaccacagccagccctacatagtgctttttttgtgtgtggctggaggaggaacgtcagtaaaatctcaaaatgaaatttggggcatggattcctccctgctggttttgtcctttcttttcagtagccttgacttctaggcagactggtaggtggctgaggtagagcgagagagaatggttttcttccttttctttagaaagcaaattgaactcaagggagggaagtaggaaagaagaaagatcgcaggacagagactttttcagccactcagaagtagaggatgagagggaagccctctgtggagagctggaacccccaggccacggaacccccactttacgtcctgggggaaattccctacgttgttattgctgtgttcactgagggcaattctgcagagctgcacgtcaccatgagctctcagggtgctttgaccattttctgctgacctctccccatgtgtctttctctaacagaggcggaaacctgacactcttgcacttcttgctgggtttgaaaactgcagctgatgatgatctggtggctgaccttgtggtaaacatcctcaaagtgtgcccggacttactgaacaaatacttcaaggaagtaacgttttcctttatcccacgagcgaagtctacttggttaaataatatcaaactactaaacaaggtaaaaaaacatgatatttaaaagtctgttagctaagctgggcgtggtggctcatgcctgtaatcccagcacttcgggaggccgaggcaggcggattacctgaggtcaggagtttgagaccagcctggccaacgtgacgaaacctgtctcttactaaaaatacaaaaattaactgggtgtggtggtgtgcgcctgtaatcccaggtacttgggagcctgagacaggagaattacttgaacctggga

SEQ ID NO: 102126 - DNA, 1055 bp, Homo sapiens
ccctctcggccatgggggtccccaagaggaaggcctcgggcggccaggacggcgcggcttcctccgcgggtgcagccaagcgcgcccgcaaagaagagctcacgggcgtgcggttcaaggctcagctgaaggacccgcagggccccgggccaggtgagtccggggcggcaggcgcagggtcgggagcacaggctggcgaggcggcctccgtgtgccgggcacagcctctcctttctgcagctttcgggtcacataggctcagtggcaagcctctggtttgcagaaaactgaggttcaggactgctgtgtacttccttgctctggactgtcggcgacagcgagagggccccgacttgcttgattgggaccgtttcatgttacaacacatttatttcccttgcccaggcagcatccctcagcgagctctaaaacctctttattgcagttgtcagggaagtaaatgaagtgtccttctctattgagtccttactgagtcggctcaggacggttcatgagacagtttgctactccttgggccgtcagcaccgttttcaatagcttccatcccccaacactcatactgacttgatgacttgtaacaagctactagaagccaccacagctacttgtcagttgaccaggaatgggccagtgactgagatgtagccgactctataatttaattacactttttgtaaagtgtgaccacccttcgcgactacttgtaatcgtttggaaagtaacatggtttgggaaaaacgcaattgaacgtgttgccatgtggaagcattgctctaaaataaaacagtggcagtttttctcccaggttaaataaacgattaaattaatggccaaaatatcttcaacttccaatttttgtcctcatttttttttttaaacgacagggtcttgctctgttgcccaggctgaagtgcagtggcactatcatagctcactgcagccttgaacttctgggcttaagctgtcctcccacctcagcctcccaagtagctgagattgtaggtgcacaacaccatgcccagctatgttttttt

SEQ ID NO: 102127 - DNA, 1031 bp, Homo sapiens
aggcaatcgtaaaacatttgttgtaacttcaggattgtcactctaagaacaccttaatccacaatttgctctgctctcctctttgcagaggggacagggagctccagcccgagagcctattattagcagtgaggagcagaagcagctgatgctgtactatcacagaagacaagaggagctcaaggtagcaggggacagatgggctttctgcagtgctggcgcccacacatagcctgtgtgccttacctggggctgctggggagcagtgagctctgcagaatgccggggaggggtctttctagagcttctgtctgcaggtctgtcggggtcctgccaggtgtcccctggtgttagacatggcagtatcctgctcctagagggcagggagagggggaggtcagtcatggactctttcttcagtctctttatgtgcaaaacactttcctgaaatgcctgcctgaataaaacatacttatttccagagattggaagaaaatgatgatgatgcctatttaaactcaccatgggcggataacactgctttgaaaagacattttcatggagtgaaagacataaagtggagaccaagatgaagttcaccagctgatgacacttccaaagagattagctcacctttctcctaggcaattataatttaaaaaaaaaaaaaaggccacttactgccctctgtaaaagatgttaacatttctagttttcttttagtgtgaatttttaaaatagcagttattcaaggttttagaacttaataaatacctagtcagaagaaaatgtgtaaatcgtttttgtttcaggactatttagtatgtcatggttttctttgataaaatactaaacttttggccgggcgcggtggctcacgcctgtaatcccagcactttgggaggccgaggcaggcagatcacgaggtcaggagatcaagaccatccaggctaacacggtgaaaccccgtctctactaaaaatacaaaaaattagccgggcatggtggcaggcgcctgtagtcccagctac

SEQ ID NO: 102128 - DNA, 1049 bp, Homo sapiens
acctccacctcctgggttcaagcaattctcctgcctcagcctcccgagtagctgggattacaggcatgcaccaccatgccgagctaattttgtatttttagtagagacggggtttctccatgttggtcaggctggtctcgaactcctgacctcaggtgatccgcctgtcttggcctcccaaagtgctgggattacaggcatgagccaccgcgcccggcctaaaacttgtcttttgagataaaactccaactctggcttccagagttgcctctcagccagccttctctttcagccttccggaggcaaaggaaacaagcgtatttggggtaggctgtagcttttcctttcataatcctgacggttgcccagaggcctctccgttcctccaggcagacacaaatttttgttggcttatgtaaatataggttcacgtataatacaaatatgtataatacaaatgttgatttcatttcttttacctttttgaagaacttaacaaagttaagtaggggagatttgaatattgtggccatcgagtagctctccagacacttgattgacttaatatgtatttgatataaatggttttttgtaattgtcttcagcattttatacaaaggctagtttatagagggaggagcgtaaatttataccattgatatacagataatgtgtatctggaggaagagaatttaaggctattgaaagaagtggtatctgtatctgttgcttgtatttgtgtgttggtgatattagttgctaccgctctcaactgcaagtctcttgactgatcaccactttttcttctgcttctcctggtttgctcagcagaactgttatttttaaaccaatatttctcaaacttaccaagcttttgactaatctttgaagagcctcagcaaaggctgccctgaagctctgtgcctgttaatataggaaaggctttatgaagctctacaggagaggccctggttgagcccgtcgtttgcgtggtgatggcatctaggcatgtgagcacgtctcaggccatggcaagaaaacagtggtct

SEQ ID NO: 102129 - DNA, 1044 bp, Homo sapiens
ctcacacgggtaatcctgacactttgagaggctgaggcgggcggatcacttgagcctaggagttctagactagcctgggcaacatggtgaaacccagtctctactaaaaatacaaaacgtggtgacacatgcctgttgtcccagctactcgggaggctgaggcgtgagaatcgcttgaacccgggaggcaatgctgcagtgagctgagatcgctgcagtgagctgagatcgcgccactgcactcctgcctgggtgacagagggagaccctgtctcaaagaaaaaaaagacaaggatgaataagaccagtaccatgcccccgtgtcaaaggcccaggccaggtctggcacatagcaagtggcatataaatgtttgttccataaaatagtgagccagatgggcaagacccctgactctttggagcttacattccaatggggtatgaggtgttatgattgtgatactgtctttcacttatttttaagaaatggaagaattagccgaacatggcatatttctccctcctaatatgcaaggactgaccgatgatcagattgaagaattgaaattgaaggatgaatggggtgaaaaatgcgtacccagcggaggtgcagtgtttaaaaaggatgatattggacgaaggaatgggcaaggtaagtgaggatttctcttctatgtgcatgcttgatacaggcataagtatgaaaacagttcctttttttttttttgagacggattcttgctctagcccaggctggagtgcagtggcacaatctcagctcactgccacctctgtcttccaggttcaagcgattctcctgcctccgcctcttgagtagctgggactacaggcatgtgccaccacacctgactaatttttgtatttttagtagagacggggttttgccatgttggccaggctggtctcgaactcgtgacctcagatgatctgccggtctcggcctcccaaagtgctgggattacaggtgtgagaaagcagttctttacgtttaaaaattgacctcgtcatttctctacagactta

SEQ ID NO: 102130 - DNA, 2638 bp, Homo sapiens
ctcttggtcataacaaaagcagggcttcatcttcacttgatggctttaaggacagttttgatctacagggccagtctacattaaaaattagcaacccgaaaggatgggtaaccttcgaggaagaagaggattttggtgtgaaagggaagtcaaagtcagcttgttcagacttactgggtaatcagccaagttcattttctggctccaacctgacattgaatgatgactggaataaaggtacaaatgtctccttctgtgtgttgccgtcaagaagacctcctccacctcctgtccctctgctcccgcccggcaccagccctccagtagatcctttcacgaccttggcctctaaggcttcacccacactggactttacagaaagataacgccatgcaatagaaaacagtgggtacttgcttttggcaggatagagctaagagaattgggcattagtatttcattatgtgcaataagtcattgtaagtgcactgatatcttcacaaaacaccactatttgatgtgtacagagttggactatgtgtatattggaaataaggaaaaacccttctcattgttaactggagttttgatgtatttctctttggatgaataggagacagtagtagccataaaaagtacttatactttagaaaacagtccttattcagaaacttttcggtcagtcttctgaagaatctcaaaaagcccacccaactttcagctgacatttccaccagccctctcatacttgttaacaattggtatctttgagtatttaccaaagagctgccaaggttacagtgaacagagttttgaaaggcattgctttaaaggaaaaaagtataggtatgtgtacatatataatacatacaaacacatgtacttctgtatacatttacatatttttacaattcatactttaatttctaggctataactcagaccaaattatacctaaaagttccaacaaagtccctttttcaatatcacattaccaaaaagatggctgcaaatgtaatttggacctttcattaattttgttttcaaaactagaataatctcaccacagaatcagaattttctaccgttccacacccaaccccttcaaatacacacaaccttgttacttttcactccagcaccttcatacgcttttctccaggaggaggttcttgcagctggaaacagcctattttgtggtcactgtcaagtggatggatattctagcgctcccaaaaaagcactatggccttatatgcagggaaggcacataccaccaagttcaatgagaaatattagagctaaccgtactctcttctctgcgtacgttcgagtatacgttgcccatatccctcccatattttctttttgctgcttttgctctggaactttgcttttagcagggaaagcagctgtcccctgagtgctttgaattgggaatatacccagtgtgtgttctcccccctcttacgaggctacataacacatctatgatgctgctttaagtttttagaggctatacctcaaagtagctgcggattttgtctcctgcactgccaatatgcaactgatcccgcttttattaattttttgaagaagtacacagaatttttacagaatgtagtattttgatatcattaagtaaaccaatcagaaaactccttgagcaatagttgtttctttgtcagtttcagttacaatcatctttacccattaagacttacattaacattccttttatataaagagttgtatatgtccacctaaattcctatgtccacacttaacctttaaagatgtacattgagggaatatcaaaaaatagcgttcatggctacgaatatgtagaatgttaaaagcacagcaaactgcactgcacttataaagcaaatctattagaaaaaaagcatttttctaaatgctcaaatgttatcaaaatactatatttatagaagtaatcttctctgttaacagccaagatttgctgttagaaataactcttgtgagttttatattgtgctttttggaggttctaatcatttcagcagtagcgtcttaaacagcagtattactataagcagttgcttcaaaatgtgaattaacttgttgaaactgtggctttaacatccatgtgactagtgtatatggtatttgctctccattagcaaaataattcattgttaggtaaacttcactagtgcaaattgcagatctgtgagcaatgtttcctattgaatataaactactgtctaaaatatacatatcagcagcccagcctttatcaggaaaattatacttggcaagttgctgaaaatgcacaaagttatgaaagttaaaggtatgctgcaaataactagccattattctatgtattattaaatatttactagttctgttaaaagcagagcagaagttagacactaaggatctctttgtgaactctgtgttctctatattagattgctgtttatatgtaagaattttattgcttatgtggcatacaatatttataactataaactttatagaagtacagtattaaagtcagtggtacacagacattctgtacatatcctgtgaaacgtgctgtcatatgaaataaatatatctgtctttaccatgctgacttctttgttag

SEQ ID NO: 102131 - DNA, 1149 bp, Homo sapiens
tcaaatcctgaagtatctttttgcctcagtcattgatatcaaactccttaatattagatacacagacacacttttctttcttggagggtggggtcttgtttacatgcagagtgtcattgtgagggatcacaaagtggttacagtttcctccagggaatgcccaatgctgggggccaggaggcaggtgaggaggagtctttctatctttttgtaccttttgaattttgaaccgtaaaataatgcctattttaaaaataataaaaaaaattttaaattattggaagtagctgttaagttgaacaatttacaagattttcaaacctgatggtgagatttttaaatatgacaagtttgatattttgtaatgacatgaaatagttttagaattgaacatttgtaatttttacaagtctttacttatcctattccaaatctacaaggtatttaaaacataatgtatatgacccagttttactttttattatttatcctttgactttataattttgtatagaagagattcatttaattcgagtgattatataacatgttatacgtcctttacaaagtataaaaaatcctcacttatctatctgacttctagcatcttagtcatctttatcagctgagagccagaaataaggaaatgcaactggaagtaaaggaaccgaactcactgctatactgttactgtgagacctggtagaaaaatcacagcattctagacccatttaatggaggatacagcaaccttgtacctctcagtataaacctattcctgatctcctgtccactgccagagctgatacataaaactctgagtgttaaataagagtctcatgtttactaggcaggaaattctaaagtacttaatatatttctgggtgatgtctctgaattgtcaaaattagttttgctatttagtaataggtttagatattggagaagatttacctcaaaacttgcttgaggatactagattttaaaaaataatggtatattatagagggattatgatttcatttttaaacaaaggtaaattccaaatttcttgtaaggtacaagtttcttgtaccttccaactaatacattatgaagtaaattaatgatattaagagtatcatccttcagaaaatttgagtaagataa

SEQ ID NO: 102132 - DNA, 1035 bp, Homo sapiens
aaaaaaccaaaaaaaaaacaaatctcagggtgttttttccccaaagtctcctagttgctcaggtatgtatctctctatctccttgtatattttaaaatcatcccagttttccccataaagacagcattgcacatggttaagaaccctagccctgcagccagtcagacctgagtttggatcctggctctgctttctgtgtggctttgggcaagttgtatatatttcttcatcttaatttaaaatagagatgataaaataatacctacttctgagggatattttgaagatgaaatggaaatgcctgtacagtacttaattaacataatgtctggcacatagtaaatagtcagaagtaaacaggaagattttaaaattcatcattataatggcttcaagtagagagcacttaaaatgacaaattagggactaataccatagaagaaagtaaatgagatgcaaaagcaaatgttttcacagaattttacctgtggaaggtaagtaaatgtctcaagtgttatgtttcctatctgtagacgattcctcctcgtgctggagttatcagtgccccacagagccacgcgcgggcatctgctggaagactgactcctgaaagccaaagcaaaacatcagaaacgtcgaaaggtaggtcctctttgggaggctgaggcaggaggatcacttgagcccagaaatttgagaccagcttgggcaacatagtgagacccgcctgtaaaaaaattaaaaactcttaaaattagccaggggtgatggcacatgcctgtggtcccagctactcgggcggctaaggtgggaggatcacttgagcctgggaggttgagactgtggtaagccgtgatcacaccactgcactccagcctgggcaaaagaacaagaccctgtctcaaaaatcaaaaatttttaaaaattgagagaaaagaaaggtagatactatattagaaatactgtactggttttgttgtatatttttctctttttccttctgtcatctcccaccttctacaacatatattcaga

SEQ ID NO: 102133 - DNA, 1673 bp, Homo sapiens
ctctgatcaagcctgcttttccttaggtgatgttgatgactatagtgctgaagtggaggaacttcttcctcagcatctccagccatcttcaagttccggccttggtacttcccccagctcttcaccccgaactagtccctgccagtcacctacaatatcagagggtcctgtaccttcccttcccatcagaccaagccgagcaccgtcaagaactcctgggcctcccagtgcacagagtatgcattttatttgaaagttttgtatggcttcctgtggccaatgtgcttgatgttggagagtcatcgtttaagtttcatacctaggtgataaagtgcaccctgttttctccggtacagaataggaaaacttgtagatgataagctctcaatggaaaggaaacttgctataactgtcactagatgacaattgttcttaatcttttttctatgtggttaggtttgtctatgtcttataactgatgattttctatggtatgaacccgttaactatttgagctttttcttctctctactggccagactacaaaatggcttaactcaaacaatactttgtgcatatcaatagggccacttagtaaattagctttcagcacctgaggcctaggtaagaagtcagcacagaggtagcattattgctgccatggtaccaaagggcagtttaatagtagactgcttttgttattcatactgaaaatacatgccctttctttacaccattgtgcacattttatagaacattacacatatatatgaaggactgttcccttctgtcaacagctacttagaagctgatcttcttacctcctgtgcgctttttaggttctcctattgacgcgcagccagcaacgccgctgccgcagaaagaccccgcccagcccttggagcccaagcggccgccgccgccccgcccggtcgcccctcccacacgcccggctcccccacagagacctcctccgccttcaggtgacaaccttttatttccatttctgctagatgtaaaattcttcactctattttaaaatgttttgcatgttttccaatctctagcttctggattttacagttttttctatcattattgctatttcttagcttttctctaaagaacatggtaggcgcaacagacaaggtagagtgtttgcagagtagattcctctaaggtgttttcacagctgcctttagctgccttctcaccagccagccagagaggtttattttgtttttgctaatttgatctagttaggcatgtaaactgttcttaggtaaaattaggtttaatttttttcaaaatcctcatttctggatgatttataagcataaaataattaaaatgtactaatttctgtaaaagtataataaaactggagagcatacgtattaatgtacaattgtatgtatttgtttaatgttcttttaaattaaatatagtgctgttacttcaattataagcatatgcattgaataatagtttttgtagtacgtagataatatgtaattcctgcatgatacttgatgtcatggatactatagcaatctttgacatttcacttctgtatttaatgtcatttcctttctgctgcctattttcttatgaactataaggggctaggagtcctgcacccactagaaaggaatttggaggtaaccatttac

SEQ ID NO: 102134 - DNA, 1017 bp, Homo sapiens
ttctgactgcagctgaagatctagatcttctaaatgctagttttcaagatgaaagcaaaattctgtacacgtggactccaggcactttgctgcactatggaagagctgagctgaagacttctgaccacaggtttaagcagtctcagtttttctaatagtgtttgaaatttgtttgaaatacacccttttaaaaacatttctaatacatctatcttcctttatgccttaaggcctgtcgttgccctgattgatatagatatatttgaagttgaagctgaagagaggcaaaacatttataaagaagtaattgcagttcagggtccaccagatggtacagtattggtctcaatcaaaagttctttaccagaaaataatttttttgatgatgccttgattgatgagcttctgcagcagtttgcaagttttggtgaagttatacttataaggtaagatgtttattatgcaaaagtagcttgtgattcataaacaatcatttctatatagaaatcaccttatttggggaaggagagaattttaaaaaagaaagataccaccttatttagtgtttagtatatgagtatttttatttccaaactaaagcaagatcatactgtggatattattctgtaggtttttataactgaattctcaacttagaaagtttaaatgaatagtgaaactttttttttaagacagggtctcacccagtcacccaggctggaatgcagtcatgtgttcatgtctcactgcagccccaaccacccaggctcaagcaattctcccacctcagcctcccaaatagctgggtctgcaagtgcacaccaccacacctggctaagttttgttttgttttgttttgtttttgtagaggcagggtttcaccatgttgcccaggctggtctcaaacccctggccttaagcgatctgcccagctcagccccacaaagtgctgggattacaggcgtgagccaccatacccagctaaacagtgaaactttatgtgaacaattgaaaaca

SEQ ID NO: 102135 - DNA, 1032 bp, Homo sapiens
tgctgccaagctgtccctttgaagtcaagctgcttctctctgacatccagctgcctctcctctctctgccagctgagcctggggtttttatgggcacaggattgggggcaaggcaggccatgggtggttttggaaaaagcaacattcgagcgagaaaacagggatataagttctcatttggggctgtggtaacagactttttggcttgagggtgggacccagcaaagggacccacccacttctgcccagaatttccctgtctcctgtccctatgggtatgaaaaatgctatgtctcaggttatttttctaagctttgttccattcagctagaagtgttcatcagacgcatacagatttcttctgagagcatccagcatgtaatagacatttaatggatgactgtctgaatgaaaacagaacttgttgctgtttgggaataacttactttgtatatgtttattttaggtttttagaggatttttagaaggaaaggtaacctttgctccgacatataagtatgacttgttttctgacgactatgacaccagtgaaaagtgccgcacccctgcctggacagaccgtgtcctttggagaaggaggaaatggccttttgatagatcaggttgggaaatgggcttctttatttaaatgaactaatgtaaacttatgaggaagcagggaatgacataatatcaaatgaggagaatattgtttttcaagaaacattaactggaatagaataaataaaatttaaatatgtcagatttttagaaatatcagatctgtttataataacttatttaatttttcagcctattttcatataatttcatgtaaagagaagcaaggaaatatttttgtgaaatttttaattgaagctaatttaggtttttaagctaactttagtggtttgcatatgttttgaactgccacttgtctcttgaattgtttatgaaacaccatttagtcccagtcctttaagtaatcttggaaataaagccagatcttaatttttactaaataaagcataa

SEQ ID NO: 102136 - DNA, 1094 bp, Homo sapiens
cgaagtctccctgggctgctttctcaggcagctctgttctccgttagtccttgtagtttccagagtgccagcagctagacagagtgatgtgtcttactttctggatctctcctagttttcctggatttctttcacccagaaaatagcaaaaagatcaagattatgtttttcaaatatgaatgtgaaaaattcctcccaactgttaccagcaatttgaggtagtttctcagtcactttattctttgtgccttttctgaataatttctctctccagttttatgtgagattttgatttgagaaatgatttgtttctgtgctgtccctggtaaaaactttagcaagagttttttcaaagtgaattctgaaagggcttaagaatcttcaaggataaccgtcttaaagaagcaaacttaggacaccctaatagaaagtaaattttaataatttcattccactcaagagtgtttgcctttaatatgaatttggttaaactcaaaacacagaaatcagtctttatgagacctggtgttatgttgtgttggatggggttgctatttgcctgaggctatatttaaaagtatttcttggatgcttaattttagataaaagaagtaagccaactgatatatttgcaattggttttgaagaaatggtagaattgaatgctggaaacattgtgagtgcaaggtaagctagccacattaatccactgaaaaatttgccagttgagggaaactatggaggacagataattaagtaattgttacaaggatagtttgaaataataaatggaagggtgctcgtaaaactgtaaaagagcatttctcatacttttgggtctgaggatctctctgcacacttaaaaatattgagaatgttaaataacttttgctaatgttgtttatatctttgttatattaggaattaaaaatgaaaatttaaaaacatttaattcacttaaaaacaataataaacctattacatgctaacttaaaataaattttttgaaaaataactttttcaaaacaaaaaatttactgagaagggtggcactgtcttgtagttttccaaatctctttaatgtctagtttaag

SEQ ID NO: 102137 - DNA, 1080 bp, Homo sapiens
aatactaagacatcactcgcctttttcactctcatttcctcataagactgctatatcttggtatcataagagaatatcataataaaataagatcatgtggtaaaaggtgaaagtagttttgatgtccttttcctgttaccggttagctaccaatgaagtacagatttttaggttgaggtgcttttaaggttctatgctgagaatttaaccaggatagaatgtggtttagaaagggaaaagatgggttgtagaccaaaaaaaaaaaaaaacgggagagattgaggattcaaaatgtattgaacattcattcatttaacaattatttattgagcacttactgcgtaccaggtagtcttttagttactaggagtattcccataaagaaaacagactaacatgtctgccctcatggattttccattctcatgaggggagacagttacaggataaataaataaaatacatagtttataaatgtgataaatgctatagagaaaaataaagcagggaggggataatggaaagttaagggcagagtgcagtttaaataaagtggtcagagaaggcctcattggaaagtaaagacttgaaggatgtgcgggaagagtgttgcaggctgtgggcacagccagtgcaaaggccctgtggtggaagcaggcctcatatgtttttgaaacagcaggaaggccagtgtctgagcagtgagtgcaccagggagagtggaagatgagggtggaaaaacaagacaaattgttgagggccttgtggaccattgtttaagcactttggcttccactctgagtgagatgggaagcatttagtagtgatttcattttcagaaatatcagcttgtatttttctcaaggagccattattcatcaagctgcctgtcagtagctacaatcttaaatgtaaatgttcttaaatgtttttgtttggagaaaaataaaatttatatttttaccagactcttaatgaaaattgtagaaagttaattgctatattcctaaaaatgtatagttcattggatttgtacattaatgtaccatttcattgaaacagaactatttgttctgcatg

SEQ ID NO: 102138 - DNA, 1976 bp, Homo sapiens
gtgaattttggtggagtggaaattatgctggatcttgacagattggtgatgaagagacacaaataacgatttgtgttccaggtatacgctaaaacagccaggactctggtttgggaaggaatgggagacaggcctctgaagtagtttgaaaacagattgctttcttttctttctcaatattaatgaaactcattgatctcaatgaattttgttttgcttttttaaaatgggtcccctgtctctgggctagtcatttaaacatatgtaagttttgttctatatggataaatgtaaacttttttttttttaacatgctgtagcttgcatatctgtttcctttctttgaaaatgtgtgcttggaaaaattgattgcagaagctctaaaatagccatgaaatcagtagcaaattttctcttagatatactaattaatgagatgctgctatatttttttcttttagggaaaacataaaacagatagtaaaactccttgcaagtgttcgagctttggatcatgctatgtctgttgcaagtgaccacaatgtgaaagaatttaagtctttgatcgaaggaaaatagatctatgagactgaaaaacctatttgcttgattaccattcccaatgtgtaaattttgtatatatgtaaagtttcttaaactgtaaaatagcaattcttgttttaatacaaaaaacattatattcaatactgtgtccttaaatgatatttcttcagaatgaaaggaattcagattatttctaggagtctatgaatgttttctttactgcctgtcatactttgtttactgaagtattttgtatggtcatttaaattaaccctctcagttaattgtcccctgtaaacgatgtgtgcagtgtaaattgtgtaattatgcatatatatatttataccaccatggacttactttcacactggaaatttgtggtgtttttccacagaggaagccttttaacagcagaaaattatccggtagcaaattgtcttagggaaattactacactgttgtaacaaaagggctggcaagtgactaaatgttcattaccttttggttagcgttgctatcactgtagctgtgctgccttaacattgagagttgagttgtggacttagtcattgagtgaatgttgaactttcttccttgaatcagcgttagagtcaaatgtgggtttaatgtgaatgctaaatgaatatgcaacatagtttcaaatggaacatagaaatttcacttttgaaaataataaacccacaacctaattgcatggttttgggctgaccgtcctgtctcattcatgattttactccctgcccagcttgcagatacatgcatttgaattttagtagtctgtcatatttaaaatcccacatatgtgagttaaatatgcaataaagaatacgccttgctgattagccacacccaggcaatttaatatccatggtcttctataatgtttataccacattgtaaatattcagagaacttgttttaaagtttatgctttctgattctgtgattttcaaaagaggaatttttttggaaattaaggactatcgtttgataattatatatgtaattaagatttagccaagcattaaattaatttttaaatatatcctttgttgtattttcctgacgactaaatttgcagcatttcaaatgactctaataaagtgggactgtgagcaggcccatgtgtacccttgatcaggacataatatgcagaacagtgtcatgcactgtatttgctctgttaattttatcttatccctacatatttgtattagttcattctcacgctgttatagggacatacttgagactaggtaatttataaagaggtttaattgactcacagttccgcatgggtgggaaggcctcaggaaacttacaatcttgacgaaaggcacgtcttcacagggtggctgcagagagaaatgagtgctgagggaagggggaag

SEQ ID NO: 102139 - DNA, 1033 bp, Homo sapiens
tgggggtgctgtaatttcatttttataccactcatttttacatcaaaagctgctggaaaaggaaattcagtatatttaggccatcctagaagactggaaaatgaagcagttggttgtcagttttatgttactaatttactcaaatattggacagattatcttttgctttgagtgcctaacccattggttggggtaaaaatttaggtatattggtttagttaatgtaggaagtcagatttaaaagaatatttcttcagagtaattgctgtagctcagaagcacgtcttctggtgaaatacatttatacccattaactagactttgcttttaatactttaatttattctgtcttaactattttattttacgtctttcttctccacaggtaatcaattgtttccccaaacaatggttcatgaatctgaaaggagaaaggactatttctcagttagaaaacttttgccgataccttgtacacttagcggatacaatttatagaaatagtatcgggtgttctgatgtggaaaaaagaaatgcaaggtaattttgtaattaatgaaatggtaatctagagttgtttagttgccagatttagtattaaaatgttttaagtagagatgtttatattttagtttaaattgtatgttcacttagtattataaacctaccaaaaatgcacataatttttcattttagcagtttttactttttttcagtatgttatttatgaagatactaaggaaagacttctggtaaggaccaaccctcaggggagtgagtaaacggttgttttctctgtctccctctttgaagaattagagaggtctcagactctcttgtttggagtttcattatgcagatttaaattcaagtttatctcccaatttggggagattttttgttttaatcaatattatgaactagaggttatcactcatggctttttggggcaacttatttctaatttttatcaagggttgtaagaaaagagtgagtgaaccattagcctttctgtggacattaatttatgggt

SEQ ID NO: 102140 - DNA, 1937 bp, Homo sapiens
ttctgtgaacaccaaaaattcctttgtcctatgaacaccaaaaatttgagacaggtctcagttaatttagaaagtttattttgccaagattgaggacacacctgtgacacagccttaggaagttctgatgacatgtgcccaaggtggtcggggcacagcttggttttatacattttagggagacacgagacatcaatcaatatgtaagaaatacattagttccatccagaaaggtggagacagctcaaagcaaggcccccccattggggacttccaggtcacatgtaggtgagagagggatggttgcattctttggagtttctgataagtttttccagaagaggcaatcagaatatgcatctatctctgtgagctgagagatgactttgaatagaatgggaggcagatttgccctcagcggggtccccagcttgaagaggcccaagatatttccctttcacagtccattgaattgcttttgtgcctttgttgaaaaccagttaactatatgtgtcatggaagggtttaaggtaagtaaacaaattgcctttttttttttttttttttttttttttttaaagagacgaggtcttgtgttgcctaggctggtctcaaactcctgagctcaagtggtcctccttccttggcctcccaaagtactgggattacaggtataagccactgtgcccagccataaattgcctggctcagccttccgagtagctgggactacaggcgcccaccaccacgcccggctacttttttgtatttttagtagagacggggtttcatcatgttagccaggatggtctcgatctcctgacctcgtgatctgcccgcctcagcctcccaaagtgctgggattacaggtgtgagccaccgcgcccggccgtaaccacaggtctataaattaccatttttaagattactctgtctgctatgtggagataatagattgaagtaggtatggatagtgatagtgaaaatgggaactggtatttattgtgtattttatgggaactagtacttactgtgtgtttactatgtaccaagcactgtcccgcaccttttacatagattatcttgttgaatcctcagaatggctcaatgaggtacacgctgttttttcactttactgatggggtagtgaggcacacaataacctgcacaaggtcattccattggtaattagagatgggaatcaaactcagccagtctgactcttgagctgctcttctcaactgggcttctgtgggagacttaatacctaatgccctaaggcctccattgtctataatgaattcttctttttcccctgcatctgtaacagtactagctatgtatcattcttgggagaactgagtaaagagccacacaaatcattttctgtaggtttagaactcttgcagagccctgcttcagaaaggctactcagtgctcttgctcataatcactggagtaactgcagggttctgaagagattaaggtgggtcagattcggaggatggcagcaggaactgagggaaatggacagactggatggtcgtggagacacacaacttgagagagaggtcaggaatgacctccagacctctgccgcaagcagctggttgaatagtgttaccatttactaagttgagaaacaactgggaaactataagtttttatggtgggatgggatggggctttcattttatgatgatagctttcattttctatatattgattgagcttgggtagcttgagatgcataagtgatataacttggttgtagttcatgatacatggtagccatgcagggttgtagtcagactctcccatcttttgtgggcagcgcggggcggggtgggggtgtgcatagaaccagctagagtgtaattttgaatggaggacacttacctaagactcagcactccctgatagtactgtctgcaatg

SEQ ID NO: 102141 - DNA, 1050 bp, Homo sapiens
acatttaagtctttaatccatcttgacttaacttttgtatatggtgtaaggaaggagcccagtttcaattttctgtatatggctagccaattctcccaacaccatttattaaacagggaatcttttccccattgcttgttcgtgtcaggtttgtcggagatcagatggttgtaggtgtgcggtcttattgctgagttctctattctgttccattggtctatgtgtctgtttttgtatcagtaccatgctgttttggttactgtggccttatagtttgaagtctggtagcatgatatctccagccgtccagtttttagttgtttgcaaccaaaggttaaatccagttcttgtttctcttatcatagctggaagcagaaatagccactattttagtatttgggtaaccttttaaatgtcttttaggcaaaatgtcgtgactttgagaatatgctgtggtttgaatctttgctgttttatggttgtgaagaacgagagcaagaaaaagatgatgtagatgttgccctactacctaccattgtggaaaaggtgattcttcctaaactaacaggtaaatctcctgttctctgaattgagcattcagacacactggctttctcaaatctatttttatgagtttataattcagagcatgtttccttatagaaattacatgagaaataatagttaccacctggcccagagatggctagagggcagaggggttcttatcctgggacttgaagaccactttagggtgggcctgtagttgagtgcagtaattgcttcataggtgaggtttagaaattcaaagactgactgaagcaaaattatacagagtttgagggaggaggatatgcatttatgtggggagcaattaaaatgctttcataagttcctcaaaaaagattaggaatcattgatacaggaatctattttaaatactagaaatgttagtttgaaattcttgatgccaagacaacatttctacagaaatcctcttttttcctaatctttattttccctgagtaccagaaataagaataatctatc

SEQ ID NO: 102142 - DNA, 2066 bp, Homo sapiens
ccagtcgtttgggttgtttgcctccccttactgtcatatcttcatagtgtggaactaaaacgtagaaatgagggaagtatagtggacagatgtttcccccaccccttcttttacctaggcaagagattaggggagtcttttttgattaaagagagtaggtccaaaataaagaccctgaaacactaaaatctggggatccccaacaaaagaactggctcagtacctagtgatccgacggagacacctctgttagacagctcctgcccacacacacagcttccagtcttgctcttctatatgaacaggcagttaacgatgatcataaggaccaacctgagcagcagaaccaaagggactgaggaaacagacagtgctggtacaagtatgcaagttttctgtaaacagattactttcaaacagttgggagccccagggagataatagaaggtatcctactcaacaggagtatatagaatgctgtagaagaggaatattgtaagaacaagaactatctcttgaaaactaaaaatatgataactgaaatataaatttaaataggattggaagctaaagctaggaaattaccctagaatgttttttgagaaatggaaaatacgaagaccaaaaaaataaaataaaactatgctgtgaaagagaaagattagcatttgagaaggcggaagttggtcctgctcagatgcggttttcagatgccttattctaaaaatagtgatagaaaacaaatttctacaaagcaaaattacaataaatttattaaactcttgcaacaaagctgttttcttatgtcttcctatgttttcctgctgtcattcaatgtgatgctgaagttcttcctccttaaaaatgtaatatttttccctttgcacaggtaatttagagttttaatttatttggtcatcatgatagctattcctgatagctgtcctgttacttagacataaaaatagtgagtaagcccaattacatatttgtagggttgttgaactcttaaaaagaaatcacttctttaatttttctactttttaaaatgggaacgcagaataataatgaaatttgttctaaaccaaaaacctacctggtttaccagttattgcagaatcttgccgttgagattagcaagcagtctgtcgtaatggcttattctgtgcaaactctttcctcaagattgttgaaagatggcttttaattttaactgttgttgttttgcagacaaagctctgatggcaccaaatcttgactcctttggacgcgatcgggcactgtatcaagagcatgcaaaacgtcgcattgcagagcgggaggccaggaggtaattctcaaaacccttgctctggcttgtttgggaagggaggagtctctgttatctagtttgggaacttgatgtttattatttaggactcgtcgtagacaagccagagaacaaaccggtaagatggcagatcaccttgaaggcctttccagtgatgatgaagaaacttctacagatattactaatttcaatctggaaaaaggttagacatttatttggaaataagactcatcatcagtttagtttctacttgggtatggtttttaccatgaaatgatttgaatcttcatggtctctgcattagaaccagacacttcttttttaattgcagaaatttgcatgcctttttattagtgaatatcatgatgaattctcaaaaataggggtaacatcttctcatagggtgtacttagtatttgcataataaatgttgttactgttccaaatggtagaattttaagtgactggaaatgtgtcaggtccttgagggcagctctcattgcagcctgtctggtctggaaaggtaaagcttggcagtagagcactcagccctgaaggaaactcttgatttggggagtcataagtaatctcaccttagaggaatggttagtactattatgtgccaggcattttcagaaggatcccaaataaaagtcttcatttcccaccattggctataattgtttggaattatatcaattgcacaccatttggaacttagttggagaagcttctt

SEQ ID NO: 102143 - DNA, 1577 bp, Homo sapiens
cacagtgaaagagtttgagtttagggactgggacatgttgtgggtagggggagggaagctataacttaacaaatgacacaactccaagataggagagttttgagcttcatcctttggataaagcaaactttttgtaatttctttttaaatgtttctctagtttgctttatgtactgtgttttttagtaagtcagttggtgcttacaattcttgaaattttgtatacaaatggatagaaattgaatttgtacttccatcattatgacatgtgttatggaaaaccagaattagaaacctcttgttaaatagttcagcggaggtcctttaactggatgttttaaaccgtttagttcctttttttccgttaccctccatattcttgagtgcgctaataggaattttcctagtgtgaattccttgtggtttcttttgtcatttctttgttccctttgtcagcatttctcaaatggaagtgtgcatcacaattacctgatactcgtttaacatacagattttctggttctatccccagtgattcttactaggtcttcagcatccagaaatttgcatgttaaacaatctctccaggtgatcaaatgcaaatagctctaatgttattctttcagaaagcaatgctttgctatacatggtctctaagtcagagagacataggatccctgaaaaagcatcctcctatatgtcagatgggttttggagaggcataaacagatggtaatacggccctcatagctgaggtagtctcagctatgagccctataaatggctatgaccttctgtttttgccactgaattttaaattggattattgacattagccacctacatgactcatgcatccctcccagatcacttttgatccagacagaaccagatttctggggcagattacaggtaaccattatactacaaagggaggtaattttcttttaagttagatggtttgtgtgagctgtacatttcatcaaataccttttcccatctgtaatttgttcttgagaatatggagctatttacttagaggggatttgaaagaagagttgaattatttatattagtttgattgaaagttggaaagaaattaaaagatactgggaaagtgaaaaatacagtcctagagggagtatacattaattgccaaagatttgaggaaaatgacatgggatgctggagaatcaattcattttctgatctgttttttaaagaagtaaagaatagtctgaaattcttctgtttagatttataagcacttatctgcaattactgtgtataattcttacagaaatggaggaggctatcacttgagtcatgttagactcacctgtctcctccagtgcacattttacaaaacctatacatgcagtgatgttttaagtataatgttttttttttttttttttttttgagacggagtctcgctttgttgcccaggctggagtgcaatggcgcaatctcggctcaccgccacctccgcctcccgggttcaagcaattctcctgcctcagctacgcctggctgatttttgtattttttttagtagagacggggtttcaccatgt

SEQ ID NO: 102144 - DNA, 4994 bp, Homo sapiens
ttattattttcaaagttttaactaccagatttcatctatatcccatttcttttctaggttcaagccagtcaacccgcagaagtgaatatgtactaccagaacacttaccagacaatgccttacggctcatcctatggcattccttatagttatacggcctatggatcatcagatgccaaatctcaaaaaacagataatacagtccctttcaaaactcccagtaatgagatgactcccgttactattgatttggtaaagaaacagcttaaagacaggtagggcagatcaacttcttaaagacctgtccgctagctttctgttccctcaggcaacatgtagtctggggtagcagatgcagaatatcagcaaagaagattcactggcccagcttcaaaagctaaacagaagatgacttcatactttgttctgctaccttcttggattacttctgtggaagcctcgaaaaattataaaaaatgccactccatgatcttgttgaagacatttctgagtttgtacctcttggactctgaaaaagtgtagtcacgctatggggggaaaagcaaaacagtgagattttggttagcccacaaaactgtgaaatctgtaaactgccattttttgttttttgagaaaaaaagcagtacagaggaaaagatgccattccaaatatttttatgttctaatagtggagctaaatgcatattttaatattgcaagagtcctgacaccatagacctttggatgtaaatgtgttatatttatccttttgtgttcctaaggttggactccatgaaagaattgcacaaaacaaatcgacagcagcatgagaaacatctgcaaagccgagtggactctaccagggctattgaaagattagaagggtcttctgggggtattggtgaacggtataaatttttgcaagaaatgcgagggtatgtccaagacttgcttgagtgtttcagtgaaaaggtaagaatgcaaaaatactaatctctttgaataaggcaaaattagggaggtctagatggccttgtgtagaacattctataattctcagaaagtacccactgaactcaacattagaagtgatgaaaagtcatgcttcatttttcttcacttcattagtggcattatctcttaagggcaatataatacctttgttgaaaacagaaataaagataatatcttaaagcacatttaaataagactttggaaagtcttatttcaatatggtggtagattattattggcctgtgctgaattcttagaatataagggactcatctgataaaattttcttttctggttcaggtttaaacttatttttaaacgtttctacaagcaattctaaatatgcatataaagttgcaaatttttattagttttttttttttttttttttttaccctggatgatgattaccattgttgctaatagtttttatctaagtaagcctatgcttgatttctttcagaaaccatttcattggatatcattttttctaaggtttcatttctcccaagtttgtttttttcaataggatagtcagttgacaaaatgtttggcattcttatactatttattgtttacatttaaaattaggtgcaaacagctagtttctcaaatgacctcctaattgattttttttctttaagataaaagtattggttgaggcactggtttataagcatttgtggactttgcagccttatctttaaaaaaaaaaaaattaaaactgtggtccttaaatatcctgtctgaactttggattggaaggcacatttccctttgttattggctatgtagattagcttagaatctgtaagcatatagtgtggttaaatatgtatttcaacttttgttatctttgttgattacttgaataccctaaaaccaatggctgggaaaagatcattgccagactatgtcttcctgatggatctttcttcctgatgggtcttaatggttccagtcagtctgtggccagattcaggatgagataacattcaccatgtcctctctgtagggtttctcatgttttgtctttatcacctggtttctggagaagcagctgcagtctgagttatgataccacttgtggtgtatcagttgcttagggtggggaagaagtataggcttgtctgtattcctctgtgccgggagctggagtcaagattggaagtggaacctaagtgtcaagagttgacagtcatgtccttcctactggcaaaactcttctgagcccagtgggcatggtgggagctggtctcataacctttgtgactagagaaaggatctttttcttaaactatgctttatgagtttgtccctggagagctgcttcttgaagtgtcttggcgcttgcttcggaactttcttgagtaaattaagacattcataattgcaaacacaactctaaaaaatttgacagtaatatgatcagctagatcataccaaaagtaggacaacctagtttatagtttttaattgttgaattattagtgtatttcatctcgattaccttgttcctagagaagtttacttcagattatgctaatgtggttatacagagtcacttagattttttggaacaaatcttaaaccttatacagtgactacgttttaattaaaagagaggtagacatagcttcatttaaagatgagtattatatttcattctaacattttcatgtgtatttcattttaagagtactgctcagcttagatctttagaagataatcttaaaaataaagaaaaaacaaaaaagtactgctgagttgataatataaattgttatattggagatacttagaaataattggatactttgaataattatactataataatatttcagagttaaccgtaaaaagataaagatccctttttttttcctctttgcttatgaaagtttaggtggtttttaaagaagttttaaatatttgtaaatcattttaacttgccattgtttttgtttccctgtaattatctttcttgggttctttgccttaactttggccctaaaatagtaataattggtgagagttttgagtttggagaggataaagaaattgtcacggtgcagactcttgagataaatcaatattgttaagaaacttgaatgagagctcacagtctgtttagggcttttattctcagtagagtttttctctggacctccggtaaaaggcattccagttaacctaaagagaaaaactacattgtcagaatcttaactatatgttgcaaaattatattctgtatgatgccagcttaggtgggtagttcctacagtacaggaagcttaacaatctctaggattaaaagataaaagaatgcctcaggctcatttatctttagtacttcatggtttaaaaaaaaaaatgagggcatggggaagtgtaaatggcaatgttgtggcagtaattgctaaaaaaaaatcagattataataaattttaatgatagagtctctggactcagctatcaaggataatcattacagatttggggacattgttgcccatggtgtggcatattaaagaacaaaataactccattagtttgacctttctgtgaacatttgctacttttgcaatggaatcatgcaagtatataaaattgcttttattacagacatctctgtattccacctgcctttttttattttccatttgcagtctgttcagttcaggaagctgctataacacttggtgccagtgttcccaaactctaaataatgtgttttccatttgcactaaccatcaggaaactagaatttctggtttcctcaggtatgtgtagtggtcattagtgttacgtgaaagtctcatagcatttgattataacataaggtatttagaaaaagaaagttttctgttttaagttagctctcatgttcttttgtattctatatgaatcaagtaaatgctttagggatattaacctggaaaaattattgactttgtaagttcacaattcatgtaaagaaatttttataaaatatgggagaatttaaacatttgacaggaagagaacaactttttaaatttgagatatattgagttcagagaggttagtgatagctggaaattttattcgccctagtaattattttgtttacattaaaaaatctgtaataaagctacaaaatagtaaacagattactgtaacgtacttggtacatatgagtggcagagcaactgaaatgtccaaaattggagaattagcagactcttgttcttacctacttatagagccattgcacttttttggtaccacacagtgataatgttttactttgaactacaaaaatcgcaatgcagataatgctgctggaaaattaaaaatagatattaaaaagacttctaagtacttaaatattctctaagggaaaagctctaaaattgttgacatttctttacttgttctatgaatactgaagtgttacatttcttaactaatgtttgctccaataactaggcactggacattatagctctatgcatggattaaaagaagaagtgtcgtttcccaaacataaaacagaatttgctacttgtgtgctgttggggattcatgattattctgtccatagagagggtactttttcagaaatccggaaatagtatggaaccctcaaataaataagcagctgaggagtttggtgttacggagtgtgttgtatttttacaggtgccactgattaatgaacttgaatcagcaatacatcagctgtacaaacagcgagcttcccgccttgtccaaagacgacaagatgatattaaagatgaatcttcggagttttcaagccattcaagtcagtccatcttgaaggtttttattattcattaaacaaccttgtttacttagtgcagcctaattgaaaattagagatcttggagcttttttttttttttttaaagaaacaatttccttgctgttgtgtcaggtagatctaaaaatggtaacagcatgtacttgaattgtgt

SEQ ID NO: 102145 - DNA, 2056 bp, Homo sapiens
gttaaaaatgaaaaaaaaaattatagctaaaataaaactgctttggtgggtttttcctttttaccccgtcccactctttcccatatatattaccattatatgttctttttagtttcctcagtgacttttatattccatttaaactcaattaacaatcttttggattgcagacatagtatgggaaggaggtgccagcagctgaaacatcactgtgatgaggctatcttggattattttacccttcatattttcaagaaaatagaaactttgcatctctcatactgccatattcttaccatttgtttctaggagaaattccagatgcagcttttatacatgctgcaaggaaaaagcgccaaatggcccgagaattgggagatttcactcctcatgataatgagcctggtaaaggccgccttgttagagaagatgagaatgatgccagtgatgatgaagatgacgatgagaaacgccggatagttttttctgtgaaagaaaagtcacaaagacaaaaaattgctgaggaaataggtaacttgatttaattgaatagtaagcctattgcattgcctttttttgtttgttttaaggcagggtgtcattccatcacttaggccagagtgcagtggtacaatcatagctcactgcagtgtcttgactcgtggactcaaacagtcacccttgtctcagcctctcgagtagctgggactacaggtgtgcgtcaccacacctggctaatttttttatttttaatttttttgtagttatggggtctcactgtgtctggtgtcttaactcttggcttcaagagatcctcctgccttggcctcccgaagtgctgggattacaggcatgagccaccatgcctcagcctcccaaagtgctgggattacaggcatgggccaccatgcctcagcctcccaaagtgctgagattacaggcatgagccaccatgcatggcctctaatgctattaaatgtgatttgatattatagtcaagtaaaaagtatttagacttactaaattttatgttagaggactattcttgggtacaagtgttttattggaatttttaaaaactaatatcattgtgataactcatgttcattgaacatttattgtgcagctggtattgtgcttagcagtttacatgcgtaaattcatatagttctatattcctaggaggcattagattttgttccctttgttgatgtcaagtttacagagattaagaaacacatccaagattttaactattacattaatactgcctttagcttcaaggaatactgtgtttaaaacaggcaaagtcaggactaccaaatgagagaggagatcatattagacattttagtaagattgagttaatagttttgctcagttcttgtgaaatgtcaggacagcatcttttacctctttgctctttgggtgttacttacttttctttgttgctcatggctgtaggaattgaggggagtgatgatgatgctttagtaactggagaacaggatgaagagctcagccgatgggaacaggagcagataaggaaaggaattaatatccctcaggtacgacaaaagaattaaactaaaaattaaaagtagattaaaaagccttttttattttgttaaagtaaaaaattccgtattgaatctttgtcattcatttcaagtaacaaaatcccatgaggagacacacacacacacacacacacacacacacacgcacgcacgcacacagagacacgtaggcttttagaagaaactgcagtgtgttcggctttttgcagtcagaatgatggaggaatttccaatttcttagatgagtttttctcaaagtggtccttcagttagcattagcattacccggtagctcattagaaacgcaaattaccaaattatcagcccccagagacctacagagtcagaagcttggggtggtggggccagcaatctttgttgaacaagccctccaggtgattctgatgcacactaaagtttgagaaccattgctttaaatggaatgtttttgtgcgtgtagcttatttttttggact

SEQ ID NO: 102146 - DNA, 1021 bp, Homo sapiens
aaagtgatttgcccttaccttagctttaaaaccactatgtcagcttgtggtggatgtagttactcagaattgacagcacctttttattttagatattttgtttcggattcgttaataacttggtgatgtggtttttcagaaacattttgaatgattttttcccctctcaaatagatgatttaaggacgacaataataggaaaattttgtgaagttacatgtgctattcctttaaaaagtctcaaaaatctcattacttcacagtaatttaggaagttgacctctgtttttgagtctgtgacagacttgaaataattatacaatgattttggcatatgagtatatatatttgggataatttggacagcacgtaagatcatgtgaaagaagggaaaatattttcagaaaatagttgctacagacttcatttaatttcctttttaagaaaatgaagaagttttcaaagtgaagaaatcaagttatagcaaaaagatagtaaaattgctcaagaaggaatataaagaagatcttgaaaaatcgaagattaagacagaactcaactcatcagctgaaagtaagtaccaaactaattgaattcttttgaaatgacaaaatgaaagctctttctcacagtgatttgctgtatatcttctgaactcattcagtggaccctgtggttgtcaagggcccttattgagtagcagtacagttctgttatttaattgtaacacagatgctttgtaaatgtattttataagaagacagaattgttgccactggaacatttctgctgcaatgactagattctctcacagttttcctacttgtgtgcagactgctgttgaacagagaaagaaggtttctcattttagcctaagacacaggtttatttctgtttgaaggagtgttgtgcaaattcttgtattttgtagagacagatttgcgatttctttggtggtatttccacagtggattttattcttagagaacttttaggaatgccctaaatttaatattagtat

SEQ ID NO: 102147 - DNA, 1120 bp, Homo sapiens
gctctgctcatctgaggtgtaaaactcccagtgatgttggctgacagtgagaccaacatgccaacaacacagccagagcgatgccagagcggatgccagagaggagacctaccgcatcctatctatgggcagggatttggagttgaaagagcacattctccaaacatccaattactagcatgaagcgcccaaaaacccctgaacatgacatgctttcctccccctcaatatctgacttcctggaattcgggagacaaacacttctttgttggattcagctatccaagcgctacctattacacaacatagcatgaataccaatgaagcatttagttaatggcaagctttaatttctaagtagataaacatgcctcccatccccaccatattaatctgtttgtgagtccattcatcctgttcagggcctcttacaaatgtacctaggtaactgtggtaatagacaacaaaaagactaatcacccaccgattaatcacaattattttgacttagctactcttatgccagaagaaatttatgaactgatcttgtcaatgtattgcagggctccaaaacaaaaccatatataagaacttctaaaaaatctaaataaggtagggatgcatgggtaatttaaagagcagcaccaatgtccagttttgggtaaaagccctacagtgtctggcatatgacagatgcaggatcctcctttgtggtgtgattggaatgagatgagatgagcattatggcagagtgtaccacatttcagtttggcgaaagtaataacattcccccaatgactgaggagagaaaccaaacaatacaattcagtcttctccatttgctaagctccatgggtgtggtgggatacttggcatgcgacctctgagtgggagggcccagagctactggcagggccactacactaagggccagggagccacagatggaagggtcagtctgaagagctcaacatgtgtccaaagagtacagtgacagcaggaaagaggctaggcagacaagcagcaattagggtgtaagatgaggccacaaggcaattagaaatccaaaggaatcaaggctaaaaatgccagggatcgggtagacaggcaggaggcacaa

SEQ ID NO: 102148 - DNA, 1044 bp, Homo sapiens
agagtagcttaacttttttcacccttcacctcgctcccatgcccaactcctgacctcatctaaaatccttgcacttctttaaaaagatgcctggtgccttcccaggcaggaagcctttgcgcacgtgcattgttaagaggaaaatgagactgaatggagcttggcaacccaatggagctctcagagcatggatgtgatttgaagtttggggaggatattccctcccacccaacctccacttctagggcatcttaaggatttggtttctgtatttacgacactgacataaatagttgagctgattttatttatttatttatttatagagacaggatctccctctgtcacccaggctggagtgccgtggcatgatcatagctcactgcagcctccaattcctggcttcaagccatcctcccacttcagcctcctcagtagagtagctgggactaagatgcactccccacccctgactaaattgggccaattttatttacaaacagacttcataacaggtcaattctggcattaatttatttcaaatggtaagttgtgaaattaaattcaaaacttgtaaatgagacacaatattatcccttttatttccaaagctattaattgtaactgacacttcaccattctccacgcttactactttttatgctgccttctttgatgaatgtatttatggtgctatagatggtgaggtgaagggtggatggatgcaaattaaaatgggctgtgttttttaagaggatgtattatcacacaaacaggcaaccaaaagagtggactttttgttaagttttagagttattcagcattctagcttcaaagatagccttaaaaaatcaatgaaactatacttaagaaaggtcagggtgggtgcaaatggagatttagagactatgaagattcttaactttgccaaagttttaatcaaatgtatgagaaagtcgtatgtctcccgacctccatccccacccccaccagtagcaacagggtttgtctaaggaaaatcactacttccctgacttgtgattg

SEQ ID NO: 102149 - DNA, 1097 bp, Homo sapiens
gcgcccctgacaggcaggcagggggcgattatctgggccgatgagagccattgacaaaatggagtgtgccatcttcacagcacaaacgtcgccctggccataataccctcttaaggagacctcaagtggcccagtcttgtcaccggctctcccaggcacaccaccaatcgtttgtcaccgctgctggtatttgcagggaggagagggcaagagaaaggcaggacccgagagcatcacaagagatctccgccctgtggcctattgtacttcatctcggagacaaagaaggctccaggcctttctccagcaagtcgcttcagcttcatcaataaatcagaggccagagaaagccattcagatatggctgaggcctcctgaaggctctctccatagagccgctttctggaatatgcaggatatgagagattttttagtcgagcgcattttgttttaattccccccgccccgcgttctttgtcacttttctcctttctgtcccctcggtgtggaacagaagatgcgtttgtaggcctgaatcggggggattgttccaatcatcagaccattcacgcccgcccctcccctgttgtaaaacacaagcccgggccggggaacagcggccccattgtgcggcgcccatgccacccagatttcacctcagccttcgccgagcccctgttttgtttccagtcaaaagaaagcatttgctcaggggaggggaggggtgttcctattgcttccactaacagagaggttaaaggaaagattgatgggagaaagttcacctagaaaaccaggatacatttctggccggccaaggccagttgtttcattgtcctggggccatgttttttgttaattatctctcactctctccttttatcaaggagaaaagtagcaaagcaggcagaaagaaacaggatataggggtcaggggtccccctgggccacctaggtattccatttgaaatgctggggcgggcagggccgagggtgagtcttgcctggcttggggtggagaagagaggcggccaccaaaataataattaatttgatcccgttacttatggggaaacttcccacccttcaccccattc

SEQ ID NO: 102150 - DNA, 1053 bp, Homo sapiens
gcgcactgccagggcgcgcccggccgcaagctctccaagatagccacgctgctgctcgcccgcaactacatcctactgctgggcagctcgctgcaggagctgcgccgcgcgctgggcgagggcgccgggcccgccgcgccgcgcctgctgctggccgggctgcccctgctcgccgccgcgcccggctccgtgctgctggcgcccggcgccgtaggaccccccgacgcgctgcgccccgccaagtacctgtcgctggcgctggacgagccgccgtgcggccagttcgctctccccggcggcggcgcaggcggccccggcctctgcacctgcgccgtgtgcaagttcccgcacctggtcccggccagcctgggcctggccgccgtgcaggcgcaattctccaagtgagggcgggcctgggcctggggcgcgacctcggcccggcctcccttcgctcagcttctccgcgcccctgctccctgcgtctgggagagcgaggccgagcaaggaaagcatttcgaaccttccagtccagaggaagggactgtcgggcacccccttccccgcccccacccctgggacgttaaagtgaccagagcggatgttcgatggcgcctcggggcagtttggggttctgggtcggttccagcggctttaggcagaaagtgctcgctctcacccagcacatctctctccttgtccctggagttgcgcgcttcgcggggccgatgtagaacttagggcgccttgccgtggttggcgcgccccgggtgcagcgagaggccatccccgagcgctacctccccggagcggagcacgccggctcccagtactaggggctgcgctcgagcagtggcgggggcggaggggtggttcttttccttctcctccgccagaggccacgggcgcccttgttcccgccggccaggtcctatcaaaggaggctgccggaactcaagaggcagaaaaagaccagttaggcggtgcagacggtctgggacgtggcagacggacggaccctcggcggacaggtggtcggcgtcggggtgcggtggg

SEQ ID NO: 102151 - DNA, 1028 bp, Homo sapiens
acagtcccaaattcttcccctatggagctttctcggcgaaggcgggattggttaggagctgacaatcggcagcagacgattgtaaatgaccggaccttttttctattctcctgcccagcccccggcccggcctccgcctccggccctgctccagccccgccagcggcccaggacccgcccctggctccggccccgcccctggctccgcccccgcccccgcgccggcggcggcgcggcgcccgcgcttccgtatcgctcctcgtaggccggggctcggcgcgcgcacccgcactaaagacgcttcttcccggcgggtaggaatcccgccggcgagccgaacagttccccgagcgcagcccgcggaccaccacccggccgcacgggccgcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaaggtaacgcagcgtggcggggtcgcgggagcggagcgcgtggccagctgactggagggaaaacgccgcctccctgcagcggttcccggaatcccctccggttccctctcgctctccccgactcctcctcctcctcctgccctccctctgcgtcttgagtatgcggctagtgcgcccttcctctctcccggggccgcacctgcgaccccaggacccctcccgggccctgtcctgcgccctccacgcgtcgcccctgctgggagtccgctttcgttgcacccctccgcgtcccaccccaccccaccaaggatgcccaggataccgggcatttgccactgcaagatgtgagtcgttgctaagtttgagggtcacattcctccaggtccaccccgccttgcaaaaccggctcaccagctgggtgctcaggttcgggatctccagcccgcccccttgaggtcccctgggattagcccccctcgacctgcgtcagggtcacagactgc

SEQ ID NO: 102152 - DNA, 1022 bp, Homo sapiens
tataaataatggtgtgtctatagagtagaactgtatccagctatttaaaaaacaaggatagaaagatcttccaaacatatttttaagtggaaaaagcagggtggaacagggactatacatgctatctcttgtctaaaagatggggaaattaggaatatgtatttgtttttgcttatgcatgaagatactctgaaggattcacaaaagaaaaaaaagttttctaaagggagcaagacttttcacaattttttttttgaatgcttaaaattgttgaacccaacgactgttgcctgttcaaaagttaaatttaaaattcctcccagactaggtaggggattgggcccagaagctgagaccaggctcacttgaataaatggggtaaatgactaggaattttactattccttacaggtctctcattatcttgtctttgctcccatttttatatttgcagtttaattagacacttcagaattttgatcacctaatgttgatttcagatgtaaaagtcaagagaagactctaaaaatagcaaagatgcttttgagccagaatgccttcatcttcagatcacttaatttggttctcatgggtaagtgctgctttttatcttagctcttatagaagcaagctgtgatgccatcctcactgagagcactggcaggaagtcgcaaactcatttccctgactagaggacccagtaccaccctgcctagtgtcaggagttaagtggaaagcaaataggaaacctacactagtagtttagattcaatgtagattcctgtcctgttgttaattttaggaaaacaaatgagtgacttaaggcaataataatcaggactatcctcgccataatttgaagagtaatttctcctaacacgctttcttcctccccaatctttgataaatgtcttttacctctaaagttgattaattagcaacatgcttattcatattctgtgaatatttctaggatggacaattgcctctgaggacattccctcagccagcccaagtactta

SEQ ID NO: 102153 - DNA, 1054 bp, Homo sapiens
aatcatgaggttggtttgatatttcattttctcttggtaaacatattattgttctgttatatggggagaggtgatcttttctctctctctgtctctccctctcccttttcctatctacctctccttctctctgcgtttcttattcagagccttaaaaagccaaagacaaaacaccatcacacatccatttttaattcagttgaatactttaataatccaaatctattttgacaaagcttgtatgtgtcatcaaagccaatttctacaggtcagaacctcacatacaaaataattcttgtgtatgggttaggcaatgatttctctaattcagtcagtctgaatgtttaaaagtcctgttatctgaggacaggaatccaaaggtctattgaccatattgatggtttatgttcacttttctttactctggtgggacaccagaaagctgcctggcctagtctgggacaggcctgggtccatagtctggtttggtcactaaccagcttgacacttggcacggacctcagcccctaagctaatgcctctgctgaggggttgctgcaaggattcgtgacataatggatggagtcctgcttgtcttttgtcttcccacacctaccaatcgcccttagaagtcattgctttgatccagcagccccttggagtgtccttttgatggttatttatttggcctagagctgctgctgctactgcttattgactgagccagtgggagacctcttgtgagtttctcttcggtgcctgctaaaaagtttttctctgcattgagtggtcacatgtatcatccaactaactgaagcttggtagatgagatatctgcattgtccctgaaatagcccaggtctgacttaggactggatcatctagtcttagccagagagggagggggtctcagggaaggcattcataattgtcccatagaggaagggagatctgaggcttccaccatgagggcccaagtttcattcattcatttactcatccggcaattttttttttttttttgagacggagtctcactgtgtcaccaaggctg

SEQ ID NO: 102154 - DNA, 1054 bp, Homo sapiens
atgacttataaatcctttttcttaccaagcctgtgataaatctaaccctgtttgagatttgaagacaaatcccaaaagagattaaggcctacctctaaatgaaattctcagtcttactgattttttgcttatgtttacagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcaggtatgttcatttttttaaattcatgttttgagtattcatgcttttactctgagggcaagcctatttaaagaaaagaatctgaaaagaattcatggagcactaaaggtctttcttccagtaaacacctcacagagatgttttctgttggttcgtgtgtatgatctggtagagtcacttttatattgtcataccaaaaaacaatcagatactactcgatgagatcagaaatcttgaaatggaaacgcttttgtttcagggagtcaggattaaattcagcactgtgtgccctttgtgtggccattgctgaagccaaatgccagaagaggtggagttgcttgagacagtggtatacagtggcattaaggggtgaaaaggtggaagcagcgaggttgggtgcagttcatggatgtgatctggcatcagctctcgctcatagatgaaaggaacccttgccagggtgtacgagaaaatcactgatgaaggctgaacacctttctgttacacagacatcagaacaataaacagtgtgatcccaaaccttcttcccctttggagtgagaacaatcaagcctcggaactccctgctgattgttttctcaggaagtagccaagtttccacctgttttaccaaaagtgagaagctatgcaagtctccctcaaagaagcccttctaaatgtcccaaccgcagtgttaggggaaagaggtcccaatccataccccaagagagggttcttggatcttgcg

SEQ ID NO: 102155 - DNA, 1033 bp, Homo sapiens
ataaagagcaaacagtacagctgatacggactctctctctctttttttttttttttaagaattttcataactttttagcctggccatttcctaacctgccaccgttggaagccatggatatggtggaggtcatttacatcaacagaaagaagaaagtgtgggattataattatgatgatgaaagtgatagcgatactgaggcagcgcccaggacaagtggcggtggctataccatgcatggactgactgtcaggcctctgggtcaggcctctgccacctctacagaatcccagttgatagacccggagtccgaggaggagcctgacctgcctgaggttgatgtggagctccccacgatgccaaaggacagccctcagcagttggaactcttgagtgggccctgtgagaggagaaagagtccactccaggacccttttcccgaagaggactacagctccacggaggggtctgggggcagaattaccttcaatgtggacttaaactctgtgtttttgagagttcttgatgacgaggacagtgacgacttagaagcccctctgatgctatcgtctcatctggaagagatggttgacccagaggatcctgataatgtgcaatcaaaccatttgctggccagcggggaagggacacagccaacctttcccagcccctcttcagagggcctgtggtccgaagatgctccatctgatcaaagtgacacttctgagtcagatgttgaccttggggatggttatataatgagatgactccaaaactattgaatgaacttggacagacaagcacctacagggttctttgtctctgcatcctaacttgctgccttatcgtctgcaagtgttctccaagggaaggaggaggaaactgtggtgttcctttcttccaggtgacatcacctatgcacattcccagtatggggaccatagtatcattcagtgcattgtttacatattcaaagtggtgcactttgaaggaagcacatgtgcacctttcctttacactaatgcacttagga

SEQ ID NO: 102156 - DNA, 1037 bp, Homo sapiens
cttagggcatcaacgttgtatatgtggtctgtcatctaccgaaatgtcattatgcagcacatgactttattgaaaatcattgtaatatctttattttggtaaatttttgtaaatcaatgtctcataaatcacatgcccctgttttcaaaaatacgtaatcaaggaagcaagctttcttggtcaagtatgctgaatactcaaccccttggagaggcacgtagtcattaagatgttcaagtctctgagaagttctgttttgaagacacgtatttctatgtttaacacagtttccactcccgcgccgcccccccctccaaattaagtaccagtcagcctcagggagactgaagccagaactctcctgattgacctatctttttgattgtgtagttataggatattccaagataaatgcatgaatactaccttgacggaatgtgatttctcaagtctttccaagtatggtgaccacaccttgagagtcagggctgaatttgcagatgagcattcagactgggtaaacatcaccttctgtcctgtggatgacagtaagccattttgttttccctttttttgtaatgtcatcatcttgccttgtttttttccacattggttggtccatcaacaagaattctttgagggcccacaaatggatggccttgcacaaggagcttaaggaatataataaagagagttgtatccctaaagaattcatgggagagacagaaaaagataggcatatcatcaatgcaacaattaaatataaatctaacaccttcagtgcctcaaggatgtgactatgttggggcccgtgctgttgaggagaagttctggaaggattcttgtggtgaattttctgggagaaagtcagtatggaattatgacttaaacaaagaaacataacgtgataggcaaaagaatgaaggcagatgtagagatggaaaatatgatgcggacagccggcttgcccagagcgaaggacagagggagggatagggctgatggcaggtgggttgggtcagactggttggtcagca

SEQ ID NO: 102157 - DNA, 1037 bp, Homo sapiens
ggcgtgaggcaccgcgctcagccattttttttgtatttttagtagagacggagtttctccatgtttgccaggctgttcgcaaactcctggccccaagtgatctgcccacctcagcctcccaaagtgctgggattagaggcatgagccaccatgcctggcctagatcctcttttaaggggttcatctgattaggtcaggcccacccagaatagtctctcatttgattcaactgatttgggaccttaattacatctgtgaaataccttctcttctgccacttaatgtaacctaattatgagaggagggcctccatcgtatttacaggtcctgcccatgctcaagaggaggggattatacaggatgtgtacaccagggggcaggaatcttgggggccatctcagaattttgccttctccagtggggaggatgtccttctagagtagcagaacatttggacaccaggtggcaatgggaagaaagctgaataagtagaatgggacaagattagggtcaacctcaggctgtcctgtaggcttttggggattttgtgttggggtgatagttaacctgagctctggatttgaggaaggtgcatgcggcgacatggtatgtgggagagtggactaaggagacactaaagagagataaggaaaccagtcaggaggctattagagttctgggcttgaactgagatgcttttagctgttggtttctgggcaagttacttaacctctttagtctcgtacttatacttgctcttataaccccgcagtgtgtctctattttagcacttaatcagtgtccattggtatgctggcgcatgtttagcagctggctttccagaaagaaaaagtcctattttgtagtgtttgctgatttttatgatataaatattcccaccatggccactttcaagccaccagcctgatgtccctgaatatggagttgggaacatatgcacagtagcacaccactatcatatagctacaatagataaagatagccccaagagcttagaaaataaaatgtagtaaaat

SEQ ID NO: 102158 - DNA, 1046 bp, Homo sapiens
ggtgtatctaaaacaaatttatatttctcacacatatactctgtaatcccagcactttgggaggccaaggtgggtggatcacttgaggccaggagttcaagaccagcctgaacaacatggtgaaaccccatctctaccaaaaagaaaaaaaaattaggcgtggtggcatctgcatctgtaatcccaactactcaggagggtgaggcaggagaatcgcttgaacccaggaggcagagattgcagtgagcccagattgcaccactgcactctagcctgggtgacagagcgagactgtctcacaaaaaaaacaaaacaaaacaaaacaaaacaaaaaatacataccaactacgtgggagaggccaatgttagactgaacataaaaaattgagaaagcacatattccctgatttcttgaggtgactaaattttatcagtgatttaattatattttctagagaaaaattatcgagaaaaaaactgatgttacagttcctaatttgaaaccactgactgtatattgtgtgaaagccagagcacacaccatggatgaaaagctgaataaaagcagtgtttttagtgacgctgtatgtgagaaaacaaaaccaggtcagaatcttttattgtcttttttaaaaatgtagctagacataataaaagtaattctatactgtacattgaaaattgtaaaacattttctctttactgcaaaaaatatatagaaagaatgttttcttcatgaactacatgaatcaaaagtagactttttagaaaatatttgtaacgcttaactctcaagtcggtgttgttggatgctttatatttcatccagtatccctataattaatttccttaatgtatttctctttaacatttaataaaactattttaaatttttagaatataatccttaacataattatcatgtagaaatcacttagttcaattgtgagttttttaatgtgggaattggtttagtctcattttctattttacagtttctagtgttgaccggtagaggcttagtcacagaatatctattaaatttt

SEQ ID NO: 102159 - DNA, 1017 bp, Homo sapiens
tagccaataatttctcaattgtgcttcttctggatatatatgtgttggatacaaacatttttattatttcaaaaaaaaaaagtcatgatcccagagtccgcccgctcctgtcctttcccgtgttcttccccgcctaccccgatggcacagtgtacctttcttaggtactcttcaaagactcaccacagaaggtactaagatatgagtgacctcactaatgatgcttttaaacattataaggcaattagtatgttcttaggcgactttttaatatgcatgccagaagataggttttctcagtaatggatgtaagaaactaaagctattacaactagaaaaggaatttttattattttaaataattgatttctactctttccctttttttaaattagtatttctctgaacagccattgaagaatcttctgctttcaacttctgaggaacaaatcgaaaaatgtttcataattgaaaatataagcacaattgctacagtagaagaaactaatcaaactgatgaagatcataaaaaatacagttcccaaactagccaagattcaggaaattattctaatgaagatgaaagcgaaagtaaaacaagtgaagaactacagcaggactttgtatgaccagaaatgaactgtgtcaagtataaggtttttcagcaggagttacactgggagcctgaggtcctcaccttcctctcagtaactacagagaggacgtttccctgtttagggaaagaaaaaacatcttcagatcataggtcctaaaaatacgggcaagctcttaactatttaaaaatgaaattacaggcccgggcacggtggctcacacctgtaatcccagcactttgggaggctgaggcaggcagatcatgaggtcaagagatcgagaccagcctggccaacgtggtgaaaccccatctctactaaaaatacaaaaattagccgggtgtggtggcgcgcgcctgttgtcttagctactcaggaggctgaggcaggagaatcgcttgaa

SEQ ID NO: 102160 - DNA, 1050 bp, Homo sapiens
ggctgtagtttgctatgattgtgcctgtcagtagctgctgcactccagtctgggcaatatagtgaggccccatttctttaaaaacaaacacaaaaaacctcttgaattcatgaaagaaaataaattaacagactgtttaaaagtcaagaatttattttgtatgtttttacgattttgcatttcagtgttggccataggaggcaaaggagcaagttactgcttcctcagcagttttgatgtagctagaaccagcaattactttgactaaaagaaaactttgtaagttcattgacttttatccagagtaagagcagtcctttgctttgggggaattaaattggcattttcttctttcagtttcattatagatgtcttacagttaatgaataatagcagtatgttgtaatatacaaaatgtatcattatgaatggcactgatactttattactgccgtttgcctatataaccgtctaatctgttttactttgtgtatgtagatactgatgtttatccgggactagctgtgttttttcaaaatgcacttatattttttaggtaagttgccttattttttaaccacgcctgtaacatttacagaaatgtcaacttaattaaggcagcatatatatggaacacatataaatcccatggattggttacaatgatagaacttcttttaaaaggtgagaattccactgttacataagagcagagaggccttttaactagaggtcttgctgtgtatcaagactttagctggatcctttatatattttaccctttgaattcacatttaggccaagtgctgtggctcatgcctgtaatcccagcactttgggaggctgaagtgggtggattgcttaagtctaggagtttaagaccagcctgggcaacatggcaaaaccctgtctctataaaaaaatataaaaattatctggttgtggtggtgtacagtgccagctactcaagaggctgaggtgggaggattgcttgagccgaggaggttgaggctgcagtgaggcaaggctgcaccactgtactccagcctg

SEQ ID NO: 102161 - DNA, 1357 bp, Homo sapiens
ctgtgccaagagaaagggaatttagaagcctcacatatcaccagtcttttccaagacatttattcagaaaatttgactgtcccctattcaaaatggcacatctctttttttaaaaagtgtgaggttgggcgcggtggctcatgcctgtaatcccaaatttgggaggccgaggtgggcggatcacctgatgtcaggagttccagacgagcctggccaacgtggtgaaaccccatctctactaaaaatacaaaaattagccaggtgtggtggtgggctcctgtaatcccagctactcaggaggctgaggcaggataattgcttgaacccgggaggtggaggttgcagtgaacccagatcgtggcactgcactcctagcctgggcgacagagtgagactccctctcaaaaaaaaaaaaagaagtagtagtatgagctcactgctgtttttctcccttctcaggatcgaacctgcaagcacttatagacagtactcgggaaccaaatagctctgcacaaattgatattgttatctccaacaaagccgcagtagctgggttagataaagcggaaagagctggtattcccactagagtaagttacttgggaaaatatctttgctgtgggccatatttaagctcgtaatctgccctcacaggaccctggtctatgggcacttgttcttgggacttcgccattttgggtgggtgctgggcttgccttcttcatcctgtccctttcttaataatctctctatcaggtatatctttacaaggaagtgaagtatggtctgtgtaaaggttgagtttttaattatttttggtaattcattgaaaagggttgtgcttatctttttctattacaggtaattaatcataaactgtataaaaatcgtgtagaatttgacagtgcaattgacctagtccttgaagagttctccatagacatagtctgtcttgcaggattcatgagaattctttctggcccctttgtccaaaagtggaatggtaagcaaaaattatttgacatcacattgggaaatcaattgaaaatggtctccagaacagataacttgccaaacaatcccagtagtgaacacccatcccagaaatccaactcctgtttgactgtgatattttattaatactttaacacaggtcacagtttaatttcctttgttttacactaaagaatgacccaatgatgatttattaacctgctctctatccatttactttggcttgctgtaattaatcactttttctaatgtagcttagttttgtttcacattactgcaaagataatatttcatcttttgaataaatattcagaagaccttcctttatttgtttggaagcaaa

SEQ ID NO: 102162 - DNA, 2267 bp, Homo sapiens
aaagttctcagaggccaatttatagttttaccctacataaaatagcagagcctgattataatttccacatctttgaatatgtgcatacttttgtactttgtgtgagaaggtaggaaaatcaaacaattcgtgtctatttttttcagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggtacttgctccttactcatttttagatatataattttagctgtataattttagctatacctcagccttgcctcacaagctttctgcccaccttttagtgcagccatcgctatggcaactatctttacacagatgtaacatgacagcacccaccccagcgataccacgtatctcttcatttctgcctcagaactaagcattcatgcatgcacagccacaccccacaggatcgcttcccaaagtaatctccctacacacaagacctcatggctctgctgtcactcagctcgattcaaggaatagcgagcaagcaccctgacaagtactgtatcagtcaggactctgcgagaagtgctagaacttggcagaggggcagaaaatccactcagattcactaacaaagacgtcacatgcttgctttggcaggacacatactaaaattggaacgatacagagaagattcacaaaaataaaaaatagaaaaaaaaaatgtcagaccttgttgactttacctgtatctgcctttctttcctctattgtgtaggattcattttcaagcgggttctccaaatgccggaaagataacatccttcagctcacattacaataagaaagagagacccagccgggcgtggtggctcacgcctgtaatcccagcactttgggaggccgaagcgggtggatcacgaggtcaggagatcaagaccatcctggctaactcagtgaaaccccgtctctactaataaatacaaaacattagccgggcgtggtggcgggcgcctgtagtcccagctactcgggaggctgaggcaggagaatggcgtgaacctaggaggcggaacttgcagtgagccgagatcgcgccactgcactccagcctgggcaacagagcgagactccatctcaaaaagaaaaaaaagagagaccctctttttcttaacatcgcatatcaagcctttaaatggctttgctaggtcacatgcttatccccgagaccaggagatcatggcactactgtgggtggtctcgctaggaagatttggggagtaggggcagaatactggcaggcagtcatatatatccaccgtgcacttcaagatagtgatgtgatctgcagcttttagttgaagtaattacatatgttcaccttttggaagtttttatgaaagagtagtgttaagtgatacaaatgtgttgttcattttagtccttgcattatcttattttcaggataaaacataccctaaagttttcataaaatatttttctttccattattcttgttaattcacaattgttctttacttatttatggatatgtttgaaatgaaggttccccacgtgtgaaagtcaagaatctgattgaaagcatgcaaataaatgggtcagtgttgaagaatggctccctgacaaatcatttctcttttgaaaaaaaaaaggccagagtggctgtcttaatatctggaacaggtgagatgtggcttccccttcactgtagagctgttgactgcccttcctttcctccccgcactcttgtgagattgtaaggttactctcggcagagtctagggactggggggaatcatgagggttgtctttgtcttttcagcattcttagtctttccacttttcttaggaatttgagacagctcccaaagaaaaaagtaaaggatgtcagaaagctggttaaagagaaaccagaaaagatagaagctacagctcattttgtatcatagctttgttgttgaaaagtctgaaaacagttgaggaatttttattgttatcttattaattagaagaagtttatgtttaacctttatggatagaggggtaaagtaataagagtattgtattctctcagatggatgtagcctgatttttttccctctattgtaagtaacactgctatgaacat

SEQ ID NO: 102163 - DNA, 1003 bp, Homo sapiens
tgggttcaagtgattctccgacctcagcctcctaagtagctgggaccacaggtaacacgccaccacacttagctattttttgtatttttagtagagacggggtttcaccacattgcccaggctgatcttaaactccttggctcagagcaatctgcccatctcagcctcccaaagcgctgggattactggcatgagctaccacacctggccaggacttttcaacattaaaattacaacttacattattcatgaagtacttgttcatttatagaagctagactcttagtctgccagtgttttttcctataaatattttgtaaaacttcactaaaacaagatcataatttggtaatctgctacttgccctgccattaaatatgtcatcactatctccttgtcttagtagcatcatttttgataacaagtattccattttacagatgtaccactatttagttttaagttgctatttacttttaactattgagagcatagtgaacaatgtagttactaaatctgaggtcaactattaagaatggacatttcccagctactataaatggaattgaatctaagagtcatagacatgtgattcatttttatttttatttatttttatttttttagacagagtctcaccctgtcgcccaggctggagtacagtagtgcgatctcagctcactgcaacctccacctcccgggttcaagtgattctcctgcctcagcctcccgagtagctgggattacagatgtgcgtctccacgcccagctaatttttgtattttcagtagagatggggtttcatcatgttggccaggctggtgtcgaactcctgacttcgtgatctgcgggcctcggcctcctaaagtgctgagattacaggcctgagccactgcacccgcctcatttttaaaattgtatcaacttcaggctgggcatggtggctcacccctgtaattccagcacttcgggaggctgaggtggatggatcccctgaggtcag

SEQ ID NO: 102164 - DNA, 1068 bp, Homo sapiens
gctttctgaaattgtttatggatctgataaaatttagatctctaatattttaagccccattcctgttggacactgcagctcttttcagtttttgcttatacacaatttcttcttttttttttttctttttgagatggagtcttgctctgtgacccaggctggagtgcagtggcacaatctcggctcgctgcaacccccacctcccaggttcaagcaattctcctgcctcatcctcccaagtagctgggattacaggcataagccaccacacctggttaatttttgtgtttttagtagagacagagtttcgccatgttggccgggatagtctcgaactcctgacctgatccacctgcctcggcctcccaaagtgctgggattacaggcgtgagccacgatgcccagcccacaatttattctttgtagctaattaagctaaagaagcctgggaataaagtttgaaacaaacaaaaattgcctttcaaccaccgtttagaacacagtttcttatttggagtctgcctataccttatatcttgacatgatataattgtaagtaaaatgctatactttttaagctagggtatttggaattgggcagtcccagttaagtcacttctttaaggctgtatcatcacctgaaaaatggactgattataaagatcaaatacatatgaaagcagttttgaaactaaacagctatagaaatgatgttatattcaactgagcattcattctgtgcaagcagtggtgtttggcggctgcatatatacttgtagaggtgctacctaatctcaccctttgtggaaacaagtgctatttctcctgaaatcatgcttggtggaaagttctgttagacagctggtagagtacattttcttaaatatttgcaggacatagccatgtgttagttgttcatgttaagagtagcctgtgccactgtttcctagacagatttataaatactctgatttctttgttcttgtcttatcccaccaggaggtgaaacagcagaaatgcctgacatgtatccccctggagagtatgacctagctgggtttgccgttg

SEQ ID NO: 102165 - DNA, 1021 bp, Homo sapiens
ctgtgttaaccaggatggtctcgatctcctgaccttgtgatccacccgcctcggcctcccaaagtgctgggattacaggggtgagccaccacgcccagccttaattactttcttaatcaattctttgagcacatggtgcaatctctcatactcaggaagggcatctcttgtttcagccattcttatgaacaagtggtatgtatatacatgtttaacctattaacatgttacatgttaatctattaaatgattacattctcccagttgatttgattatgtcatctctgagaacagctgttccaatcatctatttcttccagaagtacatctcacaggccgctaaatatactggtttttttaaactagtagacatttaaataattacatgtttaatctattaaaatgtagcaagtaattaatttcctctccaacaggctgtaaagttgatcttggaggttttgctggtctttttgatttaaaagcagctggtttcaaagatccccttctggcctctggaacagatggcgttggaactaaactaaaggtaatcagacacctttgtgaataaaggccttttaggaaagatgaggaaatttatatcaaatatgtatttttcttctcttgacatatatgagctaaaaaggaccatgccaaataaccatgtaaaatggctaaaatatctgcacatttctaataacaaattattatttagattatatttggatggaagggtactttagaggataaaaggggatgcttttagaccaagtagcttgtcagaatttcgtgttcttttgtttttaggtgttaagagcagctaatcaaatggataagatacaattttgaacttattccctaatgtggatgtttatattgttcttacatagattgcccagctatgcaataaacatgataccattggtcaagatttggtagcaatgtgtgttaatgatattctggcacaaggagcagagcccctcttcttccttgattacttttcctgtggaaaacttgacctcag

SEQ ID NO: 102166 - DNA, 1045 bp, Homo sapiens
ctcaagcagtccttgcctcagcctcccaaagtgctggaattataagcatgagccaccgcacctagccaagttaaaaaaaaaaaaaaagaaacttgtggaaatcgtaaatcacttcacggtgtgaaatactgttgctatttgaaatcatatgtcaaatatgctctcttctagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacgtcggctttcgtgccatagctttcctccagcagcccaggtaaaactctaagcaagttagctgtagtgccatttcagaaactggcctaaatggctatgtagaacatttcattaaccctataagtcattcagtattcttttctctctgtgggagtgatacagtcttggtttgtattttgtttgaatcaaaactggttatagcaatactcaaatggaaaaaacttcatgatagcgtaagtttggaaagtttagcaaaatcacagtggtactgatttttatttgttttctattttttttattttatatttttaatttttttaacagggtcttcctctctcgcccaagttctcatgcctcagcctcccaaatagctgggactacaggcacaggccaccacacctggctaatttttttgtattttttgtggagatggggtttcaccatgttgccaaggccagtctgaaatcctgggctcaagtgatcctcctgctttggcctcccaaaatgctgggattataggcatgagccgctgcacttggcctgatactgatttttattccttgcgttatcacatagtgttgtatttgaaacatagttcatggttttatcaaagaactgaagatgagaatactggtcatctaactttgtaatttgatttgattatactgtaaagtttgacagt

SEQ ID NO: 102167 - DNA, 1138 bp, Homo sapiens
cacctattcttttcattgaagatagtcataatgtttgtgctaatgtagtgcccctttacatatttttcttgcttaaaagattaaaaataggccaggcgcagtggctcatgcctgtaatcccagcactttgggaggccgaggcaggtggataacctgaggtcgggagtttgagaccagcctggccaacatggagaaaccccgtctctactgaaaatacaaaaattagctgggcgcgatggcacatgcctgtagtcccagtcccagctacttgggaagctaaggtaagagaatcacttgaacccgggaggcggaggttgtggtgagccaagattgcgccattgcactccagcctggacaacaaaagtgaaacttcacctcaaaaaaaaaaaaaaaaaaagattaaacataaacttcattttttttaaaagacttcataagtgtaggccaggcacagtggttcacacctgtaatccaaacacttgtattaaaactaccatttggtaatagtgtattctaagaactatatctgggtctaatttttacaattaaattcataaacccagaatcttacatatatagacttatgaaatatgcagcgtatactgggaagagtacaaagaagccttagggtaggagagaacttgtttcatttctattacgtttcgggaagttatttttggctagttcttttaagagtgtattttttgaaaatcataaagctaaaatacctacttgacagagtcattgtgaggattgagaaagtttaaatctttcaagttcaaagtgttcagcatgtttcaggtagtaaaaaaatgagttatcctcatcatccccttctgttgtcccatgtaatactacttagactttttaagttacctgttacatttaactgtttctgcacgttctccaggtttctaatgatctattactaaaaattaaagatactgttcttcagaggacagtggatggcatgcagcaagagggtactccatatacaggtaggcccacccacattactatggaagccacctatagagtaactttctacttttgataaaacttattttccattcccttttttttttttttttaccactttttaatggaccattttttaaatgtttatgatttttccaaa

SEQ ID NO: 102168 - DNA, 1916 bp, Homo sapiens
ccttgagcaagtaacagttttgttacttactttgggtaagtctccttccagacccccaggcccacttgataatttcatatgtgtactcccagaaatggtctgtgtatgcttactgttgttatacagccgcattttctacctgaatgagagtactatttgctactttgtatcttagagattatgccatatctactctatacatctacttattcttccaaagatattgcctatgtaatctcatgataaatgaaaaaagcaaaattgtaggtactgtatgattggaactacaaaggaatacgtaggggaaaaaatcctggtgggaagtacatcaaaatgtgttggaatgataattaatttttttctttctgcttttcagtcattgctatagcatatcgttacaaaatcccacagcattttaaaatcttgagttgtaatggtttattggatgttgacgattactctgtctttacagtgcagacttccctgctttggttgtgaaggccagtggtcttgcagctggaaaaggggtgattgttgcaaagagcaaagaagaggcctgcaaagctgtacaagagatcatgcaggtaggctgggtcttctgaaaaaatttacttttctattcatactgaataaataccgttttaagtttaaaaaatgttcctcacaataaggaaaatctattttgcaaacatatgggtaagttattttttataatcccatgtattataatccatctctataaaatagttatggatttacactgtaaattaaaccatgattgtattattttgaagtaaattgtaacatcctttgttgtctgccactgaaagaaaatcctcagactctagaacatataaataaattatcaagccatccatgaggacaaaagtatttgtcccacatgtcccgggtctaagagaagtaaattaatgaatgaatatgccttgtctttcgtgatcgatctttgttgttgtgggttttctgtccttgtagaagtctactttcacaagcatgctttagtatagttattacagccaaacatgtataattataatcggaagtaaggattaagtggcgataatgaaaacatctgtttttcccataccttatttgaaactggatcaccaaatcttcaggagaatattagaggtgtgtttattccgtctgtaccagtgttagctacactattgccacattaaaaataggaaacatttatatgttccctttgagtctttctgaaagggaaagaaaaattacagtactcactggttcataatacaaatgctggataatgctaaaagtcaactaagtatcaaaaacttaccaagcctctttttttaaaaaaaaaaaaaaaaaaaatcttacaatcaggagaaagcctttggggcagctggagaaacaattgtcattgaagaacttcttgacggagaagaggtgtcggtatgtatattcatctttttggcttttgtagtgtataagaagctgtcatctgacctgtgtaccccagaaaagacttgatatactctggttgcttcatctaaaaacataaacccagcagttacaaaggaatttgtatacttttattgttgggggtgcaaatgaaaaaataatcgatcctctgttagtcatccctagtgtgttagtgggggcacttggacttacacactattgaggttctggattaattcaagcattcatgctttttctttcatatacagtttattgcacaataaataaagtcaccttaaaccaagttttaatgcctggaagcttaaagtgggggaaaggttgaaatcttttactttgagagtagcttgattttttctgacttccctcaaaaattacaaatccttcagaagttgagtacattatgattcttgatgtatgtagcttaatgttattgacgtttcggttca

SEQ ID NO: 102169 - DNA, 1019 bp, Homo sapiens
acagttgtttagttttgatatttaaatacacaggtcagtggccaggcacagtagctcacctgtaatcccagcactttgggaggccaaggcaggtgaatcacttgagctcaggagttagagaccagcctgggtaccatggtaaaaccctgtctctacaaaaaatacagaaaaaaaaaagccgggcatgatggtgtgcacctgtagtcccagctcctctaaaggccaaggtgggaggatcacttgaacccaggaggcggaggctgcactgagccaagattgtgccactgcactgcagcctgggtgacagagtgagaccctgtctcaaaaaaattaaataaatatacaggtcacttctgtgttgaaaatgtaatgctaggtctttaggctgtctcaagatgtagtaagataattaaggaaaaaactttctcaataaatattatgtgggttgtcgttttccagaaccaaaataaaatgggatcctatgcatacagagtttatatgatcttgtggccttgcaggaagatgacatttttaataaaatctgagtagttcctcaggggaaaaatacacttggttctgcagttgtgcgctcttcacagccatgtttttggtttttggttccccgccccccaccaccaccccccaacctgagacggggcctctctctgtcacccaggctggagtgcagtggcgtgatcttggctcacagcagcctctgcttcctggactcaagtgatcctcccacctcagcctcccaagtagctgggacaataggcacacaccactactcccagctagtttttatattttttgtagagacggagttttaccatgtttcccaggccggtctcaaactcttaagctcaagagatccgcctctctctgcctcccaaagtgctgggattacaggcatgagccgtaacactaggcctcacggtcagattgacaaacgcagtggcatcttacaacataaagaacattgattttttttgtcataaataattaaccagagtgagtaa

SEQ ID NO: 102170 - DNA, 1380 bp, Homo sapiens
tgctgtttttttgtttgtatgtttattacccagcgttcctacagcgtattgtaaacatgttaagtatagggaccctgcttgtgttgataaatttttttttttttgagacagagtttcgttcttgttatctacccaggctggagtgcagtggtgcgatcttggctcactgcaacctccgcctccccagttcaagcgattctcctgtctcagcctcctgagtagttgggattacaggtgcatgcccccacacccagctactttttgtatttttagtagagacggggtttcatcatattgttcaggctggtctcgaactcctgaccttaggtgatccacccacctcggcctcccaaagtgctgggattacaggcgtgagccaccgcgccccgccgtgttgacatcttaataccagtgctgaggacagtacttagcacatagtggattttcagtacaattgattgattgacattaaaagaccaatttctgagtatatcttacgttttttgtttaatatacagtcaatattagtgacgtgaacaatatcatggaggtgatactttatggctctttgggaagtttattggtgttttcatctgtctacaatgataacggagaactgagctctgttggttagcctaatgcactctcctctgaatttcacatgttgaaactgtcatctctgccaatataagaaaaccaacagataacaagcatactaaagtatagaacttagtttttttagtgagacacttagtttacttaagtggaatgtttttgtaaatgcagtggtttttttttttttttttctgtttacagccatctcaatcagtgaccacactgcccttgctcaattctgcaaagagaagaaaattgaatttgtagttgttggaccagaagcacctctggctgctggtaaagtttgtttctgtttattgttacagtatattcagtgcaaacagaagcttagggatcatctaatccaattcattttacagatgagaatttgtaatattatcttggaaaaagagcttccactctcgaaatttatggagtctagattttttttcccaagcatcagttatatgatgagttagagatcaaatttgcagccatggaaaacattttatatgtctttattctgctgtattctggtgtgtgtttaataatccatatatgcaaatataacaacttttgatagatttgaataacatgttaatagcattttatctctatccagtagacaacatgaaaaagttagttatcctctgccaccagtcatctgccttgtctagatgtagatatagtctgatactaattcgtcttcaggctgaaaagcccctggggagaccttggttcacctaaggctactgttttcatcaa

SEQ ID NO: 102171 - DNA, 1122 bp, Homo sapiens
cagaaactcctcagtattctaataatactcagaataaaactcaaattccttaccatgcctttcaaagccctttgtgcagtctgtcttctgcctgctcttccagcctgatcttttatatccctttttctcttttcactataccctatccatgctgtcctaccaatttcccaagcagaagcttgctgctttggactttatatttgttcccaccccttactatgactgtctcctcattattcagagctccacttaaatgttagcctccttaattatatctctcctacagtttcttactaaaagcaagtgtccatccccatttcatttgtttatgatcatgaatgtctgtgtttatttttacttcactattgtctgtcttctatgttcttttcctccactagaatataatctctagtagaatgtaagctccatgagggcaaggaacttgtctgtcttgttttgcatggtgtgcacagtgcttagttccctatgtggcacataatatttatggaaagaagagcatggacccaacaagccacaaactgggagaagatagtggcatgtatataagaccaaaaggaataatacaaattagcaaatacctccttttctgggatcttaattctacgggtgagatatttgtttattagagaactaggacagtttatctgcgattgaggtcatacaggcaagcccatcaaaatctcttaagatcatcatgagactactacaagtagtcttgtaagactactaaagagacctcttcctcttgttgccctctgctatactgatatagttgacgctgctcagcctagttgtgttcagaaccactaacccacagtgcgtggtactccatcctaatcacattcaggcagttgctgcagattgaggaccctaccttttctggacttggaccctatacagtagtcaccagcctatccacaattttactttccacagtttcagttacccacagtcagctgtagtccaaaatattaaatggaaaatttcagaaataattcataaattttacattgcacaccagtctagcatagcatgatgaaattttgtgccgtccaacctgagacgtgaatctttttgtccagcatatccatgttgttactt

SEQ ID NO: 102172 - DNA, 1082 bp, Homo sapiens
gtaagtgcccaaagtaatacaggattattagggcaatgatgtattattgctagaattatcacttttgcagaatgtgttgttttttaagtggaaatagatccactcacattgctttttaaatttttgtgatattgctagtagtgttttggatgagaagagacccgagctaagagaatataattttcctgacaaatctctggctgcaataagtagttgtttgcttagtttaacgaggtgtgtttttgtagcttttaaaagctagtctttcctttagaaaatgagcgttttattataatttagaagacatgaaaaaggagaaaagaaaaaactcacgttattgatattctcatgtcatttcatttccccccccatgtattgtgtgatatgtgatcatcttgttttgtattgatcatttttccagctaatacgttgtgaacaggtttatccctctcagtctcagtcttttggacttcttcatggctgcatagaatcccattgtaggaatatactgttgcatatttaggtggtttgaaattttcattgcttttcagtaaatgcggttaacgattgctggctttaagatgaaatcattacttccttgtagattaacttttaaaaccataattacttttctgattttcaaatttgtcataattatgtataaatgcttaggaaaattgtaaaataaagtgctacagaaggaatatctaaaaataatattagacgaagcagtttattactagaggaatatgcagcttctcttcaacacataatgcgttatcagtctgcaaacaagtttttgattatttgccatttcagtgagctgttttttttctcatctgcttttatgtaaattagagtaatgaggctgacatttagatagttaaaacaagttatcgaacttctgttatagatggtgtgtaagaatatggcctctggtttgagtaccagcttcacctcttagtagctgtgtgaccttcagctaagtttcttcatttataaaagaataatagtggtgatctcagagttttgttaggattaaatgagttaatgtagaacagtatgacactagtagtcaataa

SEQ ID NO: 102173 - DNA, 1028 bp, Homo sapiens
ttgatttttcaaaattttgcaaattcacacaaaaatagtaaaaattactgggcgaatgatatgttcttacctatttaaaaatttctctggccctgtgaatggaacatgtgttaagccatctatgcttttactgttggtataaatgccacttgttttatgtgagttttataaaccagagttcttgataattgtgtaaaaattacataaattattttcctttttaagttcagtggcatttcagtagcaatgtaagcctggacagaggttacaggttaccctttttattcagtgtgcctgtggctaacttttgtgttccttgatactattgatggtgattgtgatttatgcacagctgtggctttaatgtagccatggtttctaccataatgttaggccacatgtttttcttttgatttgtgaccgggctcttattaatttttctcccctgaaagaaatatgtgggtatcccaaaagcctaaagttagatttctgaaattattttgtttaacaaagagtgtacttagaaacctgttttcttaattttcatagttctgaaaactttaattgtataaaaatgaaatgtccaaaatataagtagatcatggtaagaagcattattagtggtgaatatctaaaataggaaaaaggtaaaacatctgacagtcagtacaacatatgattattgtaattaattggatttttttattaatggtatgataaaatattaatgaatttcgataacttttcatgtcaagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccaggtaagttggagataattaactgtctcaaaaattttcttttaagatttttttgaaatttgaaggttaatgttagtttttgacttcagtatttaagatatttattaaa

SEQ ID NO: 102174 - DNA, 6335 bp, Homo sapiens
gaaacctcgacctactgggttcaagtgatccgcctcagcctcccaaatagctgggactacaggtgcgcgtcaccatgcctggctaatttttgtatttttagtagagatggggtttcaccatgctggccaggctggttttgaactcctgacctcatgatccacctgccttggcctctcagagtgctaagattacaggcgtgagccactgtacttggcctgtactaaggtgttttaacatggaatgtaaatatgggtttatatgatttaatctaactctactttggggaatgtctgacaaaattaatttctattacttttagacttgaaagagggctccagaaaaagtagatgcgtatctgtacaaacagatcctactgatgaaattcccactaaaaagtcaaagaagcataaaaagcacaaaaacaaaaagaagaaaaagaagaaagaaaaggaaaaaaaatataaaagacagccagaagaatctgagtcaaagacgaaatctcatgatgatgggaacatagatttagaatctgattcctttttaaagtttgattctgaaccttcagctgtggcgctggagcttcctacaagagcatttggcccatctgagaccaatgaatcccctgcagttgtgctagaacctcctgtagtatcaatggaggtatcagagccacacatcttagaaactctgaagccagctacaaaaactgcagaactgtcagttgtatctacatcagtaatctcagagcagtcagagcagtctgtggcagtaatgccagaaccatccatgacaaagattctggattcctttgcagcagcaccagtgcctactacaacactggtgttgaagtcatctgagccagttgtaacaatgtcagtggagtatcagatgaagtctgtgctgaaatctgtggagagcacatctccagagccatcaaagatcatgttggtagagcccccagtagcaaaagtgttagagccttcagaaacccttgtggtatcatcagagacacctactgaggtgtaccctgagccaagcacatcaacaacaatggattttccagagtcatctgcaattgaagcgctaagattgccagagcagcctgtagacgtaccatcggagattgcagattcatccatgacaagaccgcaggagttgccggagctgcctaagaccacagcgttggagctgcaggagtcgtcggtggcctcagcgatggagttgccggggccacctgcgacctccatgccggagttgcaggggccccctgtgactccagtgctggagttacctgggccctctgctaccccggtgccagagttgccagggcccctttctaccccagtgcctgagttgccagggccccctgcgacagcagtgcctgagttgccagggccctctgtgacaccagtgccacagttgtcgcaggaattgccagggcttccagcaccatccatggggttggagccaccacaggaggtaccagagccacctgtgatggcacaggagttgccagggctgcctttggtgacagcagcagtagagttgccagagcagcctgcggtaacagtagcaatggagttgaccgaacaacctgtgacgacgacagagttggagcagcctgtggggatgacaacggtggaacatcctgggcatcctgaggtgacaacggcaacagggttgctggggcagcctgaggcaacgatggtgctggagttgccaggacagccagtggcaacgacagcgctggagttgccggggcagccttcggtgactggggtgccagagttgccagggctgccttcggcaactagggcactggagttgtcggggcagcctgtggcaactggggcactagagttgcctgggccgctcatggcagctggggcactggagttctcggggcagtctggggcagctggagcactggagcttttggggcagcctctggcaacaggggtgctggagttgccagggcagcctggggcgccagagttgcctgggcagcctgtggcaactgtggcgctggagatctctgttcagtctgtggtgacaacatcggagctgtcaacgatgaccgtgtcgcagtccctggaggtgccctcgacgacagcgctggaatcctataatacggtagcacaggagctgcctactacattagtgggggagacttctgtaacagtaggagtggatcccttgatggccccagaatcccatatattagcttctaacaccatggagacccatatattagcatccaacaccatggactcccaaatgctagcgtccaacaccatggactcccagatgctagcatccaacaccatggactcccagatgttagcgtctagcaccatggactcccagatgttagcaactagctccatggactcccagatgttagcaactagctccatggactcccagatgttagcaactagcactatggactcccagatgttagcaaccagttccatggactcccagatgttagcaaccagctccatggactcccagatgttagcaaccagctccatggactcccagatgttagcaaccagctccatggactcccagatgttagcaaccagcaccatggattctcagatgttagcaaccagcaccatggactcccagatgttagcaactagctcaatggattcccagatgttagcatctggcactatggactctcaaatgttagcttctggcaccatggatgctcagatgttagcgtctggtaccatggatgcccagatgttagcgtctagtacccaagattctgctatgttgggttcaaaatctcctgatccctataggttagctcaggatccttacaggttagctcaggatccctataggttgggccatgacccctatagattaggtcatgatgcttacaggttaggacaagacccttatagattaggccatgatccctacagactaactcctgatccctataggatgtcacctagaccctacaggatagcacccaggtcctatagaatagcacccaggccatataggttagcacctagacccctgatgttagcatctagacgttctatgatgatgtcctatgctgcagaacgttccatgatgtcatcttacgaacgctctatgatgtcttatgagcggtctatgatgtcccctatggctgaacgctctatgatgtcagcctacgagcgctctatgatgtcagcctacgagcgctctatgatgtcccctatggctgagcgctctatgatgtcagcttatgaacgctccatgatgtcagcttatgaacgctccatgatgtccccaatggctgatcgatctatgatgtccatgggtgctgaccggtctatgatgtcgtcatactctgctgctgaccggtctatgatgtcatcgtactctgcagctgaccgatctatgatgtcatcttatactgctgatcgttcaatgatgtctatggctgctgattcttacaccgattcttacactgacacatatacagaggcatatatggtgccacctttgcctcctgaagagcccccaacaatgccaccgttgccacctgaggagccaccaatgacaccaccattgcctcctgaggaaccaccagagggtccagcattgcccactgagcagtcagcattaacagctgaaaatacttggcctacagaggtgccatcatcaccatctgaagagtctgtatcgcagcctgagcctcctgtgagtcaaagtgagatttcggagccttcagcagtgcctactgattattcagtgtcagcatcagatccctcagttttagtatcagaggctgctgtgactgttccagaaccaccaccagagccagaatcttcaattacgttaacacctgtagagtctgcagtagtagcagaagaacatgaagttgttccagagagaccagtgacttgtatggtatctgaaactcccgccatgtcagctgaaccaactgtgttagcatcagagcctcctgttatgtcagagacagcagaaacatttgattccatgagagcctcaggacatgttgcctcagaagtatctacatccttgttggttccagcagtaactactccagtgctggcagagagcattctggagccgccagccatggctgccccagagtcttcagctatggctgtcctggagtcttcggctgtgaccgtcctggagtcttcgactgtgactgtcctggagtcttcgactgtaactgtcctggagccttcggttgtgactgtcccggagcctcctgttgtggctgagccagactatgttaccattcctgtgccagttgtttctgcgctggagccttctgtgcctgttctggaaccagcggtgtcagtccttcaaccttctatgattgtttcagaaccatctgtttctgtccaggaatcgactgtgacagtttcagagcctgctgtcacagtctcagagcagactcaagtaataccaactgaggtggctatagagtccacaccaatgatactggaatctagtatcatgtcatcacatgttatgaaaggaattaatctatcctctggtgatcaaaatcttgctccagagattggcatgcaggagattgcattgcattcaggtgaagaaccacatgctgaggaacacctgaaaggtgacttttacgaaagtgaacatggtataaatatagaccttaatataaataatcatttaattgctaaagagatggaacataatacagtgtgtgctgctggtactagtcctgttggggaaattggtgaagagaaaattttgcccaccagtgagactaaacagcgcacagtattggatacctaccctggtgttagtgaagctgatgcaggagaaactctatcttctactggtccttttgctctggaacctgatgcaacaggaactagtaagggtattgaatttaccacagcatctactctcagtttagttaataaatatgatgttgatttatctttaactactcaagatactgaacatgacatggtaatttccaccagtcctagtggtggtagtgaagctgacattgaagggcctttgcctgctaaagatattcatcttgatttaccatctaataataaccttgttagtaaggatacagaagaaccattacctgtaaaagagagtgaccagacattagcagctctgctcagccctaaagaaagtagtggaggagaaaaagaagtacctccccctcctaaagagacactgcctgattcaggattttctgccaatattgaggatattaatgaagcagatttagtgagaccgttacttcctaaggacatggaacgtcttacaagccttagagctggcattgaaggacctttacttgcaagtgatgttggacgtgacagatctgctgccagcccggttgtaagtagtatgccagaaagagcttcagagtcttcttcagaggaaaaagatgattatgaaatttttgtaaaagttaaggacactcacgaaaaaagcaagaaaaataagaaccgtgataagggggagaaagagaagaaaagagactcttcattaagatctcgaagtaagcgttccaaatcttctgaacacaaatcacgcaagcgtaccagtgaatctcgttctagggcaagaaagagatcatctaagtccaagtctcatcgctctcagacacgttcacggtcacgttcaagacgcaggaggagaagcagcagatcaagatcaaagtctagaggaagaagatctgtatcaaaagagaagcgcaaaagatctccaaagcacagatccaagtctagggaaagaaaaagaaaaagatcaagctccagggataaccgaaagacagttagagctcgaagtcgaaccccaagtcgtcggagtcggagtcatactccaagtcgtcgacgaaggtctagatctgtgggtagaagaaggagctttagcatttccccaagccgccgcagccgcacccccagccgccgcagccgcacccccagccgccgcagccgcacccccagccgccgcagccgcacccccagccgccggagccgcacccctagccgtcggagccgcaccccaagccgccggagaagatcaaggtctgtggtaagaagacgaagcttcagtatctcaccagtcagattaaggcgatcaagaacacccttaagaagaaggtttagcagatctcccatccgtcgtaaaagatccaggtcttctgaacgaggcagatcacccaaacgtctgacagatttgggtgagtcattttaaagtttaatgggatggtagtagaaaatgttttaaaccttaatttttttctgaccttgagtcaagtgaaatacttagttactggttt

SEQ ID NO: 102175 - DNA, 5382 bp, Homo sapiens
gatttaaggtgtcagaaggagagtaaggtcatgataattttgtgaaatgaaataggctttggcaggtttatatcttagagtgtgtgtagtagggtgatcattatagttgtgtagtaacctattgtaatattctaatgggaagctcaatatgtggacttaattccctgaatgaggccactgctgaaaaactttgagccagtggtttgatcatagctgtaacttagagcagaatattgatgcctatagttttttcctttttttttttcttttttgttagatacccaagttcttcgatggatctaggatgcctttagttttgttagtatgttagacttttggtaatacaaaatgtacagtcttttaggaaaactgcagcttgtatttttcttcttacagataaggctcaattacttgaaatagccaaagctaatgcagctgccatgtgtgctaaggctggtgtccctttaccaccaaacctaaagcctgcacctccacctactatagaagagaaagttgctaaaaagtcaggaggagctactatagaagaactaactgaggtaagctagacagaatttgttttcattcttaaatggattattccagtgatgttgactctggagcgtgccaaaacccgaattgtgggcagaactgataatggctggcaccgagtggccaaaacccgaaatacagatgtggcagcggcagaagctctgtttagcaggccattatccgggatggctaagctccgctagctaaaagttacttcccattacttttgctttccagttttagaagccaaactgactgaggagtgggacggttcgtttgaatggaggaggtgttgagtgagcaacacgcagaagctcgcctacagtttcgtttccattcacgacgcgttcactgatcgccacgagtatactgcatatacgcaaagacacagacaatcttcagaaatgatcttttgccaccggagcttggaaattaataagaatagctggccattgcctgaaaggaacttctttcgcatcaacatttcgggttttggctgtttggtaccagccattggcgataatggccggccattatcagttcttcctgcggttcgggttttggcagtaacatatatattttaaacacacttatttttgtttttaaaagtttgatcttttcaattgaggcttttttggggctttgttttattactatttttttggtgtgggtggatggggggagatgctaaaatattgctgctaggatccagaaataccacactgtttcatatattggaacttgttattggctagccttatgccagcctgccactgtcaatatattctgttccccttggttacaagcttaatatactcttgtgtttttggcgaaatgagctttttatcctattgtaatattttcaattgataatagatgtcattaaatctactgcttgtatagagacaggtgtacccaaatttactcttgacctttttataaagccaggtaatggagtctgttcctttgcatctcaggaaggaattgactttgctttatgtatcagacctcatcaattgcaccctctccatcatgccttattttcctaagttctccttaaagaaactcaacccacaaaacatttatggagagacatgttgctatctaatcctgttgcaaatatttcagatcttttgttttgccatacatctgggaaaatgtaaagcttctgaatctgtttcctcacttagatttattacaatatgaattacaactttttttaaaaaattaaggaccttgtaaacgcttctattgcttatttacctaatccaagctccttatccaaaatgctaaggacagttagtattttgctgttttcggccccatcttcagccttcttgtcccaagtttcttctcacctttttaccaccacctgactaggatgacttctcctttccctaccagtctttgttctttactatgaaaatctggcttagaactcttcaaggaatattccttgattctctaactctgcctgactattctctcttaagcctttgttcttttagcacttatgtactcagtttgtattatatcagtttgcacttgttattgtgttgctctgtaaaagtgttcaattatttcatgtatatgtattccttctcttgtactagattgtaagctccttgagagcagggaccatgtcttctactttttttttttttttttttttttgtattccccagacagtgcccagtacagtgctctctctgcacatagtaggtgctcaataaatgttgttgactgactgaccagccagagtgtgtttaaatagtagttaatatgccaagttacgtatctataacctatcatgaatcttgtttaactttggaaagttgctattatgtggttttgattctaagaaattacatgttctacataaagcgtaagatttatcttttgtttgtttttacttttaaagaaatgtaaacagatcgcacagagtaaagaagatgatgatgtaatagtgaataaacctcatgtttcggatgaagaggaagaagaacctcctttttatcatcatccctttaaactcagtgaacccaaacctatttttttcaatctgaatgtgagtattagtgcttatggattggtaaaacagtgtaacttgtggaactatttaaataaaacccaaatcgaatttagtttattaatttttgttttaaatactgtgagaaataatggataatatcatttccttcagattatgtagaaaatctcaaaccatttaatgtagatatcatattgagctttaattaagaaacactttattttttagattgctgcagcaaaaccaactccaccaaaaagccaggtaacattaacaaaagaattccctgtatcatctggatctcaacatcggaaaaaagaagcggatagtgtttatggagaatgggttcctgtggagaaaaatggtgaagaaaacaaagatgatgataatgttttcagcagcaatttgccctcagaggtaagtaggaggaatattatgtatttttccttttttatacctgaatctgccatttcattgttatgttatgtctgatttggattctgtttcactcttcttagggccgggttaaacggcagggccgggttagacgacagatgaaacaacccgcagcttctcatttgacagtaactcgatgcaattcactttgtggaaccaagccacaaagtgaaaagcatcgaattgcagagaacagtgttatcacatccctacccaacattgggccctccctgcacttgtgggaaggtagtccaaggtacaactatttagcttcccgatttgcttcaaggctctatagctctagattttggtggtagcaaatttatcgggtggagggattgatcggagagggcagatcctcaggttcaacacaagaactggattggaaaaggtcattgtaggttgatgtgagcatcttgggtacatagcccattgcccttaatgatggtttcttactgtttctctgggttgtttgtcagatagcctttaattttaattatttttccttccctttgctaccttggcccttttaaattcttgtgtttaacctaatgctcagccttggtactccattcccttctccttcccctctttgctactattaaaagtcggagaagtggaattcaaacgttgaaatttccacggggctatagttgtatcttaataatgccaagtgtcaaaacaaccccattaaaatgccgcctgattaaataatgtgctgctaaatatagtgcacatgaaaacagcaagactgtatatatatgtaaatatatatatatatctgtatctttgtatgtatctctgtatctgtacctttgctgtatcttttaataaacagtttacttttatttaacttgttgtgcaaaatcacgcttgggggatgtgggagggtggagtcttaataggggggtgggagttttaattactatagattagttgtcatcgcctcttgcccttggtttccaaagcccagacttttgccaaggactggactaggtatctgatgcccatctggacatttttcttgcagttcttggatatgtagatcagagacacctgtactcttcactgtaggttcccttccttggcttggccatatcatcatcttccagtaaacacctccaattctacaaataaatcctgtttataaaatcagaaagtgaacagaacccaaatcagaaactttttgatagcagtacttttctccccaagctattcacagctgacattttcactttttttttgtttgtttgacctgcagcattttgagagaacaagttctgtacaatgaagctggacatgataactagccagtgcaacttacagttactggtgataatctgtattcccatgggattcaacaagtgaagcaagttatgccatcaccagttaagagggagatagttggtttggataatattttagtgagaccatttgagttgttaatcccccaatcaggctacctgcatatctcaagagagaaaggttaactgacatgtgcagctgacttaatcttcttgtagtagctgaatagaaaccatgataagagggttgaacaggcttacttagaaatcctaatatgtatgcttttagtaatttcctgcagtttaagcatttaaaaaagagttggaaaaaaaaataggtagggagagagtctgtatgacaaatattttccactgaagacttaacaaatattgcagaattccaagggatcttcctgagaagataagtgagcataactgttttgaatttcttcggttcaatcatggggaaagtgcttagtaactcctgatgcttacacttttttgagagagagagagtgtgtgtgtgcgtctatttatttgaaatttagtactcagccattttcaatcttaacactgagtgtggtgccttagccttgtttgtcatcaaaagttgtcagattttaattaaaggttgaggagaattattcttaaatctggtgggaaaagttgatagagaaaggtactcaaataatggtgacattattttttgttaaaaaaattttttttcttaccaaagaagaatcctagaaggtaaaattattttacaattcttttcaaagggctaaatgaataaagcagatgatgtctcttgtgggacgatatatgtaactatttgatataaaacctctttaagctgcttagaagattagactcaaaagaacatacagattaattctaaagaagagaatcccaaaatacaagggcaaagaggcaggattgccttttgctttcatatctgcacttttacctggcaataatgttaaaatgtgtagaggaaatagtcacaatttaaaatgtttagtt

SEQ ID NO: 102176 - DNA, 1252 bp, Homo sapiens
ctgacaaattaagaattggctccaaagattactttgaaaaaaaaagtttcttccacttgccgtaaggttttaaaaggtagaatatgagctttgaaaagaaacaaaagtgtttcagttgatgttatggacttccacagaaatattgtaattataaatagtgtaatatacttaatataagtaataagtgtgtataaactgaaaacatggttcatttatttatatcctgaatatattgtttaaagaaattgggttcttaagaccaaagtgtccacaactggaagatgttaaagatacgctgatgagtaaaggagtgatcatagtggttttctgcttgcttgttcagtaattttgcttactgctcttgaaggttatgctaatgagtaaaatgaaaactgctaaggaatgtaataaccttaccacagttcaaaaaatttgcagtttactataaatggctttcaatcatgaagagtagcgagttttaagttcttaatggaactttctatgattatagtttgatatatatatataatagaaaattgactaaattcagtcagattttgggttcagttctgcgacctgtgtgatactttgtaatttatcttaatcctcttctgttttccaagattactttctctttctgagtcttctccctgttttccaagattattagtattataagactattattttgtttttgatatgtagcaactaaagatatgagtacttttcagaatttaggggactatggtaatttgagataattatctctgttttctttcttagcctgtggacatctctacagcaatgagtgaacgggcacttgctcagaaaagactcagtgagaatgcatttgatcttgaagccatgagcatgttaaatagagctcaggaaagggtatgtagcagttttttaaaaaaaattattatttaccatcagccaactcacaccaatgtaccagttttaatgtctaaataagaattttgctaactagatggttgagttgtaacatcctttaccttattttcaatgtcttattttaaatgaaagtgattcgaggcctgatcatttattcaataaatgtttattgtttactatgtggcaggaactgtttcttgagagaacaaaatagaaaaatttccctgtcctcacagagtttacaatctggtgtataaaaacaactaagtgcctacaaccctatgaaatgtgtaggtattaatagttgccatatttcagccgagaaaactgaagtaaa

SEQ ID NO: 102177 - DNA, 3057 bp, Homo sapiens
aatatgttttaaaagttaaatatttaagtctgcttttcagccatttttagtgaattattaccagtgatgttttaatcaggtaattttacttagttaactgagactacttcttttcttcagattgatgcctgggctcagctgaactctattcctggccagttcacaggaagtacaggagtacaggttttgacacaagaacagttggccaatactggtgcccaagcctggattaaaaaggtacacagtatatgcacatatgaaagtgtcgaacaaaaagtttaaattttttggaaactgtttattaaaactgcatgaaaagaccagtgactctaaccaaagttccaagtaaatttgctatgtgtatatgctccagggcggacactgaagacggactggattcatgagaaaatggcaaatgtataaatgtggctcaagagccactaacttataaggttattttaaaaattgttactgctgcttttgaaggggtgatttaactttattttgaacgctaatagtgtatcaggtgctgttcagaatattccacagttcctgctggactactaacctaatcatttcaaagcagtggttctcaaatttttcttcatcatgggatactttattacaggtttatttttagtggatcactgcccccaagagccctctaccaccttaattttccattcctctattcctttgccctcgcaccccacccgcttcattagtgcctgtgccttcttgtaagatctcttggcccccgttcctcactcctcttgtgacctgtagccccaggaccttttggttgtcagctgctggttacagcaagtggttgggaggccctagtattagctctgcatgtggtgatcttgccatgggactggaagcctgagggaggatggctggagtggggtgggctgtggtgaaggggatgggatggagattaatctgtggaccaccatttaggccctagtggcctctggtgatccacaggctcaatttgagaaccactaatttcatgacaaaacagatatgtaagacctaaaatcaagggagagaatggacgcctcgtgctacgaagatgtaggtgcatctggtttcagattctgcagtgagacctgtgaactccacctacggctgcctcatcattgggggagtcttaggtggctaagaagggcattctgaagaaacgcgttgtggtgaagggacaaagcttggttggatgggtgatgggaaatttgttacaggagtactggcagcatagcagtgctgaaactgggaggccgcgtggtctaatggattgggaaggtttctttatcctgttgtactcctgactccttgtgtaatcatgggcaagtaactctttggaatttcaaagtctctgaggtgtctagtggtaatcagtaacgtgatggttacctatagagagttgctatgagtgccagtgaatgagctgaatttctgaaaaatgagacattggttgctttgtgtattttaatcttgtaacatttatttcaattttgatagctttatctttgttgatcttactaacaaattaatatgaaacatcatgtatactcattatgcctgcctttttttgggaagtagttgcactgatgtgtatagtgagtacacagttagattcattaagaaattacaatttctgcagtttgctgagggttggtgttagaataaagggtgaaaatgtatatagcaaaatattttaaagattggattaatcttggacttctatattatagttactatgaaagtgatttatataatatttgaaaaaatgtctttcatctttggaagaactataaatgtacatctatttctttagttttaattctttaatactatttagtcttgaagctaagtactcagccagtatttcaggaagttagaaataaagcttatgggtgttaaaataggcacataatacagagtcatgtacactgctaggtagaaacttctgaatgtgcttccattacaaaattttggtctttatctaatgatgtgctgatccataatgtttgtatacttataaatgtgttaataacttaaataacttttaaaaagtgaatcttttactgactcaattggttttcccctaaaataatttcttctggtatttgcagtcttgtaggcagttaacagactttaataactttaaaatgtttagtagcaccttgaaaaaaggcttcaactttatattttatgtaagatatactttgggaagcaaattattttgataaattatgagataaagatatgttcagaccaaattttaaattatagataaaagtagcacttaaaggaaaagattcatttgtatagaattactgaagaatatttgatgctagtatcaactaaaaaagaaacttttgaaaattaaaaatgggccacaacatgtagaagtcattaggcagctgaaaatttaggatgtatgatccatgttaaatatcacaaatattgtctactcattaaatgtttagttgtgtttagaaaacctgtcaaacgatcattttggctcttctttagtatagtccagcatctgccttatgtgttaaaaaacacatggaataccaacatcctccgtgttctttttagtttgttgcagtgtatttttagattacaaaaaaagcaaagttttatcagtagtctcattaatcagtaaaacatttaaagtagttcgtttaaaagaaattttatttctagaatggaatgatttggatgtgacctgataaatacagtttgttattgtggtctcattaaattaatcagctttttcacactggggtaaagaaacagatgatgatactagggaatggaaacaaaattggaaacctgggttatttggggatttatattgtactctgcacagttgcccttttttttaggcgtgttccctggaaaagagggacggatgaacctggaagtaagtaaaagacattctaggtgtgtagcatcaaggcagttaatatccaagcatcagctttctctttatacatctacactgcatggcctgcaccaaataaggaactgaaccaggggtat

SEQ ID NO: 102178 - DNA, 1398 bp, Homo sapiens
ttctaagtaaaatatttatacttgctttatagtagaatggggaagaaaactttggatgacaacagtatgcttcttcagtgtctaaactatttctaagtgatttctgggctttattcataaactaggtacacctgggacaattaatatcattgattgttttaacattgccttctttttattttgcaagctaagaagagataccagtgaacctaaatagtggacgaaaacaggagtgttctaattttttttttttgaggggggcacgagggctactgtttcaaaactgccatttacttgtcttatttgacttccaaaatactattacgttaatgtgcaaataatcagaacatacacactacagtatgtataaagtatagaggaatttacatttaattgctataacagatctagaagtaaagtaagattcctctttttagaaagtaaacaatgaatctgtcaccaagttctaactgtaaaatggggacattttacctttctttctttggataggatcagttcttaagagcagccccggtaactggaggaatgggagccgttttgatgagaaaaatgggctggagagaaggagaaggattaggaaaaaacaaagaaggcaataaggaacccatcctagttgattttaagacagaccgaaaaggtaacaagttcttttttggaatgtttattaacgtctcctttaacattacctttaatatatccttttgaacccagtgatactgaactgaaggcacttcttgtatatatacaggtatttgtcagaaaaaacattaaccccttttggggttcacagagcagcttatttttatataactatggatagagacaccagtttgaacttttaaaaggcaccttttgttatgctagttgctaaatatggaaatgtgtatatatctaattttattattacacctccaaattcaactggatttcatgtttagaaaacaggatttccattttattttctcttgacaaggaaccatccttttttctagagtttagtttattttttgttagatattttagcacatcttcattatttcctattacaatactggtttagtctagatttcataaaccctgtttgcttttttcttccaagctcagtagttaagttgggttagagtatagtagaccagctgctgacaataatgttacttcttcctgttgccttgtgttaaggcatcttggaactgttagcattgactgtattttccttttaccttcagatacctgggcagggcagcactgtgtcttctatgtagcttgtatgtagttgctaagtatttaatcattcccacagatgatagctaattggcgtcttttaaataacttcttcccttggaataatgtaagtggaatcatgagaggcttgccagc

SEQ ID NO: 102179 - DNA, 1019 bp, Homo sapiens
tggttacagcattttaattatcattttacgtctatctaggtgtagctgaaattcaaaatgcacatcaaagtaaaactatatcacaactcaatgccatactaaatgtactggcctctgcaatagaattctagtcagacttcattttttactcccttcttatgacccaagtggctttaacaggaatgcaggacttagtgctgatcatcacacaacataccactttctttttagaacctctacaaaattttgaggggagatggtggcattagccctgtggaacagatcttgatcacctcaataacactggcccattatctgtccagcagaacccattgtgaaatagtacaaggtgcacagcccttcactgattacaggcaagtgttacagtagcctagccataaggaaggggagttacatcatagtacaaaatacagtataaaagcgttatttaacattccacactgaagattactctgatgccttcaaacagtcgtttggatgttagccacttaaacaaatacatcactaaggtaaacaatataaacataccaaaaccctgtatggttaaatacaatttccatggtacaaaaatcaaagcctggagatgtttttacagattgctttttacacaatgtcttaaattgccaaatatttacaacattaaagaggaaatacattgtgatgcagagtaaaattctgaaatgattattataaaacctcaatctatctacgtgaggcactcctgaagcaagtggcattagccatgaggtcctttggtacaaggcccattgcttgaagaaccacagtagctgctgtggctttagcatgcttcttattagggctggcaaagctgggctggtaagcgcttccatttatcaatacctattcaagaaaaacatacaattgggtctggtaagggctccatttctcaatacctattcaagaaaaacatacaataagaacagcatcaaactttaatatctattagctttgtattttttcactaaatgctagaaaaa

SEQ ID NO: 102180 - DNA, 1144 bp, Homo sapiens
ttttatactgtattttgtactatgatgtaactccccttccttatggctaggctactgtaacacttgcctgtaatcagtgaagggctgtgcaccttgtactatttcacaatgggttctgctggacagataatgggccagtgttattgaggtgatcaagatctgttccacagggctaatgccaccatctcccctcaaaattttgtagaggttctaaaaagaaagtggtatgttgtgtgatgatcagcactaagtcctgcattcctgttaaagccacttgggtcataagaagggagtaaaaaatgaagtctgactagaattctattgcagaggccagtacatttagtatggcattgagttgtgatatagttttactttgatgtgcattttgaatttcagctacacctagatagacgtaaaatgataattaaaatgctgtaaccaacttatctaataaaattggcaaccagccactattttgttgactatgagaaagttaaaagtttatgttaatttttagggtctgatagaatatttcatgtgtattacagtggtattcatatgctatgtctctaaactttattttcaaaagcttaaggcccaaatacaaacttctctggaataaacgtggtgttttattttctgggttataaagtgaacaaatacttagatactattatttctttacccaatgcttttgatttttaagcacttttattttaaaaatgtgaattatacagtccccccctacacacacacacacacacacacacacacacacacacacacacacacacacacacacacacacacacacacacacacacacacacacacacacacacacccctataagcacattaaatactactttgccgtgacagctcagtgtacttcacaattcttaacactattctatgtggaatacaaaatgcctttttatctgaattaacatgcatttaaaaagttttagtatatgtgaaaataaaggaattataaatcagtaggaaagatattaaggtagaagcatcaccaatcaactagctcagtagatgttgtctgtatttattttctacctttatgaaacaagaacctgctaacaggtaaatcgtaaagtaacatatttttgccctgatgccattagtca

SEQ ID NO: 102181 - DNA, 1249 bp, Homo sapiens
tcttgcatccaaaactcaatagtacctgattcctttatagtttaaggaaacaattcactgtgggtatttaaccatatttgcctttaattttgaacatacttaaggtttttagagttagaattaagacctttaaaattgtctcatgcatctcagttggctagacttataaccattaatattttgggattttgtcactacaaaaattcttagcatcaacttctattaataggatgaatcacattaatcagccatttatttgtcagtctccatagtaattatttaactcttctgtgtttaaagactaatgtgctttttactgacttgtacacacatttccacaggaggttgttcataaggagcttactaactgtggtttgcaccctaacactctggagcaacttagtcaaataccgttacttgggaaatcatctttacggaatgtggtgctgagagactacatttataattggagatcctgaacaccaaagtaagcctaaaaggaatctttgaggaaaaaagccttctagcaaggaaattcaagattcttgaagttgaaggaatatactgaaatgtttataaacataacttttactacagtagcatctaaggttttaaatgtgttttactattttcagattagatttttagatataaagatgaaaaactcagataactcaaatgagatatctatatccctacaacctaattgtatattgagcagaaactgaattaatatgcttccttgcaaatgggaaatcacatagcagttaccccatggcattgtgactaatggcatcagggcaaaaatatgttactttacgatttacctgttagcaggttcttgtttcataaaggtagaaaataaatacagacaacatctactgagctagttgattggtgatgcttctaccttaatatctttcctactgatttataattcctttattttcacatatactaaaactttttaaatgcatgttaattcagataaaaaggcattttgtattccacatagaatagtgttaagaattgtgaagtacactgagctgtcacggcaaagtagtatttaatgtgcttataggggtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtagggggggactgtataattcacatttttaaaataaaagtgcttaaaaatcaaaagcattgggtaaaga

SEQ ID NO: 102182 - DNA, 1075 bp, Homo sapiens
tattttttgtagagacgggttttcaccatgttggtcagggtggtctcgaactcctgacctcatgatctgccctcggcctcccaaagtgctgggattacaggcatgagccactgcacctggccgccctgcattcattcattcattcattcattcattcatctatctatttagagacggagtcttgctctgtcacccaggctggagagcagtggctcaattttggctcactgcaaactctgcctaacgggctcaagcgattcttcaacctctgcctctggggctcaggtgattcttctgccttagcttcccaagtagctgggactataggctcacaccaccatgcctggctaatttttttgtatttttaatagagacgaggtttcaccatgttggccaggctggtcttgaactcctgacctcaagtgatctgcccaccttggcctcccaaagtgctgggattataatcataataaattatatatgtaaatacaaaatacatgctaaatcttagcaataaaattgaatggattttaaatttttgtttttccaatagtctgcattgacagtgtattactaaatcagataaaatactatatgaaaaaatggtattctctggaatatacttcacctgaaaatctcttaatatggaaaggttgctgaaaatttactaagtatttgtactcacataacattgtttagatgtcttgggaaatagttttattccataattgttaaaagagaggaaaccccaaatggaaatatattgaacatatttttggctaggcaaaaggttgagagatgatcttaattttccttttctttacattttcatgaaggcacggagtgtgaatgtgaagacacaagctctttctggatacagagaccaatttagtttggagattacaggtcctatcatgcctcattctctgcattcactgaccatgctgctcaaatcttcacagagtggatctttctctgcagtactgtatccacacgagccaactgctgtatttaacatctgcctgcaaatggacaaagtacttgatatggtaagtagacacctatgagcagactg

SEQ ID NO: 102183 - DNA, 1083 bp, Homo sapiens
tgggtgtgcaagataaaattaaaaagccagacatactttctatcaagctgtatcctttcagttgttgttaactagaattaattttcattgaatgacgttagtgagaagtttaacattggcagttttatatgattataatcttaaattatcttcaggtcatattaaaactaattctccattgtaatactaaataagcccctaagtatcaacaaatggtgaactattaaaccttttttaatcaaaacgttcaattatgattgtgggagaataggtgtgttttgactagagaagaaattaggtttaggtgtcagtttgtagcaaattcagattgttaacattttgattgaaacatatgccttatgattcggtaaagagaggtagcaagaggatttccatttcattatggagaaaaggagtctcaggtgattcagaatcaagataactgctttccacattaggtgagatttgcttttgcaatttccttgattgtcatcttcaggcgtaaagagaaacatgaagtacaaatggatcacagacctgaatctgttgtgttggtaaaaggaatcaacacctttacattgctcaattttttgattaactctaagagtttagttgctacctcaggtccacaggcaggacttcctccaaccctcttgtcccctgttgctttccgaggtgccacaatgcaaatgcttaaggtaataaaagtctgcataacctagcttttaagaagtactttactttgataggataaattcttgatttaaaaaaaaacctcctagcatttttacttggtacatattttcattttgctttcctcccattaaaaaaagaaacaaaaattatataagacagttatatcaaagaaattatgtggaaatatataaattatatgaaatcctttttattttcttttcgagatggagtcttgcgctgctatccaggctgaatggagtgcagtggcgtgatctcaactcactgcaacccctgcctcccgggttcaagtgattctcgcgccatgcctcagcctcttgagtagctgggattacaagcacacaccaccaagcctagctattttttttg

SEQ ID NO: 102184 - DNA, 1036 bp, Homo sapiens
acagctactcgggaggctgaggcaggagaatggcatgaacctgggaggcagagcttgcagtgagccgagatcgcgccactgcactccagcctgggcgacagagcgaaactccgtctcaaaaaaaaaaaaaaagtatatatatatatatatatatatatatatataaacacgcagccctaattctttaatgctacttcttgtcagtctctgcttccttttttagcagcagctcagagaaagtcagcaggcaattctcaattaagttttgtttaaagaaaaaataagtgtttaagtggtatacactatttgttaaagtattgagaagtcatcagcgagtcctcataaccaatttcagtcctttaaagctaagtcatacgtaaccacaaaaattaaaaccattatctaaaatatttgtgttgtgttttaaaccaggtatcaaactgaattattcagaattataaacattgcattaaatgtttaataataccttaagaaaatttttttacttcataggtctgtgagctttacttctctatataatttgctgaagacaaaactttgcccctatttctacgtttgtacctatcagtttactgtcctgttccgagcagcaggattagctggaagtgacttaatcacagctctcatatctccaacaactcgaggtttaagagaagctatgagaaatgaaggtaaaagtttaggtttaaagtgagaatactatactatatagtaaacctattttggcctaaaagctatttaaatttaaaatgccttttaccagttgattagcaacattaagaaatatattatttctttatttctggctttttttccctcccccacaattatttaatccagcagtccgcaaactttttggcactagggatcagtttcatgggcagtgaggaggatggtttcgggatgaaactgttacacatcagatgatcattctttttttttttttttttttttttttgagatggagactcgctctgtcacccaggctagaatgcagtggtgcaatctcggctca

SEQ ID NO: 102185 - DNA, 1033 bp, Homo sapiens
acgaggcacgagaatcgcttgatcctaggcggcagaggttggtactgagccgagatcacaccacttcactcagcctaggcgacagagggagactccgtctcaatttaaaaaaaaaaaaattcttgtattgtggagaacgtcgacctgaagcagacaggttgaggggaaatatttgaagtcaggaaatgtttcttaaatatgggctttgttagccctggatgcagagtttcagaagcttaaaagatccaaaatgttttaacacttggaatatttctacttcaatacaaacatctatactaccataaagaactgtaaaaactaaaaagtgaaatctgcccctccaccacccctacccccaacaacaaattcccgcttcccataggtaaccatggttaaaagtttagtgtgactcctttcagacttttttacagtgtgtaatgtatttttcatgttatttattatacagcttatatgatttttacttttcagtgatcatgttagctgataaaatctttaggttgaaggttttttcttgatactcgactaatttttgcattctttgttttctaaagacttcacatgtatcattctccgagcctgatattccgtcctcaaaaagtactgagttacctgtggactggagtattaaaacgcgactccttttcacctcttctcaaccctttacctgggcagatcatttgaaagcacaggaagaagctcaaggtcttgtccagcattgtagggcaacagaagttactttgcctaaaagtatacaggtaactctgaaataaaatagttatgtgttaaagtaacaaattaagtgtgaaatgctctcctttgcaaaatagcagatgctgccttccattaagtttttctttggaaatttaaagatacaaagacaggaagttttgtctttcccagatggtgcttatggtgctttcataccttttttttttttaagtcagattgagtaactgctcatacatttagagacttgtcttgcaaattaatcagtgttgcaggcaagaattgt

SEQ ID NO: 102186 - DNA, 1136 bp, Homo sapiens
agccggaggccccggtcccggtgagtgtcttgtagcctggccgccaaggggctcttgtctttcgtgggttgagccagctgtgaatgggggatggaaagtcctcgcgttcgaggcaaggaaatgggcgcgaagacttcggccgcccgtggccttagggtaccccgccctgggagccgcgattctggcaaggccgggtttgtgggaagagcgctcccctggctaccccgctgcgggctgtgctcacgggacgcgttcccgaggaaagtgagggggccccagagggcagcgaggagccccttggagaggacttagaggtgacttggaaaagagctcgaaaaaccctgagagcccccatcttgcaaggacgctgttcgatggggcaggtgacaagccctgcttcccccgtgatttagggcctcccttctctcacgcactccaaattattctggagatgggggaatgtcgaggattcgtggggtcagaattcactagcatctgtcttacccaaagccttttggatctttcggtttgaaacgccggtccctgttcccctcaattttgatactaaagttcagacacaaaactgaagtgttgaaactcatagattggatggggtgcctctgaatttaggtgtacttgcgtttattgagaaacatgtatgccaggtgaggctctgtacatatttaacgcaaacttcagcatcctttaaattttaaaggagaatatatttaacctcagtttttagattctaatcaagaaaatgatttgctatgggaagagaagtttcctgaaagaacaactgttactgaattacctcaggtaatactttttaaatatcattagaatgtgtatttgtataaacttttttttcataggatttgagcctatttttaaaaatacatttatacttctcagaagcattttgcttggaaagtagttttacagagaggcttgatcatctcaaccagggatgaaaataccgcatcagccaaggtaaaggagttggtttgatacagtaatgatgactgtaaagatagccagcgctaaaataggcctgatagacgtgggggttttcttttactctctaacagtttttaccactcttctttgggcagttgacttctccagttcatcac

SEQ ID NO: 102187 - DNA, 1043 bp, Homo sapiens
cactccagcctggatgagagagccagactctgtctcaaaaaattaattaatacactaatagatttgagcactagcatttgtcatataccaccctgtttgttctacttatctttaactagacctgacatttctaatttcattccttctcagacctcagttggatgaacccattccactgtatgaggcaaaagtttccatggaagctgttcagaaaaatcaaggaagaaaaaagcaagttgttcaattttaattttcttctttctcagacctcagtcggatgaacatattccagtatttgaagccagaattttctttggaaattgttgagaaaaaccaaggaagataaaacaagttgcatttttaagcacgtttctctgctaagacaagatgctcagttgacacatttgaaaagtgtttgaaaaattcttgtgcaaatgatcaagataattctataattaacatcttaagggaatttttctaaaaaccttttcattgtttctatatattttgcccctgctataaaattccttccatgaagaaaactgctgctttcagcaaaagtcacactactcttgataaaagctgttgcaggcctttgctaagctatcaaagtaacgtattaattttgtatcaactccgttctcaacaccttccttaagtctttgctgtcataatttaagcatttgagtatattttgaagtcttaaaagacttagcccataggcacttaaattttgtgttttcaactattcattcactccggctttccccaggatcaaagaagatcccattaacttgccagtggcagctgcctggaagtctgagatgaccaggcactgggaacggggaagggagggatgtcggtaggctgcgctggcataggaagcgtgctgacgtcttatctgagttctctgggggttgaggaaggtggcctagtcccctctcctcgcctcttgagagcagtagccactgccctctcttaagtttatggaagcagcagcccatcgccgcagctcaagtttgtttccttttcatccaggcgcc

SEQ ID NO: 102188 - DNA, 1109 bp, Homo sapiens
cctacagaatttctctaacttaacatgttgagtctctgagagtgcaaaacttgaaacaagagaaagtggcctgcctggcatcctctgcttattgaatggttttatttaattctcctttacattgccaccttaacaatccttccagctacgtatcttaaaggatgtgatggagaagttatcaactggtgttttcaggtacgctaaagtaaccaaatcattgttcttgtttgtttttctattttcagggagctaaggcaggcagtcccacttttgttttagctctcgccatgtacctgttgcctccatattttattattaggttggtgcaaacataattgtggtttttgccattgaaagtaatggcaaaaactgcatttacttttgcactgatcttatatttcgtttaaatagctgctctttaatatttatcaaagtgtatctggtggtacaccagtaggtactcgcagagatagaagtggcttgtgagttttcctcactccattatgtagtgtacctcaccctttgcttttcctcatcacccctcccaaagcaacttgaagtaaccaatagcttgaaggagagaaaaccatggtatatttgtttaaagttgaatatgtttatcagttataaaagagggagtaggccaggcgtggtggctcacgcctgtaatcccagcactttgggaggctgaagtgggtgaatcacctgagatcaggagttcgagaccagcctggccaacatggcaaaacactgtctctactaaaaaatagaaaaattcgctgagcgtggtggcgaacgcccataatcccagctactgggaggctggggcaggagaattgcttgaacctgggaggtgaaggttgcagtgagccgagatcacaccattgcactccagcctgggcaacaagagaaactccgtctcagaaaaaaagagggagtaaataaagtagataatttttttccttcaaaacttaaccacttttaacattggaaacactaatggacgaatttgtttgaattacttaaagtaatagatttgaggccgggtgcagtggctcatgcctgtaatcccagcactttgggaggctaaggtgggtggatcacttgag

SEQ ID NO: 102189 - DNA, 1012 bp, Homo sapiens
ctgcctcagcctcctgagtagctgggattacaggcgcctgccactatgcccagctaattttttatatttttagtagagacagggtttctccatgttggccaggctggtctcaaactcctgacctcatgattcacctgcctcggcctcccaaagtgctgggattacaggcgtgagccaccacgcccagcccatcagggagagttttaacaaggagtccagatgctcccaagactctgactttgttctataacatcagccatcatcttactgtcactcagaggggaaagaagaaagcgatagcaggagtggcacagtgcacttcccatcccatttctgaattttttcttgtccacactagtaattactggaaccttcctcaaaatttcactgaacaaaatttgtaataatactggcctctcattaggaatgaatttttgacttacatccctttaatttcttgttttgatttttaggaattttgcccctggactctgaagaccctggactttgtgaagttgttagagtacatgagcattacttgggtatgtagcaattcagtactttggagctcacataagtcttacttcactgacatatggtttaataacattttaatttttttgaatctaccataagtgttgtacttaataaagtatcattagccagtcatgtatgtaaaaaatgttggctggtcatgtgaatacttctagcttataattagtattcataaaattcatattcagactaaacaatatatagacctttaagttttactaacactgctcatggtaagatctttgaaaagtgatttctctcttggctcttaaattatatacctaatcagaattaaaaatttttttttactcttggttattgactgaaacaaaaaacatataaaatttagacagtacatggagagtttgagacgggaaagaatcaagaacactcatctcaagctaggtgtggtggctcacacctgtaatcccagcactttgggaggccaaggtgggca

SEQ ID NO: 102190 - DNA, 1003 bp, Homo sapiens
ttaggatataagtgaaacgaactccttgcccttaaacggttcactctctaggggagagacaaatatacacatgagcagattattatgtaagcttggaagaaagttgcttaacctggccagaagaaacaggaaaggcgtcttggagtaagatgtccaaatcataaggggcaagcatgttgagaatcacacctagcagggaggatattatgagcaaagacaagcaagtgaaagtgggatgtgtataagaattacaaagagtttggtattgctagagcaagataaagtcctgggcaggcgtcaagggtatggtacttggtagcagagaaacattttgtcaagaaaattctcctcctaggctgggcttggtggattacacctgtaatcccagcactttgggaagcagaggtgagaggatggcttgagcacaggagtttgagccaacagagcaagaccctgtctcaaaagaaaaaaaagaaaaagaaaaaaaaattatccttcgaatattgcagaataaaagatattgtacaaaatactttcatgattatgtgaacactaattcctgccttcctaaaatgaagcaggaggataggcaagggccagacctttggttgagccttagatatcagattgtattttagggagattattagagtaggcatttgaaggaagggtggatgtaaggcaaacgagtctaaaggcaagaggactggttgggttgtagaccaagaggcaagaaacagcaaagtccataacctcaacagtggtggcagaggtggagaagagggatggattcaagacatattgaggaaataaagtctgcaggacctagtaactgggaaattaaaaacagatcagaaccaggaatggcttacagagttcttgttcaggcttgaattggaaccaacatttgataaaggaagatgatccaatttggaggaatattatgagtttagatttatacttactgagttcaaggaacttaagtgacatctcactggcaata

SEQ ID NO: 102191 - DNA, 1196 bp, Homo sapiens
gcgggtgcctgtaatcccagctactgtggaggctgaggcaggagaatggcatgaacccgggaggcagagcttgcagtgagccgagatcgcgccaccgcactccagcctgggtgacagagcaagactctgtctcaaaaaaaaaaaaaaatcagtaaaggttatacgttatgtgtatatgtgtttaaggatatccctgtaaatgtgaagagccggtgttctgagattatttaggttgaaataaaggagtacagtatttgctgctttactttgttatcctaactttattgtctacatatatatccatattgttatttgagtacttttaaaaatatgtatccaaaagcttttttaaaattgtacccccaaattttctttatttttttattatatacatttctataattacttatagttgttaaaattagctgtgagatttagggtctgtctaattttgtttaattacatgtaaaaattttcacagcataaagacatattctcataggaatgtgtaaaataacatattgttttgttatcatttggttctaggaagatcttcctgttacagaggataactttgtgaaacttcaagttaaagcttgtgctctgagccagataaatacaaaggtattggttcttttattatggcacaaagtaaaatgagagtttcttagtgtatttagtgtataaatataacgataactgacctctcaatgtgaagaatttattaccatcttcatttttgttaatttttttatttgagacggagtttcactcttgttgcccaggctggagtgcagtggtgcaatctcagctcactgcaacctctgcctcctgggttcaagcaattctcctgtctcagactcctgagtagctaggatcacaggagcgcaccaccacacccagctaatttttgtatgttttttcataaaaatgggttttgccatgttggccaggctggtctcaaactcctgacctcaggggatccacctgcctcggtctcccaaagtgctgggattccaggcatgagccactgcgcccagcctaccatctttagaatagaacagctaggggaaaaaatttagtgtgcttttgtatatttctatataagggacattattagtctgattgaagttacgtattttatatgaaaatacaaatattttataagaaaacagacataatgtaaatattttata

SEQ ID NO: 102192 - DNA, 1040 bp, Homo sapiens
atcccagcatttcgggaggccgaggcagacggatcacaaggtgaggagatcaagaccatcttggccaacatggtgaaaccccctctctactaaaaatacaaaaactagccaagtgtggtggcacgtgcctatagtcccaactactcgggtggctgaggcaggagaatcgcttgaacctgggagatggaggttgcagtgagccgagactgcgccctccagcctggcgacagagcaagactctgttgcaaaaaaaagaaaaaaaaaaagtattcaactttaattgatatatctaatgttagcagctcagtaggaaaccattaaaagccatggttaggagtaatgactttggaagaagtagcacctagtttatatcccagttctggcccagctggtgctatgagacaccagctacatgctttaagctaagactcactttcctcattcatagaataaatgaaataatagtattcttaccaaaaagtatatacaagaatgtttttaacagaacaattcataagagccccaaactggaaacaattcaagtgtctgtctatagtggaatggataaatagcaatttgtttatacagtggagtactatgtagcaatacgaatgaatggaatacaactacaagtaacaacatgagtgagactcacaaacctaatatagaaagaaagaaaacagacattaaagagtataattttatttatataaagttcaaaagcagacaaaactaatctgtgctgttaaaatttaggatattgggtctccttaggaggagaaggggacacagggaacttctggaggtgtatgatgatgtgtctcctgccatgatgtgggcatattcacactgtaaaattcaacaagttatgcgcttcaaggatttgtgtacttttctatattttatacttctgtaaaatttgcataaaaaatagtcttaccacataattactctgaaaattaaagaaacaattgtggaatctttagagatacctcaagaagttcacagagccgggcgcggtgactcatgcctgtaatccc

SEQ ID NO: 102193 - DNA, 1096 bp, Homo sapiens
cgaagcacaacccaaaggggttggccgggcctatggttggaatgaggaagggtgtggtcttcggctaaaatttgcataaaacggaacccatccgggcgattccaacttcgcccatttattggtagtccttggggcggggcctcgcctctttctccgcccccgagcggaacatgacgggagatgtagttccgagaccggttgccatggcgttctggacagcctcgcgagtccgaccccgcccttcaggagtgacgagcggcctgaccaatgggagcagggggcgggctctctgacgaaggactggaaggtggcggtggtgaaggtgcaggccgttggggcggctcagaggcaggtgagccccgggaaacgcgtcctgtgtcttgggaaacgggcctttaagcgaaaggtggagagatgccccacagaaccgtgcagccctggggaggatggtggttcgcgtcgaaccctaacctgggacttgttcgggcccaggcctagcttagctgaggccgctgaggggtgggtaagactagatttgagggacagtttcctggaccttgacgggttttgattgtaggtcttatctcagtttgcatctccctctacttttatggaggcagaggtctgggagtgcccttccacttaatctcccaggttgggtttttctcctctgcttcttgttcctagaatttgagtgtctttttctttctctgttacttcttctcagccacttctttcttcctcatcactttgctgttttcggaaagcagttagtagttattcgctgtatgtggcttttgagccagatcggccctcttcattatgctaaacggcggaatcatctggagcgagatgtaagcatcgccttgggataggtctgggtcggggccgaacatctgcgtttctaagaagctcccaggtgctgctgtccacgttatgagtagaaaggttttacctgaactctgtccagtacaaatataatgcgagtcccttatgtcattttaattttggggtagctacatttaaaaagtgaaaagaaacacgtgaaattaattttaattatatgtttcatttagcctagtatatctgagacatt

SEQ ID NO: 102194 - DNA, 1009 bp, Homo sapiens
catggggaggagggggagagtgctaatcctgcccccacacagcccctgctgattggctcattcggcttgtcactctgttgtcttacatttctttggctcaccctctttgggttcgcacggtgggcggggccagtggtagggggtggtgagaaggtgcgggccccttcttccaattggctggcggtttccccacccacttatgggcggagatggatggtggatggggggcgggggaggcagcggagggagatgaggagataggcgggagcgagggagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggtgaggagagggctgcaaggcggcggcctggaccacgggcggctgcagcgggggcgggggtcggcgcgggggtctgcgcgatggctgcccggggcatccgtcccgcgcccggcgcttgtctccccggccgcccttagcccctcgccgcgcgcccgagagacggcagcggctgcccctctgccttgtccttcccgtcctcgggggtggcggcggagtggcgggcggacccgcactgggaggccgggggccgcggtgggccgtggggtggcggccgcgggacgggcgtggggatgaatgggcgccgcggccccgccgccgagcgggctccctcctctcgcggggaccccgggcggccgctccttcccgggctgacctcgctgccctcggccgccggcgaggggcggcccggcctcgcctcccgccggcctcccggggacccgcgttggcgggagcggcgccgcctctgcctggagccccggctccttcctcggcccctcgct

SEQ ID NO: 102195 - DNA, 1226 bp, Homo sapiens
aaggcacagagatctcatggattatgtagtggacaggatgtgagggcaggaactggggccaggacccagcaggccagctggtttgcatggtgccactctaaacccccaaaatatgaataggaggaatgtatttgttgggatacctttatttttagatgactttaaggttgagagtgcagaagcttaaacatccttcatagttattatttcttagtttatctctgagaacaaaatatgtttctgtttaaaatttcttttactggtgtgcttgaaacgttattttgatgggagtttccttgtaagtaaaaacattgaaaaatacatacatatgaaagaaaaatccttagtgcagatgggtttgtaaagaatccagggacttttaagtcatataaattaagaagtgagggacactaatttgatgatggtgttaaaattatttcagacacctttaagtagtccagtggagatcatttctgatagtatgatctttttttaaaaaaatggtatttctttatctaggaatgcttctgttgaaattgctacggcgcatggtaccgtcacaaaactcttttattattctgcctgagtaagagaggaaatgaacaaatttttaatgtactttggaaccctgcggattgcacagatactaagcattgtgaaatagggcataaaatgagtggtagcaagttagttctgtgaaatgtttgtcgctgttagcatttttttttttttttggcagtcgactagcaattttcttttccctaaagcttatcttcaatattggtagtagaacctctgctcaagtttatcttttccccaagtgcctagactgggacaaactatcaagcctcctgtaagagattaaggaggagctgctggtaaattcctttcctttttttttttcttgaggcagggtctggctatgtcacaggctggagtgcagtggcgcaatcttggcatactgcagcctcgacctcctgggctccagtgatcttcccaccccagcttccagagtatctgggatcacagatgcacgccaccatgcccagctaattttaaaattttttctagagacagggtctctctgtgttgctcaggctggtctaaaacgcctaccttaaacgattctcccacctaggcagcctcccaaagagctaggattagaggaatgagccaccatgcttcgtccaaattcctctactctaaattatctttttaatttgcta

SEQ ID NO: 102196 - DNA, 1032 bp, Homo sapiens
cttttaaaagttacttgtcaaattaatctatcagttagtggcatattaaagcccagcatattacaaaaaaattttttttagtagtcactgattttataaattaggagccacaagcactataccccagtgacttctgtaagtttggttagtttagaaaggagagagcctttcccaggcgtagtgtgctcaaggtgattagccagaaagaagattcagaacaaagcatttgcttagagagtcaaaatgtaaatttaagtcacagtgtagtggtaaatcatatatcaaacttatatttggtatattgtcttatatcaaaatatcattttataaaccataagtccaacatactgctataaaaattggtttctagcaaatagagaaaattgttatgttttccaatttcacttttcatactaataaaatttgacctttacaccttcttttcaagagttcaccacagggcaccatagatattatgtagttaagagctcaaactttggagaatattgtgtttgaccacacatagtcagggagtttgatctaacctctcaatgcctcatttctcagctgaacatggaaatagtaataataaagttcacatacttctaagtgcttacctaagtttttgagacacatccacttaataaatggtagttacagtgatgataaagaattggggtgtataaaaatacctaaaactcaaaagctaacccatttaattattgtactactggacttttatgatagtaagtagaaatctgttgcttaaaaaagaagtttctttggtggtgtgcgtctatagtcccagctacttcggaggctgaggtgggagaatcacttgaacccaggagatcaaggctgcagtgagctatgattgtgccactgcactctagcctgggtgacagagcaaggccctgtctcaaaaaaaaaagaaaaaaaaaagtttattgctaactccttggtactatgtataatttttttaattgaatgactagactaaacattgaaagtatttaataagctatcaaatat

SEQ ID NO: 102197 - DNA, 2353 bp, Homo sapiens
acataagttagctcagaaattagctttgggaccggtgctgtgggtcactcctgtaatcccaatacttgagaggccaaggtgggagcattacttgagcccaggagttccagactggccagggcaacatagcaagaccctacaaaaaattttttaaaaagtagcccagtgaggtgatgcccacctgtagtcctagctactagggaggctgaggtgggaggactgtttgtacccagaagttggaggctgcagatgccacagcactccagactgggcaacatagtgagatcttgtcaaaaaagaaaggggagggcagggcaagagagagagaaaagaaaggagagaaagagaaagagaaggaaggagaaagaaagaggagagagagaaaaattagcctcatcaactgtccagcattcatccttaaagtagtcttgttatcctttactctgtagtggttttcctaaagtacccctgcatgaaaaacaggattagagtgctagagaagactagtgaaatttgaaaaggcagttcacttgtgatgtggacttgtcttagaaacgcaagactgtacagaagtgtgatgagggagacagctgggtgtgtgtgtccaggtagttccatgttggcgagtttggagatagaaagtggcctaaggaagtttacttcctgaatgtgaatgttggccactttggagatagaaagtggcctaaggaagtttgcttcctgaatgtgaaggcctcagtgtagagagatatcatccactgggagatcactgaaaagtaaaccaaaacatttttattaatacatgggatggtagaatgtcactccagttttgttcctaaagttcgtagctctctaagaaagtgaattttaagcaagttaatctattttaatgcatcactgctctttcggtgtttttctagtagaattaatgataggtagcttgctttattagcttactgcccagagagaacattggtgaaattgttttggcttcagctctctggactgagtttggctgcctagctcagttttcagttggtcaccaaaacctgtcattgtttttgtgtggtatggggtctgctggagtcatgtggtagtgcgtttggcccttcattgagtggtggagccaggagttgagctgagggctgtggcagaattttgaattcaagtgaattcgaatgtgaaaataacaatgtctggccgggcgtggtggctcacacctgtaatcccagcactttgagaggccgaggtgtgcggatcatgaggtcaggagtttgagaccagcctggccaacatggtgaaaccccatctctactaaaaaatacaaaaattaggcgggcgtggtggcgcacaagtgtaatcccagctacttgggaggctgaagcaggagaattgcttcaattccctgcttgaacccaggaggtggagatttcagtgagctgacatcgcaccattacactccagccttggcgacagagcgagactctgtctcagaaaaaaaaaaaaaaaagaaagaaagaaaataacaaggtcatagcaacacagcaagtggtcagaattttacccttggtggttaaaattaaacatcctctttttaatacaggaggacaatgctcttgctcctctgttgcactggtgagcatttgatgtgttcctccttgcattatgtctgcaaatcgttctggtgtctggtggcatgcatttgcaagacatggatacagttcatggacgtggacgaggtcagctggcttttagtgtcaggctttaaccaacctagttaagaaggacgctgactcttaccataaaagcactgcaacaagattggaattggagctccaacgaattggagccattcgttttgtgtgtgtgtgtctgtttgcctgtgtgtgtgtacagggttaattacttctctgcaaggcaaatttcctgaccggttttattgttctaacacagacaaaatgttgtgtaaacacatatatcattccagtgtgttatctataataggagtgttcattgtggatccagtgtttcacaaaaatcaattcatttccgctctgaacttaagatagtagattttaaaaccaagttatctttcaatttctgaagttatctgaaactcagctgccccagtcttgcagaattggagaattgcattttggccactgatgaatgaaagctatatagctagtaatgagagaaaccttgaaaaattgacaagaaaatgagtgccattcttggtatatagcagatttcaatgaatagtagttccctttgcctttatttttcctctttcctgcacttaatataaagagctaatattaaagtcattaaatgagaatagatctgtattata

SEQ ID NO: 102198 - DNA, 1074 bp, Homo sapiens
cttgggacttgactctgaatgtctgggaagtaggaagttaatgtaagttttaagcaggggagtcccatgatgtgcttttgtttaaaaatctccttctgagtatcatgtgggagtggattggaggatggatagagaggaacattccattgactcggcttccagctgtctatggatgttgacgtttctacctagccttctgctttatctttgtgatgaggataatgtggtgtactttgtgaggtctcaggaatggtttgagatgaatggtaatttgtgtaaactttccggagtttctctgaggaaaagagaaccccataaaattattactattgatcaaatgaaatagcagtgtaagacaaagatcaagaattatttagctttataaacaaattaattgaggttatgaatataggtttctataggagagattttgtttcctttttttagtgaaagaaatcttaaatgtatgggaatgaatccttaaaatagcaggcttttgcattgtctatagaagctgttctctttgaggaagatctgttttgtaaaatgctgctgttgtctgtccaatctggagttttaattagtatcaaagggagggaaatcctgcagtaatcgtaaccttactttaattcttagttcaattagttttaaaccacagtcattatctgttatctttagttgttttgatcttggtagatgaagtgattaatattacagttgtgatttggtaatttaaaaaataacatgttttttcctactacaaaaggaatacatgtttattgaagaaaacttttggaaacatatataaggaaagaagactaaaagcctaccaagatcttaccatccagtgataatgactgttaataccctgtgaaggtcaacatgctcaaattacccagcaggtgcctggtgtgaagctacttagcccgggagagttgaaggcctgttagggaccacgagcactgaaggtggcaggacggtccagggccagtcaacccagacctttgtggttctgggaggatgcgtcctggtgttactacaccttatagttatttaggagaatgtgggtttaat

SEQ ID NO: 102199 - DNA, 1008 bp, Homo sapiens
ctcatttctctcttgtgaccgccatgtgagacataccttttgccttccaccatgattatgaggcctccccagccacctgtaactgtgagtccattaaacctctttttctttataaattacccagtctcggtgaaaatgaactaatacacgtaagaattttgaccatctgaacccccatgaaagggtcttaggactcccagggatccacagaccacaagagaattgctgccttgtaggataaaatctaaaccttcactcacagtttagagtgcattatgctgtatccctgttgaccttccccttttcctcttctatttctcttccatctggatctcaccatagaatgttcttttgtcactttagctttacagtttatttcccttctgcctccccctatctgtcccttatcctttaggcctaactgggtgttactgaagtgaaaatacccgtacctgccgcagctatgagtcattttccctttgatttccagcactgaacttttggctctacctctttccatctattttctagggacctctgatttaaagttccgaatttacaaatcccatcataacaggaaagcattttacatccctcttgtgacttaaacttaatttatactaatatttttcattttgaaccttcttatacctaattaaatgaaacatttgagcaaataggtgatggggtattgccttttttggggtcttctgttctgtcagaaatggtattatagttaggtctagcccagggaaaaaactgatttcctttaacagttatttgaatgatacccattttcctaatcaggaaggtttcttggtattatctaggtactgggttttatgctgccaagttcatcagttaaatggcctttagataaaggacaggttggagttgtgctcagctcatataaaatgtgctttagaaggacttctggtattatctgacccacactgcccctcatgtcacacatgtttctgcacgtacacaggatgagtactgagtacc

SEQ ID NO: 102200 - DNA, 1122 bp, Homo sapiens
gatgcggtaggtttctggttttaaaaaaggatgtctggtattgattaaatctatagttttgaactttctaatccagcagctctgtggagtaggtactgatacttggattttataaccagggcacaaaatggttaagtaacttatctgtggtccgacggctagtaagtggcaggtctggtgtttggatccatgaagtctgtttcctgagtctgcactgttcacagtatgcgatctatgtaataccgctccttatgtacattgtataataatagctccctgggaatgtatgtgtgaagttcccatttggaaggctggcatcgtagtactgcactgatagtggtggcagtgattgtgaggtgggttgggttctggtgcctatggcaggggctccagcaagcagatggttagaagacagatagggagcaaggataggaggatgggctgctataggggccagacctcctgcccaggatatttctggtccagttcgaaagttggacctttccttcctagagattggctccacttatggctttataataggacctcttccccttctggagtcctttggagcaagatgcattttcacagttttctcccaacctctttacttgagtctagcacttactgcctttgaacttctctgagggtttttactaccaactagaaatgaaagaaaaagttgaagagggagatggtattcaaaagataagtgatacaaattggagtcttttaggattcatattattgaaacgcaatttgtcaacctccctaagagggtcacatcactgtggtgtgggcccccccaaggcatgtcatcactgaggttaggatgggctctctgccatgaggagtaagccagtgcctccagctactggctagaaacagggagtgttgtcaggagatctgcactggggctgaaggacatccccgcctacttcccttttgctcttcttactatcagtctttactaccgcagatccctttctagggtccacgacctttgctggggtaaagtgggatgcagggatggggcctggggatgctctaggcagtttgcatgaaggagtggctccattggtgttaaagattaggccttctgatactttcttctccacttgt

SEQ ID NO: 102201 - DNA, 1023 bp, Homo sapiens
atctaccacttagaacattaagttgtaaaccagagtcagcacagccagggtggagattacttatttgtatcccttgctcgtaggttatttaatattctctgttgtgtcaaagtttagtcgggtatattaattagtcagcttttgctaaattatgttgtggtaacaatctccaaatctcagtagtttacgacaacaaaactttgtttctcagtttaaggctctttgtgggcttcatgccatggtagaacctcaaaagtggcatgtgccatttcaactcatacttcattggccaaaagcaagtcacgtggtcatgcagggcctcagtaagcaagaaatatttacccgcccggggatggacaggtaggaaagggtctgttaaggaagggcagcaaatatttggataacagtactatgtgtttgtatggagcgatatttaagaaggtttcctaggttttttgaggggtattgaagctgagaggttgggggcaggcaggaagctctgcagcctgtagcctatggtatcaagcttcatgagaacgagaattaactagttacatctttattaccatttttggcatctctgcagacagtggatctaatgcatgatagctgattaataaatgtttgttgaattaatgaacaaaatagcaagaaagtaacgtattctgaggcaggagaattgcttgaaccaggaggcagaggttgcagtgagctgacatcatgccattgcactccagcctgggcgacagagtgagactccgtctcaaaaaacaaaagaaagtaaacagattattttcatgctatttgatgcctccgcttagtttggaaccagtttttattttattttattttattttattttattttattttattttttgttttgtttttgttttcgtgttttttgagacggagtctcgctctgtcgcccaggctggagtgcagtggcgagatctgggttcattgcaagctccgcctcccgggttcacgtcattctcctgcctcagcctcctgagtagctggg

SEQ ID NO: 102202 - DNA, 1263 bp, Homo sapiens
cttatgttttaagaaaggagtttatgttttcactggatatactcggcgttcagggaatcagagactttcttcaagtttcccttgtcttttaaatagggacgtatttgcaagttcttatctgtttggaaattcctgtagcaagttcaggtttagtcattctgtactgctttggtggtgccttatctaaatagtattgaaaggaagaaagaattatttcaccaagagttggccttgaaaggagttagatgtattgggtatatttaggaagtaccccttcaacgctgtaataatataccaacttttaaagctacctcataatagctcttaaaaacacatttaaaacacttagaggtgatcctttttcctagccatcagtgggacaaattaattcctttttgagtaaaaaaaaaaaaaaaaaaaaaattctctttttttagtactcaagatcagcaagtattggttgactcattctttgttgttaaacctcttggtttctcaggccagtgtgtctttttgtatactttgaccttgcactttaaactgaattccttttgtcctttgagggaggcataaagctgtcagttcctgttggtgagtgtgggaaattgagttttcactcttctctataatttctgcatttcaagtggttttaataataatcataactatttctcaattttacttcttaaaaaagtagattcatcagactgaattgaatatttgttttccttctaaagctgaagccaattttgccatacttgtttgtgcattcttaagagtttagtacttaagcatagaaaactgtggggttcacatttatattttgctttattacaacttagaaggtaattgatgacttggctctgtggtatgctcaaagtgctggactgagctagttcaagaatgtcattagcagtgaatgggaaatatgtgtctacttttcttcagtagctaaacagaagtaattatatatttacattctacctatttcatagggatgttgttagaattactgtgattagatttttttttttaatttccaaatgtatttaagcttctttacagataggtgccatatcaaagcaaggtgttaatgtcatttttctcaatttgtgtttttgtcactagaaatatatatatattgctttttctcttttcctggtatatttttctgataaatgttttgaaatttgttatcttaagtttttcatagctggaatgctagaaaagcatttatgtcctatttttagtgcaagtgatgag

SEQ ID NO: 102203 - DNA, 1028 bp, Homo sapiens
aagacaatctgaaatgtatttgagttttgatgtttctaatctgtagaacttgaaggcctaaggattttgtagttttttagggaacagcattcctctttctctcaggtgatctatgttatgttgacctactcaaacatgttaactttgaaaatgaaccaacgttcaggaacaaatgaaatgacattttcaggacagcattccaaatacatagttagggacagttgttcgtagcttctggagtgtttgaaaatggccctcatatcatacaacttgaattggcattcattgacaatcactttgcttttaaaagatgcttaacaaagagttgtaagtaacatactttgagactgagtaaataaaataaacatgcgaacctttgatgttaagctgagtttgtttgatttttcaggctgaatatacaaagactgtttctaggaaaacttgtgctttgtacagatagaggaacctcctaagaattttgattgtggcttccaaaatagcagatttctagaatatgattacctactttatctaagatttcaaaaagctgctttgtctattttatgatataaagttttcaaaaaatcatcactgttttgtttgccttttttttttttcttgaaaaggcatgtgtttaagcatcagccttattagctggactgttatttcatgtatttctgttagaacgctggataatggacttgaaacttacatggctaatataataccatgaagtttaggaaactaagggctcatttctgttgtattccttggaacgtatgtgggttcaagatcaaaatcattatttcttctttgttttggtatttgtctctttcgggaattaaaatttgttcccaaacattcgtaggactacactgtagcaggaatctgaatagaaaacactccttgtttagttctgagtttatgtggatgaggactaagtgaccattgaaggtggaagggtgatcacagagattactcagaacttaatttattaattctaaaatgcgttcattgaatacacatgg

SEQ ID NO: 102204 - DNA, 1022 bp, Homo sapiens
ttttttctttttttttttgagatggagtttcgctcctgtcacccaggctggagtgcagtggtgcagtggtgcagtggcacgatctcggtgcactgcaccctctgcctcccaggttcaagcaattctcctgtcttagcctcctgagtcactggaattacaagcacgcccggctaattttggtatttttagtagagatggggtttcaccgtcttggctaggctggtcttgaacacctgacctcaggtgatccacccacctcggcctcccaaagtgctgggattacaggcatgagccattgtgcctggcctggtcacttgctcatagttattaatctgaagaagttctacagtaaatcaaatgttcaggattgcctaatgttgacttactgatttagaatatcattctcttggtatgcttctataaactaccagtgctcaatttttcttttcaattttgaacttgttgatggacagtgtctacagtctcttgacagttatgtaatttgtgtctatttaggtttaagctgtcaccttcccaaatgcggcatctgtgtagccccagagggagcattctaaaaggtaaatctgagcctggcgcagtggcccaggcctgtaatcccagcactttttgggagctgaggtgggaggatcacttgagtccaggagttttagaccagcctggtagcaagaccctgtctctacaaaaaataacaataaataaaattaacaggcacagtgatgtatacctctagtcctagctaccgtagaggctaacatgggaggattgcttgcactcaggagttcgaggctacagtgagctatgatcgcaccactgtactccagcctggtagcaagggcctatctctaaagaataaaaaatagactaggcatggtggctcatgcctgtaatgctagcactcggggaggctgaggccggtggatcacctgaggtcaggagttcaagaccaacctggccaacatagtgaaaccctgtctctactgaaaatacaaaagttagccggg

SEQ ID NO: 102205 - DNA, 1505 bp, Homo sapiens
ttcaggaacttgatataatgttttattcttgatgacccactggaaaatagaaccttctagaagaaataaagtcactttattgaagctttatgaatggctctcctatctgcatctgtagggctctacaatctgatttttccaaacaaatagacaaactatggataataacttttcagatgttactttgcagttagttggtggtctggaagaagaaaaaagagcttcaaagaggggactgttaattccatttatctcttgaacaggaattgctttcctgtctttcattgctgtcccttatttttcacctttatgttgtagctaggttttggttttattagctccctgatgaattctctcttcctgccaatattaaagtaaggatgatttagaagaactgaggttaaaatctgcctattgaagctctccaggctagataccctgacatttctctttgtggaaagtaagcaggagtaaagggacaaatcgtccgaaatgccattgagtgttgccaagtgatgtgctgacagctgtacctgacagtgattgctggaccctggtcattcctgagtgtctccttttcacctcccatcccctgctgccactcccccctaacaacaacagaaattctgggaggaatgcctgttccctatttagaggacaacttgagtgatcatgatagtttgtcagatataatgtggacaatgacctttttcagttttagtaataagattcttctttttatcaggttctttatcctttatgcagttttaaaatattacttatgaacaagctgcatatcccttttaggtcatcttgttcttctacttcaaatagcacatgtagaagccacatttgaggctcagggcttcagacatgacaatagggcattgatcaggttggctatatgtttgggatttgtcagttcctttgtccattttttgtctcgctttcagtaccttttctctgtgttttaaaagggctttgtgtacctcttgcctttatgtgtaatcttacagggcagctttcttctttttcattcatttcctgctctaagagtcatctcaagataggaatctggtataagactcacttatagaacagggacataggctcttccagttgttttcattcattgcagattattttaaataagagaaaggtttccttgtatttttctttaatgttttccaattttgaattgttatagatgcaaagcctttaaaaggataatatgtggaggcagtatttgtttggggtatcttttaattgtttttctagatcaaggacagatatagatagattaatacctgaaacgaaaccctaacaactctcaaatatcagataatttttttttatgtttctgaggatgtttttatatcctttgagatatttaaaatatacacatttttatgtttctcccacatttggacatttctttcccctcaatgtttcattgatgccacatttctaccaattttaatcttgtattctatatcttactatcc

SEQ ID NO: 102206 - DNA, 1002 bp, Homo sapiens
gttctacagtctttgtgtgataatctcaacattttcattgtcttggagttggcatctgttgattgcaattttttttttttaagaatttgtcagattttcctacttctttgtatgtccagtagttttggattatatcctggacattgtgagtttcatgttgtatagatgttgtgtgctgttgtaatcctctgcagaatgctgtttgtttcagtaggtatctaacttggttagatctgccttggttatataccagactataaattctctatgctgtctgtggacaggggttcctttctcagttcagttttcaagaccagtgagtgctgtgcttctttgagcctgccgtgcatatccatatctcaggtgtgagcctaagacaagcgggagttaattcacacaatggcaggtcccatttctaccttctttcctctctggttttccccacactttacagcccacaggtgcctttttcattagttcctttaaccacaaagaccgtgtttctgttggagttttagtctctgcacctgtgcttcactgcatagctccctgactggggcccacctgtggggcagagttgtagagaaaagacaaaaaagaaagtttttactccatggaaaggaaactttttagaaactttttactcacctcccaaatctgcctgcttttgtctacttcttattgtcctcaagtattatagttacattttgtgttctgtctgctatagcagaagcagaactctggtttgtgacattttattttatttttatttttgagactgagtcttgctcttgctgcccaggctggagtgctgtggcaggatctcggttcactgtaacctctgcctcctgggttcaagcgattcttgagcctcaccctcctgagtagctgggattacgagtgcccaccaccacgcccatctaatttttgtatttttattagagacagggttttatcatgttggccaggctggtcacgaactcctgacctcaagtgatccgc

SEQ ID NO: 102207 - DNA, 1050 bp, Homo sapiens
tagccatttcttaataaaattataaaaaataggaatagaaggaaactacataaatatggtaaataatctttactaaaatacaacaacaaaccaacctattaaaatatgaaataccaaaactgtcactgtgaaagtcacaggcaatacaaaaattattgctatcacaactattttgtatagcttagtattattgctttgggctagtaatgtaaggctaaattctttatttccagaaaatataggtctaggaaatctaaagagattcatatgtgagactattagcactaataagaaagtatggtaaagtagctggatacaaagaagagaaatcaataacctctttattttgcaacacagtaaaaaaatggaagtaaaactgaatgaacagaatgtattctcatatatattaaatatctgttttactatgcatttaaaatccagagcttaccatttttgggaaactctacaaaaagatatatgacatgttgattccaaaaggattttatgaggactaagtgagataaaacacactaaaatgttcaagagaattatcaaggttgcctatacaatatattgaatgagaaattgtcgaggaaaagaaaggcagctgcaatttctaaagggaatctacagtgagaagtagtctgattcacaaacctctggttaaatatggtgtcttgactacacttgttttctccttccctaaagtctgcaataatctcaaaggaagcttaaaaatgttaattcatagctgggcagatggggtgttgtcacctgtaatcccagctacttcggaggcagaggcaggagaattgcttgaacccaggaggtggaggttgcagtgagccaagattgcaccactgcactccagcctggggacggagtgagactctgtctcaataaataaataaaataataaaatacataaataagtgaaatcttaattcataaggagaaacataacagtaaaggagacagtgaccaaagattttaacaatttttcaaaacagaaagtgaatggagggagtagtaactgagttcacagagaaa

SEQ ID NO: 102208 - DNA, 1050 bp, Homo sapiens
tgtataataatttttagcaaattatatagagttgtgcagccatcaccacaatctaatatattaatattttaatcaccccccaaaagattttcatggatatttatcacactcaccttcttctttcataacttttgcctgtggcatttaaggcacttgagagtacagttttaggtttaagttaatttagtctgttgcttgggtttatgtaagtaaattattaatttactataatcttgctaactatgggattataaaacaagtttctaaaaaaggaatgtgtgcctcttcttttctttccctcccattctctctctttctgtttcttacattttgtgtcctgttttacacttttctaactttatatgcataacttccaaggacaagaagatgtgaatttatcaagtctttataatacattgacagaatcttgaagtgctgtggaaatagtgtgtgagagcattttgttttccttttctcactgaataatttgtttgtcttttctttggattttaggcagcctggatatctgggccataactgtagaggaaagagcgaagcatgatcagcagttccatagtttaaagccaatatctggattcattactggtaatcacagtcagcattttttcatttttacttatcagtagtgcagatgtctgtggaaactctatcatgcaaagacgagatgggcaaatatgaccaaggagagacatttacctgttttgccctaaccttgtgcctgtccttttacaatttttttacacataatggaatcataccttgtttgcaatttttagtgcatgtcaaaccacttgttttgtgcatgtaatttatgggaattggttaagatcaaaggaccaatggctcacacctgtaatcccagcactctgggaggccgaggtgggcagatcccttgaggtcaggagttccaaaccagcctggccaacatggtgaaaccccgtctctactaaaaataaaaaattagctgggtgtcgtggtgggcgcctgtaatcccagctacttggaggctgaggcaggagaattgtttga

SEQ ID NO: 102209 - DNA, 1005 bp, Homo sapiens
tgatttcttatgttataaaaggagaacatgtatctctagcctgaaatatcttgttacttcttaccagagagttatgtctgaaaagtgtctttctcatatggaactaaaacaaaacaacaaaaaaagtggtgacatttgaatgacaacactgtcaaaaagttgaatttccatggagacatctaaattttggtgttccttcaccaattagttttggcttcacccatatcacccacatttatttgaatgtcccacatttcttgctttataatggaatgattttttatctttcattgactgaagaataaaaggtaaagaaaatatttgagagttagtgcatggtaaatccataacattaatagataatagtgaattatttgactatcacaaataggcattcaatcttttaagccacaggaaatacagagagtataataaaaagggtggcaaatacagttttggattcttggctcatggctttggagagccatgctgaattctgttgtcctctaagatgtctcatttttttcaccaagggtgcttaatacttcacttccctgagttaattagtgatacgaaggcagctcgctatgaagaaagagcatgtaggctgggcgcggtggctcatgcctgtaatcccagcactttgggaggccgaggcgggcggatcacgaggtcaggagatggagaccatcctggataacacggtgaaaccccatctctcctaaaaatacaaaaaattagccaggtgtggtggcgggcgcctgtagtcccagctactcgggaggctgaggcaggagaatgatgtgaacccaggaggcagagcttgcagtgagccgagatcatgccactgcactccagcctgggcgacagagcgagactccgtctccaaaaaaaaaagagcatgtgatttgtagtcgtacacctgagtttgattcccaggtgtaccattttcagtgtctctgatttggagatacagttaccctctttgacctcaagttttctaat

SEQ ID NO: 102210 - DNA, 1113 bp, Homo sapiens
attttgttttcgtgttggtgggagtggtggttttggaaaggttcttttatggtcacagttgttctcaggccatgctgttggtttgcagggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtaagtctgaaaatgaattggtttctgtattttcttgtatattttaaaaataaatgttttcctttttttccctctcggtttataacattatgaaattctaggaggtaattctgtctgaaaaatgatggccccctgcaggaagatagtgctggggagaagaaggagcatgttcacatttgaaccctgggatgtaaagtaatcaaaatgaaagcagagatgcaggccgccagtcaggggaaaaggaagaaacttacagtccgctgctgcagcttctgggtttttttttttttttctcttccattatccttcaggttgttgcatacttccttttgattttcggtttccataatgtctgtttctccttgtgcataaacaattcctttggattatggcatctagaaatatatatattttgaatcacagtactgagtcacttggccacattaaattctttcttagaacaaaatggaatagagaaaaaataaacattgttatcctgattaaaaacctaattccagccgggcatggtggcttacacctctaatcccagcactttgggaggctgaggcaggtggatcacctgaggtcaggagttcgagaccagcctggtcaacatggcgaaatcccatctctactgaaaatataaaaaattagccaggtgtggtggtgcgcacctgtaatcccagctactcggagaggctgaggcaggagaacctgggaggcagtggctgcagtgagccaaaattgtgccactgtactccagcctgtgcgacagagcaagacttcgtctcaaaacaaacgtgattccataaaaaattatctttcaaccaggtatttttcttataagctaattgattaattagt

SEQ ID NO: 102211 - DNA, 1131 bp, Homo sapiens
aagcacagtaggccaggcacggtggctcatgcctgtaatcgcagcactttgggaggccaaggctggaggattgcttgaggctcctagttcaggaccagcctgggcaacatagtgagatcctatttatatttttttaatgtaagtagatagatagatagatagctaataaatttttccttttctgtaaaatggaaaaattattatgtaagagaagatttctaacaaatttggaagcttaaaagatgcttttaccagtctgatgattaaacagtatttttaaacttggccttttcctcagtgtctttttgaggttagcctccttttaggttaggggtctgcagcacagatggggtacgtgtcttgaaggttaactggttgcgcagtatgctgtgtcaagccttttgaaagtctgaatgatggctcatgaaaacttttggtttgtttccatctatttttatttgttgcttgagtagattgacattcttacttaagcaaaaaccaggatttggagtataattcagtatagttatcaaaagaaccaaatttttaaaaagaaaaacacattaaaaatatagttatcaaataatcttagaaaattttggaattctaaaactgacaaggtaaacctgatacatgttgctatgtgtggatatgtaaagttaatctgattccaaatgagatgtgtggtaatgtgcttgatagtgtgcacgtgaactgtaaaccagtcatctagatgactataattataaacttactcagtaaagcccaagttagaatttttttcttctctttgttggattttcagtgtctataaacattgtttttaaaaatgaaaataggccgggcgcagtgactcacgcctgtaatcccagcactttggggggcccaggtgggcggatcatgaggtcaggagatcgagaccatcctggctaacatgatgaaactccgtctctactaaaaatacaaaaaaaaattaaccaagcatggtggcgggtgtctgtagtcccagctgctcgggaggctgaggcaggagaatggcgtgaaccctggaggcagagcttgcagtgagctgagatcgcgtcactgcactccatcctgggcgacagagcgagattccgtctcaaaaaaaaa

SEQ ID NO: 102212 - DNA, 1049 bp, Homo sapiens
caaaggatctgagagatttggagcagtccagcccctatgaactcaaaagactggcccaacaagccttccttttgggacagggcttcatactcaggaaaaatgactgggagtggaatcaaaattgagcagtatagggacatggatacaaaggaaagagatggtccagacaaaagtaggggaggagaatggagactggaattcctaagaagcaaggctcacataaaaatgagcaacagaaagtatcaagcaaggtcaaatccactgcagaaagtgtcaagcaaggtcaaataacacaaagttattattaggaaaaaggagaataaagggagaaataacacccctgtggacagtgaaagcacaccagtaaatcactacttcaaaacaagctcaaagagaataagaaaatgatacaagacttgaaagatgaaaatcagagtttttaaggctcataaataaggtgacagaaagaatgagaaataaaagaaaaattcattctagaaatgaggatgcaactagaagcaacacaggggatactaactgaagaaaaatagaagttacaaagaggaaaaaaatttaaattaaaaggaaatgaggctgggcgcagtggctcacgcctgtaatcccagcactttaagaggccgaggtgagcggatcacctgaggtcaggagttcaagaccagcctggccaacatggcaaaaccccgtctgtactaaaattacaaaaattagctgggtatggtggcacatgcctttaatcccagctactttggaggctgaggcatgagaatcgcttgaacccgggaggcagaggtggcagtaagctgagatcacaccactgcactccagcctcggggatagagtgagactaggtctcctaaataaataaaaggaaatggaaaagatataaaaagaatttgagaaacagtaacaagtatttaagacaaagaagattgaatgtatgggcagcaggagtccctgaggaagaaaactaaaccaatggaatagaacaaatgataaaaatgaattcaagacaactttcttaaaataag

SEQ ID NO: 102213 - DNA, 1070 bp, Homo sapiens
tttaattggaatatattacagctggaaagtgattttctttaagcagtactgggttaattattattcagtgttgaaatgtgattggatgtgaatggtgttgagctgttttttcttcataggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctggtatgtgacttgctgaaaccataggctgagtttttactacttgtattttgctgttcattattaaaatattttctcttcacgttctgattatgtttaaatgatattttagtccagaggaaaatatctttatttttttcacttgatttcacattttttccactgtattaaatgggatatgttagtgtggagagagtcaaagagaattatagatttctgggtaccactgtggacaaaggtgagctcagcagtgaaagccacaaatgtaattttctttcaagggctgagaagagcaattgaagttgaactgtagttgaacattttctatttttatgtatcagttactacttttctttagccactatgaattgctaataagcaagccaatcccctaggaatagaactatgttgggggttgtgggaaagaataaaaaagaacagtttatactattttatggtattacatgcctgcttaattgaaggaaaggatttaaaagtttctggtttaattaattccactttgagactttattaagtcttttttcctttagttaaagtataaaactgtagatgtagatagccttggtctaacatcttaatgaattcatatcaatatggaaagtattatttttaaagtactttgactacatctaagtaaattcagtattgacgacatgggttttagcatcatacttgaaacatttctgcgcctttggccccctgaatttgttgtatatttatcaggatatatatttaagttatggccaaataagc

SEQ ID NO: 102214 - DNA, 1148 bp, Homo sapiens
tgaccctttactgatagtttgtcatttcctggtctagagcagaacatttaacaatatagagctgggtatggtggcttatgcctataatcccagcgatttgataggctcacttgaggccaggacagatcagcctgggcaacacagtgagacccccatctctacaaaatattttaaaaattagctaggcatggtggcgcacaccttgtaatctcacgtttgggaggctgaggcaggaggatcatttaagcccggaaaggctgtggtgaactatgatcttgactgcagtgaggctgcagtgaactgtgatcatgactgcagtgagtctgcagtgagctgtgatcatgactgcagtgaggctgcagtgaactgtgatcatgtcattgcacatcagcctgggtaacagtgagagctcatctgttaaaaaagattcatggaatatgagtgtattatatgttaaatatgcaaaggttggggaagagtatcattataatcatagcatttgttgaatgaggaacactgtcccaactacctgtaattttatctttgcagcagtataaaataggtactattttgacaaaatgagggacaaagagactcagttggcctgtggtcaataagaaaacataacttttaaatcactaatgaatagtaaaaagcatgaattttcatgaaaccggattacagttaactttttgttgaataggaatctttctgacattgatcaagatggaaaacttacagcagaggaatttatcctggcaatgcacctcattgatgtagctatgtctggccaaccactgccacctgtcctgcctccagaatacattccaccttcttttaggtaaggaacatgggctctgatcaggaattgtatgcggagtatatgaattccaaacttggctttattgactatgtgtcttacctgattttcatccctgacaaggaaactaagtatccgtgaattctagagactctcatctaggtctatgttaatcttgggcccattttgttcttcaaagtacttgaagtatattagtgaaacaatgaagtaaaacatcaatagattgttgattttctaccaacctatgtcatcaatgcttaccagaaattttcacaacagatgccagcagcaagagagaaactgcatg

SEQ ID NO: 102215 - DNA, 1013 bp, Homo sapiens
gagagatgggaaagggaagagagatgctcctagtgagctgagctgctgatcttcccttggaggaatttaaggttacttgagagggcaatggaaatagcagctcccacttagtgctcaccatgtcccaggcattgttcttaccactttttgattattaactactttcatcctttggaattgtttcaattttggtggtgattcttaagcttggcactcagagtctgatgacattccaatattcattaaaaaactctttgtaaatagagaagaccaaatctttatattttccttactgtaaatgaaatttgctccatggcatggtaaaatctttaaaaatccttcttcataacttgtccaactccacccagacagctctgtgtgaatctatttttctttttccccgcaattgcagaagagttcgatctggcagtggtatatctgtcataagctcaacatctgtagatcagaggctaccagaggaaccagttttagaagatgaacaacaacaattagaaaagaaattacctggtaaggcagcctttatgttgagttaaatcatttagattaaacgaaattagagatttcctatctctaagacaaagatagaggtaaacataaatttagtttttgacatttttgccttgtaacttaactgaccttagttggagataattgttaattaagcttgtggatttgggtctggatagagaaataagaacattatgcactctgctaatgcaccgttgttctaacttgtaacttgaaatctgattataaactgctaaacaaaaattatgtaaatgttatccatagaatatacagcactaaaaactgatgagtattaaggtgattgcttaataccaccagtgcagaaatagaaaatcaaatcatctactgttgttttctcatgttgttataagagaattggaaactccttaattgcaggaacctattttaaatttaatgtgaacctattttattttatttattttgttttttgagatggagtctca

SEQ ID NO: 102216 - DNA, 1038 bp, Homo sapiens
gtaaatataatacccagttctgtgtattccctttattcccatagaaggaatactgtatttttatgtaattttttgttttctaatgtgatttcttgtaatgtttaatatttcatccctaaaaggaaagacttcctagatgccatttttgtgaaaagacattgtgtagtgtaagaactgaaaaattagtaatttgtctctgtaaatgtcacaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctagtgagtgaagtttggttatactttgaaaatatactaagatggaaccattaaaaacagtaataatttttattatctttcatttgttcaagaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggtgaggaaatatgcctcttaaaagctattatattaaactggcatccttttctctaattcatttcatttacttacttattcagtaaacattaagcaactgtcttgtactaggcactgggaagcaaaaatgaagtagacagggtccttgtgtgaaaagtagcctgtcaaggagacaaactcagcaaatatttactgagcactgcttcgggccaggtgcttttgcagtttctgaggctacagcagggacagacactctgtcttctgggagcttaccctctgtttgcaggaggaacagagactaacaaaataaagtgtgtactgtattagaagatgaaaagtgctatggagagtgagtagggaagggaatagagagtcctagggataggaaatgttgtgattttaactaaggtagccaagacaggtctttctggatggtgacatttgagca

SEQ ID NO: 102217 - DNA, 1168 bp, Homo sapiens
taaagggcagaagttttaaattttgatgaagttcagtttaccgttttttttcttttggtgttcatgctttttatgttctatctgagaaatctttgactaccccatgactgcaaatattttattttcttctagaagtttttggggcttaaaaaaataatttttacaagtttttataaattgaaaaaaacttaaaattttaagtttcatagttgtatcttatatgtttaggtctatgagctatttcaagttgatttttgcagatagtataaggtaaaggttgaggtttatatttttacatactgatacacagttgttatagcaccatttattaaaaacactggcttttttcccattgagttaccttggtagcttgttgaaaatcagttgaacatatttgtaatggtctattctggactctattctgttcttttgatctgtctgtcctttaccagtacctcaccctgttgatacctaatttttgaagtcaagtgatacgaattctctgttattgttctttttagaattgtttttggttattccaggtccttaacatttccatgtacattttagaatcagcttatcagtttttacaaaaatgcttggaattttgttggaattccattgaatttataaatcaatttgggaagatttgacatctcagcaatagtaaatctatggcataaatctctattttggtagttataaatttctctcagcaatgttttgtagtttgcagtgtccaagtcttgtagatactttgtaaagtttatccctaagtattttgtggcttttgatgctattgtatattgcatatttttattttagtttccagttgtttggtgccagtatatggaaatagaatttatttttgtatattgaccttatatctgtgattgcttaactaacttcctttgtgtgtcttactttgttgaccagaacctcccatactatattggatagaagtgggaagagccttgttccctctcgatgaaggaaagctctctcaccatagagtatagtgttaaccagggttcttgtaaacaccttttatcaggttgatggacttctccttttgctgagggtttttatgatgaatgggtgttgaaatagatcatatgttttttccccgcatctattgagataagtatgtgttttttctttcttattt

SEQ ID NO: 102218 - DNA, 1022 bp, Homo sapiens
cttataaacaatcatatactactttagatgtatgtagatattagcatttttgttattcttataagaaattggatgttatacttttttcccctccaaatatttgttttccttttctaacataaaattctttttaagccaattcagcttttgacagtgggaagaagtaaaactcctattctataattctaaaaacaaaattaaaaattagcatatttgaaacttttataatagttgacctttggattgagattctaggccaaattgtctagacatctgagtttgaggtatgtgtgctgttctttcagagtattaggtaatgatcttttctcaattgtacgattccaggaaagtgctcttaggggaaatattatttgagccaacttagtgtttttcttcactttgctttcatgcttacatggtgtgtgtttgtgtgtacactatatatgttctatattcatgcatatatgattatgtgtggtatgtcagtattggaagtacagctgtaaattaaccatctctagaataagtgcaattagaaacaaaaaaacaaaaaagaataagttcaattaaagtatgctcacattaactttcattgtcacttgtctcttttataagcaaaaaaaaaaaaaaaatagcactgttgcaaagcctatgttgctttttaatagtctcttgggatataaactgttaaatattaagctctcttctgaacccaggcagtagtccagatttgtgccttcacattgattctttttctagaaatttgactcccctaaaaaaggttcaggtattagaaaatgatactctagtgagaggcttttgataaatgtctagaagattaaataattttggtgattgaatttctgttgccattactaaagagaacacccttaatatgtggcgagtcacccctactttgtttaattgactatggctgctttcagtatcacagagtttcttacataaaggccaattttagcccccttttccactagccctttttccaaatatgcttattttta

SEQ ID NO: 102219 - DNA, 1058 bp, Homo sapiens
taattaatatgatgagtttaaaaaaaatcacaggtcaggtcgggtgtggtggcatgtgcctgtaatcccagcactttgggaggcaggtggatcacttgagcaagtggatcattcgagactagcctgggcaaaagggtgaagccctgtctctacaaaacacacacacacacacacacacacacacacacacacacacacactagtcaggtatggtggcatgtgcctgtagtcccagctacttgggaagctgaggtcagagaatcacttgagtctgggaggttggggctgcagtgagccatgattgtgtcactgcactcctgcctgggcaacagagtgagaccctgtctcaaaaaacaaacaaacaaaacagtaaacaaatcacaggtcagtataactatattgttttgttatttaacacgcatttggaggacttagtgaatatgttgtgttatggttattatctctagtattcctctcaaacctgataaagccaaaacaaacaattaaattggagaatcaaaagatttatagaatttgattgagacaactcagagatggatttatcatttagtctcttaagtgtcacttgcccacttttctttgttgtagccacactggaaaatgaaatactttttttgtaactttagagcatgtgtccattagcaaccatgttttcttggatgaagagataggccaggaggagccagtctcctgactcttggggtttcttcagtgcccctcttgatcggcagtgcctttagagcatccacgctgttgatgcaaaaattacttctgccttcctgggatgtgtcatttcacacatctaacctgatagtgtgaatttgttgtatcctaaaccttcctttccctaaaggaagccagctggagagtacagaaaagaaattagggcttcctgttcttttgtatttcatgttcacgtagattgttcacctggaagaaggaaatgcagttccctcattataggttagtactgtaacactggaggaataccttacagagtacagaattttaaaattagttgatcaggatactaaatc

SEQ ID NO: 102220 - DNA, 1074 bp, Homo sapiens
ggtgaaattttccttagccatttcccccaataatttgctcatttcctagatatgtaatttaatggcactagatttgtttgtcactttgaatttttttctttctgaaggagttaaaaggatacttcttaataactgtaactgtacttgagtctctttaatagtatggagaagaatgagagaatagtgtagccatctgctcccctatgtgaaaggactgggtattctacaaggactttgttctggcaaaggaaggagagtcattcactcatttttttaagagtatatatttcttcattctatagattgccttctcggaagttcaactttttaaaaagcttatcaacttagaaatcatccatgttctgcttatgttgattcatgccatagtaaactctttaagtccaagaaaagagaagacccagaatgcctgcctctgggcagcatgttgatttccttacaactgtgtatctcagcagtgtttgacttggatgaaggaaatgatagaaaaactttgccatcttgaaatctggatcataaggtgccagagccttctgttagcttatttgtcgtctgttattttatggttcctgcaagctccattccttggaggtgcttgaaactgcaacttacataatcagttcctaagatcggttcaaatactgctatactcaaaaacaagtgtgtttaaaaaatttaagtatcttttttcatgtatttgatacatttaaaaattatttttgaaactgtgtcataggtaggttttttttctgtagattcttcaaaatcactttttcttacaagcttttcaattttatagtctctcctaatgtattactagctttacttaaatccggtaatcaatgatctataaatccatatccagttacaagagcctagtatagaaaggaaatgtgcggtataattcttggggaaaaatgaaaaatcttcatttgtgcctatgggctatctattatagtatgttgatacatcatggccagtgtccattctggttgtgcagtacctgttgttgaatattttgaatatcactcatgaatacattttttcctggatgaa

SEQ ID NO: 102221 - DNA, 1042 bp, Homo sapiens
ggaagagtgtcttcatcggggattatcagtataaccaaaatcagcacttagtttttatatgaccaggttaaagagcctaaaacatctgcattttcatgtttcagtatggaaactggtgcctctgttccctcccaaacaagttgactccttggctgattcagactttgggtcatatcctaactgctacattgtactcaacacactgggtagggaggagggcgggtattgatgctttacagatctgcactgctggagcccaaggaaagaggcagagacaagggacctttaggcagcctcgccgcacccaggcttggagtgacctttgtttagagagagtcactaatgaactctctcatgggtttttgttgctgacgtcagatttggctgtgctttggcattcagtatgtgtttcagaaattccttgaatggagggaaatagttcagaggttaagataggcaatagaggagaggttagttgtttggcttgttgtcatacatttgtgttctctgtaattatttatttttgtcccccccacctttttttgtaaacagaaaaaggtccacttaccatttctgcacaggaaaatgtaaaagtggtgtattaccgggcactgtacccctttgaatccagaagccatgatgaaatcactatccagccaggagacatagtcatggtaagaaagactccagtgagagggtcatttctgttgaagattagcctctgtcctctttttttcactttattcaacaattgtgagattgtcagtgagtatgaaacccaataatccagcatctagatttttaaagtataagctcaatcttctttcttttctattaaaatgaaagatggcatttaaaaaaatgtatcctaacatcattttaaaattgagttgataaagacagtgtgttcttatttttaaatctataaatgtctgataatttcagagtttagattactacttatatactatgagtatacatatatatgtaatacatatattttatatatgatgtatagacaatatatatactagtgtgcgtg

SEQ ID NO: 102222 - DNA, 1016 bp, Homo sapiens
gtttgtatttttttaatttcatgaattttgcagttaacaaatgatgagcatgagacatgtagtacaacattactgtcagtctccctaggttgaaaaatccggggttcacttatacttttgtgggcacagtcatcagattctcagattcctcaaacgtctttgggacatagcttactataatatgttcgatttttagaagtctaacattgtgacagtgttttttaatgtaggcagtcttagccttaaaaatattttgtttttagaaaaacttagcctggttttatccaaaactataatttttcatgtttaacaaaaatttaatgtggtaccttgtatatagcactattctcagcactgtagataatagaaaattatcaagtctgccattcatatgtttaaaatctttttagaaaaatctagagaaacacatgaaaaggccaacatgtgatgaagttctcaataaacattcactaactctgctaggaatttaaaagaggagaggaatcagtgtaaagtgatgtgctcagggaagaccaaatgctttcaattgagtctgaccttgatggctaaggcttagatgcgtagaaaatacatggcctctcttgatctggaactcccaatacttggagggtgaattaaatcaaatttgacatccgtaacatgttagtagaacataagaaatgagaagacctatgctcactgctgttttgttgaagtttatcttgagaacacaggctgagtgtctaaatcagtacaatcttttggctttcatgggccacattgcaagaattgtcttaggctgcacataaaatacactaacactaataatagctgatgaacttcaaaaaaaagcttgcaaaaaaaactcataatgttttaagaaagcttacgaatttgtgttgggcctcattaaaagctgtcctgggccacatgcagccagtgggttgcgggttggacaagcttggtttaaatgcttatccttggactggtacaggcctgaatgcatccagattgct

SEQ ID NO: 102223 - DNA, 1080 bp, Homo sapiens
tcagaattaaaatgcaaaccttaaaagcatttggcgtaataaatggcctctgtgaaatttttaaacagtataatcctggattttcctgtgcactgaatatgcaagttaaatttatacaaaagaaaactacaggaccttaatacaattgattattgctgtaaataatgacttccttaattttctcatcatgtgtctgtggagcttttaaatgcctaaacacagcagcagtcagctttgcttctcgtggaaaccatttaaggccatggtttttttttttaaatcttccttgtccttatactgaataaatactacttagttattggaggttttcagagtactgaatttatattgattgcaccctttgctttcaactttaagtaataaactcaagtcaaattatttttaataatgacatgactttctgatgaagcctgttaagtcacttcccaaatcaaaatatttaaattacatgcctcaggactccaggcactttgtctcaactgccattattaggacagttatggggtaaggcttttttaaaaagtgcagagaataagagcttgaattatagtgcattttttttttcagcattactgcttagactcttttcccagacacttggactaagatgaagagattcctatgccatatgtcaatctaaagagggcagaggcttgggacttcactgtagttgggtgctgggtctattcaggggttaatttagttctacttaaagctgtgactttttccacaggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtacgtgttggtgggctctttctgatgatttttgaaatcccaatttgatcatttcccccccacccccttaagtatttt

SEQ ID NO: 102224 - DNA, 1116 bp, Homo sapiens
gtggagaaatacagtttcctaataatctattttgacatccatgtcagtcagcaaattttcagagttatttcctgcatgcaaatagcacttttttttgccaggcagaagcaaaaattgaattcagtcatgtggttctgaataagatagaaagctgtttcctttaaagctttccactttcattaatcttatacaaatgtacagtagaatgaagaggtgtttgcacttggccagttagttctgtgccctggttcatcaggaaatggcattttaaaaactgtgtgtaagcagaggtttgaaatgatagatgaaatggttgttcagacttccagttatagggccatgacctagatgagcaattgtctaaaaatattttatactaggatacaagtatgagtgatttgaataagaagtgtttaaattttttttcaagtctaatcatctttcagaagaaacaaattgaaggcaaggaatccagatgtattgctggagaaggatcagatggaacaaatagagggaagaaagaataattactcagggcgggaggaagtggagggaaggatgtaaggaatagcaagtttttcatactttattttcacataaaaggctgaaggcgctaaagaaggtcccctcatctaatctctgctttaagaaaaaaaagccttccattagcttgacttccaagttgaaacttttccttactcttttggtcttgactgaaaagttctgagtttttaaactaaagcttaggctaaaatagaagactaataccatattttccaggatttgttttgctggggatcaaatcagtatgcctcttcttcaatatatgtatggtgtgcagttctcttgctataattatgggcaccttattttccaaatgaaaaatcaggaattattttgattttcagatttgtttgtatatcttataaggatgtaaaaagtaaattgcctttagatctgcagtcacacagacatgtttatctaaaattattttttattatttattattattttgagacagggtctcacttcatcacccaggctggagtgcagtggcatgaccatggctcacagcacccttgacctcctgggctcaagcaatactcctgcctcagc

SEQ ID NO: 102225 - DNA, 1507 bp, Homo sapiens
tcttttatttatttatttatttttttggtactttactgtgggtaaaaagctggcatattagggagtgcttgcttttttttttttttggtactttactgtgggtaaaaagctggtatattagggagtgcttgttattcatggtgttgtgcttttccctccaggtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccaggtaaaggcagccagtgagagtgtgaagacttagcatgctatctagtgccaaaaacttcagcaaatgctttttggcaatgtcattttgaagcaagccttgttatgtgtgtcttggttggctggcagtatgggaatccagtgcaggagccagaaatctgctgtgaatagttgggagttgggggtgggggtgggacacagtcaacttctcctgcctgggttgatgaaggaagcttcattgcagaagtggcacttgagctgcatcttgaccagtgggtaagatcttactagaaaatggagagagcctgcctgtcagacagaaactgctgggaaggctcgaaggcagacagtcagaatgtatttaaggaaaatcacatacccctccatttgtctagaccattgagttttttttggaaaaggtagaccaattaaaggttaatgggaggctctgaaatgccctgctcggaaagaataatgtctgaaaggataaaggtggttattctgaatagttctcttttgcttaatacaataatgataaaatactcaaatttctatcaataatcatgccaaacagcaagtgcccatctgggaggcactggaggttccagcatcatttctgatctgagaacacccagatggaacacagggtctaggcagatccatctggaggagcggtgtgcaggaagattagagtggagggccggcagggcggtgccaccagtcagggggctgttggtgtcacccagctgagacctagggcaggcctggacccagctgagttcatgttcaccaagtagggaggtgccggtggaagcagaagaggcgagcacgtgggagagactgcagaggagagtgaagaggttggagtcacaatgcctatgggagccgaaggaaaggaaagagggctgggattgagaataagggcccaccttaaagcgggaagggagaaaggcagaaaatgaaatgaatgcgcagttaaagggaagagttgtgttttagttgtgttgagttgaaggtgaacgtgggaccctgtctggcaggctgtcggaatatagatctggaggatggaagagagcacgagactgggattatagattggagccattcccatagagaacattatcggatatcaggaaatgtgtgaggtcatccaaggagagggaatacagggagaaaatagcaaatccaca

SEQ ID NO: 102226 - DNA, 1045 bp, Homo sapiens
gttaatgatctcatgatagttcataaaatgtctgctccactgttaatcctccactaaaaatgccagtcaaattggaaatggggaggtgtcccgggcaacttgagagtgaaaatagaaccaaaatataaagggcacacagccagatgcaacagaataattgtgacctcctggctttttgaaatagagagttctagatggtcagacaatgactttgtgaagaggctggaaggctttggcctccacttttggaaataaacaattgttgggaaacagtgaagcatccagccctcctgctgtgctgcctcagggccctttgtggctgtgtgtgcttgtctggcctgtgcttgttggagaggtgccatgctcacgtctgccctaattgataacaaagcgcaacataacgagaggtcctttatgttattccacacaagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaaggtatttttgtatttatctgcttgtatttgatgaaaacaatattaggcgttatattactgtttgcactagttaagattcacagacaggagttgcgggattagtttgtcttctagatcttttaactgcaaaagttatagtatatagagtaccaaaagggagcctcttatagataagtgcattctttcttctctcatgaaaacctatgtgccttgtttttcattgccttatgcaagaaggaattcagctctgagacctggaacactcttgtgcattagttggagattatgactctctttatgcttattacccagtgctgtaccagatatatgtgaatacttggaaacccaaaggatctggggaaatgatcagaaggacttaattgtctttttcattagggtcttatagcat

SEQ ID NO: 102227 - DNA, 1089 bp, Homo sapiens
ttttttaaaaacctgtgacgtagtaccctcaaaactgaaatacacatatttaatatgcttaccaagagcctgcatatgaatgcatctgacccagtgctcagcacagagtaggtattgtgtaactcttagttaaaaataaatgtaaaaaccattttcattcaaaaagaaatcatgatgctaaatggtagatcactcttaaatactcaagtgtcggtaaacatgcagttgggttttttattcctgtgtctgggtcttcccaggaattgtctccctgtctgcagctactgaacttttatgtgcactgggggaatgtggagcccagggcattctgcagctctgtattttatctgtgactagcctttctcttgaatggatcttgtcctaacttccttattcgtaaacttgcttttgcaaagctgtctgggatttctttaaacaatcaagctctctccgtatctcaatatttctccccaccagaatttattgccatgtacacttacgagagttctgagcaaggagatttaacctttcagcaaggggatgtgattttggttaccaagaaagatggtgactggtggacaggaacagtgggcgacaaggccggagtcttcccttctaactatgtgaggcttaaagattcagaggtaaacccacattaactgtttcctctccctttctgtgcggtgattctctttgtggggagtcacgatgtttgacagcggaactttgttgggttttgctaagttctggaatgtgacagtaaatccagtgtgacctgtcattgtttgatcttgtcatttggcactgcgcagtaagcactggcttcccccaagcagaatgccatcagggctaagtggaggctgagtgtgatggggctggtccgcatcagctgggaggataatgttcagtattaagctctcttcctgcctgtaactgacttacgctttggagtaaactttcttgattagatcattatggtcattgatttttaaatgcccaagaatggtagcaatattttgcctgtataaacagaagtattctggtgataatcgccccagaatattggatattattagaaagtttttagaa

SEQ ID NO: 102228 - DNA, 1072 bp, Homo sapiens
gcagtggactagccacggaagacagaccctcaggtgctcctgaggaatggaggttggaacagcaggagcaggaaggaagaaggccttgctggggaaggcctcgggtctcacacagtcccgtctaccactctgtggaagtgagcctgaggccaggacaggaagagccacactggagagctgaatatataagaaacgcatcttggccagaatagaaggcacaacctggagtgtaactaaagatgaaactttccctggagagtttgctgatggacacccataaatgtccagatactactcactggttaaggaatctgacctctggaggcctggaaatccactcctttttgtcagcatgccttctcctgtgctggggagggagaggcctccttagaccctcgggtcccactccctgcttagagttgtgctgtatcacccattggtccttccagcatcatgcccctgtcctgttctggagacgtgggagactcccatcgcctgtcctccttgcctgccaggggaaggcttcctgcggggcccctctccccggtgcagcctcacgtcttaccgctgagcaatggcgtctccactccagcctctttgaaacaccagcaccccctgctctcctgccttgctgcctttgttcatgacatttctcaccagcggccaaccagctccaacctctccactttcgcaagagctgggagatcccacttctggaagctctctgtgaccatcccaaccagaagcaccgtgtccctcccctgagctccagcactggccccgtgccggcaccactctttagtattttatattactttgctttctgtgcacatttcttacttccacatgtagctgactagcaccttggaggcagcagccgtatttttcagtccccacacctctagcactgtgcttaagtgagtgtttgagtggttcttaggattctcaataaagtggctgagttgccatgacccaggagagctcctggcgctgtcaccagagtgactctcagcgtggatccacaaatgaggaaacaccagtgagttctgtgctgtgctgcagaggtgtggga

SEQ ID NO: 102229 - DNA, 1042 bp, Homo sapiens
aatcccagcactttgggaggccgaggggtgcagattacgaggtcaagagatcgagaccatcctggctaacacggtgaaaccctgtctctactaaaaatacaaaaacaaaattagccgggcatggttgcggtgtgcctgtagtcccagctactcaggaggctgaggcaggagaatggcctgaacctgggaggtggagcttgcagtgagccgagatcgtgccactgcactccagccggggtgacagagcgagactccgtctcaaaaaaaaaaaaaaaaaagaagtactcagtgtgtattggtggccattattattattattattattattcctaaaacccatatacagtgttggcattaaccataatgtctacattacctgaaattaacagctgagtgctagcattacatgagtagaatttcctgtcccaggcaatccatggtatatcttaattttgtgatccacacagtctagccgaagcaaaaacattctgggctttgctgaccagtgattgccacaatttgaatttttagctatggtgttttacttttgtgacatagtaatccatagattttaccgttaatgtcatttgtttttcagttatatgtaagctttacataagtgctctgttataaagtgagctgtattataaaagatgcgcctttaaaaatgtttgatgtaattattttcttactaggcacgtgggaaaaagcgccagataggctggttcccagctaattatgtaaagcttctaagccctgggacgagcaaaatcactccaacagagccacctaagtcaacagcattagcggcaggtaaggagtttcgcatctctaactggaagatggtctgcatgccacttgagtttttccacttgattttctcattaaatatcttaggttgtttttcacatgtgctttaaagcacttcctgtacttgctgggactgacacccaactaatgtgatatggaatatgtctttcaaaaggaccagatatctaagtggcttttctgtgctggatacaacagaacccttgttggaatg

SEQ ID NO: 102230 - DNA, 1034 bp, Homo sapiens
gtgatgtgggcctggggtattttaactctggaagtttctgttttgctttatctaaattgaaaggatggttttgcctttcagcctttagaagaagccacactctctgaattaaaaactgtcctcaagagcttcctaagtcaaggccaagtattgaaattggaggctaaggtaggttttaaattatttatggtacgttttctcgggttattttaagcttaaaatggctacagaaagtactagtgaaatattagatctaactctatactaatttttctgtagttaaaattttgtatttattttaaatttaaatgattatctgactgtgcagttttacttttgcctttttctaggtgtaattataacctcttacatttgtgcaacacatttagcctttcaaaacacttttttgtgtgtcccatttgattagcgcgttttcacatttccagtcttacttcttttgtagactgatccgtcaatcttgggtggaatgattgtgcgcattggcgagaaatatgttgacatgtctgtcaagaccaagattcagaagctgggcagggctatgcgggagattgtctaaaagtgttggttttctgccatcagtgaaaattcttaaacttggagcaacaataaaaagcttccagaacagatcatattatgttcactgtcttttaaactggaatgtagaaggctttatttttatgtccttttttggtatcccctgagtataaaggccaaaaagcccttttggcctagagaatttggtttgagtagattatgtttaggaattaattggttagacacagcacctaacacatggtcactcagcaaagtctatctggtcctgcctgccaaaatcccgtgtctttaagggtttgttcagagttcctggtccctactagatcatcggatctgtgtttgatccatagccctccagggaggcctcttgcccttgatcctaacatgaacacacctagttgtaggctgctctgtagctttcaaggccatttcatgtacatctgaagctgcatgacagc

SEQ ID NO: 102231 - DNA, 1055 bp, Homo sapiens
tccattcctagcaaactaggaggttcgtgggaaggtgatttcccaagcaacttggcataatcctcattgggtaagtttaccccttagtaatagtaagtagctcaccctcatgtaatatgtgaatatacaaagagacaaaagtaatgattttaaggttatttaaaattttttgttgttattgagttaaatgcagaaatccttcaagtaattttgtttgatctattttcctttattgctttgaaggtgcgatgcttcagtacctctgtggtcagaccatttgccaagcttgtgagggtatgttaatttatattcttctgtaatgataaagtacgcgaaagtgtgagtcaaacagcagtacagtcagggcgtggatttttgtgtagttactatctaaacctttttgcgtgacttgtggttcccaaaatgtgctgtgtgcatagggtggggaaaggaatggtgttgagtatttgctttttgacaggcccatgcataatctttaaatatgaaaactttttaatcatttgtttttccattaaccctctaaaataggcaagctagcatttacttactttttttttttaatgaaagaaacaggtttaacaaagtgacatgcccaagttatcacaggaagttattacaggagacgatattaaaatcaaggtaccgggctgggcgcggtggctcacgcctgtagtcccagcactttgggaggccgaggtgggcagatcacgaggtcaggagtttgagaccagcctggccgacatgatgaaaccccatctctactaagcatacaaagattagccaggcatagtggcgcatgcctataatcccagccactcgggaggctgaggtaggagaattgcttgagcccgggaggcggaggttgtagtgagcagagatcatgccactgcactccagcctgggcaatagaccaagactctgtctcgaaaaaaaaaaaatatcaaggtacctgggtttctaatgcagttctccatgttccattctggtgagaaatattcatactcttcacaccctttctttccagtaggcaccaa

SEQ ID NO: 102232 - DNA, 1487 bp, Homo sapiens
gccttgcgccgcgaaggtccctagctccggggagtcgcgggcgaggggcacgcgcacggacgagaccgcaccgcagcgcacgcgcactggcgggcactcactcgcccgccgcccgggaggagaaggaaggcatggaaagttccagccggttcgagagctaggtagcaggcatggcaggaggcggggtaggggcaggcagggtcgcgagggggcgtgcggccgccgcgagccgctctgggccgcgtctgcagcaccgcccctagccgcggccggcgggctgggctggggtcggggcgggggcggtgcggcgggtgcggggctgcggagggggcgtggcggccgcccgcgggcggagagggggcggggcggcggcaaggcgcgcgggcggggcggggcgcgccgagggggcgtggcgcggcgtctgcgcagctgccagcgcctttaagcccgggctcgcgctctcggaccgtgctttcgccgcctgggagccgtccggcgcagcagtttctaggtccccactgtccccgccgtcccgccccttcgcgtcccgggaaccggctggcttccgagccgcactcgccgatcctccaggcatgccccgctacgagctggctttaatcctgaaagccatgcagcgggtaagtgaccttccctcagagccggtcttcccgcgcgggcgcccccgctgccgctaggccgccgtcccccgcgcgccctggccgcgggaccccgggccttcctgcactcctcggaggaggccggggcggcgggcgggcggcgggcgtccgcgggaagggggcgcgcgtgggccggccgggcccggccgcgtgcgcgcgggaggcgggggtgtgcctgcgcgtgtgcgcggtccgggagggtgtgcctcgcaagcggcccgccgggcggggggcggggcggaccgagcgggccccgaccccgatcccggcgccggcccgcgggagtccagtggaaggtccgcgggaggacacgcgcgggcgcccagcccgactccggcccgtccccgccagtcgtgaagctgcctcgtcgccggccccgccgccgccgcctggtccgtcccgctccgccgcccgccggctgccgccgaccgcctccgctctagcgcccgccggccgcccggaacgtccgcgcccaataaagcgttcctccaaagcttgtttgtgccgttgtctgtattccagtctcttgcaatcgctctcatgttaaaaaaaaatcttttgacttttctttttctgacttcagcgaaaatcccgctccgggtgcccttagcccagtttcattcatccaagttgtggcctttcttgcgcctccagaagacactttcttccccctgcttttgattgatcttgaggtaggggatttcaggtttggagggatgctaagcgaaccagcggcccctttcaggtgacggcgtggccaaggacaggggcccgcggcccggaggcagctcacttcgtcctctgtcctgg

SEQ ID NO: 102233 - DNA, 1085 bp, Homo sapiens
aagtcgtcgccgaaatccccattctcccgtgaattcggaattcggtaacgtagtttggtgttatgtttttttttctccaccaggtgtaataaaacaaaaatcattgtaccacgtccgaactttgtaagcacagcttcctacagcgctagaggagtggacgcatttttacgtttgaaattaggctccaggtcaattgcgaggagtattaccaagtttggttgaacttaagctcaattgataaactaacaatcacggagcgtcgggagattgttaggaagtgtgctttgcatattgttaactgggaagggacgccagtgcctctctatgaggtccagacagcctggccaggcatgccattgtgtcccccagcttgttcttcatggatttggaagaagttaagatagtatctgttcagcctcttgaatatcccttttggccctcctccttgcttaccagcatatgtaactccgaaaggataggagcagtgaaaacaaagcattattaaaagggaagatttttaattaggtggaagttgtttaagccctcccttcaacttacgtgttttagggaatgtggaacctgggaaattcgttactgaaattccttttgtttactttccttgtcttggggaggtagcaggtgacactgaaagaggcaacctgtaggcaataatatttgctcattctgtaaccctttgaaacctttgaaatgaagacttgccctcccctttgtttttgccatagttgccaagtatcttggttaacatggctgcaagtattaagtgtatttcttttaccatttttttttatgtcctgtaataacatagcctttggatgtggagcacccatttttcactctagttcagatcaacagagcgtaatttggttaaaataataaataaccttccttgaaatcttcgcatgagggaaggggggcaaaaaaaagaaaaaaagccctagaaagtagataataaaggtgaactgcctcttggagaaagaggccccatggcagtagatagaaggttgtaacagtggtgacttatgtacaatggcgaagttatgttgaggagatccttgacctaaata

SEQ ID NO: 102234 - DNA, 1085 bp, Homo sapiens; identical to SEQ ID NO: 102233

SEQ ID NO: 102235 - DNA, 1085 bp, Homo sapiens; identical to SEQ ID NO: 102233

SEQ ID NO: 102236 - DNA, 1065 bp, Homo sapiens
tatctgcttgaaaccaggcaacttaaaatagttacctagtaatggaagacttgaccctgtgaacaatgttatactttcatttggtattaaattttcttgggttacagcttattgccgcagcaagctattgaagaaggaaggagtcctgttcctgcccctgagctacagctaaggtacaaggaatggcttgggggtaaggagtccttcctcaccagatatggtttgtatgtatgaagactgcttgtcagaagttgacattttgcactaattttttttcttaattcatgactcacacattcaatactgatgtttctagattttaaaaatctaggttatatctagtattatatgcagactattgaatcttctaaccttttagattataaaatcagtttcaaaaaattaagagttcaaaagcaatgacgggaaaattctgaagtaatatttttcatctagtgcctttgctgtgtttgtactactacatgtttaactcatctaaaagaaacctggaataccataatggggtttaacatgaaggtggaaggaagggtagagaacaaatgataaaatactgtgtgattactcatgttataaaaagttgttgcaatttgattatcagacttttcctatttaatgttcttagctttgtgttagaatttccaatatactcatgagtttatctgtttttagtggaaggcaatatttttaagacgtgttatcaacacatgtagttacctcttaggggaatccttacttaaggaattagtcaaatgaatgtctggtaagttatcaatttgtctaaaggaagaactacccttgggtttggaaagtgacagttaattcagcctcttatcctttttgttgctttgaaattagagcaagagttggcagcctgtggcttccgggccagatctgacctgtcacctatatttttgtggcttgtgaagtaggaaaagattttacagttgaataggtggggaaaaaaacagcaatactttatggcacttgaatttcataaaactttcacatttcagagtccataagtaaagttacattggaacatga

SEQ ID NO: 102237 - DNA, 1065 bp, Homo sapiens; identical to SEQ ID NO: 102236

SEQ ID NO: 102238 - DNA, 1065 bp, Homo sapiens; identical to SEQ ID NO: 102236

SEQ ID NO: 102239 - DNA, 1032 bp, Homo sapiens
aataccccaccacctccatgaaaaaccagtctcatgttcttccaagttcatcttaactcatttggtacattaaacaaatatcaagggcctgcaacattaggagtataatagactaatctttcctttggttgcatgaatctcatcacgtctcccatcacatggatcactttctactttgtattacagttaattggtgaatatgttttacctcctttgctagattacaaattcttgagagctgagtctttcatgtttgttctgctatgctttgcatatatggtagatacttactaagctgccttgaggggttactactctcatctctataaaacagttatttgctatgatacagcgtgttgacctcgtgctagtagtttgcttacaagtcagtgcacttcgctcacgctgggtgagttgtatgttaccagaagttgtgttgatttccaagactgttttatgacaggtaatcttgtttccgtaaaataatttaaatatcatgtgagctgatgaaatgagtgcaaacctttgtttcctgaaaaccaagttggattctttgggaagacttgataaaaggtgagtcattaaaataatgactgtagaattagatatggctgaaataactcaaagtttgggaagaaaaataactaggaggattgtgtatgtggagtgttttacaaggatcttttaaactttccactttaatgaagctgaaactggaaattgtagataatgccatctgtagatgtcgcttagatcaagcagaaggaactcaaatcatcagggaactccaggtcatcgattccattctccaagtgcttgtcatgacccctatattgaggttggcaaataaatgtatgtttatgtgttgaataaaatacttaataaaatacttaaggtacgtatatatagttttatgactggatatggctttgggtatgaaggcttctgctttatagaaaaatgctgatttttttgttttctattataaatgagtagaaaaaccttgtaagatctgaaatgaagatactggat

SEQ ID NO: 102240 - DNA, 1032 bp, Homo sapiens; identical to SEQ ID NO: 102239

SEQ ID NO: 102241 - DNA, 1032 bp, Homo sapiens; identical to SEQ ID NO: 102239

SEQ ID NO: 102242 - DNA, 1231 bp, Homo sapiens
ggcctggttttgccagctttttttttctctcttcctcctaccagccagaaatccagattttataggaaatctggtttttttttttttgatgttgccaactaattgaatacttaggtaccatggatcaaatgtaatgtatctgtgggttaggttggctctcattttgtaatctagatattcagataattagctgtaggttgtctgtaaatctcttagcatttatgttgacaaagcccaccttgttaattggtcactggtttgcagtaggactgatttcagcaatggcaggcatattcaattcttgaaagtatctatagtttcggattgttgggttgtatatgtgcatttaggctaaaatatacatgtaggcttcagagctgcaccgtgtaaactgtgagggagtgacattcacagtccactttttctttcaatgtctgagtgatatcttgttttaggcatgtattagtactatttggtttgtacccgttgtattaacctcttaggtgtttgaaatactactggcatgcaaagattgctttgcctagaaaatatttttttttgctcagagtgtatctgtggaattaaaaatagtttacccatgatccctggaaaatagtattaccatgaaaaaaattcaggtgctctcttggtaaagattatagaggagggaggtgatgacatttttatttttgaccaggctttgtgtttccataaaatagaagccaagttattaccttgactaaccttctttttttgtcttttttttcactcccactccagatagataacatcaaattgcaaataaaacgaactcagatcccaggttgttcttacgtacgttttggcccaaggtgtaattgacttgttttgcttccccttgcaatcatttttactatgattacagtcccaggtaaggtaatttctgtccactttgggcatacctcagtagaggttggtgtagatgaaagcttaaaaatgaaattgcaagtgaaagcacagacttagcaaaacttctttattggagccctcaatcctcataaactggcatttttctgcttctgccccagaatcgagaattcctggttttgtctttgttttgacttgagtttttaaaagtttctctgtaacacctaccctggagtggttaagtgctttaattttgtcaggtgaagaaaccaagtgcagttatggtagccgggttgctgtggatataatccagtttgagaaaatt

SEQ ID NO: 102243 - DNA, 1231 bp, Homo sapiens; identical to SEQ ID NO: 102242

SEQ ID NO: 102244 - DNA, 1231 bp, Homo sapiens; identical to SEQ ID NO: 102242

SEQ ID NO: 102245 - DNA, 2031 bp, Homo sapiens
ctaatagttgatgagacagttgggagtctaaaatgtttgagagagctgcatctttaatgcattattttatctaatctttctatatataaataacttgggaaaatcctaatatgccttgcacatagttgacagtttaatttgaaaggaactaatatcacttctagtatattcaggttgtagggagtaaactgacatttactgagccacctccccattgcactgggcaatactagctttctctgttacttattccttataaatcataaggagcaagttggtttcattttaaaagccagacagttgagacttgttgaggctcatagagatgaagttgttgcctgagatcctacagttaggaagtgacggagcatggaacccagcccttaaaaactgtgctgttttcttctgtaccgtgccacctacatagatgtggtacctacacccacctcccttcttacagaatcatgaaatctgtctgttggggtggggagaaaacaagcttgggtatgcccatgttttttgtttttggtaggttacacaaaagtgattgtaattcaggtaattagttttcagaggtgtctgtgtgttctataacccttcaattattagctggctaagtgaatatttttcatttggatcagaggatgagcagggctcatcaagcttaccattgacagagtgctggactaggcgtctcagattgtaccttgagtgtgtggtttgtaaattgactccaaagctaaaagaggtggttgtttggtcacgtttaagattattgcgtactactctttgcaggccccgccctgtgtcattgaacttatgacttgaagccctgagtataggagataatttttcttgttccttgtttggttttagtggcaggtggttttttattttattatttttttgatagagtgcccatatatcctgctgtttacatatagttccagaataagtttctggtttggaagataaattatatggtcacccagacagtactagagagatctggtcatgataactaattacattttggttaacatggttatatcacctgaaggagtgcttatttaaatttggtcttacctttttttctctttctatttggtcaaatgcagcaaatatttatatttacacttctctatttggattaattcttcagttgcaatttaatttatccagatgcgtggaatagaaccaaaactgcattctaattctgtgcaaaacaataaaatactactttctgagaaggatgccttctcttttgggaagaaggggaatctgctctgtttcaaagcacctttgtgttcaaggtttggctaaatctgctcatcaccactaggggactgtttctttttgcattctacaagtattactcccattacagaagctttttaagaaaaaaatggactaccaaggaacccacctacatgcttttcataactatacctattttattgtcttataattttacttgagaggtttgcgtgaatgatgaactgtgacaaaaagcatatataaatataaaaatacaagttaaaaagcctcatgttagctgaagattcttccatgtgtattcttataaaaataagggaaccctggacagtgctcattgtattttgttgaagaaatgttaacttctttaaaaggaagaaaaacatatatatatatataacatactgtatattcagaaccatttttaaggaatgtagtttatctcttgaaagactgaaattcaaggctgtgactgtgactagagtgtaaaatatagctgcattgcattatagtattttatatatttctacaaaccaaattgacctgtttttggttttgtttttccttttccagtctttaccaggtgctggtctctgcatgtgttttgtttaagttggaaaaatctagacacgacccacagagtggtatggtatccagtgagaagggaactgtccgcagtggctttgaaggatatgaggaagcctaggcggagagttgagaattcagccttgagctagtgttagggtactatttggt

SEQ ID NO: 102246 - DNA, 1052 bp, Homo sapiens
gggtagcagagagccctggaggcagggtttcataactgcgaacagcagttttcattgtaattgacacagcagttttcattgtaattgacaagcttcccttatgcagaaacatttaacgatacctttttaaataatgtttactagtcatctgattagattttattaaaaatttagatgattcgtcctacataatgtcaaagcatttgtttaaaaacttggaagcttttgggggtggggaaggtggtcatagaaatatgatcatcttcaggatttggcaggtatgaagtgatacaaacctcaacttttaagatttttttttttttttttgcttttctctggcaatcaatcttatttatgccagccgttgacacttagaaaggatttaaatcacttttcatagcataattattgtattgcttaatgctttaaaaaggcacgcagatgggattgagacatttctatccaggcagttttttctgcattagacctaagaacctaattttgtagggcagtagtctctaggcattatgtttagctccttttgtcagtgagaagtgtgttgtaaagtttctaatactgtggtctgttttgaacggttttgagaagaggtagctttagtataatttataggacttaaaaggaaaatgcctagaatcatcagaaaaagcatggaaaaacattcttctctgaggttgccttattggaaaaggagaaatcatttagaagttaatgtgtggaaggcattaggttgaataaaattgttgttcgtattgatctgtcagctgcaattacaattaactgaaaatttagtatttgtctctttttcaggagagaagccgtcaaattttaatacatttaattttaggtatatttaaatgtctgttttgcagagtgattatcttaatccagaactgaaaaattcctgatggtcctactgaagatttatctaatggtccacaaatgtctgttttgttgaggtttggcggacataataataaatcattttttagtcttctgaaaacttttctcctcctccctcttttctctgcttc

SEQ ID NO: 102247 - DNA, 1047 bp, Homo sapiens
gttttgtgtggaatgtcgtgtttcccattagggcagggggcgtctcacaagatctaggttactgtatgacaactatatccatttactggagtttaagaagctttataacaatacatttccagagactaggcagtacttggttttctgtatttaaattttctgagggtagatgataacatctagtaaacaccacctgcctgttccatccaggaccctaactggccataaagttacccccaaactctcttaggattcatagtattttaagatttcatttttgtgcccttattacgaatataattagtgttttctcccctttagggtgctttaagatcttagtgcctgtcctaatctgagcataccacagtaagacaagaaagggcaatgctgtggtaggcagttagctgctgaagttaggccacttagttatgaggtagatgaatttctgtcctcagctcaaaatgataatattctcactgacaaaagtatcagctgtgatcatatagattgctctttcctgtggaactgaagtgtattaaaaaaattttttttcttccaataaagaatgtctcgttgcgccgggtttgctagactgaaagtttcctcatcacgtggcgagacctcctctacttcaatctttgtcttttgtctctgctgccttgcagggttggtacagtaggcttcactagacttagctgcaactcagaatttctcctccagcacctgagtaaatgctgatggtcttgtggagagtggattaagagtacgagctaagttctcaatcccaattaagaagcggaaaatttaaactgtcttcttcaaagtttatcacaaccaccaccatcaagacagcaaaccaaaggacaaagactttgaccctgctgtgttgctctgtgtagtccagttcacgtatggtttacagacttggctggggttactaaaaataaataaaaagttggacacttctgtcattggagcgctattattcacaagttaccagaatgagagctgtactggacacagcagacattgccatagtggccctgt

SEQ ID NO: 102248 - DNA, 1708 bp, Homo sapiens
cctttccaacacaaattcttgtaatgtctcccctaagaaagaagccctgaaaatgctgcggaatccaacagatgaagatgttccttggcctggattcattcttgggcagaccccagcttcagtatggtactggtgtgctgaccaagtcatcgtgcagagggtccttgcagccaaaaacattgctcatgccaaaggctctactcttatggctggcttcttaaagctcctgccaatgtttatcatagttgtcccaggaatgatttccaggatactgtttactgatgatatagcttgcatcaacccagagcactgcatgctggtgtgtggaagcagagctggttgctccaatattgcttacccacgcctggtgatgaagctggttcctgtgggccttcggggtttaatgatggcagtgatgattgcagctctgatgagtgacttagactctatctttaacagtgccagtaccatattcaccctcgatgtgtacaaacttatccgcaagagcgcaagctcccgggagttaatgattgtggggaggatatttgtggcatttatggtggtgatcagcatagcatgggtgccaatcatcgtggagatgcaaggaggccagatgtacctttacattcaggaggtagcagattacctgacacccccagtggcagccttgttcctgctggcaattttctggaagcgctgcaatgaacaaggggctttctatggtggaatggctggctttgttcttggagcagtccgtttgatactggcctttgcctaccgtgccccagaatgtgaccaacctgataataggccgggcttcatcaaagacatccattatatgtatgtggccacaggattgttttgggtcacgggactcattactgtaattgtgagccttctcacaccacctcccacaaaggaacagattcgaaccaccaccttttggtctaagaagaacctggtggtgaaggagaactgctccccaaaagaggaaccataccaaatgcaagaaaagagcattctgagatgcagtgagaataatgagaccatcaaccacatcattcccaacgggaaatctgaagacagcattaagggccttcagcctgaagatgttaatctgttggtaacctgcagagaggagggcaacccagtggcatccttaggtcattcagaggcagaaacaccagttgacgcttactccaatgggcaagcagctctcatgggtgagaaagagagaaagaaagaaacggatgatggaggtcggtactggaagttcatagactggttttgtggctttaaaagtaagagcctcagcaagaggagtctcagagacctgatggaagaggaggctgtttgtttacagatgctagaagagactcggcaagttaaagtaatactaaatattggactttttgctgtgtgttcacttggaattttcatgtttgtttatttctccttatgaacttaaggatatggtgagacactaacttaagacaatactgactggtctttggggaaaaaagttatgtaactgtgcatctctcaggcattgtttacgctgtaggttttagccaaattttacttagcagaaaatcatctaattacaagactttattttcccagagatggattaaagtaaatcttcaacttaagtgaagccaaacctaacagactgaattgtgcaaatgtggttttaaattttgcatac

SEQ ID NO: 102249 - DNA, 2204 bp, Homo sapiens
taaatgttgctgatgatccccatatttattgatcatattaaggttgtttatatagtttggaaatgaccagccccctaagcagtgtttgattaacttatgctaatcagatgattactcatatattctgctaattttctagctttattcttgttatttggaaaaattattagccaaatgccttcctaggtggatccagttggaagatatgtccagaaacctgaagaaaaattgacgctgcctttgtgtgctggattgctctacttgattagatcatgatatatcaaggttgaatttttagagggaaaatttaattctgatatcttattgcatccttgataagtttttccctgattttttttttcctcaaaagactttccatctgtacacagcctctacatttttgttgtagtgacttagagcataaggatgtttcagtgcaaactggccgtcggtaacagaaaactcagtgcatactttgctgttgttaggttgtcaatatagtctttctgtaggatggatagcatgtttgagaggtgccaaacaagaacttttggggttagtagtgtgtcttgtggagggtattacaggactgtgtaattataggactctaacttgacatggcttggcacccacttgcagctagtgggtacagggtacaaaagatgttagagaaaagctctacagattacgtacttctgtgtcttcgtatgctcaacactgtcctttgtcctccatgaaagatgaaggaagcaaattatgtatgtactttctttgaccttctttaatctctgatactttttagattgcatgattttactaggcttgtatttagggaaattactttcataaatacttttgtagattttgaatcaaaactcagtctttttaatttttttgtagtctataaactagtttcattatgatggacttgattagtccaaagttaattttagaaattgtcaggtagcatagtgtcttcccatgatcaggaggctttctgaaggactgagtctgtaaatgaaaaaataatttatgtatgaatagcatgtatttctgaagagcttagagtgccttgtagaatttttttctcaattttattcttgaggtttataatttgggggccaaatagatagagctcatcattttcttgtttggaagttgaggctgcgacatgtccaaggttatgaagtctcttttgggaagaacagaaaccaggtctccaaatctggactcatggtttgttcagatgtgtctggacaaatggttgtcaatgttttgtcctgttttttcaaaggaactgttcttcctttgggacaaccttttggtgtttgggaaagtaataagatcttggatttttcaaattaacattaagttgtaagaactaaaattttctttgaaccacattactgtgtaattcactgataattgacatattggctgggcagcctatctcttccatatccagcgtaaatgaataggaggtgtttgtgattttttttttctccctttatttaacattgagtcctagtagtttggagaattagggtccctctaccttctttctgctcttgtcttagtaagatacataaggtacatcatcttgtgtctgtgtgtatatagcagtaggtcaagtttagagtactaaagtctgtaaataaggaatgactattagcatattcattagaattgtttattcttgccagtataaacatcattttatttagactaaagtccctgaagcttgtctttcttattgcttcccagtaatagataatgtgctcgagtaagtttgtgaattgctgattgcaacttaattcagggaccagtcttcaatctatatttcattagaatgattgttcctggaatgatcatacatggactgtcttaagctagcaaaatgttcatactttacactgactaaatgggtcctaaatgatgacattggtctttagacattaacatgtgtatatttttatattagctcaagctaaggttcagaattgaagcttgatattgactagaatagctaaaagtcaaaatgaggtgaggacactggtcttggaaggtagagaaaaataaatgtcttaccaggtgttaatggtatccccagttcttagacttttgtcttctcaggcaattttcatctcaagatctgatgagaagggcatattacattggtatgcaggatgattattgcatatttt

SEQ ID NO: 102250 - DNA, 1008 bp, Homo sapiens
tacaagacctttcctgttaaattacgtgactacagagacttgccaggacaaaattttcctaagaaatcagaaaaatgattaagtgagataagtacctgggtgacacagatattagcccgttggtaaaagacaacaaatattagcttaaaatctgcatatgtagaatcattttcattagatttagagcttgaagcaccttggctctcagctactttaaactcctccccatataaatcagggcaccaataaataagtttcagctttttaaaccctggtttgatgttaagcattataaagtacgaagtttgttaccacagtagagataatttagtagaaaaatgctttgaggcttcagtatttgtaagattttgcattagccagatgctaggttgttgaaggcatttcagtgttgataatagcctgagcagacttctttacaaatgggatctgtttctatatgtgtatatgcccacttaccattcagagagactggtctttctctttgtcttccttcacattgctgtgtcagttctacacctagtcttttcagcacttagcaaattcaaattttgatttttttgtcagcttagttcactttaaggcatattggcatggtgtgtgaaagtgatgttttgccccagtattgaggacttttagatccaaataatgactcattaaatataattatgttttaagtatactgaatttctgttagcttaaaatgttaattctcaggaatgattttctcacactttgtgttggctaataataaaagcactgttttattctcaaaactcctttttcaaaaattagggagagagcagtagtgatcatttatgtgagcccctttgaaatgatggtgtcagagtgcagagaaacaatggagttttgatgccaaaaaggtttttttgcagtaaaagtaaaaatttggaattagttggcatatagaggaacccttttgtactggaacgtatgaggctggattgtgaaaaggtaatctttcgattg

SEQ ID NO: 102251 - DNA, 1944 bp, Homo sapiens
agcctaaatgttgtttcttttatatccattaaaaacttaaagttacttatgttctgtgatcttaattttgttgtgtttccattgtaggttgataggtatatcgagaacaggtacgtgacaacagtttatattccatgatagaaagctaaagtccatagaaagcacaaaatcgtgttcacacattagtgtacccacacatagaaagcacaagactaatagtattctctgtatcccacaagtgccagtcataaaggccaccaggtatttgtctcagagttgctatgagcactacagtattgataagcccaagacaatgcggtatctaaactggtcctaatggtaagggacccaaaggaataatctcaataagtttgtaccacattgatggagggagagaatataaatgtcaagaatgccaaaattatatttgggggttactagctaaaatggggtttgagggctttttactgcaacttgaaactggagaaatagggacagatgtctaggtttttggtgggtggaacaggtgacatatttctgttttaagctgtagtgtgattggggttttttgtaaaaaatcttaaatcttttaggaaatattacctcttaacagtgcccccccaaacatgcagaaagtcatactttaacagggcaaatactacttgtctttgattttttttgtgtacgtttgtatgtgagagatgaagttacctttatttttttcctatacttgactgtgcttcattttaataaaggataatttgatctgagtgttctgagcatcagactaattctgaagcatatttgctagaggagctactttgcttttcacaatggggtggagaggattctttcacttgtcccattaaccctcttctagtctagatgagatgaaatctgttaatgtgtgtgtagaagaaaacgtatgttcttctactcagcattgcccttttccacctcctcacttcacctccgagtagcttgtttatcaagaatgaatgaatgtctttgtcttaaattttgcccatgtgttaaaagatgtaattctcagaatgggagagaaatgactacctttgttcctactcttttatataattatccttttagggaaagacttggtcaactctaatatatctagaaggaagactatatctggtgtagactaatatgagatgttttagaagagttaacctgaacactttgagggagagattattcttgccagcaaaaagctagccaggaatgagcctaccacattatttgagaatatcaaacctcaggcctggggggatgaggggaagaagattaccagaagtgcaggaaagagaagtttgaggaacacccttggcttagcaacatgtgataatgcaaagctgttataacctgttaatcctacgtactatgtgttctgtacctttacatgtttttaaatttaagatagtttgtaagaactgtacaaaaaaatgcttctggagatttctttggcagaaatgcctttcatctataatttcatggagaactgctttaattagcctaggtgaaaagtagtcctagcagtgtaaatatgtataattagagttttctaatttcactgtgagatctctaacttttgagtggcaaacagatcaagtcttttgctcatagacttttctgtggggttattaaaatgcaaaagctttattttttttaataatgccatactccattagtgtcagatgatggtatggaatttgttcccttgctttcccccactgttactgcttcagtttatagattgccagcagagttcagaaatagagcagggatttacccgttctttgcttggacatcccattttcttttgtccagacccatgttggcaatcatgtatgaactgtgttatacttctcagtgctttcttttttctttttgataagatggatatcaaaaatagttgctgtgcaa

SEQ ID NO: 102252 - DNA, 1298 bp, Homo sapiens
ttatttttaagccaaatgtcagcagagtgctgctgcttttatctagtaattttgatatgtaagtattaatgcatttttaaaagatgtctacattgaaacatgttcttcccagtgtcctgcttatgatgctttgttcagattttttgtaagagaccagttagtacactgggggtgtatattgtgtacatgtgtcattttagttaggcattgtaggccaaatgtgattataaatgaagttgatgaacattaattttgttattagtgagttttttgaattgtaaatggatttccagtttaccttctgttgtctacagcttttttaattttaaggtttgactaattgtatccatctcattgtacagtgttttagttgcaagcagaaagtagaatttggtataaagcaggttatttctatattgaaaggagtacagttgaaattgtagatttaagattgttaaaatcatgacaattctaacttgtctattctaacctattgtgtacaatctgattttttaaaattgtaaacatgtatgatcttggtttcatgtgtttttgaaagtgttattgtttaaaaaatgaaaaaagcatatctgctaaagagctgtcagttttcattactgactctgtaaaatacactgttctttgtgtactgtgtgttattttgccagctgctgcattagccttcaaaagtatttggaaacttaagatgaactacatttcttgcaaagtacattcctttctgtggtattttgtcctgtaactgaagtatagtaattattttatggaaatgttagcaattctgtaccaactttgaataaaatgaaaaatttatatttctgtgactaagtattttcagtatgaacactgccacaatgtagtgttctgggtctcagagttgaagaagagtttgtacctcagtttcttttgcccttggcccatgaatggtttccagtgaatttccccctactaatttttgtcatttttaatctttgtaaacactgactcacaggtattgactgagaataggattatgtgtaaaacatagagtaaattaaaatattcttaattttttcacttccaattttgaaatttcaagttataggaaagttgttaagaatggaatgaggaatttaggacttgacttcatccaggctcaccagggattaacatactgcctgccacattggctttgccattcttctgaagcataaatattttttctgaaccatttgagatactatttgcagacattgttcccctttactccctgagtactttgcgtgtatatttcttaagaa

SEQ ID NO: 102253 - DNA, 1034 bp, Homo sapiens
gcacacatgcaaaaaaacatggtactaaatagacagccaaaggacccttgtttatgatatgtgagctgaaacaagggcgaaacattgcctttgtctgcctcagctgggaatgtgtgcaataggggactgcagttttccaccatgctgtgcatgtgtgcatatctacagatgactgcagtattgttgggggtattgatttgggggctacaaataaattttagcaagtaggcaaattggcatatatggattccatgattaatgagaatcacttggaattgtgaagcaaatacctatgtaaccaccacccataagaaatagaacattaccagcaccaccacccgcttcctgccaaggaggctcattccactttcagaaagttctaaactttaaaggattttctgattgaccttaaatctgtctctggcttttactcccaagttctacctctgaagtgttatcccctcccccacttctatttgaagagaaatgttgaagataaatgtattctgaagtctcaaaatcagacatcatgttcttcactctctgggtgtatagcacagggcatagatttcagacccttcaccatcttgctcttctgttttttcctctggataactttgaggcagttgaggttccttttcatatgtggcctccatgtttcagtaattgaggagagacactgctaataatgcaacaaaatgagagccaccattccctagggcttgcccccttccaagtctaatttgggatctcactggcataccctaaggtaggccccctgtaaagtcctgttgtctcttcataggagtttctgactctctttccagctttccatggcttttcagagttgaggtttttttttttttttgttgctgtattgttccccatatgcttcaggagttgaacatccatttggttttgtattttaatcccaagaatttttagaagtttggatgcactgttaagtgtttctgcctgtgccttagatgttgtttctgtcttttgtcttatttctagttcttttactctgcatc

SEQ ID NO: 102254 - DNA, 1031 bp, Homo sapiens
ctcatgttgtaggatttcctaggagtgggtgttagagaagatgggaatcaggttttagcgcggtaggaaaagtccaagagtagaagagtcagctctctctggcactcagcaactctgtggcctccccttctgtttctggcttctttgggcacagaactcaggttatgggtctcccatctgcattgccacaaggacccagcaagacagtctctgcagatgtgctctgcgacgagaatgctgcttgtagttatgtgagtcgagctgtcttgtgcaggtacagtacgtgtgatagggcctgagtggagtcgcgtctcacatcgaggctttcttactgcatttaaaccttctgccgtgctgcaaatttcatcttttgattgcttcaccttgttttgtgctagtgttcagcttcttgagaacacctctgaagagaatgcctgaggcgttgctaggcaacaggaaatgcacagtggctaggcttcttccacagtcataataacaatgagggatggagagcatgtgtgtctgtctgtctgtttcttttaaacttaatcacaaatgggtgtggttttaacagcgcagttatggatccttttgccttttttgttgaaagaggagcatataaaaactgtccgagagtcattagcgcagttcttggatggaaggcagtgaagaagtcagtttctccactcatgtagtacttccaggggtttctgcccttttttcaagtagaggatttgactttgttgagagttggcatgaccagcatcctaggatctgcactaacacgtagcctgagtaatgctgacgtcacttgtctgaggaccaggctcaagaactgctgtgttcactcagttcattttcagacctctgtgtgcagtggtgggggttgggggtgggtagccgtttctctttatgggtggaataaattcaggtcctggaggagcccactgggaccaagccagaactgctgagaacactagccctacttctgggttcccccctggcaaaggtgcatgtgcctcgctgaggaa

SEQ ID NO: 102255 - DNA, 1979 bp, Homo sapiens
tttacatttaagggcactgtcagaaaatacagttttccccctggacaactaggggagtcggggaagggctggcagcaccgggcagtctgcatggtgactgaatggtggaggggctaggcctctccaggggaggggcagaagggacatgagagctgctggctctcttacaaccatgctgctgtgaatggagtgtttttggtggcattgttttccagtattggggcacagtctgtcttggggaagccatttctctgagtgttttcagatctctagagggtttgggccatgtagtagagagttttgtagcatgtgagtgtcttaagaaatataaaggagggcacattatcacctggaagatcacgtgggcaagttctacctaggaagaagttcactattgctccagctttcaaacactgttatctgcagtgagaaatgcattagtgtcctgaacctttcttggttacttcttgcctggcatcagtcatctcctcacttccacttctgcagagttagtgtgggtcaaagttacgtgcttttctatagaaaagagagatgcttttgtgaagctgatagcaacttcatagaagtggtgattctataattagcaccacacatgtaaaaacaaacctttaaaatgtaaacactgctcggctttgtgttcaaggcaatgttggtgcttgcatggaccctggctacctggtaggcggaaccatgtcacttgtgccatgtagcacatggtcgaaggtgctgggaatgtgtaacgtaattagattttagactgttttcccaaaatgagctgtgtacttattgattcaatcaccaagagtagaagtggaaaatggaaaactagctatttggagagcttttgttaagtaagaatgtcagctttggggcatgtctagtcagttgcaatgtagtcaaatccagacgtttgtgccttgagtgaggagttgatcgtgagtccacgtgcgttaggacttctggtcttgtgttttgattctgcctagtttggctggggaagaagcagacactgatagctcattgtggttgtggagtcctcttgattctctcttttcccagggtcaggaggaagttggggcagagggctctaactcccctggagacactgagccccttttctggtcaccttcccttgaacagcagctcctctgattgttagaatggtttctccatggcaaccttcatgaggatgcagggagcgggcatcaagggagttagttccaaggccattttttcagcctaactcccatttttgtaggtctcttgtggacctgtgctgtcatgagaaagggatcctcgcaggcatcaaaagccacccagccccaccaccccacacaggttgtttctaggcctgactttcttcatgtgtaaaaatagaaatgcgggactgtacttggtgttgtcatagctgtaaaaagtctcattctcagtccttaggtcatctgtagttagcaaagcccagcagtgagtcaggggtccttgcctgtcatggacagtctcccacaggactgcggtggaagcctgggtttctgctcatgcagcagctcgtacagcctctctgcccagctgggctgcatattccaggaggatgagaccatgtgtgcctcatccatttaacctcctgaggtttgtctgtagtagatgctcattaacaagttaagtttgcccagatgaataggtaagaagaaaaggatatgtactggaagcaaccaggaattggtgaaggtcattcctgtgtgggaaaaccataatggaccatttatctgtgtacttgggtcactgaagcaggcagagattgactttatcctggacttctggtcagttctcttgtggcctgggagagacatcttggttccctgggagaagaggtcgggagggggttggtaagaggttcaacttcggagagtggcgaatacagtaaggtctgcctgtctcggagtcacttctcaccttcgctg

SEQ ID NO: 102256 - DNA, 1701 bp, Homo sapiens
gttgctggggagagggctgctggaccccaaccaacactcggcaccactttctcttcttccctttcctcaattgccacacggagtggagctgccacttctctttcatcctcttcctcaaaagttgtctgaaagctgtgaaagtactttgaaaattagagtcttatgaaagacacttcttttttaagttcagaaatatgaggtttctgatatatctggcttcctgtttccatccttgggtattctttttacccttatcacatcatagaatccaaaagctttgggtgtatttcttaggattattgagtgagtgctgagtatatggagaacactttcaggagggctggatgagaattgattagtgggcagttgagttggttgttggcatctgtaaacacactttctcttagaacatgttgagactcctaggctagctcacaagcttctaaccctgtgaagcagttgaatggaaaatggaagaaagcagtgcttgctatgaacaatatcataagtaagaccaagacagccccagaggtgctatttgaataagttgaatacttgactgtaaggaagggcaggcttggacttcctgtggactctctggagggaggggcatggagcactcggcagtggtggtgtctgggttacttgatggccagagcatgtcatgctcttgctagagcctccctcctgatgcatggcatttcagcagcacattactctaagcacagggcttcaaatggaatgaagcaagagaggaaggcttctagggaaactggacaaggccaaggaagaggcgggagctcagagaaaaactacctgctatagacttcagtgtgttgggaatgttggcagacagggtgaggtcataacttgtccgtggtagattggaaggacattttgatgaatagtgagtgaaagagcaaatggataaatgggaaggaaaaaagcattgggcccctgttgggtgagagttccctgtactgcccaccaggtggccaaatggaattattgtggggcaaggggagtgactgggtaaaaggctgagggttgcaaggaggtggtgatttgaggttgatcacactattttaagctctgttccagagcctaactcaaagtaagtaatcaataattaaatcttgaataaatgagtaattcataagttgggtcattgcaaccctattacctgctatatggagtagaaataagcaagtggaattaaaccttggaaaatgtggccaggattatgtgtagttttcagagtgagcccaagtggcagtcttgtcagtgagcaaatgtgcaagtcactgcttcaagaagtttgtggaatagtggattcgtttgtaccgtttttatttcgttgcttaaggaaccctgggagtcttcatcagctgtaattgctccctgttgcctccatcccacatcagctcattgaccaagtcctgcccattcagcttctaaactgccattttaaaatcatcagctttatagcgatgattagcatgtaataaactgcatatatttaaagtgtataatttaataaggtttgacatatgtatacactcacagaatcaccacggtcaagataataaacatatttgtcacccctaaaatttcctcctcctccttcgattccttcctctacttgtccttcatcccaagcaaccactgatcttttttctttcactgtcgatttttttcgac

SEQ ID NO: 102257 - DNA, 1028 bp, Homo sapiens
tgaaaggaaggggaaacttcagccaaggagaaaggactggctcactacaggagagccacgaggacatttcaactcgaagatttgcaaaacagcaacggatctgtgtgttttagattctgctccggggcgtacaaagaagccatggggcttcatggggctttggcaatattgccactccacctactgggaggctttggctacaaataacagaaacccctgcttgaaccagcatcatcaataagataatgcattctcttatataatacaaatgctctgtaggggagttttggagacagttgaataagtggtttaagaatgtcaacaattatccagttctttccatctctgcttttggtgtgggcttcattctccatctggtatcaagaccacggtgggaattctaagcatttcattaatgatctccaccaagaaaacaagtggctctgcattctgagccactcaagtactactgactacagatggatgggctttgagggaggacaaaatccaagctcccaatacccaaagtgacatttagatctaaagagacattttataggctatgaaaagacagtctgcttgccctgaattcaccaacaacaaaaaggaggctccatatcatagtggcctccttgaaattgcgaaacaatatacttcacaccccagggagtttcaattcagcctctatcccaaatcactaggcaagtggccacatttgagggggatccaatagcaagaagctttagaagcaatccaggcagcagtaaaggaagctttacccaaagcccctatctccttcagattctataaaatctcagttgtccattaacacacttccctaatggggttggacaaagagactccaccagtatttctaaacctcttaggacttgagggcatcctccacctagtaaaatgcaatgccgaacttgtagctgactcacaggtgagaagtaaaaagataaaacttgactgtatatcaaataccttttcaaaaagaactaccaaggaatggccaaaaaactgag

SEQ ID NO: 102258 - DNA, 1046 bp, Homo sapiens
cacactggttctctttttttctcagacctaaatttcgaccactcaactttcagcctgctcacccctgcttattgccatccacctttgggctgggttagacctaatcctccccttgacaaagccctcaaagtagccttcacaagataagagtcgagacccctaacttaccaacaaattttaatgaaacttctagtaaactcaaagcgctttgccaacatccttaggagcaacccagttctcgcagcaccccatgtgaggtcgctgttgaagtatctttggctgcagtggtgtggaattcatctcaacagagttgacggtaaagaccagacatgtagcagcctcactgcttgttggaggaaccacccttaagaaaatttcccaagatagtagttttcccatctccgtactttgctagttaatgttctccacttgcttgcgtttatcctttcaattcctttgctaattaaattgctgaaaagtatacattggtaagaatagccactgtcaatggactgcaaacaaaactcgtttctgttattgatgataaaccatttcagagaagaccaggctgagtctaaagggttcagataattacaaggggaaggcagagagagtagttcatggccacaggacttggccacctctgggcaacacataatgcttgctaagctaatgactgtagggatatagaactggccctcagcctctctgtcttcctttggcctctgctcttcctgctgccttctctctttgaccacgatgacacactttccataggccttcctcaccacatcacagaactcagagaagaggctgtcttcttgtttgatacacagctcgtctcttaggaacacccgatatttccaaggcacccatccttgactacccgcagcatgcacaatacaccaagttggggtttgtatgaaatatccatcactaatatcttccccagttacgagactttctgggatattggtttccccaaaatatacggtcttaaatccatcatattgcagtgttctcagggttttcagatattggaggca

SEQ ID NO: 102259 - DNA, 1096 bp, Homo sapiens
tgggaagtggcttttttttttttttctggcatctgatccagagtcccggagagggaggtgcagagctgctgctgggtggggaaccctaggggcaggtggagccctggctccctgtccctgagaagctgtgtcctctcagaactgtggcctaggctttggactttcagagcttgcctctgtggtatgaggagcggggagagactgattccaagagccctcctgacctcaatgacagtgacttaaatttccatatatactaaagtcacctctgctgattttctgtccatctaggtcaagcgtaattatttgcagtccctgtgcctgtgactcccatagccctgggagggggctgtcatcctatctgtgccacaaccagagttcatatgtccttttgccctccccattacagaccatcttacaattggtcctggaatcacacctgtcctgacgcctggacattgacctgcccatctcccggaactggcgttaggtgctgttgcctcactgcagttcttccctggcaacaactgacctgtgcttattttctctcctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggtgagcagggccctcgggtgggagggaggcagggggagacacagctgctgccctgcaccagggagcagtaccaccactacccccgtagctctcctgagcccatgccggcatgttttgtgagcttctctgtattcttctgcgccaccgtcccttgtgctgggagcatgcctgcctcttggcaccacctgcagtgttagagagactgcggctgatcgtggggaccctgcatcacgcccctccaccccccgcagtgtcccaggaatccattcctgtgtccactgagcacagcctgcgtgggaggcctgagccccggccccaggttctgtcgctccggatagggatgagtgattggactttggaaagggaaaatcgatgccccct

SEQ ID NO: 102260 - DNA, 1037 bp, Homo sapiens
tcttgaaaggattgatgatccacttcctcagtaaaaaatgtattgaggaggccaggcacggtggctcatgcctgtaatcccagcactttgggaggccgagggatcacctgaggacaggagcttgagaccagccttgccaacatggcaaagccccgtctctactaaaaatacaaaaattagccaggtgtgctggcaggcacctgtaaccccagctactcgggaggctgaggcaggagaatcacttgaacctgggaggtggaggttgcagtgagccaaaactgcaccactgcactccagcctgggtgacagagcaagactctgtctcgaagaaaaaaaaaaaagtaatgacatcatctagtcaagggtcatatgcaggtaaatttcaactccttttatttttattgttatttttcaggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcaggtgagttgggttcattgctatgcatgcttctccctcctccctccctcccttttgtaaagcagcttatacgttgcttatgttatatgctgaccggaaactctgagacttcaccttgagaaagacaaaattcctactctgaatgttcagcgtctcacttgttttaagaagatatcaaggtgcatttgaaagcaacctcagacattgcccctgaccttcctgggttgataatgatgggggaaagaaagccttccctgttcactggggagcttgcagggtgcagcggggtaggcgtggctatgcaaacaccctaaggtttgcgcagcaggtttccatgaatttgctcaagggttggagctcatgacccactctagactgagcagaccagagtggttccctgctcatgtggtgctgggggtactcagcagagaaacaggagtctgcagaagat

SEQ ID NO: 102261 - DNA, 1138 bp, Homo sapiens
ctaaggtgttgacgtcacctctttccagtagaaacttacactttgtccctgtctgcctgcaagcatgcaggacttgactcaggaatttgctgtccaaacaggatgctgtggaagctgcactttttttttccccagggagtgggggctggcccttactgctttataagcaccagctcaagaaggaacctacagcctcttggaaaggaatctcactaggggcttgactgcgtgggtctgtagcgctttcactgtaagaaagcaagatgcattttagaaactttaactacagttttagctccctgattgcctgtgtggcaaacagtgatatcttcagcgaaagtgaaaccagggtaaggcttctaatataacgtgattttctttagttttcaaagcattatgctaactgggactattaactgaatacttgggagaatgtggctctcttgtgggtttgggggttttgaaagaaatccaaagtctttcgagccttgaaaatcaaaagctgttgcctgaggaattaactgaggaaggaatttctaaagatctcaatatttgacaacatccaggcccctgaaccaactcactaggaaggcgagagttggggcatcgtgtgtttttcattctgtgtatgttgtaagtgaacttttcagaaagaggcctcttctgacagtgaatagtgttttacttttgtagccagcgttgtgaataatttcatttcgtcttaggaaataaatgttataaagatatttgtatgtttgtagtaattatgagggcctggcctcaagctcccagatttctctaacaagagaaaatgccgccagagcaaataataaaactggagaaattaagtgtgagatcagtgtgcctcctgggcagcagctctctttgatggtgattaatataatcattttaatcactacacttttcttcttcatttgattaaaatgtaagttttttcatcagcagctatccggctaattgagctttaataatactgtataggaatgaatcctgtatgctctatttgaggggtggtatttgtgcctggtggtgttatatgctttatatccaaagccatattgggacatgcgaaggtttctttttttaaaaaaaatcaaatgtaactccataattgtat

SEQ ID NO: 102262 - DNA, 1162 bp, Homo sapiens
cggccacagtgaaatggagctctgggcccagggtggccacatctccccgggccaccaccaccaaaaagaagtcagaagttctatttctgtgtgacacctcccaatttttcaatattaacaactaattttccgtcaatgttaatgggctacagttcaccaggagaaaactaactgggccattctaggcctgatggaaagggaacagctcttaggaatcagatactcggtgcaaagatgtgtgcccacattttagtcacttgacgggaacacctagattttcctgatgaaccaggttggcacagttgttctctctttgggtggacagagataatatccaagttgtggtggggtcttgcttgttctttgtatgtagtttattgttccttcagtatgttttgaatcattggtgaccttcatgaagatgacaggacatgcttcctcgtgtgacttgttatcaggcttttaagtcatcagcaaagaatgcaggccaaatgcagaaagaaagcgtttgcagtgccctgttgggacttctcaactgcagacatggaaacagggtgtgtgtatggtaatggaaatagcaggtaagagcacataactcacttttctcccagcacttggtgaaaaagaaaaaacaaaccaacaacagaaaaccatttctgacctgcctcttgagttttgaaactgggtgtggatacaaacgatctttagcgaagccattcagaactgggttttctgtctttattgaagagttgcagattttgatcttgctcatttttttccccttccctccatgaccctctcacctttactcctccgctgacattcagccagctattcaccaggtgccggcgtggtgtgtgcctggacccctcactgcgccagcctccctgggagaatcatctcctctaaggagagtatggaatgctgcagcggaaggaaaaggttttccaggcagcattaaccctggaaagtagaattcctactttgcgtgtgaaggactgacttgttgagaatgaaccagccgtggggttgtgaaagctgcttagcgcagggatgagggctaaccagacactggtgttccctgggcctgagtgaccacagccagcccactcctgggtgattgttcttccccaggtttttgctgctgcagtgctgtgcccct

SEQ ID NO: 102263 - DNA, 1014 bp, Homo sapiens
ggctcactgcaacctccgcctcccgggttcaagaaattctcctgcctcagcctcccgagtagctgagattacaggcgtgtaccaccatacccagctaatttttgtatttttagtagagatggggttttaccatgttggccaggctggtctcgaactcctgacctcaggtgatccgcctgcctcggcctcccaagtgttgggattacaggcgtcagccaccatgcccagccttttacagcttttaaaggaccataaatgtgtccccatattttcatcaggagtgcagtgaaagcacccttctcagcatggccctgcaacctcataggtaatgtgattgacgtcacaccactgggctcagtattcttctgttacattggaagaaacaaaaacttcaataatacttggtcttcacctgaacggtgcactgaaacgttctgtcatatttttttagccttttgaaaagtgttctaaatatttttgctactgactgtattacaatgattgcaaaaataaactatttccaagagagttctgttgtatatttttagtatcatcagagtatcagagacctcacttgaaaaatcattaaaaattaaattacatattttcaacttgtatgaattgtacattttattgtgaaagccatcttatgccacatccctttagaattagcatgggtagtgctgaccttattttaaacctattattattattattattattattattattttttgagacaaggtctcagtctgtcacccaggctggagtgcagtggcacgatctcagctcactgcagcctcgacctcctgggctcaagcgattctcctactttagcctcccaagtaactgggactagaggcgcacaccaccatgtccggctaatttttctattttttgtagagattgagtttctcaccatgttgctcaggctggtccgaaactcctgagctcaagctatcctcccgcctcagcctcccaaagtgctgagattacagacatgtaccacctcac

SEQ ID NO: 102264 - DNA, 1044 bp, Homo sapiens
actagaccgaagttctgaatttgaaaatagatttcagattagcatgagtggtgaaatattttttttctaacagaagtatgcctcttagagcttgtgttctcaactttcgaagtattcaggagtttctttcttttttttttttttttgagatggagtctcactctgtcttccaggctggggtgcagtggcttgatctcggctcactgcaacctccgcctcctgggttcaagcaattctcctgcccctttcccttaggccagaaatatttccacttctgctgcagtgttgtgtagtacattccagagtctcccgagtagctgggactacaggcatgtgccccccacgctcggctaattttttgtatttttaatagagatagggtttcaccatgttagcctggatggtctcgattctcctgacctcctgatcctcccgccttggcctcccaaagtgctgggattacaggcgtgagccaccgcgcccagcctcgggggtttctttttagtggaaattacttgtacctttcttactttgaagcattttgtttgtgtctacacaaattttgaaattttacatagaaccacagcaggatttagggggtggggaggtgggaggcaaagcagtaccattgatcaagtttgttagtttaaagctggtgtagtttggatgtttgtcccctccaaatgtcatgttcaaatgtgatccccagtgttgcagggaggcctggtgggagatgtttgggtcaagggggtagatccctcatgaacggctgggtgctgttcttgcagtagtgagttgagttcttactctatgagttcacagaagagctggttggttaaaggagcctggcacctcctcctctctcgctctttctcttgccatgtgacacgcctgctcccccttcaccttccaccatgagtagaagcttcctgaggccacaccagaagccgagcagagctggtgcgtgcttgtacagcctgcagaaccatgagctaagtaaacctcttttctttatacattacacagtctcaggtattccctgag

SEQ ID NO: 102265 - DNA, 1051 bp, Homo sapiens
tctctgcattcaaagactggatccgggaaggaattaatcagtgtccctgggcaaagtcttgaattctttattgtttgagattatgacatgagattatttcctcatctgtaaaatgtaaataacacctacctcagagccaagataagaaatttaagatgatatatataaacacctagcacagttgctggcacacaggatgtgcttaaattgtgagtcgctttttccttccttttccttccttttctctccagttgttcctcccctgtatcccatcaggcactccatcctgaaagctctgccacagtgatttctccaccttagcctctggcagtgactccagggtaggcaggtggaggaaggacaggccctgcctttctgtctgagctcatagatgctatcataagtgggtttctaatctaggatatggtaacacataaaacatcaccatggaagaaaggtgcgtttgttagtatttgtattaaattattttgagataaaagaaaaaagctcttatttgaggcccagtcttttaggatttatggtgattcctatatagcaattcttccaacttcaaaaataagctatagtctaaaaaaattctctctctgcacttgctgtttagtgctggaaggcattttccacagagacaatactgtattctcaagcccacagaaacctatgcaacctatagtgtgactaaataatactgctcagaggctactctaaaatttacacactaagtgatatggtttggctctttgtccccactcaaatctcctattgaattgtactcccataattcccacatgttgtgggagggacctggtgggagatcatttgaatcctgggggcggtgtcccccatgcttttctcatggtagtgaataagtctcacaagatctgatgggtttatcagaggtttcacttttgtttcttcctcattttcctttgccgccgccatgtaagaagcaccttttgtctctcaccatgattctgaggcctccccagccatgtggaactgtaagtccaattaaacttctttttcttcccag

SEQ ID NO: 102266 - DNA, 1048 bp, Homo sapiens
gatgccgtaaccattgtccatgttttattcataatttgacgctaaaacctgaaaagttgtcagtacggtttatgctaatacagctataaaaatgttcttcgatgccagctaagcagctggtgaggattacgttccttctgagtaggtctagcttctgacgcgggaggcacccgaggagaacgtgctcagccgcggaagcagacagacactccgtgtttacactcaaacaactgctgaaaatcatttcatgtcacgttttacttcatatttggatctgactttcttgaatggcatttttatttttcttagagtttgtattatctttttttgacgcattgtgtgctttatcagatcctcaagttcttgtatcttctcagttatgacaaacattctattattcacgtttcctattctggactggcttttcccaggacctgaggctgatctaccttctgggggctcttcttcgctctgtccctaagttgggtctagtgcatcctaaatctcatgtctttctcctttatggtttatgccatcattttgctggactacatttatattttctcccctagaaaagagaatgaaaagtcagttgtctgatttcttgaaaatatacgtagtatctcaccctcacgcttgattgatagcttatctgcaggtagacttctccagtggacattgtttctcagaacttctaggaaagctcattggcttatagtgtccaatttagctgatgcaaagactgatgtcagtccaacttccactcccttgcaaatgactgattttttgtctctcttgaaacatccttctttgtcttggatattctgaaatgctttgtggatgtgtcttcacatgggtctgtattcatagtaggcttcatttggtgagtcccttccattggaaaattcatcttctttagaacctgaggatttttgtagcgttccttaagctctgccctttgatttctgttctttctgggcctcctagtaatgctgggcctcctaaataggaactctgtatgtcttatattttcctcctttatatgttt

SEQ ID NO: 102267 - DNA, 1159 bp, Homo sapiens
agagtgaaactgtctcaaaaaaaaaaaaaaaaaaaggccctatcgccaactgtgtagtccagttctacggtactgatggttagggcttcaacacataaacttgtggggagtgaaggacatgaacatagttcagtccataatgctgttagagccagctgagctctctcagttatattcagagtgtctgcaggaatttattagccaacactgttgttcctaaaacaaccagcaagaggctctctctctctctctgacactctttagaatggcatcagcctccatctccacaccgcacagccaacccagcagccagtcctgggtgcctcttcagatgatgttctgggctcctctgctttttaccctccctctctcacccctgtctaaaccagtgtcctcccctgcctgtgttatcgcggaagcctccccattcttgcttccctcttgtcactctggagctctgcctctcaatggagcagccagtggtgttttgaaaacatgaatcaaacctggccactctcttgctctgagtcctctgagcacatttagcgcgggctccagatgcttgcctgggcatgtgaggacgtggcccgctctgccctctccagattcagctcctcctcgcgtctccaataccacagctgggctactctggccttgctgctactgctcccatgtgccaagtgtggtcccttcctcaaagcctggaattcccggaaggttcttcccccagatacccacatggcttactccctcactcctcccaggtcgctgcccagatgctccttcctcagaaatgtcttcccgagcccctagctaagcgagcgcaccattccccccaccccagaccatctgtcctcaaagtgtcttcatagcactggtcactccccaacatcagggtatataattgcctgttgtctgtgtttgctagaacgtcagcttcacgaaggcttttgtctcatttaccactaggtgcccagtaccttaggagcttggaagttcttagtacctaagaatagcacttgcttcatgaatatgtattaaattgataaatgacattctgtggctcaagtgagtccgtggtgtcaaaggttatgctgggcagactgcctttggtaatgagcatagacccctctttaggtccaaagcaacccccgggaga

SEQ ID NO: 102268 - DNA, 1064 bp, Homo sapiens
tttatagttacttagggagagttgacgtctttacatcctaggttcctgtggtgttattctacttatgtaagccatcttttctctactcagtacagggtggaagttttctttatatagaccctatctatttctttaatttgtatttatgttttagattcttcaatatgaacatttttatgtaaatttaagaaattatttaaaaatgggatttttaaattacacttatttttacctctatatagagaagattattgtttctgtgtattaattttgtaaccaaccacctgtgctaaagcctttgactatttctaatagttgattcttttgcattttctaggtataaaatcgtatcacctgcaaataatgatgatttttccatcttgtttataatacttcaaattgtatttcaacattatagaggcagcagatgggtattctcatcttatggaaacacgctagtctttcaccactgaccatagcttgggtgtggcaatatggtattttatctcaccttcaggtatcttgatgactttccctgttacagacctagttaccccaacagacacatctagctttctttcattacttttacataggctccaagctgacacacaattcttctttaaagaagcagcttcccgaacgttctgtgagccacatctccatctgcacactctcgatgctgccctgtggaggactccctagggtggtgggagtgtcctgtatccgcactgtccactgcagtaaccactggccacttgtggccactgagtgcttgaaatgtggtggacatgactgaggaactgaacttttaatttttttcattttaattaattttcatttaaattgtcatgttattgagcacttaaaatgtagctagtactaccgaggagtgtttacttttgctaattttcattgacatagccccatgtggctggtagctgcagaactgggctgcacgggttcctcgctcattcatggaagggtaagatatgaatgctagaaaggccctggtggccactcattgtgcccagagatgctgagattgggcccacatcacacag

SEQ ID NO: 102269 - DNA, 1062 bp, Homo sapiens
gcttatccctgtaatttcagcactttgggaggctgaggcgggcagatcacctgaggtcaggagttgaagaccagcctggccaacgtggcaaaaccccatctctattaaaaaatacaaaaattagccgggcgtagtggtgggcgcctgtaatcctagctactcgggaggctgaggcaggagaatcgcttgaacccgggaggcggaggttgcaatgagccaaggttgtgccactgtacttcagtctgggcaacagagctgtgtctcaaaaagaaaaaagaagtgaccccaagacggattctgtccagttactgcttgaagatttgccaaaaatagcctcacaaggccagatcacttgagtaaaatgtttctcaaaacatctgccaacattgaagacttttccaaatgtcatgatggcaattattgattgataaggtgacatgtctcatccactttgtccatcctggcttatgcctgtcatccaagtgaaatcattagtagcaccctctcccactctgaagcttgagtgataaattataattataggtcctctattcacttagcacttacaatcaattatacttacaatcaattataggtctcctatttacttagcacttaccacttgtgccagatattttaggtacatcatctctttgaatccttcttacagccttctaagatatatactattatttccccatttcatagatgaaggagacttcttcaccctttataaaaataataagcactgtggaatcccggggtaactggatatccgactctggggttctcgaagtcctgggaccagaaggttcttccaaggctgtgcctttcatctcttcagtgagaaattcgtgctgagaagggtgacgaaatttcctcaagggtgctcaatagatactagcaaaactcaaaagcaggtctttttttcttgcagcctgctggttttactctgcccacttaattctccaacgaataatgttctcccctttcccagcgccatccaaaagaacccggagcatacaaaccgggggacttcgggagtccaagccagctggaacc

SEQ ID NO: 102270 - DNA, 1321 bp, Homo sapiens
ggcagaggttgcagtaagctgagattgcgccactgcactacagcctggaatacagagcaagactctgtctcaaaaaaaaaaagggagcaaatccaaacggatccctgacattattaaaaagacttatttggaggaaaaaaagaggatttttttctaatctgatttttttctttttagcttcagctccataaaagaatagttttagccactatagtttaacatggaacacttcattgagaggactatagctaggttactaagtttctgagtatcaagagcagttaccccaccatatttctgaacaaagaactcgggaagctaaaccttttataacttggaaaggtccagtacttttccttttgttactaatttcagcaggtgccgcatgaaattcccatgtgcaatcataattaatgccaaagagagaggtatctgaggtcggcctgaattcacgattaagagacaaaaatattatttaattcagaaagttcctcaacataacaatagcatgtcttattttatcactgtattattaatcttctcaggctgccataacaaaaaacacagattaggaggcttgagcaatagacatgtatttcccacagttctggagcctgcaagtctgaggtcgaggtcccagcatggtctctttctggtgaggcctctcctctgggctgcagatggcccccttctccctgtgtccctacgtggtctttcctcagtgtgtggagagaggagcaagctctctggtgtctcttcttataagagcactaatcctattatattagggccccacccttctgacctcctttagcctaattacttccttagaggcctcatctccaaataaagccacactggggattagggcttctgcatttggacttgggggatgcaagcatttaatccatgataatcacctttaatttttgttaatctttgtgctttattttaaagataataaaatagtttctattcattaatatgaagtgctttattttgtatattaagtaccctatttatgtaatacatgtcacgggtgcacctagccggggtcagtgtcacaggcagtaaaggaatttaccaagacagttgcaggtaaagaaagccagatttattagagaaagtataaaaatatgttgcaagggtgcagcaggcagcacagcagagaaggggccgtctgccaagcggcagaggctggaaggaagttttatagggttgcgctggaggggcctatgtgctgaaaaaggtcactgtgcccggggttgtttgtgattggccatttctcagaatcactgttcattgttctctcccatctggg

SEQ ID NO: 102271 - DNA, 1405 bp, Homo sapiens
ttccagcctcaggacaattacataaaggaacaaaaaataggctttgtgctagagcagaatagctaaggcaggagctgttggttccaatgtttatatttcaggctatattctttgtctctttgtttctctccttttaaaaaaatgtgatccactcattttcatacatatcaccgcagggcctgtttgcgcaggtctgagaacgcatcactcctggtacagtaatagtgactgtgcacacatcagcatgtgtgggatgggtagaccctgggtgtacattgtctatgcagaatcattaggactcatctcaaggatgctgaggaagtgccagtcatttcacatacagttcagttgtgagagacaattttttcctttgtaaatactaatcaccatcaaagcataagaatgctgatgagacacagccgatcactctgccatgatctctgagcattaggaggctataccatggcagtagaaagtaaaaatgtctcttcttgggaaaaacagaaacattttcaaagtgtaacctcaggagaatattaattaccttaactcaaactttgacgttggggaaagggttggcttcatgttgtgtaaatttcaatcatcatagaaattctttaccatatttgatatagttggggtaggttttttatttattttcacctctgaagatttagctgggtttaatatgctcacattccccagtgaagtctacatgaggaggctgggaagcatactggttaaggctatgggtcttaagcatacctttcccacttatgcagtgtgactctgggaagctatttatcctaccgatgccttggtttccctgcctgtaaatggagctgttgatagtactcacattttatgatacacataaaatgcctgtcagagtgattgggtctgtatatacaatataggtttgtgtattagttatctactgccatgtaacaaacccaacacttagtggcttaaataataaatgttaattatgtcacagtgtctgtgggtcagaaattcagggatggcttagcctggtgcccctgcctcagagtctctcccaaggctgcaataaaatatcagctgtggtttcatctgaaggctgaactgaaggagtggtatctactgccaggctcacttgtgtgggggctgctgcaccctctccatagggtggcttgcagcatggcagcaggcttccctcagagcaagccagatggaatgggatccaccatctttttgtagcctaatctcagtgatatcccatcactttcgctgtattctattcctgagaagcgagtcggtaagtgcaaatctcactcagggagagggaattacaaaagggtgtaaataccaggacgtggggatccctgggggccatcctataggccagtggtccccaacatttttg

SEQ ID NO: 102272 - DNA, 1694 bp, Homo sapiens
ggttgtgcactgatgtccaattctagggtcctgtgagatatacagcaatcagtgaaaacccaaaaaccaggtgggctaagggagtcccagtctctgagggcaaatagctctatgcagtgggcaacctgagagctaaagtcacagcgggtccttggtaagccttgcagcaagtggaccatttctcatttagctgaaaccatccttctaggtgggaatatgtagtttctgcggtttcaatgtggcagtcttactgttaagactggggtgtcacctttggatgatgtaatgtaaatgtaaatctactttaggttggtggtatctccccttgtgtaaacagatcattaactgcaatgctgacaaaagtccctgggggtctggccgtcccctccttagccagtctgttggatctggagagtgatggtgtgaggaaaaaagactggatcaaacttctttatatatagtcacatgattctgtaagcttagtcttcaaggaaagaaaaaaaattaacctgaactagaattcttttgaaaatttacatcagaagctgttttgtaactataattgcttggccagatatgtaagatttgttttcattggctggctcaggatcaatattgtaaatactgtataatgagtttgttaattaaatgtattagattcacactgttacagatgaatgaaaacttttattaaaatatgattattttctgtttgtacaaatatttgatgaacatattccattatagtactctttttgtgagtctttttttcttttctatttagaaaagcaaaacaattcaaaatgctttgaaccagtaattacatgtgctttgaattgctgaaaatggttagttggttccctggaataagagtttattcagtcatcatcaagctgaccaggaatttaagagttctcagataatattccgttcatttccaagcagtgaatatagttccgtatagtaatggaaacaaatacccttttttcagttgtctgaaatatgaatgtatatttgattcatagagctttgctggaaggctaagtcagaaaattatagaaaaatttactcttttcgcttgagtaaacttacctaaaaaaaacaaaaacaactcacctaagatttgtgatagatgtagtgctatcatgactttcttttaataacaaaatattcggatcagcatgaaagaagtagaagtgacatccttccattctttatgtgagtagagacctttgagcagtgctcccaaccttagctgcacgtcagagtctctagggagctttgaaaaattcccatttccaggccactccaaacccattccaatctctggggctgggaatcgcctggaaagctccccaggtgattctaattgttagctgaggttgggaaccattgtctgaagccggggtttggcctgaccagaggcatcgttatatcttaaaaagatcactgaaaatttgatgaagctccacttctagctagatgacttaccctttctgtgccttgatttcctgaaccgggagccaggcccttggtctgcaggcttccttctcctgattgttgtttgaccctgtggcctacaggcggggtcactggtgcccacagaccaggagatggggcatttggtttaaccttaggttacctccgttcgccttaatgggtgctgctcactctccacccaaacggcagatcat

SEQ ID NO: 102273 - DNA, 1021 bp, Homo sapiens
taggcccagaggataaagcagggaacatttcaagctccttgctttcatggagcttaggatccagtggttgagggggagatagacaataggaaaaaggcaagtgaacaagatcatttcggatagtgataaatgcgatgaagagactgaaacagggatagagagcaaggggagggggcttggtcagagtggtcaggtcctaacactgtgggggttttgttgaagagctggtgaattggggcagtcctgagggaactaacaagggatgtccaggcctgcagccatgagcaacagctggaagctggagctgggggaggaagtcacgtggctggaaacctaggggaggagctgcctgccaggagctgtagacttgaaggtgtggagttgagatgctaaggcagggtacaggcagggaagaaattctcaggcttctgatttcattggcagaactcaaaggacagctaggaggcaagggagcccctgcagtggagtccataggttgggtcatcctttcagggcccacagaagggtagataatggctctggggacagtgtggataaaggggacttacacagaggagttagtagggagccactttagatggagtggcccagggaggcctctgcacagcctggaccaggttgacaggaagaagctccctggggaggtgtttgtgtggccggcatcccggcagagggactagcaggtgcagaagctccagtgcagggtgaactccatttttaaaggacttgaagggttgcatgagagacagagaggcgattggtagctgaggttggataagcaaccagaaaacatccccctggggccatggtaaggattcaggtgtgattctaattgcacatcttggtggagaatggctttcaggagggaaactgggtaggctagagaggaagcaaggagacctggtaggaggctgttgccatcatccaggggagataggaagggagtgggactaggatggtggtattggagatggagaaaggggcagagcctccatctgag

SEQ ID NO: 102274 - DNA, 1101 bp, Homo sapiens
cctagtttaaagtgcaagatatgagaacttttatagatgtcacacatcgttttttggcaataaaatcacttaatgatggaaacctttccaaactcctgttttcaagatattcttactgtagcacaagtttctggcagacagtgattactttctcacacattgttaactggcatcttgtgcttgaagggccaggtcaagctggtttatttatttatgttaaatcatcaccatggctcgaaccttgtaacctggctggcagttgctcatgcgcagaggggagatgtaccagctctgttcctttcttgccattcatctctgcttatgtccttagaaatagcttcataccttaagttctagggtacacgtgcacagcgtataataatgataataataaataaataaataagtaaaaagaatcctgaaaaaaaaaaaaaaaagaaatagcttcataccatttcttagcaggcatccttgccagacacttgcctgtttgtgtgaggactggctcagttaaagactagataatataaaccacacattctcttaatgaaaatttgggatctgcaataacagcacaattctggaagcagagaaggtgtgtggagccatgtcagcccacaccacctggcaccccaggtgcccatcagggggcctagtgcacccctctgatgcctgtctggcttctgcagcaagagcaagcaccagggtcaacccacataataaagcagcagaggaataattttcttttttagaaaaaagaaaaacctaatataaacagaagcgctaatatttttcactcatcccagtgagtggaggtcatcaccttccaccatggagaccttgacctatagggtggatgagcggggaatggtgggcaaaactccaccaaagagagctgcttcctcccagactgtctcgctctaacccctggactgcgacttcaggctgaggggctttacctaggtcagaaacacaggctaatttcccaagaacacatcaaacacaacaggtcaaaatgaaagccatctttcccatccagtctactcactctgctctgtcctgatttctacccacaagctgctcagtaaccggggaagaaac

SEQ ID NO: 102275 - DNA, 1026 bp, Homo sapiens
agaaggggtgtgtgtgtgtttcttccctagtgagaaggtgctgtttctggcttttttcaagaccctgggacataacctcaggacaccagcccctgagaggctgctgggaagagctggagcgcagtgctgctgtgtgaccccaaatctgctcctctccatcaccttggttttagaaatttcccgttgctgtggttgtaaggatacatgattctggcacacggcctcttagcacagttttgatggacagtagcagcttctggctagtctccctgtttcagttctctgtcctctccaatctagtctctttgtaatagccagtgagctgcggacaagatctgatcattttatttctttgtgtaaaattcttcagttgtttattgcagaatttcaggtaaatccccactccttaggcagcccacaaggccctttgtgatgttatttctgccttctttctttctggccttggcattgctgggtgtccccaccctttgttacctgtggtctcgctatgccacctggattaaactacttactgttccttgagggagccacgttctttcctgccttgaaactttctacattatgtaccctctgtctgaatggagtttctcctcctcgcccctgtctgccctcctgcctagttatctgccacaagtccaagagttagcatggatgtcatatcttccagtcccagtcggatgaccctgttaaggcattgccctcagcctgctatgtctctttcctcagctgtgtgaaattcatcattctatctccagcgcagaacacaggtgtgggatgtggtgaaggcttgaatgggcggctagctgctggatagtgtggtgatcaagaacacggactttagagccagtgggtctgggatcaaatcttggctttgctaatttcttgccgtgtgaccttgggcaagttacttaatcttttggtatcattgtggtctcattgataaaatggggacggtaatagtacctagcccttgaggttaccgtgagaaattgagaattagattac

SEQ ID NO: 102276 - DNA, 1410 bp, Homo sapiens
taccaaatttcctcttcaaagaggtgataccatgtaatgctcctctgacactatatcagtgccatgcttatttccacaaacttctctgctgaggtattatcaaatattttgaatctgagaggtgaaaataatgtccattgtcatgtaatttgcatttcttttattatgtgtgaggtcgagtatacttttatatatttaaaaagtatataagtattcttttatatattgatatttgtttttctgtgagatggctgcttatattctctgcatttttcttatgggcttttgacctattctttctgattttgatgttaaagaagttagacttttgtctgtcacatgtgttccatatatttttataagagtgtgctgactgtttgcacttgaaaatgtatccttttagtcttagtaatttcttgtaattgatgcatgggaaagcaaagtgtggatgatgatggcactcttagaatctccaacttcattcattgacatctttaaaggttgctttactttatactctataacctcttaaatcctgaagaatcaggtatttccagtcctacccctttccctccattttttttttttttttttttttttttttgagacggagtctcgctgtgtctcccaggttggagtgcggtggcgcgatctcggctcactgcaagctctgcctcccaggttcatgccattctcctgcctcagcctcccaagtagctgggactacaggcgcccgccaacacgcccagctaattttttgtatttttagtagaaacggggtttcaccgtgttagccaagatggtctcgatctcctgacctcgtgatccgcccgtctcggcctcccaaagtgctaggattacaggcgtgagccaccgcgcctggccccctttccctctatttttaattaacaggtacattttatcaagtgtatgcccttttagaatgaaactccatgtggcatggtaagaatcccttttcaaaacaaagtttaaactgtacagacaggaggatcacttcatgcctatatcaccccatcttcagatgtaagatatatcgctttgatctttgcataatatctactgaaatttatttgattcccataaatcaaaaccattgtgaaaatatcacctgtgatgcagtgatataaaaatattgcctctgaggttgtgtctcttggccagatattctatttgtgctccagtctgttgaaagaattgaccaaaatttatagagaatgaggagatccagagaattgtggaggacaatgaagcctacctatagcttatgtttacggagtgggagggtgatatggtttggctctttgtccccacccaaatctcatctcgaattgtaatctccacatgttgagggagggatgtggtgggaagtgattggatgatggaagcagt

SEQ ID NO: 102277 - DNA, 1010 bp, Homo sapiens
atgcttcttgctccacactgtcttatccaaacagattcttctcttttccttttaggagccattctgactctagctctctagtcttgaggctagacaagtttcttctcctttattcttggaaaagactttcattattttctgagtctgtttcccatagttggatcacaggaacttgtttggagcttccggcaggaatgtccagacccttgtatattccctgacaaaggacagacctcttgatgggtgagggtggggtgagtggggatctttctctggtccggctcacagctcagagagggtgagggcacagcgctgcctggatatccagcggtgcaggatcagcctcgaggccagtgctgtcaccccacagcacagccaagttatcatcacatgacattttcttctcgaaatagacaagcacatatctttccctatttaattgcctgctggtaccttattgtaaaatatttgcaagttattctctgtagagaatatattttatcgcctccttttcgaattccagttttctaaagcctcactttcctttatcccttaacacaggactgaaatatggcagtttcttaagtcactggacttgcctagattggatttagcgtaacacatgagcttatttggaaaatgccagcctctcctttgtgtggtgtaggtgtgtttgttcatctgcaggtggcagatgaagtgactcattaccctgacactgggttgctgtgttcgccatatgattcgcagccagttagggacattggtttcctggtcactgagcacaactgccccctttgaaaacaggagcctttgaatatctgctcctcaactgctttatggacaattacatgaagctgatttcagcctgggtcagggttagtgaatcctgaaatagtgtgggtgccccctccttttcttttccccagggtgagggtgggaaaggagttataatacatgtcaaaaaaaaaaaaaaaaaaaagcatgtggcacagaaaagaattccttat

SEQ ID NO: 102278 - DNA, 1007 bp, Homo sapiens
gatctggcccaaaatgtcaacagtgtcaacagttgagaaactctgatctacagatatagggaaccctgcctaatacacaaatcctccgtagttcccaagggcggcctgtaggtaagaaaaatgcagagagagccagtgaaccacaggacagccctaaagccagttggtgaaactgtaaatccataatcctaacaaaataatgtacagtcgtaacaaagtgagttttagagacaaagctttacaatttctggtaaaatttccacatgtgcaaaaaacagagtagataaatcaaggtcctacatctacttgtgttaacaaactagtgaagtgcataatagagaataccaggtgaactcaaggcagtactgtttctaaaattgtggaactagtatgaaagtagatatggagaggaggagtggtaatggtattccctgacattcgctcagcagttgctactgagccatgcattcgcttaaatactaggaaattatcaatttttcaactgtcgaaggcctataaaaatggcaattttctatcattcaacctaaatactatgtgtaatgtattattatatattaatattgttaggatatatattatgtataacatattgtgttagtagtaacatatttgtgcatcctttacattagtgtcaaattatcatctgctatattaatatcacagattaatttatattattggtatattaatatattgatcaaatagagggtcagcaaacttttttctgtaaggggccagagaataaatattttagggctgggcacggtggttcatgcctgtaatcccagcactttgggaggctgaggcaggtggatcacttgaggtcaggaattcgagacctgcctagccaacgtggtgaaatctcatctccactaaaaatacaaaaattggccaggcctggtggcgggcgcctgtaatcccagctactcgggaggctgaggcagtagaattgcttgagcccaggaggtggtgggtgcagtgagccg

SEQ ID NO: 102279 - DNA, 2260 bp, Homo sapiens
ctttcttttttgagacaaggtcttgctgtgttgcctaggctgaagtgcagtggcgtgatcttggctccctgcaacctccaccttccgggttcaagcagttctcatgcctcagcctcccaaatagctgggattacaggtgtgcgccaccatgccctgctaattttgtatttttagtagagatggggtttctccatgttggtcaggctggtctcaaactcctggcctcaagtgatccacccactttggcttcccaaagtgctgggatataggcaaacggccactgtgcctggcgtatactgtctcttaaccattaggtaagtgctggtcttttttccccctggcatgtttttggaagagagtgaataggtcttttaggcctgtgtagagacaatgatgctgtcattgttaacattttctgaatcattctgaaattttgagtagaatgtatggcagtataggaatctggatgtcgaaggattgatgaaaactttctaaatacattcaggcaacatgagatctttttatcggcaattgtgcaagtaaaaatactgtgatacataatttgtaatagagcaggtaaacttaggaataaaagctttagaactgcaacaactgtatatgagcatattcagttttggtttaggttggtgccctccaatagagcttttagcaatgacagatgttttttatgcattgtccagtatggtggccactagctctgaatggctattgtgcaattaaaacatagcttatcttaccaagggattgaattttaaatattcaattctaaataattaaaggttaaatttaaatagctctgtgtacccagtgattactatatcggatggtgcaggtctcagttctttccaccattttttccccaccatattttatatctttacataggtgagacaaatggacttaggtcaaaaggtttacaactggagaaccaagttggaagcaaagaggtttttttgcaaagaggaatctcttgcaaacaaacctggaacttggcttagtgagtcagtttttctgacatgtaagtatggctctttcagagcactagcactggggctgtgctcccctggagaggaagagccttaaggaaggaaggaaggaactcttgagtctgttaagtaaactgagtgtgttgacagtttgaacacactccttctggcagcaaaacaaactgcttggcttatttcgtattttgaatcaaagtaattcctttaaactggcttttaattttcaaaggtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacctggacctgctgaatcatagcccacatgtccaggtgagaagctgacaagggagcagctattctatttggataggaaggcttccgctgcccagaacctgtggctgtagatgtgggtggcaccacagggagaggtgtcggcggcttcaggtgaccctgtcaggttggcctgacgtcaggaggctcctgttgttcttctagaccccactatccctcccgcagtgcttgccttggccccttttcttcactctgctcttcaggcctacagagcctcgtgctgcatcctctgtccggtctttcccagcagcctgtggtgcggagccttccttccttctccctcgttcctccttccgggactgaagcttagcttgctttcctgccccgtcccttttaaactggtgttgtagctgtcacagcatttctcttcgctctgatcgctgactgacttgctctttttcccactgagctctgaaatctttgagaatggggtctttgtcttgttcctctttgtcacctcagtgctcatggcagggcctggcacatagtaggtgttcagtaaatgtttattgaatggatgggtatttgtggggaaagggttctgggaaataatga

SEQ ID NO: 102280 - DNA, 1113 bp, Homo sapiens
agcactttgggaggctgaggcaggcagatcacttgagctcatgagtttgagaccagcctggccaacatgacaacatcctgtctctactaaaagtacaaaagttagccaggcgcggtggtgtgccctgtagtcccagctactctagaggcttaggcaggaggattgcttgagcccgggaggctgaggctgcagagagccatgatcatgcccctgcactccagcttgggcgatagagtgagaccttgtctcaaaaaactaacaaaaaacaaaaaccactttcttctggaacattctctcacagaagttgggcagcttgctatgggtgtgtgcctgcatacatggccactccactcttcccacaggtgggcaagagataaccacagggaggaccaagatgctctttaaaaggatttggagtctgctgtagcacagagatagtggtggtgcaattagggccccaaaattctacatcacagggcaggctgcatcttacagaaaagtcaaagcatatgccacacaatgctccccttggccattagaattattattcaagtacccattaggtaattgaactttgagcaaattaacttcctcatataccacacgccaaggcaaatgatttcccacttgtgccccttgctgagtgaggtgatgtgtgtaaagttgttctccatgagtcagttacacatcatgactttgaactaaaatgcttgatttgagccattttctattaaggccccttctagttgatggtcatgaaccatattgtcagcctctaaaataatgcttgactttctgtttttgtgtgtcaaagatggtcagtaaaagccacacccttagatgtacagaacagagtttttccccagatgatcaagagagtcagtagtgtcagcagtaaacttgccgtgtctaaggcctgcccacatctctggtgtcatttgccctaggaaggatgggtttaaaatcatcaagcaggaatcagcagatggtttagatggaatacctgagaataggtcatctgtttgtaatttggagcagtaaagagttcctatttttaaaagtgagcacaacttgccctggccccagccccagatttcgggtgatgcaggtggc

SEQ ID NO: 102281 - DNA, 1031 bp, Homo sapiens
tttttttatttttttgagacggagcctcgctctgtcgcccaggctggagtgcagtagcgcgatctcggctcactgcaacctccgcctcccaggttcaagcgattctcctgcctcagcctcccaagtagctgggattacaggcgtgtgccaccacgcctagctattttttgtatttttagtagattaagctgtagtcactaggtctgcaagataaaactgttttagagggactgatataatgggaattctgttactgtagggatcatgatttagctcacagtataaacgtttcatgtacaaaagcacttgagagaaacagtttaccaaaacatacatttgtatacttaaaggtacaaagaacagtgattatcatataactggaaagtaaatcaaagaaatgttttttattttagattgagcatttccacagaaattacagttttgtcctttttgaaaaaatagaactgtatttcagaaaaaagaaactacagttttagcatgcagaaaggaaaagggagaacaagccggatcagaagacgaaaactctgcggaagttctgaatcaagaggaggtatggtttttcttttagtaccagtaatgaaaaaagaaatccttttgtgattgcttgtttgttcatacgtagcttttctttctttctttcttttttctgagacggattctcgctctgtcacccaggctggagtgcagtggtgtcatcttggctcactgcaacctctgcttccccggttcaagcgattctcctgcctcagcctcccaagtagctgggactacaggcgtgagccagcatgctcggcctaacacatagcttttctcaaaggcacacagtgttcaaagagaatctttcttttttttttttttttggagacaaggtacattctgttacccagattggaatgcagtggcgtgatcatggcttgatctcccaggctcaagtgatctcctcccttagcctccctcctgcctcagcctcccaagtacctgggactacaggtacatgccactgcacccgg

SEQ ID NO: 102282 - DNA, 1027 bp, Homo sapiens
aattattttgggaaaaccccaaagtgagaaaaacaagtgctgagtaattttcttgggtgtgcgcccatcatgcactgcaaaatgcgaatgtttgctttttcctaagatgcagtgacttacttagacacagtaactgcttctctggacataggttgccttgcttgcttaaaaggaactcaagagagggaactagatgccctgtgagcgcacttagcaggtgtgggcaggcgacatcgctctgggattcccagtgaatgtgcccccaagtgggagggaatgtttttatttaatcctacctaactcctacgggtgctaaaagtgtctgcatttaggtttgtccagggaggatatagatctataaagatctggattgatcatatgttctcacagatctgtgtaccggcaaagaaagttaaaccaaattcccaaaggtgtgtcaagctgtgggcacaaaattagagtctcatccatcgtcttcagtgtaaactgagttgtttgatcagtgactttgagatttggggagaaccatgacatcatcacgactcagccttttccatgcagagctggctaacccgcctgtgtctctgttactctgactctaccttctctctcaagtccttacttgaggttccggaggtgggcccctgctgtgatctcctactgtgcctcccccagtatttccttcttttttctcctaaagatcatttggtccgggcgcggtggctcacacctgtaatcccagcactttgggaggctgaggcgggtggattacgcggtcaggagttcaagaccagcctgaccaacatggtgaaacccccatctctactaaaaatacaaaaattacctgggtgtggtggcacgtgcctgtaatcccagctacttaggaggctgaggcaggagaactgcttgaacccgggaggcggaggttgcagtaaaccgagattgcaccactgcactccaacctgtgcaacagagtgagacttttcaaaaaaaaaaaaaaagatcatttggaaccttgttttaagga

SEQ ID NO: 102283 - DNA, 1029 bp, Homo sapiens
agtagctgggactacaggtgcgtgccaccacgcctggttaatttttgttttttgctttttctattttatctttttttgagacagagtcatactctgtcgtccaggctggagtgcagtggcgtgatcttggctcactgcaacctccggctcccaggttcaagtgattctcctgcctcagcctcccaagtagctgggattacagatgtgcaccaccacacctggctaatttttgtatttttattagagatgggatttcaccatgttggtcaggctggtctcaaactcccgacctcaggtgatccacctgccttggtctcccagagtgctgcgattacaggtgtgagccaccacgcccggcctaatttttgtatttttagtagaggcgggtttcgctatgttgcccaggctggtcttgaactcctgacctcaagtgatccacccacctcggcctcccagagtgctgggatcataggcatgagccaccgtgcccagcccctgtatacactgttgcggccccttcccacccagctgccgagagatggttctttcacaggtctcctgcttccgtgcaggtagcttattccagggacagggaagcaggaggaaaaagcactaggaggaagaccgcagactggattcagaacaggctatcgtggagagctgtgtgcttcgctgccggcctgaggctctgcgttcccctccttggtgctcaggctgcccggcatacgcagcaagtgctgacccagcaggcagcccacgtgcgcttcaggtgtgggaggctctgcgggctgcggggaacaggatcgctgtgggaggttgagcctggagctctgaacagccactctgcgcccaatctgctgtagcgctgagggtcaggaaggcctctgggagttctctagaagaaggcgctggggaggaggagttaacatctcatttcattagagcatgccagttctgttctgggtgtgacttttgaagaatattgagttctaccagtagaactttggggactgaaacctgttgaggatt

SEQ ID NO: 102284 - DNA, 1091 bp, Homo sapiens
atttttggctgtgctcaagttggtggcatctaattgcttaagtctttgatcagtctcctcagcatatgcttgtttttgatacaccaatggctccttccgcttttctgtgaagtggctgacctgcctatccctcttatggtggaacctcccttccgtgagcacctaggcatccgtggcacggccagggtggagatgggtctctgccctgccacgcacgactgcttagccactttccattggccaagacaccgcgctgcctagtgacattggttttggcaaatccagggtcagtgtgacagccagcaggtggacacacacagcagggtgagagatggcagcggctcccggcgatgaggaaggtggggcttccccagccaggcgaatccgctgtggttcttcatgcagcattcgcagagcagtgtgcagtgggactcgggaagatggggcgagcccttgaaccctatcctctctcatcaacagaacggatgctctgctcctgagactgtcgctggtggttggcaaagaggtgttttacaccgccctctgggggagcgtcctggccagcccgtccatccgcctccctgcctcagtcttcgtggtgggccacatcaacagggatgcccccggccgggagcagaagtacatgctggggaccaatcaccaactcacggtgggtgctgtgttcctcacagggcatggggaggaggcgacatgtgggcacagcatcctcatgggcaggttgtcactgaagctgcaaagggacatccaggaaagggaggtgcaccaagcttaagtctgggtaacgaacggctgagcaaggcgagaaggaggccttgtgcagttgaggctggtggtggcttttttaacatatgcattaaggttttttttgtttttgtttttgttttgagacggagtctcgctctgtcgccgaggctggggtgcagtggcacaacctcgactcactgcaagcttcgcctcccgggttcaagcaattctcctctctcagcctcccgagtagctgggattacaggcacccaccaccatgcccggctaatttttgtgtttttagtagagatggggtttcaccatgt

SEQ ID NO: 102285 - DNA, 1035 bp, Homo sapiens
cagagagcatgtgggtgtaccagcctcctctttgctacccaccgctctccttctcctgctttgggtgcctcctaaatttcattatacacttaacacagggattctctagtctggagagtgatgattttgaaaaacagaattgaaatacattcatgatttcaactgatacttaaatagcttggtgttaagagatgcacaattcacatctttttattttttacagagtccagtaaaaggtgaaaacggcaaaataattttggaaacaaaggcagtgattcccggtgacgaagatgcttcgtttccccctctgaagtctgaggacagtgggatcgggctcagtgcctcgtcaccggagctctctgagcacttgagggttcctcgagtttctctggaaagggacgacgtttggaagaagggcgggagcatgcagaggacgtttctttgcatccaagagctaatcgccaactttgccagcaagaacatttttggagtacagctgacagcgtcaggagaagaaagcaagtccgaggagcctgcagggaagagggacagggatgggacgcagagcctggcagccaatgattccagcaggaagaactcttgggagcccaagcccatcactgtgcctcagttcaagcagatgctgtcagacttgttcacagcacgagggtctccattcaagacaaaaagttcagagtcaccatcgtcttcgcccagcagccctgccaggaaaaacgggggagaatgggatgttgagaaggtggtcattgacctggggggttccagggaggaacgcagggaggcctttgccgccgcctgccacctgctgctggattgtgccactttccctgtctacctgtccgaggaagagaccgagcagctctgtgcaacgctcttccagctgccaggtgagaggcagccctgccgaagtccctctttgggaatcatacgatgaggcgattgacgtgggtggaatatcccctatccacaatgctagggaccaaatgtattttggatttcggacttttttcagat

SEQ ID NO: 102286 - DNA, 1057 bp, Homo sapiens
cgcctgaggtcaggagttcaagaccaacctggcaaatatggtgaaactccatctctacaaaaatacaaaaattagctggtcatggtgaccggtacctgtaatcccagctactcaggaagctgaggcaagagaatcgcttgaacccgggagacagaggttgcagtgagccaagatcacgctgctgcactccagcctgggcgacagagcaagactctgtctcaaaaaaaaaaaaaaaggaccttatttcttaggttttgccacatgcatgtgcttcccagccatctcgagccctcagtaaaaccatatcattgttatgggtttgttttttctgcaggaaatcagtagctctgatgagatcaccatgaagagtgaattcccgcttctgcgccaacattctgtttccagcatcaggcagttgatgccattcttcatgactctaaatggtgcatttaagacccagagacagctgcctgctgatagcccaggaactccattcttggactttcctgtcacagatagcccaaggatcttaaaacaactggaagaatgcatcgaatatgattttctggaacatccagaatgttaaccatgtgagagagaatatgtttaatccatgtattggtactttactgaaaaccaggttatattctaaagaagaaagaaggcaggatagtgcttttgaacaagcctatttccattttgaaagtagatttcaggctaggtgcggtggctcacacctgtaatctcagcactttgggaggccaaggcaggcagatcacttgaggtcaggagttcgagaccagcctgaccaacatggtgagaccctgtctctactaaaaatacaaaaattagctgggtgtggtggcggcgcctgtaatcccagctacttgggaggctaaggcatgagaattgcttgaacccaggaggtggaggctgcagtgagccgagatcacgacactgcactccagctgtgtgacagaatgagaccatctccaaaaaaaaaaaaaagtagatttcagataatttactgttcagcaacaggacacacctccctaaa

SEQ ID NO: 102287 - DNA, 1003 bp, Homo sapiens
ctgtcacccaggctggagtgcagtggcacagtctcggctcactgcaacctcctctacctcctgggttcaagcacttgtccctcagcctcccgagtagctgggactacaggcacatgccaccgctcctggctaatttttgtatttttagtagagacagggtttcaccatattggtcaggcttgtctcgaactcctgacctcaggtgatccacccacctctgcctcccaaactgctgggattacaggcatgagccgctgcgcccagccctatttttcatttttaaacgtatttcttcctacacctattctgagagaaatgagtatgctaaacaaggatgttaaatggagaagtatacagaaataaaaatgtaaaagccaccagaaacttggtttaacttggttaaactgaaaaggatcacaatttaaagaaatagtagaaagtaaatcttccatccttgtatgtaacttagcagaaaatgttgctgccttttcatttatttattgattattgtgtaccttccattgacactcagatctctttcccctacaatagccaggttagtctctctctttttttcttttttttccatttttgagacggagtctcgctcttgttgcccaggctcgagtgcaatggcgctatctcagctcattgcaacctccgcctcctgggttcaagcaattctcctgcctcagcctcctgagtagctgggattataggtgcccgccaccatgcctggctaattttttttttttttttttaatacagatgggatttcaccctgtcggccaggctggtctcaaactcctgacctcaggtgatctgcccacctcagcctcccagagtgctgggattacaggcgtaagtcaccatggtcagcttttttgtttttgtttttgtttttgtttttggagacagagtcttgctgtgttgcccaggctagagtgcagtggcacgatctccgctcactgcaacctctgcctcccaggctcgagcgattctc

SEQ ID NO: 102288 - DNA, 1099 bp, Homo sapiens
taggaataataatctgcttattttttattcttcttcttgttcatttgaaatcaaactgccatgttaaaacttagaaaataggctgagctcggtggctgatccctgaaattccaccactttgggaggccaagacagaaggattgcttgagcccggaattttgagaccagcccaagcaacgtagggagaccctatctctacaaaaaaaatttaaaaattagccggtcgtggtggtgggtgcctgtggtcggtcccagctaggctgcagttagccctgatcatgttactgcactctagcctaagcaatagtgagaccctatctcacaaaaaaaaaaaccttagaaaattatttataaatagtttttctgttatttaagtttatagagttagttttcatattgtaattatgaaaactatgttgtcaatctgagtctttaacttatgatatacgacagatgattaatttagcagaatcaaaagccagccttgctgcaattctggaacattctctgttttccacggaacagaagttactggcagaacttgatgctattataggcaagaaggggacgaggatcatcatttggaatcttagaaggtaaacgtggacatagatgttgaccgtttgggaagtaaagtgcacgtgcagggtggtggtgttatattcatctctcgttacacacagtagaaatacatggaaaggtactcattttttggtgtagttactgatttgtctttgcccaggatatgttatagaggccatttcagcttcaatttgagatattttcatcttgttaaaaaaaatttttttttgagacgaagtctcactcttgttccccaggctggaatgcgatggcgcaatctcagctgactgcagcctccgcctcctaggtttaagcgattctcctgcttcagtcccccgagtagctgggattacagtcgcctgccaccatgcccggctaacttttgtattttagttgagacagggtttcaccatgttggccaggctggtctagaactcctgacctcaggtgatccacccgccttggcctcccaaagtgctgggattacaggcgtgagccaccacacccggccaaaaaa

SEQ ID NO: 102289 - DNA, 2032 bp, Homo sapiens
gatgttaggtacacttcattcagtttcccctgctggtaacatctaacaaaactatagtacagccaggcacactggctcacacctgtaatcccagcactttgggaggctgaggcgggtggatcatgaggtcaggagatcgagaccatcctggctaacacggcgaaaccctgtctctactaaaattacaaaaaattagctgggcgcggtggcgggcgcctgtagtcccagctactaaggaggctgaggcaggagaatggcgtgaaccagggaggcggagcttgcagtgagccgagatagcaccactgcactccagcctgggcgaaagagcgagactctgtctcaaaaaaaaaaaaaaaaactatagtacagtagtactattgatattgacaggattttgatgttgatacagtcaagatgcaggacactttagtcatcacaggaatccctcatgttgctcttttgtagccatacccacttccctcataaccccactccctccttaatccgtggcaacctctaatctgttctctatttctataattttgccattttaagaatattacataaacaacatggaaaccttttggatttgacttttttcacttagcataactcctggcgttttccaggttcttgtatgtatagtttgcaccttttcctttttcttttttttttctttcttttcttttctttctttctttcttttttttttttttgagatagcgttttgctctttcccccagggtggagtgaagtatagcgccatctcggctcactgcaacctccgcccaccgggttcaagcgattctgctgcctcatcctcccgtgtggctgggattataggcacctgccaccatgcctggctgatttttgtgtttttagtagagacagggttttgccatattgaccaggctggtcttgaacttctgacctcaggtgatccacatgcctcagcctcccaaagtggtaggattacaggcgtgagccactgcacccagccagtttgcacttttttcttgctgagtagtgtttcattgtatgtatggaacccagtgtgtttacctattcaagacatctaggtttgtagttttgggatattacaaataaagctgtaaacatttgtgtacacagttttgtgggaatatagtcttcatttttctgaaataaatatctagaagtgtaattgctgtatcatatagtacttgcattttattttctaagaaatgccagactgttttcctgagtgttttcctaccagcagtgtatgagtgttacagtttctccacatcatccaggatccgttttctttctttttctcttgcctttgcacccccaaccccccactgacgtgcaccatgtgtaggtttatttatttgcttacctttttaatgacttacagtgtttgctggcttatcttgctgtgaagttaaattttggttctttctaaaaattatttttacagctacaaaaatgcaacagagttcgattttgaaaaggataaatatgatatcagaattcccgaggatttagatgagataacagggaagaaggggtacaagaagcaggaaaggatggaccagattgcccctgagagtgactattccctgagggtatgtattcagctctctttgtggaagtgagaaaatcattgaatgctggtagtattaggagaggtcatgttacctgcttgtgatagaaaggctgccagtgctctctaaatgaaagtatctcagacatgattttccctggcccactcagcctgggcaacagagtgaggctgtatcacacacacacacaaatttagttaaacttttcattagcacactggttgatttatttgtttggaaaccctttttaaattatgaagtcgtcaggcctaacaatgcttgtagtttttactatatgctgacattattatcttattagaatcaatatattagtcagtatatggtggccagactaattcaaaaaacaacaaattcaaagtcttattaaattttaacgtatttgcccgtgcacggtggttcacacc

SEQ ID NO: 102290 - DNA, 1055 bp, Homo sapiens
aggtgggggggtctccctctgtcccccacactggagtgcagtggtgtgatctcggctcactgcagcctccgcctccatacttgacagaaaaatcagaaaatgtacctttttgtacatatatacattttttaaaattaaaatgtgatcataccatacgtgctgttttgtaatctttttcacttagtaataaatatatcagcatctatatagatcagttgattgtattctgcaagtcatttttactggctgcggtatattgagcttatttttaatgaaaaataaccaaatcagaataacatacagctttatagcctattttattgaagagttaattgatcttttatcaagttaataggagagcttctgtgtaaatccatgtctaagtaatggtgagcaaacctgtagatactaacttcttgttatgttattttccaggcttattgcagtatattatatctaaagccaagaatgcagatcatcctacgtggacagaaagtgaagacacagctggtttcgaagagtcttgcctacatcgaacgtgatgtttatcgaccaaaatttttagtatcctttttctgattccttatagagatatgttagtcaggtgtattctcttttgcccctttccccttatatgctgatagggattctagtctgctctagctttgccctcctttgtgtgcttttggacttaccaaataatgaaatagaaaggatgatttgaactgagtgaggtgttgtgttcaaaatttaccttaatattttaagtctaaaacagtgagaattacctttggattcaactgcagaaataaagatcattatgggataatgatgtatcacagaaatagactcatcaaagcttatgaaaaagttggatgtcagttaagggtaagctttattttttatttgaaaagaaaatgtctattttccacaaaagttaggataatatatgctcttgagtcaaatgttaaataattttattgtaccttttgcctatagctttttaatgtaaatttgtaaaaaataacactgtggtatttgaacttttattaact

SEQ ID NO: 102291 - DNA, 1013 bp, Homo sapiens
ctcccagttaatctttgtgtttttttgtagagacagggtttcaccatgttgtccaggctggtctctaactcctgggattataggcatgagccgtcgcacccagcctaattttgaaagagttacgtcataatttttaggaaaggaattaaataatggcatcttgtggtagaaatgatgtggaacatctgatgaagtatttagagtccatatttctgtgttaatattttgttcttgttttgggacaggaagcgtcctgatcagacatgggttcagtgtgatgcctgtctaaagtggcggaaattacctgatgggatggatcaacttcctgaaaaatggtattgctccaataaccctgacccacagttcaggtaccatagagttggtagtaccctttttggaaagacggaaagtactgttcacagtgtatgaataggcgctggtgacatgttattcctatgtgatttttctgaatagaaattgtgaggttccagaagaacctgaagatgaggatttggtacatcccacttatgaaaaaacctacaaaaagacgtgagtgttgtattgatgtatagtgggtaataatgcccagatcatgaacagtgatgccttggcaacattatttgatgcttctccaaggtaaagcacctgtaactgaaaaagtttataatgtggagtgcgtaatatcaagggctttaaaaacaaaaacttatgctgtggatacctgctgtttatttcatgcttattgctgccatatgtgcggatgttttgtgtaagagcagtctgctgttgtgagctgtatgcagaggaatcattagtgaataccccccccattgaagcttatagagaaggtgtaacagaagaggtgatacatgaattttaccagttacgtgttggtgagtgccatagaagctctggtccagtgctgtaaggaagctcatagggagagtagttctgtctggtgggcaggagagcagaaatagatcaggaaacttcatgaaggaggtcatttttgt

SEQ ID NO: 102292 - DNA, 2094 bp, Homo sapiens
tgaaaaacaaaacaaaaatgattgcttgagtactcgaagtacagtttctgctgaatgggtattgcttttgcaccatcataaagttgatgccattgtaaatcaggggccatctgaatgcaagtaggcagttgtgcttcttgcttgagaagtttgggtcttgataagtctagtagcaaagaggtcaccacatggtaaatctttttggctttgtgggccacataaagtctctgttgcatattctttgttttgttgctttgtttcttcacaccttttaaaaatacaaagccattcttagcctacttgcaggctggatttagttcattggtttacttgttgattcctggtatagcacaaggaatttacatgtttggaattgtttttgtgtcttctgggataagggggaagaggaagattatatcttgtgttttgggcatgtcacactagaaatagttcctttaaggtgatgatttttccctccaacagattaatgctgaactgttgtttcggccaactgctctttcaactccaagcttttcttctcctaaggaaagtgttccaagaagacatctttcagaaggaacaaattcttatgcgacaagacttctaaataatcatcaagttccacctcagtctgaacctgagagcaacaggtcagtggctaagattggttttccatttggggaatattaaacagagcttttacttgacacttctgtgacagtgatgcaattcgggatcattgtaggttccattgtgaattgtaggttccatgaatgtgaaaatcttcaggacaaattgtcttgcttttattgtctaaacttaggctaaaccctacttctgccacctgttaaattcgttaaaaagtattaattgaccagcctggccaacatggcaaaaccccatctctactacaaatacaaaaaaattaaccaggcgtggtggcgggcacctgtaatcccagctactccagaggcggaggctgaggctgaggctgaggctgcaccccagcctgggcaacaagagcaaaactccgtctcaaaaaaaaaaagcattaattgtattcattgtagagtttgatcgcattctcacctgtttgaatttctatatagtatgacaattcctgcttttaagatgatcaggacttaaaaaaatgtgaagcagcccgggcgcggtggttcacgcctgtaatcccagcactttgggaggccgaggtgggtggatcatttgaggtcaggagttcgagaccagcctggccaacatggtgaaaccccgtctctactaaaaatataaaaattaggtgggtgtggcgttacatgcctgtaatcccagctacttgggaggctgaggcaagagaatcgcttgaacctgggaggcggaggttgcagtgagccgagatcacgccactgcactccagcctgggtgacagagcgagactccatctcaaaaaaaaaaaaaaaaaaacatgaagcaattaacagtacgacactatagtgacccagaagttctttgcaaagcctatggcacactgtaggcacttaatttattggaggagtggatggagaaggaagggacaaagagaaagtgatgcatgaattgaatagttagccatcttgactggattgatcagcgaaggctttgtgatgaggtggtacttacgttggttcctgaagttctgaaaacagtagtcttgtagatggcctcttccaatttaatagaatgaagacaagtgaagaagaatgaatgtgatgtctacaaacgagtggatcacactgactatactgatgtttgttattcgaagaggaacattgaaacaagcttctctaagatagtggggccagattttttttgagatgttttgtaacttttatcaaattctcaaaggaatttttgaccccaaggaagattataaataactaactgcctttatgcatatataaatcaaagagggcatattctagaatagtttgctcttcctttctttatttttttgagtcggagtttggcttttgttgcccaagctggagtgcaatggtgcaatctcaactcaatgcaacctccgactcctggttcatgcgattcccccacctcagcgtc

SEQ ID NO: 102293 - DNA, 1764 bp, Homo sapiens
tcagtgattggtactatacaatgcgtcactttaaaaaatgagcctgggtatttcttagtattgcaaaacttatagctgggcacagtggctcatgtgtctaatcccagcactttgggaggctgtggcaggcagattgcttgagctcaaggagtttgagaccagcctgggcaacatggggaaaccccatctgtactaaaaatataaaaattagctggacgtggtggcgggtgcctgtaatcccagctcctcaggaggctgaggcaggagaatcacttgaacctgggaggcagaggttgcagtgagccaagactgtgccattgcactctagcctgggcgacagagtgacactccatctcaaaaaacaaaaaaactgttacaatactgcatttgttagaatgattacttcaaggtcatctattttgtccatattttataatcttatgttttatgtataaaatttttttcagcttgaaacggagactttctactcgttcctcaattttgaatgcaaagaatcggagattgagtagtcagtttgaaaattcagtttataaaggtgatgatgatgatgaagatgtcatcatcttagaagaaaacagtacccccaaacctgcagtagatcatgatattgacatgaaatcagaacagagtcacgttgagcaaggtggtgttcaggttgagtttgtgggtgacagtgaaccttgtggccagactggttcaacaagcacctcatcatcccgatgcgaccagggaaatactgcagctacccagactgaagtaccaagtttagttgttaaaaaagaagaaactgttgaagacgagatagacgtaagaaatgatgcagtgattctgccctcctgtgtagaagctgaagcaaagatacatgaaacccaggaaaccaccgataaatctgcagatgatgcaggctgccaattacaagaactgagaaaccagctactccttgtcactgaggaaaaagagaattataaaagacagtgtcatatgtttactgatcaaatcaaagtgttacaacagaggatactagaaatgaatgacaagtatgttaagaaagaaacttgccatcagtccactgaaaccgatgctgtatttttacttgaaagtattaatggcaaatctgaaagtccagaccatatggtatctcagtatcagcaagctttggaagaaatagaaaggctgaaaaaacaatgtagtgctttgcaacatgtaaaggctgaatgcagccagtgttccaataatgagagtaaaagtgaaatggatgagatggctgtgcagcttgacgatgtgtttagacaactggacaaatgcagtattgagagggaccagtataaaagtgaggtgagttatatcatccaacatgtagtcatggagtccagggccatttaaaccttaagaagctgccagttggctgggcgcggtggctcatacctgtaatcccaccacttggggaggccaaggcgggtgggtcagtcacttgaggtcaaggagttcgagaccagcctggacaaaatggtgaaaccccgtttctactaaaaatacaaaaattagcctagcgtggtggtgggaggctgaggcaggagaatcacttgaacccaggaggcggaggctgccgtgagccaagattgcaccaccacattccagcctgggcaacagagcgagactctgtctcaaaaaaaagctgccaattgcttgattggaatgctttcacttaaaaataattctgttcttattgagtgtctgttattc

SEQ ID NO: 102294 - DNA, 1820 bp, Homo sapiens
ggcctgtgcttccagctactcaggaggctgaggtgggagaattgcgtgaaccctggagagcagtggtgccatcgcagctcactgcagccttgacctcctgggctcaggtgatcccccacctcaccctcttgagaagctgagactacaggtgtcgtcaccaagcccggctaatattttgtgtttttagtagagtcagggtttcaccatgttggccaggctggtctcgaactcctgggctccagcgatctccctcctcggcttcacaaatgctgggaatacaggcatgggcaagtgcacctgactcataaaagtgaattattaaagtaaattgagttctctaggggaggttttgcttttccttttgtttaattgtatattattctacggagatttgattttgatattttactttttaaggtctacatgaatcttaacttgtaatgctcatctaataagttacatatttgtatttgcagcctcaaactccgatctcttcgagttaacgtaggacaactgctggctatgattgtgcctgatcttgatcttcagcaagtgaattacgatgttgatgtagttgatgagattttaggacaagttgttgaacaaatgagtgaaatcagtagtacttaaagtatatgttatgtaagataaaatatttgctcaattcttttggttgtacagctttcaaaatataattaattttgttttatagatatgataggcaacagactgaaaaccataatctttactgtattctatgcattcaaatgtggtcacaaatattgtggacacattatcttatgttttgaaatacctgtgaattgttggcattgagcagctgaagctaactcatgactctgttttgaatgtaaatatttgtaattaagcctgcacatatttttttattgccctagagtactcaagtgtttttcaccaagagcttttcaggttgcccctaagctttgtgcaattttttctggttccccaaagtgtatttttctctaagtcgagggctatgccataatacaaatggaaatgttacctttgattttcttataaaggagtttaaataggatttttaaataatgtagtaacactcctgatacaactctggttataagtgaattgagcattaatgtttcttttgtataaattcctgtcctgaaatattttattcatgaaaataaggtaagcaaaaaccaactccattttgccaggattttgttgtgctgagattgccaatcacggttaaacacaaagtgtttttatagaatgaagaaacagtctttaacagaaaaaaggtattgaaatattaaatggccaccaagtttactttgaagcccatttttggctgtttagtcagcatgaagtgggcatgataattttttaatatttctttttgtgaaatttcctgtacagccttttgtaggattactacaggttaatgtgagttgaggaagacagtctttctcaaacaatactacataccttttattatattacaaacctaagtgttttatatcctagagtcaaggaacaaatttccttaggattatagtattacatgccataaaatactatgctttattggtcccatgttttgtgcaattttaaagagatggctttctattaagtataaactatgtatatataagaaccatattttccacaactaaaatgtgcattattttttccaaagttttatcattgctatttatttttacctttgtttttgaacattcaatccgttcattttgtatgtatgcttaatacgtgtcggtcatatacagtattgaatttttactgtatagtaattctgg

SEQ ID NO: 102295 - DNA, 1718 bp, Homo sapiens
gcgctaggtactgaacaatttcatagctttgaactctccaaaatgttctagaagccaatacagaaaacccaaaaatctcagtttttgtttgcagaaggggcaagagaaccggttgtgttagccctccaagtgcccagcgccagcatagggtctgtctaacacacagcccaggctctgtaaacctttgctaaaagagcgaatcaacaaggaataagtaatggataataataataaataataatgaatccattcttccttcggtcgtgggtctggcaggcataaattccggccgggattccgaccccagggccagagcaggactcgccttggcgtctatgagtgggcggggcttccctggggtaccgcccacgtcgggcgggacctgagggccgctggaggggcggggcgtctatgaggtcccgcccatgcgggggcggggcctgcggcgcgcgggaagcggcgcgcgctgcgcgggaggtgacggtgcctctgactgtccgggtccctccaggtacggcttccctggcccgggcagctccgcggctcttttggtcgcgtcggtccgggccagaggccctcgccgagggcgggcccctgggccccgggatagctccggagcggcgcgcgttggggcggcggggccccgtccacccccggccccgcgcggcctcctcccggcggcctcagtcccagcttcccgggcccagcgcccggtccctgggaaaggcggggttctcctctcgccccgccgccccggtcccctaccccgtttggccccctcttccgggaggctcctcccggggcgggcccctccccgggctctcagggcgcgcccctagcccctactaagcggggacaggccgtgcagacggccggggcccctaggtagcctttacctgggtgtttcgttttgcttttctggatgtagcggcgtatcataaacttgtggatgtcaggacccagcgaagcattttaggtggagctagcaaggtgttattgtcagatggcaacgttaacatcctttcccaatgcagtgtgcattttaaatggctcctggcccctattcagcgctcaataaccctttgctgctgttaacactgttgtttaatccatcaccagcattttgcagctttctcctgtcttgaagaagtagaacggtgcccgagaaacgtttttccccttcgagactcaggaggatgaaagtcatcacttgtgaaatagcctggcacaacaaggagcccgtgtacagcctggacttccagcatgggacggctgggaggatccacagactggcgtctgccggcgtggacaccaatgtcagggtaaactggggcagagatagacatccgggaacactgcttgaagcaatagttttcattcttttacttaaaaccagtgtcggctgggcgcggtggcttacgcctgtaatcccagtgctttgggaggctgaggtgagaggatcgcttgagtccaggagttcgacaccagcctgggcaacagccagacatgaaaaagtagcgggacgtggcagtgtgcagctgtaggcccagctacttgggaagttgaagtgagaggatcgcttgagcctaggagtttgaagcaagcaacgatcactccactgcactccagcctgggtgacagagccagacccttctcttaagtaaatgaatgaatgaattaacgtatgtcaacaaactaaactactttgtcatctagcc

SEQ ID NO: 102296 - DNA, 1146 bp, Homo sapiens
tgccaacccttgcactgagggttctttgctgttttgtttttctattcagctatttataggttatgccttcagatttattaatgtagccagtcattttgcagtggcatttgctggcctagggacccttctgtttaaggtgattttgtatagctctgatctgttatgaatttgattttggagttttagctcagaaggcaatttgcctactttccctgttgaaatgcttggaagtaaatcatcctggccatagtgtccactgaacaacataaatgttgttttaataccctaaaaatcctgacatgcagctaatttttttgtatttttagtagagacagttagccaggatggtcctgggaggcagaggttgcagtgagccaagattgcgccactgcactccagcctgggcgacagggtgagactccgtctcaaaaaaaaaaaaaaaaatgaaaataaaaatcctaatatgaaggagtgtgggtgaagcgtggatcactgttactgaatcaccctgcagatgctgtcatcctattgtggaaggtgaatgataacaaggagccggagcagatcgcttttcaggatgaggacgaggcccagctgaacaaggagaactggacggttgtgaagactctgcggtaacttgggagggaccatggcagtgatctctgtttacgatgagtgcattaaatggaatataccttttgactttttttttcttttcttttgagatagggtctcattgtcgcccaggctggagtgctgtactgtgatcacagtaccctgcagccttgacttcccgggctcaagtgatcctctcacctcccaaatagctgggactacaggtgcatgctaccatgccctgctgatttttaaattttttttttttttttttttttttttttttagtatttattgatcattcttgggtgtttctcggagagggggatttggcagggtcataggacaatagtggagggaaggtcagcagataaacaagtgaacaagggtctctggttttcctaggcagaggacccagtggccttccgcagtgtttgtgtccctgggtacttgagattagggagtggtgatgactctgaaggagcatgctgccttcaagcatctgtttaacaaagcacatcttgtaccgtc

SEQ ID NO: 102297 - DNA, 1054 bp, Homo sapiens
cctcccccggtccacatgtgtgatccttgcttgttgatgggtctgtctgatctgtgggctccctgagggtggggactgcatgaagtcatctttgtgaccccagagcctgacacagggttttagtacagagtctctcacttactgcctgctgagtgatgcgtggtaaagggaataatatttaagtcatagtttatactatttgggctcaaacaggttttggtaatgctgttttggtgcgtgtgtgtgtgttttttttgtaggacaaaagatatcaatttttaatgaacataaaagttatgtccaaggagtaacctgggaccctttgggtcaatatgttgctactctgagctgtgacaggtaaattcagctttggcatttacttggaatttctttgtatttacttggaattttctgaagagaggtatttatcgtaacttagccaagatttatcatagtctaactttgattcttttgttcttgttttcatactcattcttacaacataatcagaaattggaaattaattaggacaagtgccttacacgaagtttgtacttagtaaatctttttttttttttttttttttagacacagtctcactctgtcacccaggcaggtgttgtggcgcaatctcacaatctcagctcactgcaacctctgcctcctggtttcaagcgattctcctgtctcagcttccctattagctgggattacaggcacatgccaccatgcccggttaatttttgtgtttttagtagagacagggtttcaccacgttggtcaagctgttctcaaactcctaacctcaaatgatctgcctgccttggccaatgtgctgggattacaggcatgagccaccatgccccgccctgaacttagtaaatctttattattattactatttttttttttttttgagagaggggcttactctgtcacccaggctggagtgcagtggtgcaatcacagctcactgcagctttgacctcctgggctcgagcaatcctcatgcttcagccccccaagtaattgggactacgggtgtgcaccacca

SEQ ID NO: 102298 - DNA, 1046 bp, Homo sapiens
aggttggttttgatttttttctcctcattgtgggtcatatcttcctgtttttgtttgcctggtactttttgattagatactagacactgacttttactttagtggatgctggatgtatttttattcttataaatattctttttttttttttttgtgacagagtcttcctctgccactaaggctggagtacagtggtgcaatctgagctcactgcaacctccgcctcctgggttcaagcgattctcctgtctcagcctcctgagtagttggtactacaggcacacacccccacgcctggctaatttttgtatttttgatagagacggggttttgccatgttgcttaggcaggtctcaaactcctgagctcaagtgatccacccggctcggcctcccaaagtgctgggattctaggcgtgagccattgcacctggtcagaagccttgtttctgtggttttactttgtctctgtccccaacccccaggtgtggagctgatgagtctgccctaccgcctggtgtttgctgtggcctcggaggattccgtgcttctgtatgacacccagcagtccttcccttttggttacgtgtctaatatacattaccacaccctcagtgacatttcatggtgagtggctgctaatgagggagagtgagtgaaggagaccgtggctgtatcctggaagacaccccggggttagggagcatttcattactaaagatggctttgggggacatattcaccaattttgtttcttatttatttttttgagaccaagtatcactctgtcacccgggctggagtgcagtggtgtgatctcgtttcactgcaacctccacctcccaggttcaagtgattttcatgcctcagcttcccaagtagctgggattacaggtgcgcaccactacgcctggctaattcttgtggttttagtagagatggggtttcgccctgttggccaggctggtatcaaactcctgggctcaacgatcctcctgccccagcctcccaaagtgctgggattacaggcgtgagccaccacgcccg

SEQ ID NO: 102299 - DNA, 1784 bp, Homo sapiens
gtattttacaatttttctgtttgtttttatgtgacggaaggtattccttgaactatttttggtattaaattatttttcccctcttgatttcttctgaattatttaccaagcttcttgaagatgtaatcttttgcaaacaagaatagttgttgaaaattaagactctgggtttttatttatttatttattcatttgagacagggtcttgctctgttgcccgggctggagtgcgatggcatgctctctgctcactgcaacctccgccttctgggttcaagtgattctcctacctcagcctctcaggtagctgggattacaggcatgcgccaccatgcctggctgactttttgcatttttagtagagacgaggttttgccatgttggtcaagctggtcgaaaactcctgacctcaagtgatctgcccgcctcagcccgccaaagtgctgggattacaggtgcgaaccatcttgcccggcccaacgctctggattttaaaaaagtattacctgtgtttcgacgctttctatatatagaaaccatatctgactgccttttacagcagccagcagagtgttcacaagaccgtcggtaatgaacagaacacaggttttgaaacttttcgatgactggttatggtttaagttgactgttataaatgtgatggtttaacttaatacatgaatgtaatcctcagttattaaacaagtgggcacatcttactatttaatgccttgaaccagaagttcagctgaaaatttaagtatttcctttggtagttttgaaggttggtatcatacataaacaattcctgtgatactaatgagccatcacccctctacttttttttttttaaatcaaggagaataaacttaacacccttaaagacggacactccaccaagttctgtaccaaccagtgtgatttccaccccttctacagaagaaattcagtcaggtaagtaatattgttactggtttaatataatgaaaggtagagtatcttttcttttgttcttttggaaattaatgccgcctaattttaagtcagttctgagacagcagggatgcatcttattggaaccattgtttaaacccgccggctgcctgtttacgcctcagcagggggcacctggccagtgagagcatcctggtgagccagggagtgggttcagcaggagattgtctagctcaggtttctccacctgatgactgctgaccttgtgggccaggcaattctttgttgtggaggactgtcctgtgtattatgcgatgtttaacagcatccccggctgctacttcttgcccatgacattctttttttttttttcttttttttgagatgcagtcttgctctgtcgcccaggctggaatgcagtggcacgatttcggctcactgcagcctccacctcccacgttcaagcaattctcctgcctcggcctcccgagtagccgggactacaggcgtgcgccatcacacccgggtaatttttgtatttttagtagagtcgggggtttcaccacgttggccaggctggtcttgaactcctggcctcaaatgatccacccgcctcagcctcccaaagtgctgcgattacaggcgtgagccaccgcgcccagcttgcccatgacattcaaaaatgccactagacattgcccactgtcccttgagaggcaaaatcgcccctggttgagagccactctatagaacttccattatatcagtataggatcttgccaggcagctcagttccgtgtcttggctctgtattctgtaaatgtcagccc

SEQ ID NO: 102300 - DNA, 1069 bp, Homo sapiens
agccgctctggagcctggctggactccagctcccatgtgcaagaggactcagccgggacgctgccaccctcctgccttccctcttctgccaaccagacgcttccaggacggagtatttgagagaaaattgtctagacaattacagtgttccttagaatggcctgcgtgggcacacgtgccacttggttagctagcatgagaggaggtggcttggccagagcagacattcaagaccaaccagaaatgtcatttctgcactgtggaaaaaaaatgcacgatacacctgaacctgggcatctccttcctaacacgcgctcaggatcaagcctccccttcccagcctggcagggttgcagggcgtccatagtccagcctacgcctgcccaggctctcggctccgggtccattggctgttcacactcacttccctgtgtcctggaactgcctgattgttgtagattactaaaaatccacagctcattccctcctgcgccctgaccacctgcccacagcgactgtgtcctcctctgagccaccacctggcggttgtcctcacactgctttggacttttctgctattgagtaactcagcttctcagcctttaggctgctatgggccctagatgcatgctggtcgattctgatcaacgagcaactgcttttgtttgtttgcttttttctacagctgcagctgtgggtgattcggatggtctgttggtggaatgtggagctggacgggtcaaggagcacagtgtggaaagagggacaatttgctacaagttggagataagagacatggcatactgtgaaaccagtgctgacggaagaaggtgactttcttggaaggtcaagacacttgcttgacagcgatgtccaggagggctagggagagttctgctggaagtgaaggcagcacctgagggtggctgagggaactggtcagggctgggaacgcctccagccctttgaggaatgattcgctgattaagagatgtttggccttgaaaattgcaagaatgaaatctcttggtgggaatgtgtagccaaaagccagcaccctgagtggctc

SEQ ID NO: 102301 - DNA, 1039 bp, Homo sapiens
ggtcatcgaatacactttcccattagggaaggggcacgtttccttaagagtttgggggatcagaactgaatccacgtctgtctttttgataacataattcaaatatggcgtaatggcgcctgggggagagggagtgaatttgaggattattagtttcactgctctggaataggtcccagaggagaccacgcagagaccttgcccaacaaattgctggacctctttttgctgagccctgtctgccaaaaggctccacgtgtctttcgcatctccactatccccaccatgaggtctcttcccacagtctccgaacctccatgggagccaacattttctaataatcgtttcctacataaaatcaacaaggggaaaaattcctctttaagcacatgtctagatgattccatttctctttgacagagaattatcagtgacggccctatggctcataagactgtaaggattgtaaacctctgattaatggagtaagacagattgttgttattcacggaattcaatatcctaacctcagacccatgtttacagcacattgacttgcaactttgaaaaaagccctgctttttttttttctccaacatgtttagttattaacagagagcgctacggtaaggaaaccaggccaacatatccagttgggtagcctaaaccagaatatgcactgtatgtagtgatttaggatttaaaaccccaataatgcacggagatgctatgactccaatctttttcccatattacctgcaacttgttctagatgaaacccttcaaagccctccgtgattaacttttcaaaacagtgtcatgcattttcttgttctctaagcagcagagaatgtagcccatgcatctcaggctgctatcattaatttttttcctttccttcttttacttttaagttagtgattaaaacacagaggtcttcatgaaatatgactcccctgaagaatgataacatttcattctgcatttttgcagcacccaagttcatgtttagatgaaggtgaccactttcatttccatc

SEQ ID NO: 102302 - DNA, 1048 bp, Homo sapiens
tttctcgctgactttgaggtattacgtacttgatgcaatccagggccacagatcaattcacgatgggatgaagatatgccctggaaaatgtagctccagcatctttcatgtttgccttttccttttatcccaaacttgacactcccaggagcttacgagtttgtaatcagcccagtggccgcaagcacctccttcttcccgatggcagacggatgtcttccggcctcctcacccatcaacgtgagccccctgatttatggtcctgaacccagcaatcagggcctgctgaggctgagctctcacctggcctttggggtgaatttggagggaaagtggggctagaagtgaatgggccacctcatttaggttttggagatttggttctctgttttgtcttgatgtgcacataagaaaacgcttttgcacatggcagcctgctggtgcccacatttggaagggatcaagccaaggccatctaaatcattccgagggagcagctgcaagaagcatctcataaattgtaagagcaagcacttgtgcagaggggctgcagtgaccgtgaggccccagggcctcaactcagaggacagagtcattgcatgggtccagttcgactgagaagtcaccaaaaagaaaaaaagcttctgtgaaaaccggaagggagaagtgatctagtgatgctgagatttgcattcatagggctgggtgatatttgactaagtctcctcctaagtcagagatctaagttctcaattttaagaagtcatatttactggtttctatttctttaacaaactcttactgttgactgagtgctttacaaatattaattcacttaatctttctaacaatcctataaaatatgccttgttatcatcaaattagtggttatattattacattcatatgctatctcctatatgtgtgttaagattcctccaacaaactggtttaagtatttcatactgaattactaacaggtagatcctggtataggcagtggtagaagtgggatttactaacttccttctgtatgatagatataaaa

SEQ ID NO: 102303 - DNA, 1027 bp, Homo sapiens
acttaaaaaaattaatttaggtataagtaacataaataaaatacacagctaccgggggttcagttcaacaatctttcagaattgtatctactttggtaaccaccaatcaaaacaagatataaaacatttttgaacacaccagaaagttcccttgagcccttgatagtcaatttcctctcccccatcactttctgatttatgtagatatttatacatatagattagtattgtcttatttgaattttctatgaattgatcaaactatgccttcttcggagtttggcttcttttgcttactgtgttgtatttgagattcatctgtgttgttggctgtatctgcagtttatagttttttatttctgtatagtattccattgtatgaataaggcatacctagttctagcaaaatttattacaaaaactttcctttctccattgaattactttgacatctttgtggaatatcagttgactgtgtttgttggtctattgagcaactctttagttaattcagttgatttgcatgtccgtctttatgccagtaccctactatcttgactactgtagctttatcatatgtgaactcatattatttaagtcttccaaatctgtggggttttttcaaaataatttcagatattctagatccttcatgtttccatatatcatttagaatcagctcatttatttctttaaaagaaacttgctgtaatttatatatatattgtatagaaccaatgaataagtttaagacatcttaacaatattaagtcttccaatcaatgaacatggtatatccctttatttatttaggcctcttccattttcctcagaaatgtcttatagtttttatgtagatgtcttatacatattttattagatttatccctaggtatttgaagttttaatgtcattgtaaatggtactgatttttgaaatttcacttcaaagtgtttgttactggcatatagaaatataactgagttttgtatagtgactttgtatattatagccttgttaaatccac

SEQ ID NO: 102304 - DNA, 1019 bp, Homo sapiens
caggactcactactgcaggaggatgcagaggaaagggatagggtggagagcgaggcatgctatccactgaaagagagggacaggcacatgtgtaagttgtaaatctcagaaaagagaagtaaagattagtagtgagaaatgggaaagccgagaggtgttatttgaatgcacacattgaatgaatgaaaaaagtctcacgacaggattagatagaaaaatgcaacgtttcctttttaaccaaaagaggcaagagttcgcagaggaaatagattgtgcttgagaacagccatggcaatttttcagcaatacaatcaggcattttaggggaaacttaataaatggcttggatctcagtggtcaggaaaggatggagaacagatatcaaaggctgacatagattttctgagcagaaaaaataaggtagagagagaataagcctgggactggggacagagaattcgaatgcccaaggtcaaattcagtctgctaatgtctgcctggcccctgcacaaggactcgttccatgaggcagcgcctgcgcccacatgtgtacagttgacttccaccgattgttcacccaacgtggaccaccttgcctcagaccctatttgacacaagttctatctccaacaaaccagctgtcaggaaatggtctcaaatctccaagaacagaaacttctcttgacagtgcattctgttaccttcagtatgaaaactggcaatgacacagcaagacctgcaactcaggcttcctgtccccagccctccacaatgctaagagcaatggcagagcacctgtccaaggcctcgaatgagctgttggctatacagaagcatctggaaggatgcaagagcaccctagaatgactatcataaaaaacctgccccattcccccacaaccctttcccagcccttctgtaatgtgtggttaaactgagtctcatccatttttccttcctgctaaagactaagcttgggaagagagtggaggggaggggtgctggacttgagtgtggag

SEQ ID NO: 102305 - DNA, 1094 bp, Homo sapiens
taggggtgcggctaaacaacccaccacgaacaagacagcctccgacgacgaaaagcgatccagctaaaaatgtgaatagtgctggggtcgagaacctgccctggaggacagatgtgcttttgctgaagtcacttagaaggcaaggtggctccatctgcccttcccctctgcagcttggataaagggtggaccacacattgttcagcagagcagatgggagcgcctggcgccctgggatcccgcatcctggccgcggtctgccgacatggggtaaggaagagaaagatgatgatttgtactaactggtacaacctactgccaaatcgccagggaaagcgaatgaaacacatcccaagaaactctgtttatggtgcaggaagggtttagtgactttactgctcagattaccatttggatatcagtttcatcatcgtcaacctccaatttcctgttttgcttatcttagaatgactcttttaaaaaatgtttgcactgctcagatggctttggcttcaagttgattagatatggaactggtttataatggattagaatgcaggatttgtttgctttgtaatattttaagaaagcaatgaaagaagcggcaatgacagggagagatattgtatacttacagtctgattcttttttcattaccggaaaagacaactaatttaggaatgtggattatggcccttggtccctttttgatttgtgtttcacttcagggttttcctgagttacaaatccctgcagatttgtgagacttaagaggtacacatgtacatttatttttccttttagcatttttttttttagcctgcaggatcccatggggtttttttccccctcctcctttcctttatgtgtttcctgataagccaatctgtgtactgctttccctgcactgtctgtacagttggaagcattattcaaatgagtcctgtgaaactgatggcctgtggccccggttgttaaacaccgacacgctgctcattaacactcagcatccggatatcctaatttcagctcagattttggtaaatatatattttcttgatcatttccaactaccatgcaaagccacatcctgt

SEQ ID NO: 102306 - DNA, 1951 bp, Homo sapiens
gaactgtaagaacatgcttggacacttagtcattgttctgtgtttttattaatgaagaaaagggaagacagacttccaagagttactgtccacccggtggtgtggccccatagcgaagtctaaatgcctgtagagatagagctagctggtgtggttgcagtgaccttgtagaggaaatcagttcattactttgacatcattcagtgagctctcctttcctaaggaagtttaaatgtccttagttagggactgactttcttaagtaagtttaaatttactacatattgtgaagagacaggatcaagttcagaatccttaaatgtctgattaggcatcacttggatgaggaggtgggcgatttggctctgacagctggagatgaaggcacactcataccacatacaagggaggatttggagcttttaagccagtttcagatttactctgaaatgtggagcattcctgcaagactgtgcagctcacggaatatagaagacatggcattttactcagaagtcataagtttttgcccccctcatttacctcgtattaccaagaaagaaaatgttatcgatactaaacaccatcagttcagagggaggatgtgtgtgtgtgcccgcatatgtgtgtgcgtgcgtgtgtgcgcacatagctttaaaagaagacattcaaaatttgatgtgctacaagcctcatgaaagaacaaaagaaatgaagccttttgatatgcattcgctattcccagatgtacgccatgccttttccatgtccctcctatctctgttgaacttatgaatcatactcattacttttcagctttttaaaaggccaatttttgtccagttttctctcttccagtcccagctgaaattagtggaaagaaagtttgatggagctttcagctttgaacaaaatcccttcattgtaaactagcaccatctttatccaggtcttacccagtcaggctaattccagaaacttgtggtttttagtatagtctgtctacctttagccaggcacaggacagccctatgaaaaaatacccaatatatattttttggaaatgaaacattaaaagaacttaaaaagtaatttttggaaatgaggcttcaattagaattatttttctcaaaaaacaaacaaacaaaaaacacaaaaaaaaccactcttctccaaatgcccaagccttctttcaaaattagttagaaacttaagtaaaatacaagtccacaccatccccaaattacaaaatggacttacccttgagagggcatctgcagaatatcatcagggacaaagatctcgaggctaacgatgtaggtttcatttctcagactttgtaatataaggcaagccctctctcagagctgccatcatcactttttgaatttctttgggggttatttaatgaaaaacatgctatgttttgttttaagctgaagtcctattctggacactctgctttgggaaaaaatgttatcatttaatttcctttctgcaaattaaaactaatgaagtgtggccttgtcaaaggctatggagatgttccgggcatactgctgtgctctgtgctttccagcaggcgctcctccctcacgcaggagactcagttgtcctgagagagatgaagcagccttgaagcagatgctgcgttttccataaacctgattttgcctcacatgaaccaaagactctcaaaactccgcttctatagaattagctgaataaaggcattttactgatagctgttcgtgttagcgaaacctgtctacctgctatagcacactctccgatttgggccatttatgcaccccgcaacctgggatctcaaggagctttaaagtcttaatgggaacttggcattttcctgatgatctttaaaatgtggtcactaaactcaggattggcgtgtgcttttagaacactggagtagcccttgttttagaggctg

SEQ ID NO: 102307 - DNA, 1060 bp, Homo sapiens
ccatgaccaaggtttgaaatctctgagtccagagtttacttcccaagtcctgaataaaactctattttcaagcgtgggatctgttattcaagcaggagaagaaaccagagattttattctctcctggactcagtgcagagctacaatgcttggtagaccacttatttcagaggcaacactgatacgttttgtcccatatttaatagcttctattgaattaaattgaatcaaatgtggctttcttttttcccacctttttatttgcagtaaggttgagatggttttagcttgaacaagaataataaaagaaggacaaaaaggaagatggacagaaatacatgtcactcttcaagtggttagagacacgaaatctgaaatgaggacaaggaaggaggaagttgacagtcaagactgtaactttttccatgtggcagagaggaatgtgtgatgccatcaacaggctgagctgctcaattgtttgtttttgtccaggctgtggatttaatgtgactaacagtaaccctaccatctgcatcaacgacctcatcacagaatacaataaacaacacaaggcagaactgaagcccttaagagccgattatctcatcgccagagtcgtgactgtgctggagaaactgatcaaagagtttcaggacaaagggcccaacagcgtccttcccctttattaccgatactgggtccacaggtcagtgctggctcatcttcattcttttcaactcctttattagtatcttagtagttctgtatcttttttttttttttttttttttttttttgagacggagtctcactctgtcgcccaggctggagtgcagtggcacgatcttggctcactgcaagctccgcctcccgggttcacgccattctcctgcctcagtctctcgtctcagtcacctgagtagctgggactacaggtgcccgccgccacacccggctaattttttgtatttttagtggaggtggggtttcaccgtgttagccaggatggtctcgatctcctgaccttgtgatctgcccgccttggcctcccaaagtgctg

SEQ ID NO: 102308 - DNA, 1033 bp, Homo sapiens
atgcaggccggggaagcggattggtggactgcacattcatttaaggttgaaatgcttagcattgtaaaggtgactgtgaattttaagcttcattctttattgacctggcagatgggagagtgctgtgtcttggtgtaatgaagcattatgttggtacagtgaaaaggaaactgccttcctggctggaattcggtctccctaaaagctcatggtctggtgaggtggatggcttgggagtgaatgtgtgtatgtgtgtgtgcacagacgttgttcctgatggggaaattgagacccaattgcccatcaaattgcccgattctacctggtggtttcctgaaatggatgtttgatagcaaatccattcctgtattgcaggctttttttttttttcaataaaaaaacaaacaaaacaaaacaaaacactttggaagtttttttcaccttatgagtttttttttctttctttctacttctgctttggaaacatggaaatgattcatgtagagaaaaaaataattgaaattgaggaataaatcagttgcgggatacttcttacagccaaaacctgtcggggctctgagctctgtaagggaatgccaaaagcaagctgctgcctccagaagcctcgctgtgcgcctcgtgggcataaactggaaccttggcaataaacttctgcacacaaggtcgccctgtgcgagcgtttctggaatccagatttaatactgcatacaacaccttgttttgaaaagagaagatcactgctttcaatgttatggaagtctattccatgctgaacatcgaaatactgatgctctctaggcagagaccatggagaaggaagctggggacgttttgtcctccctgctgcctgcctgcaggagtggactcagctgagactgtgccatgagcctccttctcatcacaaaggccggcttgtcaatggaagaagatgtgccagacagccacttcacacccagctcagtgacgccttgggctttgtggacctagtagtgtgttctgacctgtcttcaaa

SEQ ID NO: 102309 - DNA, 1044 bp, Homo sapiens
actctttgctttttatgtcatttaataagttgtgcatacatattctaagggaaattatgagccgcctgattcattacacatttttccaacttgtaattatgttggcatcagatgttggcatcctttgaaagaactggcatattacttgatcattgtaaatctctcagtacttttaacaaaatggcattagaaccattttcttcaaaatttcctttctcccatgatccctgcttgggaaataggcagtgtggtagaattctttcaggactcatttgaaaaactcaacctttcaagaacaagtcttcttgctattggcatactgacctgaaaaacataaataagaatgtctgtggagttcaggcatgagtgagattattacaggaaattatgacgtggaagaaatagaagctagaatattaaaacaccagttgtttggctgcatgtttgcgttgcttagtatcatgagcaagtttgttcagaggaatgctgattaaagttgtagtctggtaaagtgacattcctcgttacagcaaaattatccatgcagtttacatatttgcaaatatgcatagcatattgccagaaaacagggacccaaggcttctggtagatcttttcttttcttctctttttgagacagaatctcgctctgttgctcaggatgaagtgtagtggcatgatcacagctcactgcaaccttgaactcctaggctcaggcaatccttccacctcagcttcccaagtagctgggaccataggcatgtagcaccatgcccggctaatttttttatttttaatagaggcagggtctcactttgttgcccaggttggtcttgaaatcctggactcaagccatcctcgcacctcggcctcccaaagtgctgggattacaggtgggagccaccgcgccagccctgatttttttctttttaaaaggaggaaaagtcagaggtgaaaaatttagtatttttttcctctattttttctgtatattggtatgttgtctctggcttgctctttcatatgtaatttcttattttcagt

SEQ ID NO: 102310 - DNA, 1061 bp, Homo sapiens
ctgtatttcaaatgttggcttaaaagaactgaaattcatctaggcttgttaggaactgtttcacgagtgtgcagtgtaatacaaaattgaggattttgatagatttcccatctttgttactcttaacgttaaaatcatagttcacagagtgaagttggtgggattctttcatttgtttctaattaaaaaaaaaaaataacttcttactctaattccttgtacccagtgaagaaactccctctgccttccaggtgggtctattccttggttgttgggagagagtgtcccgccctttactgtccccactctatggctcccctgccctcttaggtgttggttggcagaatgccagccttctagtcccctcttcattgtttgaagtcatatatcaccagcaggtgtcttttatccgtgaaattgttctagtctctaacttgctgcttattgtctagaagctgtatccccagagtcatgctgtggcattgccgacgtctggagatggtggagatgcatatgtggcctgcaggtgacatcaggatcagccaccagtgctctgccttacgctagctctgccagagtcctggggcgggggtgacctggggataaatctcgagcaaggttggtagaaccagacccacctcctgcattttaatggaaacaagaaggctaacttacttggaagatgaatgaagtgtatttttttaatcacgtagaacaatatatatgtatatttacgtgtacacacacacacatacacacacacaccagaaccaaaccagtctcaagaataggttaacacaaagacaataataataacaattattattattttaattgagatagagtctcactctgttgtccaggctggagtgcagtggtgtgatcttgacttactgcagctgtgaccttctaggctcaagtgatcctcccgcctcagccgctcaagtagccaggaccagagacacatcctaccacacctggatcagtttcgtatttattttttatagagacaggacctctcactatgttgtccaggctggttccaaattcctggcctcaag

SEQ ID NO: 102311 - DNA, 1052 bp, Homo sapiens
gaatctggaacctcattacctcagtgtgtagaacttaggtgagtatagtgactcccagtattcatgaagagctgcagtgtgtcaggggataaatacagctatccttcagtatctgtgagggattggttccaggaccccggcgtacgccaaagtccgtgcgtactcaagtctggcagtgagccctgtggaaccctcgcctaggaaaagtcagccctctgtacattacaggttttgcgtcccaccaatactatattttcagtctgcgtttggttggaaaagaatccacgtataagtggacccatgcagttccaacctgtgtcattcacaggtccactgtactaaattctagcaaatcctcttcaatccgggcagttgtgtaaaggagaatcatctcttcccaaaactcacgtccatagctcgtgagcaaattttgatcgcaggaaatattttcaagctgcagttgttccagtagtcattttagttgggaatctttggctcctttaccacttgcttatgtttgaacttcttcattttatctgatttatccctccctggtttgactgatgccttatcctcttctgtttatttgaggtatttccacaacttattctgcctttactgaatattaaaatctccatacagagtcagtgtccaaatcaaatatatatatatatatatataatttttttttagacagtctccaactctctccctcaggctggagtgcagtggcatgatcttggctcactgcaacctccacctcccaggttcaagcaattctcctgcttcagcttcccgagtagctgggattacaggtgcatgccactacatctggcttatttttgtatttttattagtggcagggcttcaccatgttggccaggctggtcttgaactcctgacctcaagtgatccacccaccttggcctcccaaagtgctgagattacaggtgtgagccattgcacccggccaatcctagcactttgggaggcctaggtaggaggatcacttgagcccaggagttcaagaaccagcctgggcaacaaagtga

SEQ ID NO: 102312 - DNA, 1081 bp, Homo sapiens
tttgatcggggccgagtggccggctgtgagcatgggaggggagggaaggaaaatgagtcatcgtgaggcaaaaggtgtgcagtgacttctttgaacagaaagttttcttccatttaagaagaataacaatcaaaaatggacaaaagttattaaacccatttcctgggtttaaaaaaaaattgtggttgtagaaaatgaaagcataaaaaatcaagtccatgtaagcttgaaaagaaacctgcagtggtggatttgcacatcggccttaattggcccaattgaccttctctgctgtatttacaattgccttaaaattgtaagcagatgtttgaaaccccgtctttaataggtctccaacatctgtttcaccactgctgctgcccaccaaagcagttgtaattagggagcaccgaatgcatacatctttccttatggacccaatcgatcggatttctccccacggtattaaagtcgacccttattcttgcttttatttgaatacattttccaatatattttcttacacaggacagtatccagccaagtacaaaaaaaaaaaaaagatagtcgttctccatactgaattgttaagatcatgtctgtataaatcactgaccgtgagtgacaaagatgttcacacatacaagcacaaaaccctgaaaatagtgaaagcttttgttctttcctgtggcctgtgtattctaaactaggtgtttcctgcagaaatgatcaaaggtaaaatgtgggcatcttagaaggcgggaggaagcattatttatttatttatttatattttaatcaatagacttcacttcttagagcagtttaaggttaacagaaaaattgaacagagtatagagttcccatatactccctccctgtccttctgtctcgcccgccgaatccccctccgtttccccctattattaacatctttcattagtgtggtacatttattacaattgacgagcttctattcataaattgttgttgaagtccatcagttccacgatggctcattcctcgtgctgcggagttctatgggtgttgccaaatgtatagtgatacgtatccaccttta

SEQ ID NO: 102313 - DNA, 1041 bp, Homo sapiens
tttgctgaaatcgtaatgtactatgttccccatacttccaatatctacttgtatactaatcttattacaaaagaaaatcaggctagctaatatgtctaactcttgacaattctcttaattttttattttttcaatgagatgagtggtaaagctataacgggagtcctaagttaaagtctcagctcttgagctaattagtgggacaagttacttttttgttcctctgtactactatgtgtatattgtgggcagtaatacctttattaatgagctgtgatctaaattaaatacaatggtaagtatgaaagtgccagtacaatttctgacctttaataggtgctcagtagtagtagtttcgtttatttacttgaatttcacttgggatagaatatctctggttagtacaatttccttttaaaattagaattgtatgtttcttctagcttctgtctagttcacaatgacccttcaatgattacccacagagaatgtaattttatcatcttcatgttctcaggttctatgaacttgaaaataagacagtaataattatctaatctgaagaagagagaaaaagatttaaaaaataaacagagcctcagggacctatggataatatcagaatgtttaatatatgtgtaggagagatggaaaaaaaatttgaaaaaatgatggccagatgttccctcagtttggcagaagacataaatttccaggctcaagaagttcagcaaactccaagccagatgaatatgatgaaaatacatctaggcatattatagtccaactgctgcagaccaaagattaaaaaaaaaaacaagtactgaaagtaatctgaggaaaacagcatttcatgcagtgaggaacaatgatttgaatgtctgtggactttttctcagaaattattaaagccagaagagagtggaacaatatttttagagggctcaaggaagataaacttgtcaacccagaattccatatccaacaaaatgtttcaataatgatggcaaaatacatgtccaggtaaaagaacactaagat

SEQ ID NO: 102314 - DNA, 1035 bp, Homo sapiens
ttttcccccttttcttcccttctgggtctgtgctgctaactgactcaactctgcaccctcctcccctgaagtcgaggcccgagaggacagaaattgggctggaactaatttaatggctgagtgacctcacagtagagaaacagccggatcctaataggggtctttgtctacatttccaccctggctggtagcatgccagtcaagagtcaagctggagacacaggtggaagcgattagacctgtcataaagtttgaaaaattgattctggaggcgaagtgaatagattgagcttgacagtgttgtcctaaagattctaagggaaaattctgtagtttaatttgaaatcccttgattattcattagctttccagatggcttttgttgatgttttacatattaatgcctgtattgtgttattggtgtactcttaatgtgcacataggtaatgagcaaagaataaatacattggtaagtgtcccaaattaatgggatattagcgtaattgtgaaataaagggttttaaagaagttgattgcttgggataattagcacgaatttttttatgtgtcagtttggtactttaaaagtgaaaattattggagaattttaagaaaccttcattttaatgtttacttctaaaatttaaaatataactttggcctttgactttggcaacggttgtgactgaagggttattctggcaaattctccatcaaattttttttgttgttccaattcaacacctgaataagttaacctttcacatgccaagctcctgaagttgaattattctgtggcctggtatttttcagagaagcttctacattaatttttagtgttcttggttgtttattttcatattttgtcaccgatttttcaagtatggtagagttattttgatgtttaccattttgtgatagtgataatgtgttctatttaggtgcattttcattagaactgagccgtcccagtgtcctctcagcgttgatgttgatgtcttcatcattccggggtgcagtaacaaagtggcatcc

SEQ ID NO: 102315 - DNA, 1222 bp, Homo sapiens
cccagctactgctccgattgctcaaggtttcgtgctctgcgctcaagggctgcgttttggtgtctttgttctgcccaattttcttattgtctaattttcctttttttcttttaatttttggaatatttcagatatcaaatacagagggggagctaaccaatccatgattcagattttacagacgtgattatttaatcttttgccaaatttacttcagatactctttttttttaaagaaataaaattgctctcagttccttcccctccttttctagagatagccactgcgttgaggtttgtgtatatctttactttgcatattttatactttgatcaaggtgaatccatacacaatatatattattgtttgtttttaaactttaatggcattaaaatatacatgcctttttgcaacttgctttttttttttttgctcagcatcatattttgaggtttatatatgaacaaattgaatgattgtgttatctttggttcattcattttaattgctggtatagaattgcgttgtatgaatataccatatttatttatacattcccctgttgatagactttgaacttgtttcagtttttgactcttaaaaacagtcctgcaataaatatctttgtacttgtctgcttgtgcacacatttggaagtttctgtaggaagtacacctaagtagtagatttgccggattgtaggctatgtgcgtcttcaatttaaccaagtatcacagaagctctcgaagtggttgtaccaattttcactgtcactggtgttgagtgagaacacaatttcctcacaaccctgctaacactttatgttatgagactttacatttttgccatctctttactgaccagcttccttatgacttttggttgctgctaaatttgcttgtagccaccttggcttctcttgtagccctgtgtcagcctatggatttatctcttatagctaattggcttagtctttatctcctttggttctcataagattaattccaatgaacatttgttgtatacctaatgtatgtcagatcctatgattgatgtatagatagaatttccatgatatgttaaatatgtacctctttagtggcaggtgaggtgatttaattaaaagtattttttttcttatgatgaatgtttaaaaaatttttcttttcctctccattttattgtagtatttgataaattcaaaatatatgtaaaacatat

SEQ ID NO: 102316 - DNA, 3010 bp, Homo sapiens
aggctggagtgcaatggcacgatctcggctcactgcaacctctgcctcccaagttcaagtgattctcttgcctcagcctctgagtagctgggattacaggcgcgcaccaccacacccggctaattttgtatttttagtagagacgggatttcaccatgttggctaggcacgtcttgaactcctgacctcaggtgatctgcccgactcggcctcccaaagtgctgggattacaggccaccgcgcctggcctacaaagggataatttaaaataccactatagtgttagggaaagcctcttttaatcctggcacttccccatccatttccttaagagagatatttccaataaagttgcttttttttttatgttatcagggtatattttttggccaaccatatgctggtaataattatacatttaaaagaatgagataatcagttttactttaaaatgttactgtgatgttctagaaattcaccctttgcaattatttaatcttatggtgatattttttaaatgtcatcttaatgggtaaagggtatgcaattttaaaaagcacttttggtggtttgcgagcaaaaaaaaaaggttgaaataccaccatgttaatttgttcagcagcaaaagaaaaagaaaagagaaagaaatactgccgtatcactatagtaagctgtttgctagaaatgggattgctagatcaaggggtatgaatgatcagctttacaaaataatgtcagattactttctgaaggggttgtatcagtttgtactttggccagcagttttgtctgtttatatactttgatcaacagtgtgtaagagttacagttgatctacaacctctccaacacttgttattgtcagacttaatatttgccaatggaatgggtatgaaatgatgcatcattgtggttttaatttgcattttttgttattaatgagattgagcatcttttgtatgtttatgaactgtctttgtttcctttttatgaaatatctagtcatatattttaccctttgttctgatgagttgtcttttaaaactggtaacatcgattatgtgcgttgtaaatatctttttctggtttgtggcctgtctttctactgtttatggtgtattttggtgaacagaagttcttaattttaacataatctgattggaacctttcttgccctgggcttataaagacattcctctgtttctttttagaggttttaaaatgatgtcttccacatttaagttcataatttatctggaattgatttttgtgtatgttctgagatagtgatccacattgattttttttttctcctgtgtggttctaattatccctgtaccatgtattgaattggccctctgttcaccagtggtctgctgtgccatctcttttacatgtttagttactacctgcatgggtctgtttttggcttgcctttctgtgtcacttgtcaccttgtctgtctctgtgttcataccacactgtcttaatcattaatactatagttttacctgaaatctcggtatctggggaggacttgaatctcacctatttttggtcatttgttcttaagaattagcttgttacatgacatgaaaaaccctgtaggtattaattagaattaattgaatcagtttgggggagaatcgaaatctttaagattttgatcctttttatttttaagaatatggtatgtatctctatttatgtaaagttttagtgtagttttgtaatattctccatagaggtcttccactttttcatatgttaattctgatgttattgtttttgttgctattataaatggtggtgttcttaaagattctatcttaacttatttattgttagtaaatattttaacttattgttaaatagaaatttaatgaatttttaaaaatattgaccctttagtcatccacttgataaacttactacttctaatattttttctgaaattcctttgtgttttctgtgtggataattatatcatttgcaaatagtgacagttttagttcttctagttatttttgcttttaatttattcatttttttggtcttaaatgtgctggcatactttatacttacgttcaatggaagtgattagggttgttcattagaagcgattatagtgggcatagagttcttgttctcaattttaaagagaatatttctcagctgagaataacatttgctgtgaatttttgtagatacctttgattaagttagggaagtcttttcagttgtcacatgcttttctgcatttgttgagaatatcttgtgtcttttcttctttaatctgttaaatgtaatgaattccgttttatagatttaaaactgttcattttcttttatattctttcttgagataaacccaaattggtctttatagattatatttttatgaactactagattgagtttgctcatattttatttagatttttgtgtctgtttatggctagaatcacttctcatttttctttattggctgtcttatctgacttgggtattaaagttacactgactttataccatgagttagagaatagttcctctttttctgttccctgggagagtttggattggagtgatttgtttcttaaaagcttggtggaacttaactataaggtcatttggatctaatgttttcttcttggaggtttagtagtaattagcagttgaacagtcataggactgttcaggtattctatttcttttagtcagttttggtaagttttagaaatttgtcctttcatcaagtttatggtatggttttttttttttttttttttttttttttttttttaagatagagtctccctctgttgcccaggctggagtagtgcagtggtgccatctcattgcaacctctgcctcctgagttcaagcgattctcctgcctcagcctcctgagtagctgggattacagccgtgcgccaccatgcttggctgatttttttgtatttttagtagagacggagtttcaccatgttggccaggctcttcacaa

SEQ ID NO: 102317 - DNA, 1713 bp, Homo sapiens
gaatactattctgctgttgcttatacaaagtgtgctgccagttttatttatgcctttttttttttttttttttttttttttgaggtggagtcttgctgtgttgttaggctggagtgcagtggcgccatcttggctcattgcaacctccgcctcctggattcaagcgattctcctgcctcagactcccaagtagctgggactacaggcacctgccaccatgcctggccaatttttgtatttttagtagagatggggtttcaccatgttggccaggatggtcttgatctcttgacctcgtgatctgtccgcctcagcctcccaaagtgctgggattacaggcgtgagccactgcacccagcctatttatgcgttttttgaagaaaatatcatttttcttttagttacattggattttctgtcttttgtgttacatcatttcacttctaagtctagatagagattatatttatcctattttggatgcatgtgtttcatgattctgcattttgtctttcatgagatctagaagtttctgagccctgtattctttaaatattatgtctcattagtctcttctctcctgctggaactttaactggatatatatatacactaaactgtttccagatcacttattctttatctttcatattttttatctctttgtttctctttaccagaatttacagtgctggataatttcataaggcatatattttagttcaccaattttctcttcaactgtgcctaatatcctctgtaacccatcctgtctcttttttttcttttaacaattgcatttttaattactttttttttttttttttaagatggagtctctctctgtcgcccaggctggagtgcagaggcgcgatctcagctcactgcaagctccgcctcccgggttcacgccattctcctgcctcagcctcccgagtagctgggactacaggcgcccgccaccacgcccggctaatttttttgtatttttagtagagacggggtttcaccgtgttacccaggatggtctcgatctcctgacctcgtcatctgctcacgttggcctcccagagtgctgggattacaggcatgagccaccatgcccggccgcatttttaatttctaaaagttctgcctggttcttttttgatatgtccagtcattcttcatgttctcatgttatatgctgatttttgtgactctatagctattctgtagactatatcagacattcccaatgtctgatatccttgaggagggggatgtctaaatttattgcttttttgtttttttttctgttgtctctcctcaatgtagctgtcacctcatgtgtttggtgatcattgattatgaacttctgtttgatctttgtggtgatcttgagagtctaatttgaggatgcttgctttctgaaagcatttctatcagctttgtctgggagccagaaagtttagctggcatcacttttgagttcctacattttgcttctggcccagggctcagtgtcctgatcctattactgctcttggcaccactacttgtagcactaaactgtagccaggtttaatttctagctcaaggtttgttgcttttgcgtggagagggtgccttcacatgttcccctatttctatgagctcagcaaaaacatccaaaaagtgtttttttttttaatctaggatatacctttttcctcccaacagtacattccccca

SEQ ID NO: 102318 - DNA, 2479 bp, Homo sapiens
ctagaaatattcatgcagaataggtcaggttctagacattatagataaccagtcttttgtggaaggtcattaatgatcctaatgaaagcagtttcccttgaatggtcgaagtggaaaccaaattgttaggaaactgacagtgaatgagaatggaggattcagatgggtgaaaaatgaagagttcttgatgaagttgaagaatggctgtggtaggaaatcaggaagacatgagccgtaatgactcttggctatggtcagagaggagctaataaagatttaagaactggtttcgacccaggtagtgatctgaggtgtccccctggggtgggagagcctagtgaggtaggcagtgaagatcatgttagttgaggaggttgttaaactacaaggctagggtattgtgtgcatggacctcgatgtggctgggatgatgatagaatttggaggaaagagaaaaacactgaactagttgccagtgatcttgaaacgtgacagtaaccaagagataaataggtgacaatgacaggaaaattagatgtagtaaaagagagtgtttgagagcagaagctatggcaactaaagactggatttgaatccttcctagcttggtgacatgagcaaattacttgatttaagtgagcattttcccatctgtacagtggagataacgataattgtgcctgctaagaagaattgctgtgaagattagtgaaataatgcatgtaaaacatttggtacagtatgtgacacatagtacaaatagtttgctaggaagattgttattattcttcacttgtgatattgtgaagttttcatacagcaaattggacatcatgagatggattgattaaataaatagatttgaacttcaaggactggtagtgttcttgctttggaaagaagaaacttggtttatcctaataatagtaggataataatggtgaagtgataggtacaagtaatagtgtttatgatgcgctggtgatgataggaaaagaaagccattatatgggcaagagctagaagtaataaaatggtgcatttttcagtgatgtttggcctatgtagctattctctgataactataaaaatccttattattgaagattcttcaggaaaaaaaacccttagtctgaaactttaccaccaatcccccttgccccccattgaaatacgtatttttaaaacatggcttttgataatgtgagggttttttcctttttgcgatttagcagtgctgattgtgtattgcagtagttgtgagagcattagaagcagcagtcgataggaggatggaaggtctggatgccgccttggggagttaggagattggcagacttaccctgtaccactctagccctactcctttgcccaagacagaaacacactgagatggataggagaatatgagcagttgataggaaagttctcagtggagtcaggatttaggttaggccaggagattgagaatataacagtttgtgtatgatgaaatggcatatttcacagaatgcagtaaaagcaggtagggtacaagtgcagcaacaggaagatgtcttttcttcattcagcaaacacttatttgagagcttaccatgtgctaggcacatacaaagataaataagatgcccttgatgatcctctatttaaaggagacatgtaaacaggttaacttagagtagagatggtgaatatgtgaacctgaggaaaggaagaaatagattaaattatctggagagagaggaaaagtcagcagaatggggacgagaatctttcggagctcagtgttctgataggagttatttccttgggcataggttccaagtatttttctaatataccatagaagccaggaaaactttcttctgttatctcaaatgatttaattactgacttgagtttgtgttgtctccttagacttgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtggtaagtaggtttgctaatttttcatttttgacattgtgtattgaaggttttctggtttagggctatctgagtaaagatgtttttgtggtacgtgcgttttgacagggaggtacacatgctgttgaaaagttgatttgagaagggaaagtaagcactggctcaaaaataagattgtggagtgccagagaatgagtggtggcaaaaggtggttttctgacagggcataagaaaagctcttggggagagccatagaagcaaactcaggtaatactgtaaaacgggtctcaaattaagactctttggctgaagatgtgtttgaagcatataaataaatgcccactgaaagttctttggttagttctgataatccttagattaaaaatcaagaacattttactagacacaaa

SEQ ID NO: 102319 - DNA, 1030 bp, Homo sapiens
taagtgttgattcattaaaaaaatgaggcacaaacattaattttaaactttttttttaattaagaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaagtaagttactatatgttgctcattttgtgtggacagtgataaacatgttacccaataccaagaaatgcaagttcaatggaaggcttatgtcttattcttgtatgctgctcaacgtttgtgtaatagggtggaaaaaacaaatacttgagatttggatatgaatgaataattgtaacataatcagtgaaattctgaatagtactagatggtagactggaagctgagtcaggaggaattaacatgggtgtttataagtatcagtgttatagtgcagaagagaggaaaaagatacagtattttgttcatttaataaatagcttagttattgttacctagagtgaagaaaaagagaacttattttttaatggtttgagatatatagctaagcataaagttcaatgaatttgtatatatgagaatctaatcttttaaaaaataaatttgtctttaagcaattcacgtgcttctgagataaatttgaagaaactacaacatcttgagttgatggaagatattgtggatttggcaaagaaagttgctgtaagtggtagaatgtaggttcccccgagcccttggtttaaataatataagcatttatatggtgttaggctcaaatgactaatttatagcaattaacaggtaatggttttagttttggttaacctgagataaatctgctgtccatcagtgcgtgctcagtatttgagagatcagggagatggctgatgtcatggttctacgctggggaccaggactgcatcttgtcattaaaggatagaaattggaacttgtcacagaaagtggggtatgggttc

SEQ ID NO: 102320 - DNA, 1020 bp, Homo sapiens
tgttatattgcacttgcctgctaccccaggcagtctggccaggttgtagacctcaaattgcaggtctgtagtaattgcagaagcatcttgagctctgagggtggcctgaagtcacctgaagaggtaacatatatgagtccatagtatctgttaatttatatgtcagagtctgtctactctaagttacatgccagagtagcaaaaaataagtggttgtaccagttttgtagtaaggatctgaaatacttgcataagatgaatttataatgccacatgcaaatttagaattaataaccaaagccccattcttcatttctcttttgaaacagaaaatcttggcaatggaagaagctctgaattggataaaatatgcaggcgatgtaacaattctaactaaattaggatcaattgacaattgttggcctatgttaagtattttctttactgaatgtaagtataaatgctttaaattgttacttgactcagtttttaaaggtgtttgggaaaatgagatatgtagttaagtgatttctgatttatcttagaatttaaaaaaagtttttattttgttatatatggctgaaaaagagaatttcttttttttattatttatttatttatttatttatttattttgaggcagattcttgctctgttgcccaggctggagtgcagtggtgcagtctctgctcactgcaagctccgcctcccgggttcacaccattctcctgcctcagcctcccgagtagttgagactatgggcgcctgctaccacgcctggctaatttattgtatttttagtagagacagggtttcaccgtgttcaccaggttgatctcgatctcctgacctcgtggtctgcctgccttggcctcccaaagtgctgggattacaggcgtgggccaccgtgcctggccgaaaaagagaatttcaaactggtagttttattctatattttctgtcttaattatttttatgacattgtactttaaaaattttcactgaatggatattgtaagt

SEQ ID NO: 102321 - DNA, 1023 bp, Homo sapiens
gttttgcaggtttttgttttcatgcatttttattgaatattgtgcatggtacaccatacatgcttgacagtgtttattgaattgacttaagtaattatgtggcctatttggaatatgttatgacagagcatttattgtaaatacaattacaactaatataataataaataaaggttttttattgctagaaataaaaggtgagattagattcatagcaagcaataactgatgttttctgcaacattttatcagtttatttttttactgagttatttaatagacataaaaggttacaagaaacatgtgctatttagaaagaataataatataggaccgttgtggactcacctaactcaagaattagaatattatcaataccaatttgtttttttttaaacaaatgttctctcttgctctctcctaaaaataaaatttagacaagtaccacataactaaaattgtaatggaagactgcaatttgcttgaagaacttaaaactcaaagttgtatggattgtatagaggtgagaatgaatattataaatatattttaagatttgcccattagaactttttaacactcagaggaagttaataaaactgctgacaatatacaattcataaaattggatgacatatttgagggaaagaactaatatcttgatcagagttctctaatgatttaaaaaccattaattgaaagtgaaaatttggtttttaaaaactttagtctttaatgagttgaagaaatatgattttctttggtaacagctgagatgtaattcatgtgctacactgttcattcataggaaataggactttaactcaattttataaaaggaatttgggaaaatatttaatgttgtattgaattccctaatgctgttgatatgatgtgatttagtttatttttaaaaaattgagtgttcgaaatgaaaagttttagttttttctctagcacctttcatatatattctcgttaacctaccaactcatgctttgcaattaatctaatcagcattgc

SEQ ID NO: 102322 - DNA, 1025 bp, Homo sapiens
cgaggctgcacatgatggctcacacctgtagtcccagtactttgggaggtcgaggtgggaggattgcttgaggtcagaagttcaagaccagctggggtaacatagcaagacctggtctctacaaaaaatttttaaaaattagcttggcatggtggggtgcacttgtagtcctagctacttgggagactgagatgagaggatcccttgggcctgggagatggaggctgcagtgagctgtgattgcaccactgccctccaacctgggtgacagaccctgtctctaaaaatatgtgtgtgtgtgtgtgtgtgtgtgtgtatagtgggtgtgtatatatatatgtaacaaaatattgggtattgtaatctcattttctacataaataatcccctatgttatttctgatatcgaagatagaaatccagatccatttttactaggtattgggttcttgatgatttttggaggtcattgatgggtcttctttcaccttggtttctcaggaaggagaactaatgaaaatgaaaggaaatgaagagttttccaaagaaagatttgatatagctattatctattacaccagagccattgaatataggtaagagcaaatagaacaaaagagatgctttttctatggcacatcaagttagaatggtagtcagaagaaataaaaacaagacggagaattggagagtatcttccaacttgtgcagaatagattttctcatccttgggtgttggaagcattggagatggcctgggtatatgaagctaacgtagtagcataactcaagcaagtcaggcaaaatggtgaattttctgttccattttctttaaaactttccagtacagagttacctcttttgtcttgttctcattttgctatcaaccaagtcctcccaagttattaactggtcaaaaaggattaaaggattagttcttaatagttaagatgccacccattcagggttttttgctttctaagagggaacttttacaggataattgagagaatgcatacatgctc

SEQ ID NO: 102323 - DNA, 3767 bp, Homo sapiens
taatatgtctcgtttgatcccccaacagccctatgagttagagcaactagagttatcttcattttgaatatagggaagtttaggttggttcaaacaaagttacttatgtaagaagtgaaggaacggggacttcgccagttaagactccaggtcctatattctttttgctttgccacacatatgtaaagtttaaaaaaagttttctcatgccttatgttttctacgtgatttttatttgtttcatgtgtaatgtgctttactgactaaacattgtatctttttaagacctgaaaactaccttctttatggtaaccgagctctttgttttcttcgtactggacagtttaggtaagttggttaaaatatctcaaccactgaattattatgctaaatacccatttttgggaaacgtttctgtttttcaggtatacaagaaaatccttgactggttctttggcagaaatacttaagtggttaaaagagtatgcttaggctttatatataataacaacagtgacagcagcagctattctgattgagtgcagacatatgttaagcattattttaagtgctttgcatatgttatttggttctcacagcacccgtaataggtaggtaatgttatagtccacattttacatgaccaaagtgtaccactagtaaatagtgataccaagatttgaacacagattttatctgatgatgtcaaagtctgtgtttgtggcacctatattacctctttatgctctgttaattaatccatatagtataaaagaagcattttcatcttttctctgtttatcctggtataaaaaattaagtaaatatccttcataagtgaaagaaagcaaataaatttaatattatgagagtggagtcataattaattccagttccttatattgaatttgagctgagtttttatttattagctaagaaagattgagaaagatactgcaccatgattttattgttccccagtataaaatttttagaacataaattatatatattgagcattaatattgagcaggtagactattatatttaattttgtcctgccttactgtaagaaaggtgtagggtgaattcaagaatacatccacacagtagaagaatattcaaaataaaacaaaccagaaaacgaagttggaatctgggattctcagaaccaagctacataggcataaggtcctgcataggtattagttataattcatatttgcctctgaccttcagctacccaaaatgaaatgggaaaacttgacaagttacttaattctcattgtccataaagaaacaggacaccaattggtcaggtgaaacagttttcctagtatttagttttgaaagaagttgggctgtaatattaattgagtgatggagtagagaataatctcagcagtatcttatgcatagcaaaaaactccctgaaagcacagttttgggtttcacaaatactttttttgtgaagttttctcatgaaagctgagagtctgctatcagttgtttttcagtgaaagcgcttgtatgggagggtgggagtggggaaggtagtaaactctaagcatgtagctttaaaaataacatttattgtgtttttcttttattgtaaacagaacacattctcatggtagaaaatttggaaaatacaagagtttaaaaagaagaaaataaaaatcaccagtaatccaaccaccttggagaataccgctgtattaacgttatgcagcttttagatggcttaagccgtggataaaccgaggctatctagactagaggaatggatgggcttgacacagtcttccatcaataccactgtcctcaacgggttctgacaagaaatgagctgcacatgtctttaggttattgctactggctaggtccagaattgcatttattttgtgctgtttgaaggtgaatttgtatgctttcaagatcagatgaataggttggcaacttggctagcctcttgtgaaaattgaggtgcctgtctgaaatattgcctggcagaaggttttccactttccacttctgagagctgagaggcacaccagggtgtttctgctctctttcatgagtgttgaatgctagacacacaaggaagatccttctaataccttgctgcaacaggaggtgaatcagagtagaagtacagaagctaggtagtttggtgaggtaaaggccaagagcagcttgtggatctatccttgtacctccttgctgatggtctagcttgtggtttaataccatctacatttcactaaagccaggtcagcagcattgttcctttgtttcttattaggcaatcaccaatatatattggatgcctattttattcacgaagtgttttaccacactggttttgctggtgtttcctacctcctcacacattgtctatatgatttgctcagtaatgtagggataatgttttcagagtccatagtatatataactcctgatcaggtgactagatggtgtgacttaaggaaagaacacgttgccagtaattcagatgtgccattgacacaggaggacccatgcctgagaaagacttttatctgagttactgagattaagatgttttgaagctcccaagcagagggatgctggatctgctgtggaaatctggctgagcagctgcagggacagctgggggtaaagcatccaccctcccccagtttggcgaggatgcactcctcagctgttctggaaggccagacttcttatctgctgtcattgaagcaagaattgagatgtccaaagagaacagaaatgggacaatttaatactagaaaggaataaaagggttaaagtcttgaatgctaaaacttctgaaataattaatttatcctgaaagattagaaaatataagttgaaactttaaatgaaaaagagattcaatttaaaaaagaactttggcaagattgatatctaaaagggtaaaaataataatactgtatcttacaacatggttatcactgttctgagcatttaatgtgtattaactcgtaaaaccatcacaactacgtgaggtaggtgctactgcctttttacagatgatgaaacaggtatagggaggccaagcaaagtgtctgaggacactaggtggatgtgatggagccagaatttgaacccaggcagcctggatgtagagtctctactattaatcactatgggaaggtggtgatagaataaaagggaatgtgaaagtcgaaaaaattaaaaaataaatggtctaaatagtcaataaacgtttatgaggaaatgattatccttccaggacatgtagattaaaaactacgagtttctcatttatacccatcagatggacaaaagcttaaaaatctcataataccaagtgtttgagaggatgtggaacaaaggagactctcatattcagctggagaaagtgtaaattggtacaatcactttggagagcaatttgacaaggtgaagatgtgcatactctgcaacccacttctaggctcatatcctctgaactctcaaatgtgtacccaagaagatatgtacatgccttcatgatagcattgtttgtaagagtaaagaaatgaaaacgacctaaatggccatcaataggggaatggataaatatggtatattcatacaatggaattctatatggcagttaaaatgaacgcaatgttgagtgaaaaagcaagtcacagaatgatttgtacactgtgatgccatttattaatgtttaaaaacatgcaaaacaatatgcatatatacagactgtgtat

SEQ ID NO: 102324 - DNA, 7711 bp, Homo sapiens
gattggagttgggaggggtggtacacggtgggtgtcaactgtaacaaactactacaaaaagagctgaagtatatggcaacatgttaatttcttgctaaggtggtatgccattggtacatgggtgttcattttgttaatgttctctgtacttttatgtatacttgaaatatttgataaaaagtaaaacaaaatgtaattaaaatgcacatgataaaaggaacagaaaaagaacagaaacagtgaccactaaacatcaaggataaaatagtgaacaatgatcttgaaaagagaaatataagtattgtaaggccagttgcagaagcgtgaagtgtgcatggggaagcctgaggtgaggtatatatggggaaacagatgcttccttctggtggcagtggcagtgatgattttaatgccaaaatagtcatacagtttgtaaatccaaccacttttgggtgaatataagttaggccaagagcctttcaaaacccccctgggcctgcgaatgttgcgcttggaaaacgcaggagatggggttggaatgaggcaggggttggggaactgcgctgcctcctgcgcccccactcctgccgcagcctctccccttcaaatcttcacattgaggattgtgtttatcccaggacacctggcttagaagatgagatgtccgttttattctgctccttctcaaagtgtacttttcaaatatgagttggtaactatagggcatttgagagtgatcattgtaattatagtaatcagaacttttcagtttagtcaagaatctggacaaaggaatcagtcatatctgtaccttctgcagttccaacagcttatgtaatgtacatgattaggctttgcccacttagtgttcagttcattcttgtgagactcgtggaaaattcagattcttcggtgggatgtgatgaactgtgtaagggcaaatgttaattggagaaagtgaatgcttagcttgaatcgtttttgaattgctttggaaactcatgtatttttaaacttggtgtttacttgaactgttggtattcatttaagtatttacccatcacatgataactgccttccatcagatcccaactgtgattggtagcagacagatagactttaactaactcttctcttgttgctttttttcccccctaaatttctggaagactagagatataaagcactgtatgtttctgtgagaatttcacaaattcttgtgtgtgtgtgtgtgtgtgtgtgtgtgtgtgtgttggtttggtgaattattcctcactctgccctctggtgtgtgctctttatttttacttagagccactgaatttgcttttgaagaaaacatttacttttttcagtcttctttggggtataccccctttttaaaaaaacagtaacaaatgcacatggtaagcaacagagtaggaaaaggtacactcgccagctctgacccatcctctgattcatctcttcagatccttgtgtattcccataatattttatgcctatacaagcatttatgttgaaccagatgaaattgccatttttgtaagtcagaatataggcagttttatttggtttaatgtaatgtatatgtctttttctttaaatgggtaggaacatactacatacactgttgtacatcttgcttttttttttacatttaagtcttggagcttgttttggatctgtatatagagacctaccttgttcttcatggctgcacagtgttttactgaatggattgcctatgtaatccattagtttgtattatattagtatatagtttatatatatatattagtttatattagtatatagattattttatttacaatgttaaattatagatatattagtatgtagatttccattttaaagattatatatacctatgcaatgattatctttttacttatgttttacactcaggttcaaatatatctgtaggacacatttctgataaatttattttactcatgatatatgaatgaaagaacatatcattttaattacagacactttttatttaaaatgtatgtttattcagtccgtggttattactcactgcatatttgtcagtgactgaccattatacctgaatcttgcttttgttccttagttggaagatctggaaacttggggaatagttgttatttctttattgatctggtcatatcctgaaaataattataattgaggaaaaaaggaatatcccttatatggcttgcaaaattcttgcatactttttatggtatggtttaagagagtcaataaatagcatctcctttcccttccaagtccagaatcagttaaaagatggatggaaaagacaggcaaatggtgatcaaatattgcctttattactgatgcaattggagaacaggccttaagtctgatagtcaaggggctggttactattaggttggtgcaaaagtaaatgtggtttttagaaataatggcaaaacccctaattacttttgcaccaacctaataattcacccacagtcagacagaactgggctcttgggaactttaagcctggaagaaaagggaatctggtgttttagattccaaagagtaaggccaggtgcagtggctcgtgcctgtaatcccagcacttggagaggctgaggcggatggatcacttgaggtcaggagtttgagaccatcctggtcaacatggtgaaaccctgtctgtactaaaaatacaaaaattaggtgggcatgttggtgcatgcctgtaattccagctactcaggaggctgaggcaagagaattgcttgaacacagaaggcaaaggtttcagtgagctgagattgcgccactgcactccagcctgggcgatagagtgagaccatgtctaaaaaaataaaaggattccaaagagtgagaaaaagaagaggtgaagccatgtatgattagtgtccctccctcaccattagataaattattattcatcatctggggatgttagccaagggtggggagaggaaagagttcaggaataattagcaaatccacatggaaactaggggagagggaataactgttctttacaagcatcatcttttagggcagaatgtagcatattttatatgcagtaatggggaggggctggagaaataaaaacacttccctatgtaagagcaataagttggagcacctggactagaactctctttcttactctgtttaatactcaccatgtcacacagtcttcaagagtaaataaccgtttgcatctggagtcttgtcccattttcatacatctcttgcacaggggattgctgctaccaaaagtcaaacctgattatttagaccctgggctgcagtggtctggatgagcaatagcatcatgtaattgactatgcccactttgccttagttgtaggatgtggtcatatgccagtaaatgtgaaattttattagtattaatattaattgcattcatatactaattgtgatatttataatatatgctattataacgctgtttgtagtgctatatattataagtaatgttcagcattgattcaacaaatattggggttctgttgatggataatgtcagaaatgagcaaaaacagcctctgtgtttcagacagtgggctggcattgtgagggccttgtagtgggaaggaatttgttgcatttgtggaactgatagttgctagatggcctgaatacagaggagagggtagtatgttcataggctaagccaaggagggccttgtaggctgtgttaaggcttttggcctttaagagcaataagaaagtaaaggattttaaactgaggagagagagcatgattagcacttaaaaaaaaaatttgagcatagtgaaaatggatctgaaggggatgtagtgtggatgtaggttaggaggctgttgcagtagcccaggccagagatgatggcttccagcagaatattgacagtgggaatggaaaagtagaaggattcaagagtttagaggtgaagctgacagaagttgctcgtggttggtgttggaacttgagagtgaaggtggttggaactgttctgacgtttctgccttaagcagcatcatggattatgggcctactcactcacattgggattgctggaagaggaataaatttgtaggaggtagaactggacttcactctcggacactgaatcgaagtgcctttgaaggccaggcatggtgactcacgcctgtaatcccagcactttgggaggccgaggtgggaggatcaccagaggtcaggagttcgagaccagcctggccaacatggtgaaaccctttctctactacaactacaaaaattagctgggcgtggtggtaggtgcttctaatctcagttactcgggaggctgaggcaggagaattgcttgaacgtgggaggcggaggttgcagtgagccaaagtagcgccattgcgctccagcctcggcgacgagcaaaactccgtctcaaaaaaaaaaaaaaaaaaaaagaaagaagtgcctttgaagcatccaaattccaatgttgtgtaggtagtgagttatatgggtctggaactcaaaggagggtttggatgggaaacatgtttggaatagccagcctccatgatttgaagttgtagatgtgggtgagactgcttacagagaagtttttctcaacctggactgcactttggaatcactgaactttgacaaataccacccaccccagagattctgattcaattaacctagagtaaagcttgggcattgggcttctaggaactccccagatggtactaatgtgcagtcacggttgagacccactggcctagagagaacctaggctgagactaggagaggaatcaggattgagccttgaacacatatggccaattggagaaggatgagcctgcccaggagattattaagatgtgaccagagaggtggaacaaagactaagtgtggtgtcatagaagtaagtaaaagagtggtcagcagtgtctgttggctactgagaagccagttacagtggaacttagatttggcaacatggacatcattcactaaccttagggggagctgtcagtgggaagcttgaaacatgccaattagatggggttgagaaatgcaaggaaatggagacagctagcgtaggcagcttttaaaggtgtttggggagagagacccagggtgagtctctttaaatggtaaagaaaacttaccttattcaagagttccagaagaaggtggcactagggttgtatattcagtggctcaacaatgtcatcagagacttagatttttccagcctcagtgtgtgacttggtcctcaggctgtcccctcagaatgtaggatggctgctgtaattcagacatctttagcagaagaaggacaactttgtcttatgtcctttaaaaaaaatcttaatacacatgctgaaaagtatacaagtgttaagtgcagctggaattttcagaagtcaaacaactgtaaccagcatgcagatcacaaccccagtaccccagaagttcctcttagtcatgaccctcctcctagtcatgatccatctcctcccccaggagaactaccatcctggcttccagtggttaattttgcctattttagtacaatgtaatgaaataatatactatgtgttcttttatgtttggttttcagcatcgtttttgagatccatattgttgcatgtagttgtaaagtgttcatctattgcatgaatataccacattttatccattctattgttgatgggcatttgggtagcttctcctatttggcttttacaggtagtattgttgtgaacatatgtatttatttctgttgagtgtataattaaggagtggaattgttgggacagagggtatgcttatatgcatttagctttcctgtgtgattgtatcattttgtactcttacagcagcatatgagaatttcagttctgtgccctcaacacttactatttttcatcttttattttagacattctggtgggtgtgtagtggtataccgctgtgattataatttgtattttcataaattgattaaggatgtttcagattttcataaggttattgaccatttggatattctcttttgtgaagtgcctgttgaagtcttttgctatttttttctcttgagtagaatgccctattcatttttaggagtttttcttttgtattctgaatatgagtcattggtcagatatatgtattgcaaatatcttctcacattcagtggcttgccttttcactgttgatgttttcacaaacaagttactaattttaatgtagtacagtttatcagttttttcctctgtgataagctctttttgtgttctgtttatcatctttacccattcaaaggtcaccagattttctatgtttcatctaaaggtttaattgttcaactttgatgtacagatctgcagtccatctggacctggtgtttgtatttagtgtgaggtagtgttcaagattcatatgggccaggtgcggtggctcatgcctgtattcccagcactttgggaggacaaggcaggagaattgcttgagcccaggagtttgagaccatcctgggcaacatagtgggaccgtgtctctacaaaaaaattcaaaaattagccagaaattagctaggcatgatggcatgtgcctatattcccagctactcaggaggctgaggtgggaggagcgcttgagcctgtgatgtcaaggctgtagtgagagggactggcactgcactccagcctgggtgacagagtgagcccttgtttcaaaaaaaagaaaaaagatccatatggatgtccaattgacccagcaccatttattaaaagagtatattttctccatgtaccgcagtatcacctttgtcacgaatcaggtcattatgtgtaagaatccatttctagtttctctgttctattttgttggtcaggttgtctatccttatctagttggtttttttttttttttgtacgtaaccttttagtaggtattgatatctggtagtataagttatctagttttgttcttccttgtaatctctttaagagtgatgaattagcataaatatgaatgtgaaatgatgaaccagcaaatattaatctacgttgaaaaaagaaggtggataagtcagtgagttgggtaccctgaggagataggaacaattgaacaagttaaatgggataagcaaggttatagtgagaggtggatacctgaattagtgattgaacagtttgaagtttgaacagttttgagtttgaacaccctaagttccaggggtgcagtgatgggtggctgagttgggctagaggtggaagtcattgaagataaggaagccaggaaactgatagactgtggtatggatctgttagttcttgataggttatgaaagtacatttaataatgtagtatctaatttaatatctacctcagaacaggtagaacagaattatttacattttacagatgagaaaaatgggcccagagatgttaataactccctaatagccccaagaaaattagtgattaaattagacctaacctgggtcttatggtctagcttccatgctctattcagtgtagcttaactgatgttgtgtgaaagacctggtagtgatacatttggaaagtcttactgacatgcagaaatagtacagaaaaacatacaaataggaatgttattggctgggcatggtggctcacacctgtaatcccagcactttg

SEQ ID NO: 102325 - DNA, 1057 bp, Homo sapiens
tgtccaacaatgatagactgggttaagaaaatatggcacatatacaccatggaatactaagcagccataaaaaatgatgagttcatgtcctttgtagggacatggatgaagctggaaaccatcattctcagcaaactgttgcagggacaaaaaaccaaacaccgcatgttctcactcataggtgggaattgaacaatgagagcacatggacacaggaaggggaacatcacacaccggggcctgttgtgaggtgggaggggagagggatagcattaggagatatacctaatgctaaatgacgagttaatgggtgcagcacagcaacatggcacatgtatacctatgtaacaaacctgcacgttgtgcacatgtaccctaaaacttaaagtataataataataataataataataataaagaaactatttctatttcctagtaattaaaattgtagggatttggtacacagataaaagaatgaaaccaatagtgcagaatagagggcctccacacagaacccactatgtgagtaaatattacaatgtcatattgtctgagtccttcagattggcagaaattaaagaggctgatagtctggtgttggtgggtatgtgtagtaacaggaagccccagtaaactggtgggagtgtgattgcttacaaccaagtcagggagcactataatagactccacagttacttgattctgagtgtgtgtgctctagaaaatttcttgcaaatgtgcacatggtttgatatgcaaggttggtcattgcagcattgttttaatggcacacaactgcaaatacctacatgtctattgataaagcagcagataaatgtggtattttcacttgatcaaagttgttactctgacctgtgtgatctgtccccgtcttgaacacttgttgtttctccaacctcactgctcctgctctgtccctggttcactttatcttggcctcttggcatcctcactgttcctcagacattccaggcccacttccactttgtacttgcccttccctctgcctagaatgcttttccccagagcgttg

SEQ ID NO: 102326 - DNA, 3197 bp, Homo sapiens
agagagatgagcaagagggaatttccacatgtgtgatagagaatgagatagtgaaaagacctttttattgtaattgggtttcagaaactctgagatacctttaatttaagcttcattgaaataacttcagtagggaggtctgaattaagtcttttctcaactaacaggagttacattatgttttatagggttcagggaaaaggatccaataaaaggtgagaaaagtatggagaaaagagaaagaaataaagttctctgcaaatttagtagatttggtttatgatctatcattatttcttatgctagctgtgggttttttaatgcagttatttaaactttgaagtccgtaaatgcttaggggataggatttgaccttgtagcctatctgagagatgcctttgtcttcttatactttaggtgtcaggaagcatggcctataccctttcagcaaaacagagtttaatgaaatgccatatgaattggagtctgagctaagcccaaatagtctgtctaaaaaaactccagaacctttagagccacacggtaccccagagcaggattacttatggtaaacctgcataaacacgtacccacgtaattgtttctggcttcttgtagtgaaaagctgatccttcttaaaagcgttgtttgttttttataatttctcctagattttcactgaatcacagtgttctttgtgaaatgtgtagtgaagaggaaagagctttggaccaggtgtcataaaaatcagggttctttggtttgcctcttaagtaagtgtgatattaggccagtttctagcctctagcctctttcactagtaaatcaccttgccagtagtactgtgcctaaaatgggaatttggtttgggaggagctagaagcagggttggttcagttagcttcaggttttggtactgttagctttgtagattaaaaagtttatacttaatatagaagatttccaaaatatgtaaatggaccagcaaagattttggttctgtagcaaaaaacccttatcattggaattaaatgtaaatccctggtttttggtttcttaaagccaggagctgcacttagagataacaatgaaaagctgagtgaaggggagacggctggatggaagatctagcctgagcacatcccccatctgtctgcactcttcggaggtatcggaaaaccatggcacaggcccatggttccatccagctctaaaaacttctcgatttccaggtgtaggaaaggcgatgacttagagattgttactgccttcaaatatttttaaaacataaagttatttataatgaatgacattttttactttatctggcacaaaattattatattctctgttagcaaaatataacaaaagttgaactctgctgggggtacagaaatttcttaagcaaaaatattgatccttagttattgtgattatttgtgtatttataacttttcacttagctcattaggtaatgttatttcctgaggtattaacattttacatttatttttcattggtagggacctaatctaatattttaagtaatgaatcagttttcaagcaaaacatttttccttacctgttttctttaacttaagcatatttttgagaaaaaattaaatttatctttttggaacagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtatttcacctaagattcttttggttacagtcttaattccctttcaaactttggagggtgggtttcttggattaacagaggaccacaaatcaatcctcagatgatttatccttattttatcatgttatcttggtcatggcacttgagtttttcatttctatctgtgtagagttacatgttatccattaagtaattataaatgatttgtactttttatttgaaacagacagcaaccaaattgttatttattcctctgtagaaaaaaaaatccctttcagaaattttgaataaaataaaagcttttttgaaacaaaattatttaaaaatatttccttcattgctaaagttatttcctaaagaaaagacccttcagtagagctgcttgatgtttccgcaccatttgtgctaattctgcagcgtgctgaatatatatatatataatatatatatatatatattatatatatatatataatgttttttatatatatagcagaaattggctgtgcaggctaggagttgtagattttcattctctccttgttttctctcctaagtctttttgctttctccaatgcctgaaagtcccttagtctacatttttagtgtatgagtctttcctgctttttcttcttcgggttgtacaaagctgagctgaacagctctgtttgaccggcagatgttgttatccatcataacatgattatgtaataagatggtgagctccttgaagacaggtgccacctttgattcagatttacatattgctgtcatcttgtcaatgatcacatgtgatggaatgtcagacaaagtttgtgtaacattttgttgacaccatcctaaaactaaagacatctagaaatgtaaaattgcttagatttacttttcagttttctaaatttgaggtccttactatcagcttaaagtaaatttgaaatcttttaaagtctgtgttgccaatccattgattactatgtgtgtgtgtgtgtgatgacttttataggtcgaacagcaaataaggatccaattaaagccttttatgaaaacaggtaagttaatagcaggtcagtagctgctactactaggaatggctttgctgcatgaatttaagaatcacttatgtttgacgctttaggagctaatagcaaccacagtaaagttggagatggaaggaagagaggtagttttttaagtgtccgtgttatcaggtgacctgtaagttgtcagatttatttcgctgttttagtgaaccatatagatataagctcagtagcctaatcctgtgggaaaagaggggtgaaatgttaattggacattactatgcttggatgggaccagtttggccatgaaactcctggcagcacagagctaggacatagcctgtgccctgtg

SEQ ID NO: 102327 - DNA, 1230 bp, Homo sapiens
ttttctttttctttctttttttttttttgagacagattcttgctctgttgcccaggctggagtgcagtggcatgatctgggctctctgcagcctctgcctcctgggttcaagcaattctcctgcctcagcctcccgagtagctgggattacaggcatgcactaccacaccaggctaatttttgtatttttagcagagacaaggttttgccatgctggccaggctggtctcgaaatcttggcttcaagcaatcctctcgccttggcctcccaaagtgctgggattgcaggtgtgtgccaccacgcccagcctggggtctcttcttataagggcactaatcccattcatgaggggacagcctcatgacctaattcctcccaaaggttccacttcctattaccatcgccttgaggatttggttttcaacatgtgaatcttgtcggggacacagatatccagaccataacagtgctgtaggctaagtctcatttgttttaagttgtgtgtgctcagtgcatgtatttatttacatatctagtaaacacagacaccgcagaacctcattacttggcatcatttggagatgaaggttctggagaagtgaatatttttgtgcttcatttatttctgaatcttaataccaccagagtttgatgaaaatcctctaaagtatattacatgcttccctgccttttaacacggaatttaggaaaatacaggttttcttgatggcttaaggttgtggtcacacataacagtgactgacctcaagcctggtggtgttcctcccaggattcttcaggtgagattgttgattttttagttagtgatcctctcttttcccttgtcttgtttgttgggtggttggtttttctttccatagttttgcttctagcagccatttctattttttgtgacctgcagctccatgttcgctcaggctcagttagttccatagatacagctacttagtattgagcatttccatttggttagcacattagcgtaatgatagggaggggaaactcaggcagttgtcctacctgatgcagttccaacagcatataaaacatctttgaggataaaacttttttttggaagatagcttttaatttcttcatatttctcaggccattactatcatttaattaaataaattctgtccacccttcagcatttacatacaggggaagaaattgaggttccaggattaaggttaagtagttttgtc

SEQ ID NO: 102328 - DNA, 1055 bp, Homo sapiens
ggtcttgaaatcacacaggtttacttagtgcttctgaaatgaactctctactcttgagttcaggccattctatccaaatcgtacttcttcctcaaaaccgaacacaaatgccatatcctcactaacatttttctcagccactccagcttaggtgatttttcccttttgtgagttgtgagagatattactgactatgcaatttatatgtcaataacaacacagtattttcttttcttcataaggatgattgttgtttaactactgaagtgatgtgtcttttcaccccatctgattataaactgagaacaggagttatctcctgtatctctctgtatctatggtagacctaaatcataatgatcactattataattgatctttaataatttaatttattatatatagaaaaatatcatcagtagcttcttttttggcttacccttttgtagttacacccacgtaccacatttctgcttctgttttcttactccaatttatattttaaaaatagttttactctcaggcttgtagatttttatgtacagattttaggaacaaatacttttgtgttcacaggtcagcctccaaaacataaaggaaaacaaaaatctcgaaacaatgaatcagaaaagttcaggtatgttttttctctaaggtatgtttttttccccttaatatactcttcccaagaaaaaggaaaaaaaattgtttttcgagtattagctactttaatgtatgtattatgatgactaccaaaatccctttcaaatatcaaaagcatatctttaggaaaggataatttttggctaaaggattattaatcctggatattaatatattgacttctgaaagtcacataatatgaaatatttccatattaatttcttaaatcccagaatatgtactctaaaaggaaaaagcattaagagagatataaggtgcacatgaagcctccttccctgctcacctcatttgaccctcctgcagtcccttctctaaggcctcctccaggaatacactgttaacagtttcatgactattgggaaacttactct

SEQ ID NO: 102329 - DNA, 1070 bp, Homo sapiens
gttagcagtcatcaatatcaaggcaagaccatccaccaacaaaaagattatgactcactagaaatacccagtgtagatgacggttgatgggtgcagcaaaccactgtggcacgtgttatacctgtgtaacaaacctgcacgttcttctgcacatgtatcccagaacttaaagtataattttaaaaaaagtttaaaaaaagattatgactcagtaaaccctcagatgatcattagcatttgtagcaataaagtcttaaattaaggtgtgtacattgtttaatggacgtaatgctactacacacttaataaactacagtatcgctaaaacataactttaatatgcactgggaaacccacaagtttgtgagactcacttgattgtgatatttgctttattgtgatgctccagagccgagcccacagtatctctgaggtatgcctataatagctaagtaaatgtcttaatctgtcactagtactgcttatatgcaaaataatatgactttaattataaattaatctattatgaatcatgcctcaaggaactctgagacagtgattctgtgttttaaatagcaggataactgctttattggaacaaaaatctcttttctaatttgatttggccaatcatattgattagtgagattttatgacaatcattgattcgtaagattgattagtgagattctattacacttctttttctgttgtgactggatgcaaattgggcagaattatattcagatttttaactgaggcatttttattgacagcaattgaacctggccatgattaactatgttttggtcgtctatggacttgccatttctctccttggaataggacagcctgaggtaagatttgtaacagtggtaataaacaattaaaatgatattgacatatcttataaaaattattttctcatttttacccattttcttctctgtaccttctgataattttgtctgaaatatctcagtttaatttagtttgtgtttttaaagaatatttagtttcctattagaaaaaggctttgccaggcaatcagtgggaatctactttttatt

SEQ ID NO: 102330 - DNA, 1049 bp, Homo sapiens
ttactaatgggctgtttttaagacagagctttcatccgtcttgtgccacaaaagactgtgacaacgtcattggaatggcattccttccaagggattagcacttaataggatctatgttatggtgtgtttacaccataattagccttttttaaaaaacaaaaacaaaaacacgatttgactctttttagtattagccagcacacgccaggcccttagtgcgtactagtaaatgcttataggttgattgtctgatgtgttcagcaggattggtttggttgtgtctctgactatccatatgatcagaaatttatataattcctaagaaagtgaaacacagaggtataattttgccacaggaatttggggatatgcagttgttattttaatattataaaaaaaatcaacctttagataaaatttatttcagtatttctctttgtatgtaagtgatcattgttttcactgctattcaaggaattatctgaagccgaaaaccagtttaagaggattattgaacactaccccagtgagggccttgattgcttggcctactgtggaattggaaaagtatatttgaaaaaaaacaggttagtagaaatgacactactttaagctctaggctggtaactcatttaaaatccaatgtgataatgatccattttctagaattattttgatatctcctctgtagcacactatcataattgtgatttactttgaggacctgaaatttcactatcagtattaattgttaaagcaaggccagtcattgcagttcttggtacttcctgattttaaatctaataagtcaacaatatagtaatttgacattaaagatttaatagtctagtgtataatcatctatagatagtgagtgaattgatataaactaatgtttttaaaatctgattgtttaatttttttgatttaattattttttaaaaatctgtatgaagatggttttaaataagaggtatatatgtgttcaaagacatcatgagtgagttaggaatataaaagtctgtcctctgaactctattgtagttgta

SEQ ID NO: 102331 - DNA, 1028 bp, Homo sapiens
gggctggggtagtgacctgagaaggcaggctggctcattctttttcctcttcaagctaccttaggaggataggaaacaaagtgagattgttacctctgatttgttgcaattctgatctctcataaaatttgagtcccaaatctaaaggtcattgtgatcattgaattagctgttagagacctaaatttgagataagtctggcacttaattgagttatactggtttattcaagaagctagtagctgcccttgtcctgctgttccaatgtccctggttagtaaatcagatgaaataatgtttataaaatatttgatatattttgaagaatgatgcaactttatgctgtggaaataaatatgttagtcaagctctctctgtctttatgtatgttgtagtgagtgagtgtgcagagacatctttaaaacgttaattaaaaaattttttgtaaccctagggttttatacgcatcagctgttgccagtactgtaaaatagaatttcacatgaattgctggaagaagttaaaaactacaacctttaatgataaaattgacaaggtaaagcataacaggattgtctgaatttttcagtatacttattgtatgtcaatttttcccccaagaattccttcctgaacattctgcacataattagaaaattttaaattataactttaataataaagtggaaaatcaaatttgtttttatttggacaatcataaaggcattaaccatagaggctttgtttttttaaagagacggatctcactgtgttgcccaggctagagtgcagtggtgcagtcgtagctcactgcagcctcagactccttgacccaagtgatcctacttcagcctcccaaagtgctgggattataggcatgagccactgcaccaggccccacttgaaagttttgatgtggaattagggatttcaaaaccaaaatttgatgaggtaatttgtactaagaagtcaactcaaaacaatttttttaatgttgggaagaaagatcaacttcaattttaaactgc

SEQ ID NO: 102332 - DNA, 1060 bp, Homo sapiens
agaagtgatttttttttatcatttgtgaccaagaaaaagcaaaagaaaagatgaacagaattatttgttggagagaattcattgtaaccagatcaaccaaattatagtgttgtgggttattattgagatgtgaaaattatattttactatgggacctttcttagaaatgagagtttacatgaattattttgcagagtaatttgtactatttctgtttaccctatgaagtaacttagatacatgaaagtgacatctatacaatctgtagactgcatccttagacatcacctaatcattgaggtttttgttttcatgaaacaagtacccttattttgacaatactgacagtttcttacattgaatggaagatgtaggccgggctctgattaaaaaaggaaaacttctaatatattgcttggaagatggtttctacgatagtcaaaggaaaacagttcattgagttgtcactaattgtaaatgtttatcagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaaggtatgcagaagccaaaggcatgataagaataatatactctcatttaaatgtataaatgtaagcatcttttgggccttatattcatcattattgaattgaaataaagatttcacttagtaatttaatactatcactgtcttctgttactcgaagacagaattgggttggtgtaaagaacactgaaaaacctttcagagattgtattcccactgaaaaacctttcagagattgtattttaactttctgtgcttaatgactaaacatatttattgtatataaagttaaggtagttgatgaggctgggttaggattgttgaaggaagtggccgtattttaggggaactaagttgttttttttttttgttttttttttttgagacggagtctcactctgttgcccaggctggagtgcagtggcgcgatctcggctcactg
